United States Patent 7,868,149 (PLANT GENOME SEQUENCE AND USES THEREOF) - sequence listing, part 112

SEQ ID NO: 61291 - DNA, 22558 bp, Oryza sativa
  unsure (1)..(22558): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctagaacatgccaatcgcgaagccctacaagccgggttgtcatatgtcattaagaaaactaatctccctaggcccttcgtcacctactgaatatgttattaacacggtccaacaggattcaggaacatcagaattttcctctcttttttcttaaacatgaaactaacaaagcaattattggcagcgtgatcggattggcggaaaactcataaactcgagtataaaaacgagccactaagctagtcctctcgagagattggagtacaaggaaagcaatgggaggggtcaatctagcaaagcccacattgacaagtatttctttccagatcagtaccgtccacgcagccgtgacagcaacagaaagacgccatgtcgcgatcctgacatcgtccttgagattcgtgctcccgtgacgtgtcggcatcggagggcccctcgtcggggtcaatgggcggtggggccagaccaccgaccgggatctttttcctggcgcgcagaaccgtttgtttccgccctctcttttttcacaggagcaccggtctctggcttttctctcgacctttttataagcgcgggggttatcggtcgcacgcgtcgcggaatcagaaccaaaccccaccaccacacaaacgcatgcgcgcgcgctcccccgcgcgcgccgcaccggtcgcccactcgcccgcggacgccaagcgatcgtctcgtctcgcactgtttcaccggtcgcccaatcgccaccgcgcccgtacgtctatacagcgtggcaagaggtgcaagttggtgtcaggatcagtttaattacaaggttgtctgatctatatattgctgcagcacggcgggcgcggggtacgtttggctgcaccctgtctcgcggctgatacgtttgcacaggcgttcagatacagccgatacaccggcggcgctagctgcgtttcttctccgcatggacgctccgagcggcgagagcggcggcggcggcggcggcggtggtggcaggaggtggaaggggaagggggtgacgcccatacagccgcggcggcagctggggacggttttggaggactcgtcggcggcattgctgcggccgctcaagaagattgggcggagccccgaccgcctcctccgctccgcatcgtcgctctccacgtcctcgtcggctccgccttcgcctcgctcttcttcggcttccgatgctccagtccgcgtcatctcgtcgtcgccgtcgtcgccctcgccaccgtcggcgcgacacatcttccccttcgcgtacgaggcctccacgacgacggtgggtgggagcccaaggctccacccgctgtcgtggcagcaatccagcatgtcccagcccgcgtcgccacagcaacagcagcagcagccgttgcagcaccagcagatgatatcgttcggcgcgtcgcctccgtgctcgacgacgcagttcgtcgtcccggagaacgcgcagcagcagcagatgctgctgcggtactggagcgaggcgctgaacctgagcccgcgcggtggccccggtggcgtgccaccgtggctgtaccagcagctgctccgggtcccgccaccgccgcagaagctttaccgcggcgtgcggcagaggcactgggggaagtgggtcgcggagatccgcctgccacggaaccgcacgcggctgtggcttggcaccttcgacaccgccgaggacgccgccatggcgtacgaccgcgaggccttcaagctccgcggcgagaacgcgcggctcaactttccggaccggttccttgggaagggccgcgccggcgggaaaggccgcaccagcgtaagctcctcggccgctgccgccgcgtcgtgctcgtcgtcgtcgctatcgccaccggagacacctgacgacgcaaacacgcagcaacaagctcctcagcagcgagaacagcgggacacggcaggagtgtccatggagaagaaacaaccacagcctccagctccaacctctcgtcaagaagggtgctctggcggcgacgcagctgcgccgtacccggccgaaatgcttcacgcgccggcggcgtgcggcggcatgtgggttgctcccgacgagtcatggttcagcacgtggggccctggcagctccttctgggacgactacgacatggacagcgctcgcggcctcttcctccaccctcgcttcaccggtgacgaaactagcatggatcattccggcacgcaagcaaccgtgccggcagtggcagcaacagcggcagggatgagcatgccatgcgatgatgttccggtaacctcttcttcttcagatctccctccccaagggacacctcagactcctaccttcatgtggaaggaggactaagcatgcatgcacacagccacgcacctcgacgagacgactatctcttccatctcccatcgacttcgacgatctctttcattactcatcgacttcaaccacaaaggtatgattagggtagagatgcttgcagattgcagttttaaagacaattttgcagcatcacacagctctacgtacaacagccacacctatatcaattctcaagacttctaaaccacaagggaacccctgttctaggctgcgatttttaggtcagcttgttggggtgaccacagtacaattccctttatttcgtatcttcccaagattgtgtgtgtcagatattcgttgaactcgacttcaaaagatttgaagtattcatgttttcttttactcatgcgatggctttgtcgatctaactaggtattgattcttggggagattaattactacttcagttaatttactagctactagaatatttcatgcatgtatgtgttcaggtgatgattagttttacttatatttaattatcctgtaccctccgttttctggaacatctctggcattccactgtttttgtgtatactctggggaggtgattagtaacttcatactatttgcttctcgagatatttagtgcagatagttcagagcaaacgatgccaaactgttgcgaatcgtgtactaaaggcaagcacattataactctcgtaagttcgagcgagcagagcagccggggagttcttgtcaactacacaactcacaacgtatgtacgtgacagcgtgcgcaactgaatcacacggcaaaataatcaaggcatggcgcaacttgactatggcagcgtcaccacgataggtggccaaccacttatatcagatgcaaccctgcaagtggtagtccgacactccgactgataagaacgtgcgctgccatatgccgccatgtatatgtaaccgtgaacttaacttacgtgcctttagtgctgtacgtgcagggaaacacgcgagtctccgatcgaccaatcgacgacctcagagcatctccaacagtctccccatctcactctccaagctaaattttagctattctagcaaaaaaaaaaaaacgtgctccaacagcctctctaaccctaaaccctatccggctggccaaaacctcccctccactagccaaatttggctagccacaaatcacttgccaatcgtgggccccacacagattctccaccaccccccatctccttcgtctctccagcggtccagccacgactcgacgccgccgccgccgtgcacagccacgatctcaacgccaccgccggcgcagccacgacctcctcgatgcggcgcagaagggcgggccggcggcggagagaacaacggcgcgcgtcttgaacccacgccaaagcgccaccatcgtcgtcgaggtcgccagccgctgtcgccgtcgtctgcaccgtcgccagtcgtcgccatccaccgctggcgtccccgaggttgccgttgccgtcgtttggatccggatatgcccgacctccgttgcctccggcgtgacgtgggttcagggcggcgcggcgtggatgccggaggagggggcaacctctgtcgcgcgggctccgccgcctccgcctacacctccccggcgctgcgagtgcggctcgggagggcggcgaggaggcaggcttcgccctgcacgccatcgccgttgttgaagctggaggtggcggcggcggcgggtcccggatgcgcatgagcaggatggccctcgccttcggcggcaacagcggtggtgggctggacggcgcctgcggcgtctcgcttcgttgtggtggtggcagcggcgccccccggcctgcgtcagccttgagaaggggaaaaaaggagagaggggctgacgtgtgggtcccatggctaaaatagagaggatgaatggagagactgttggagtgaaaggcaaatttgactctctaatttttagatggatgatcaaatgagtatttggagagctcaaaatagccaatctgttagagatgctctcactcacgccgccacgcgagcgctcgttaaattcgtcgtcacccagctgcaggtgtagccgtgtaggagtcccagcaccacgcccgccgcagtctgtgttgtgtgttcctcctgggtgggtggcgatcgagtttgatcggcggcatgccgcatgcctcccacggacatgtgcggttgtgcgcgctgccgtcggtgtccgcggatccaatctgctgatgccgtgccgtgacttgtgaggtagtaggagagtactgtggacatgcatcctggacctggactactggagttctagcggtctactagtggatatgcatgttgccgcagattaggcctagataatcatggcctctgggccctggggtccaaaaaaagctttacgtttagatttgtgaaggacttgataggcccatggtatggaagtggttgaatccttcggaccactttaatgggccgaacagtcaataggcctctccggcgagaatgctaattagcgcagacgtgctaattagatatctccggcccagttagtcgcgtgcggttccagccgacccaccagtgaaaaagaagtcctacttttccaagcaaaaaaaaaaaaaaaacgttgggagcacatgctgacgcgctattggaggaaaaatcgcattccataataaccgtattaattaatcttttctttttttattgcaaatttgaaaattacgtgaaattttaaacatttaatgcagatttgaaaacctttccactcaaaatttgaattttttgaagtcaaaatttgaaaactttcaacttttcatttaaaatttgaaaacttttgatctagatttgaaaacttcaagtcaaatttgaaaactttcaacacaagattgaaaactttcaacttgaaatttaaatttttcgaaatcaaattttgaaaactttccacttttcatctcaaatttgaaaaactttcaactcaaatttaaaactttcaatccatatttgaaaactttcaacccagatttgaaaactttcaagtcaaatttgaaaactttcaattctatatttgtaaagaggtatgcgaaagattgaaaaaaataggaagaaatgaaaaaacgcgtcgagaaaaattacaaaaaaagaaaaaaaaagggcgcgtgggggcccagctgacgcgcgcaccagctaaattgctggcgcgtacgcgcgcgctaggagccccccttctccagagtcctgaacctactccgttgcgtctgttgtctcgtccacgatttcgggggttcacgtgttgtcatcatcgtagaccactcgtgtaacaaatgtatccaaaatctgtctattactaacttataataaattagtagaaaaatgagcctccatgttcactctcacgatatagaaaatcccacattaatcgaaagaaaatatgaaaaaaaaatgaaaatgaaagtgtattaggattaggttgtgtaaacggacaagaaaattttaagtggaaacggacaaggaaaaaaaggaaacaaaagtcaaaggaatgatataaatattgtgcaacagaccaagattctttgaaatccacgtgatacaaaccaaccataattatagtactttgtatggccatcagttatccgttatcaaaatttaaacaatacttacatgccatgtaacaaaatcatactccaagcacaacaaattaattcaaactaacaattagcaccatagaaccttttcaccacagtccgcttcgtcaacattaactagcagaaatcctctcttcgcaatccaattaattcaatcacgccgacaatctttcctttcaattaattttgtcttaataattaattgaaattgtcatattaatcagacaaaagcaaaaagaaatggtgaatagctaatatggtccctgaaatttcgcttcgggctcagtttagtccttgaggtttcaaatcgtccaaattaatcatttgggttaatatagtccttggacccataaaaaataccacgtgaatacgcgaagtcattcttgcatgcagcggtatgaatgaaacgaacattctacccttatataccatatagaaaagaaataaaagacacaaacaaaataataacaggctagcccaagcccaacattgttgcggagggtggccgagaaaggaatttatacgatcagtgcttggctgcagcaatcataagtgacaactctaaaacgatcatacatgtgtgaaatacttgttttctttttttttctttcttttctatatggtatataagggtagaatggtcatttcattcatatcgctgcatgcgaggatgacttgacatgctcacgtgacactttttgagggtccaagtactatattaacccaattgattaatttgaaggatttgtttggacgatttgaaacctcaaaaactaaactgagtccgaaacgaaactgcatgcaccatattagttattcacccaaaaagaaaaaagccaaatcgaaaaataatttaaagtatatgaaattcgaatttagaaaggaaaagaaagagtcaaactagaaatacaaagttcaaaattagaaaataaaataaaggtaaaaaaagaagagttcatgtacaaatacaattttgacaaaaaaaagaggggagtctgtcagtgttacggataaggtataccctttatacttggatatacgttgtatactgatacggtatacccgcgcgtacacgggtagttcctgtatacgttaaggaaatctattacatgatagaaacagaatccacaaatggaaggagtcctactcggacaatactgggtcgttaccatatcgtgaggggtccgatatctccgagtcctacttggagatcaactgacccgcggtataaaagggaccccttgggcagtatcgaagacatcgaatcttaccgccaacatatccaccacagcctacagagtcggagcttataggagccaagtcgccgggtgatctagtcgaaccaactcgactacggtttcgtcggtatcatcgagttccactattccctttgtaatctatggtttccatcatataatcccataccaactggataagggctattacctaccaaggggcctgaaccagtataatccttatcttttgtttgcttgatgtcgtattacgtagatcctcgttccaacgtactccaataccctctatatccggtctacgggtatcccccgtcgacagagtccaaagtgaaatacacttaaaaatttctgaaattaaaaggagaccccaagtggaaatacaatttaagaaaacaagaaatacatatttaaaaaatagtaaaggaaaggaggaagagtccatgtagaaatacagtttttaaaaattttaaattcaaattaaaaacaaatgataaaatagaagattggatttgtaaatacaatttgaatatctgaaatttagaaaataaaaaaactccatatacaacacaatatgggttgataaaatttggaataaaaatataataaagttactcaatttgatttctgtacaacgtcatacctaaattagtcaatcacaaaattttagaataaaataaacagatatgcaaataagtgtccatgcaaaatttatacaataaaaggcctgtcgacgtttgatgtcgcgattttggtatttgcatagtatggggatcgttagtactaggatatatgcgagattgtagtaaaagagatggagacgaggatttttatacaggtttgggcccctgaattgtcaggtaataaccctacatcatgttggccgaagccggtattactcttattcaccataatcacaccagtacaatatttggggtagcttatctaactgttgtcgacatggcggtctgaaggtctgactcgtagtcgacaacagggtagtcttcctcctcgaatccgtgcccggcgagatcagagatagcgctttcgtctctcctgacagtatccggagacaccgtaggggactagtcgtgcttatccctgaagtcgatatccggcgtcttgtcttggcgtatgttgacttgtattggctttgtggctttgtggcgtctatgttgtccgtgtcccctctcctcccagggggccttgtatttatacccataggtgtcctcttatccaagtagaactagggaaaccaatatggatacaatccgagtagtccttgtcgtttccatatagaactctagtcatcattccttatacggaactcctcctatatccgaaggttgtttccgtataacacatggtatgtggtggatcatgttgagatttagtcaactactattaggtatgtggtatctataaccctgacaaggcccaaatttaaatacaacatataaacacccaaagttgtgattgaaataccaaaagataataaagattattggaagacgaatctagactctatataggaatataatttagaaataactaaaatttgatattaaaaataactaataactatcatgtatgtacaatacaatttgaatattccacattactagtttggtaaagtgagtacaaaatttaaaattattgtcattttaatatattttaataataaaataagaaatatatatatatatatatatatatatctattatataagagaaatataagaatgctagccaccatgctagtgttaaagaaaaggggatcagattattgcaaatttgaatacaatttgctagaaaaaaaatcttaatctcaaggatgcatgaaattcggcttctttaaactggttggctcggaggaccaaatgacccttgggatggtcgcaggtcagtgtatacatccacctcgccaatcgccatccacccccaaccttcagctggctcggcaatcggcatctcttatcctcacgtgcgcaccacctgctagatgaaattccccacacggccaccaaccgtgccgatggcacccgccaccgccaccgccgtggcgtccccctccacctcctcccggctcctacaccgcagcctcctctcgccaacacccacggccgctcgctgcctccggccgccgctgtgccgcgggcgcctccgcaccgttcgccaggttgtcgccaacggcgacgtctcctcgccgtcctcggacgtggccgccgaggagtccgcggcggcccccaagatcggcaagcgcgtgcgcgtcacggcgccggtacgcgtccaccacgtctccaaggcgccggacctggacatctgtggcatggagggtgtggtcaagcagtacgtcggcatctggaagggcaaacgcatcacggccaatctccccttcaaggtggagttcgagctcagggtggatgggcaggacaaaccggtccggttcttcgcccaccttcgagaggacgaattcgagctcgtcgaagacgaatagctgaataggtctcttttacagaataatgtgctctcgtcgtctgcagtctgcagatgcagtatctgtatattagaagagaagattgaagagggtgcgaggagatcgcaagtaagttgttgtttgtttacttgtcgcgtgctcttcctcactcttttgtagttctgttaaacaccaacattttgagatttgagaaactgagaacggttcggattatgacaattatgaatgaaagtggttatactgatggttctgttgttggctgtattcagtagtattttttccagttatcttttcaagagaattcgctgcttataagaatatgttactcatcaggatggaaatcaatctctctgactagcgtaaccttttagcatttgattggaatatcggatcgtatttatctattggtctgttcacttgaacatttatcccacagtcccaatttcaattgttatgagcttatttagttgctgcagtaatagcattgagaacttggctcagggttgctagccaactaaactagacatgttaattcttagtagcacaattggtttctcaagacctcggttattgttggtggctcggtttactccacaaactagtaaattaccagtagtgttcaccaggattttaccgtaggcttgtttcgtccctctgcccatcaaatgtggccttgctgagttagccttccatgtttccaattgagttacatggtttgaaatgtattcactgttctggttgaattcccttgaatcttgatctgtcgagtgagagccatgctttaggtttggcctgtgcacatacatatttggacctgaccaaacatagatggcacatgaactggattgtggagggtatttaagctactgtagtttgcctcaactttagaccttgtgattaggtcctgtgtgaaggtaaagtgcacatagttatttatagcacatgttggtggtgattctctccagatatattacaccaggtcattaatgctggaaaacttacttatgtggatatactttctcctcgtcctctacggtgcttgatggagtgcttacttataagcaatagcttgatgaagggactattactttttaagtctataatatggatgatctgaatatattctttgtaggtgataaagggatcttgcatattatcttatccaaggagatgagtgttatattgcagtatatctttcaagtctggtttgatctagaaattagacatttgcttctctatgctttcaggtgctagaaaaatagcgtaagttctttcttttaatttttttctagttcattcacaaagttagtacacatcaccataggttgctaacctgctattgcaccagaattgctgctaacaaattttatgatatgacgctagtctggatgtgatcaagagtgagagtttgtcttggggccttatcgattgccctatggcttatattaattttaagccaaagccaaaattttaattttgaaacttgattttgaaattgactttgatgttttttcaacatagttatttttttcaagtttggcttttaagtcgataagaacatttatacaaaagttttactcacatatcattttttaattgctaataagccgttatgacttataataacccgtaagcaaccgatggggaccttgctgtgagacctttatttttgttgattgggggggggggggggggagattctttttattgtgcaagaaattatcacaactttttttctttaccggtaaatacatgggaaatcctatatgttttcttttcccatttataatgagaatatgcaagggaattatataaagaaaagtaaatcgtcaattttctctatttttttacaaaccttcaacaaggaccaataagtgtttttttaagactatctatcattcatctttaaacggatacttccaattgtgaaaactcattcttaaaagtataaacgaacttttgattttgcatgattgtgacgtgaatcataccttgatgagggtcaaattcaagctgagttcaaccattcctaatgttctttttagtttgcatgctggtggtgatatactgattctgtggaggcaatttactgtgggagatgatagtaacaaattctagagattcaagctgagttcaaccattcctaatgttctttttagtttgcatgctggtggtgatatactgattctgtggaggcaatttactgtgggagatgatagtaacaaattctagaggtctgacataatgttcattcgaaggaaaatattttcttcatttcctttatgttgaacaaaatatattgaaagaagagtaatcaggttttgtccctttatttccgaacagatgtttttgtggttcattggtatggatttctgaaagaacatgcatctgttctggcatgatctatcacatcctgcattatttgttgatcataaggtctcaacttgtggatttggtttccccttctgctggatcctgagtttctgttggaacgtgttcacattctgaaacattgttcatttatcatatttctgttgaaggttacacttcaacatagtaactgacagtatgctgcatttttcttccattctctggatgtatagttaatcaggtcaatatacacgtagaaattagagaaaaatctttatttatcgttgcataatggaaattaatgcttacattaccacatggaacttggtcattctctgaatcgacggaattgcatcagatattccaaaaggtcttatctgaacaaagctttcttcttttattttacactatcgcactatattaatatgctttggtcatgagactgtcttccaaatgaggcatgtgatatgtcttttattcgttttaggcgctcgtacaaattacaatcatgtgttccatgtctcccattaatacgtaggaatgtaggattatgttgacagttgtgatcatcaaaagttgggtgtgatgagggtagagaatgagacatgaggtagcagtgcattgtacttctagcgggtaagcgttttgtttactttgctagatcctgttttcgttcagcttttcagcttttgtgaatgcgccaactttgtacagtaaacgtcagcttgggttctgctgaaaactttggattctattattacgaagtgaaagaaagttggtgatttatctctcaggccatcaccaatgtggtgcttcggaccgtgcccctagcgacagctgttcgcttttccgtcggcgtcgtctccttgcgatggaacgcgtcgctctggtaggggacgcggctctctccgcgcctcaccagcttttcatgggagacgcagccaggcgccacgctgagcgcgtatggagctcgtgggtacggcatcgtccccccaaatttccccttgcaccctcgcctcactctcgctctcccctcggtctcgtcgtgtcgcgcccgacatcgccggtgccacgtccaccaccgccgggaccgccaccgtcgatgcattgctgatggccttagagagagagagagagagaagaaagaggcgatggcgacgacgacgacggatccacgacggcgatgaccagatatggccaccgagcgccgcagcagccgtcggccactagccggcgacgggcggagacggcttcgaggagcccgtgctcaccgcctcgcgcgccttgcccggcctcctccgccggcgccttgcccgtcctcgccggcgctgcggggggcccagatccgcccactacggcgccggatctggcgcccccgaccggccacagcgcgaggcggaggatgccggggaggacgccgatgggatagagggagagagaggggcgacggtggatgcccgcaacgggagaggtggccctcctcgtcgtcctcgccgacgctcccgtggcgccccgtgacgccgctccccgggtccgacgaggccaaggaccgcgccatcgccgagcaaggggatgtggggcacgcctcgcatctccggtgagcagcggcgcgctggatctagcgcggtgtggcgtgagatcggagggggggcgtgggtctggcgacagcgggagcacggagcggcggtggaaaaacgggagaaggggtagagacgggcgacaggcagaggagagtggcgagcggcggcagtgcgagggagagtgagagagagagacgagcggcggaggggaggaggcgagcacgcgtggaggcagaggggaggaggcgcgccggtaaatgaggggaagagagagagggggggagaagagaggggtagtatagtaaaatacctacatgggctctttgggttagggacactcgttgggctactagtggtatcctctattgtaaggggagtttcccagagagcgccctcagtaagtgagggcacctatagagtgtccctgattgtagatgccctcagcccattcgatgtgttggaaaataatgctatgcaatcgactttcgagtgcccttctacagttgtactcacctgacgtgaatggtccacttgcgagttaacccttgatgcatggttgatggccgttgccgttagagcaatcctaacccaggaactatgaagtcggagccattgtttcgacatatttgcaaatgaaaaataatttgtgaataaaatttttatatacgtgttattagcgatctaaaagcaaatgctgaaaaataaacttcgatgaaaataccataaaatcagcttcaattttaaagttgaaaatttaaattttggcgcataagcataagcataagtgaaaagatgagaccatatagcttcttcgtttgccccagttcacatgtgagagttgctagtaggcatggtaatgaaatgttcagatgcacgtactccctccgtctaaaaaaaataaatctaggataagatatgacacattctagtacaataaatctgggctaaggtcacatacaatactaggtttgttttttatgggaatgaggaagcactgcgtgagctgaagttttatccggctggttggaggaggtaagcgtacttgaaattcagtgggatactccaatccggtcaaattgataagagaatgtcaacgaatcaagggtgacggaatcgtcttctaccccaggaactgaaacatcagctgcgaattcccatcacgtgaaaaactgagatgctctccaaacaaagctcggcgagtcgctccaagccaccaatggtttgcttgtttgcaagcgacgaatgtactgtacaggattacaacggtcgacccattcaagttcaaaataatacaaagaactagctgggtagcccacgcaattatgcggctagcagaaaaaaatcatatattttttaagtataattttacttaaaatttattaaagagctatctcaatgttaagactttgaaagaccaaaccttatcatcctcgtgtttctaattacatagtttttaaaatcacaccagttgctacctcttatgtcatctccttctttatttgcttgctcgatctatcactatttctatttattattcttagagcctttaaaaattggattttatagtttttagagtttattgtcacgtttgggtttcgtttttataatttctagatgtcccgtcaaacgttgccattatactcctgtccactatctcttctctttattgttattgagattttaaaaatcgaacataattatagtttgggttcatttttactttctagaagttccgccataccgtcagcggttttgccattatgctcctctacggctcgcccgctgcctcccttctttattgtcattgagattttaaaatcgaacatgattattattggtttttttttttactttttagaagttccgaacctttaaaaattggacttttagttttattttttataatttttagaagtcccatcaaacgatgccactatgcccctctgcagccctcgtctgccgcctactcttaccccgcccgctgcttctccttttcattgtcattaagattttaaaaatcgaaaataattatcaatgtggttttttttctttttactttctagaagtcccagcaaccgctttacttgtttgtttcacgtcctacctgacgtccctccttttaatcgtcattaggattctatttagtgtttcattaacaatttttatatgccatatcaaccgccaccaactctacttatttataggcctgttacttaatttatttcgtcgtgtgttttagatggtcttttttttcaatagtctttatttttatcactaattttagttatttataaattttattcctaattgaaatctttttttttctaatttcagaatttattttttctaaaaaaattagttaataccatattgtgttcttttaatgtttttatttcttattttcaacttcagttgtttcaaaattgtatttatacttgaactctcttttagtttttctaattttggatattattatatttttatttgaaattttaattaatctcgtattgggtccttatatggattcttctttcaatattgcttatttttaattcggaattttaattaattttaaattgtattcctacttgaactcttctttattttcttttgccttaatttcggatttatttttctttttattccaaattttaattaatctcatattgagttcttatatggactgttcttttaatattcattatttttaattccgaatttcagctatttttaaattgtattcctacttggactcgtgtttccttttctaattttggcttttaatttatttttatttcgaattttgattaatctcgtattgggtttttatatggaaacttctttcaatattgctaatttttaattccgaattttagctatttttaaattgtatttctacttgggataaatctcgtattgagtttttatatggaaacttctttcaatattgcttattttttaatttcgaatttcagctatttttagattgtatttctattggactctccttttcttttttttcttttttccgattaatgtgggaatttctagccctcacagcgaacgtggtgtctccttttaaagttattttaataatataatagatataatagttagatagatagatagatgcgagatggtccatcggcatctatctatcacccggccttctctcagaacagtgaagtaccccagtagagtatatactatcatacggcatcgtatcttattacggcttgatacaggactcaattttgaatccactcaatagctgatacagtactcctactagctggttgaacggtaggactacacacacagtacagtgtgcttccttccagatgcatcaacgcgtgcctctgccaccttgggaccagacagctgagtaattatggtgtattttgcagtaaagaactcctttttgggaaattatcagcacaaatccctgggattagtatggacccaaattctccctgggggagtagatgacgagaaccgtagctactgtaaatttggaggtagcacttgtaacttcaagcttgttgagtgagttgtactgttactgttactgttactgttactgtacgccgtgccaaagcatactctgtcaccccaacggctttctcctgtggagcacgcgcgtcgtgcgccgctgcggccgcgcacgaaccccgacgacgcaacagaaaaatttgaaatccacccacccctcccccctcccccctccctcctccgtccaccgcagctggcttcaccttttcctcggttgctacagacgccacggttcaaaacacactctccaacgcacaaaaaaccctcccctaatcatccacgcctcaccggagccaaacaccgccaccacccatgggtctctgtttcagcaagaagcagcaagtgaggcggcggcgagaggagcagcagcagccgccgtgccatgaggccaggaaggccggcggcggcaagaaagctggtgctaaggaggtcgcgatagtcccggaggcggccaagaaggcgccgccgcccaggaaggctgttcccaaggcggaggagccggcggccgacaagaggacggtgttcgtcgtcaaggcggccgcggccgcggctgctgccgaggtcgccgcctcggcgagcggcgaggcggcggatgaggaggcgaagaggcccgccccggaggaggaggaggcgaagcccgtcgtcgtcagcagggtgccggtgcggacctcgagctgcaccaaggaagaggtggacgccatcctgatccagtgcggccggctcagccggagctcgtcgtcgtcggggaaggtggcgtcgggtgagggcggcggcgggcaccggaggtactctggatctaagaggagctacgatttcgaccgcaagaggaggggcggcgcggcggcggcgtggacgacgactgcgactgggagaggcagggcgccgccgtgtccaggccgtcgccgcgccggaggacgccggagcggaagcggtcggggagccacgagaggagcggcggaagtggaagcagcagagtgagccgttcgccagggaggcgcgcggacagcgtccccgcgacggcgagcggcgagcgggcctcgcggcagcagccggggaagatggtgtcggtcccggccagggagaaggggcgggcgccgtcgcccgtgccggccgcgtccgggaagaggtacccgtcgcccaggtccaactccccggcgagggcgggggccgcgggtaatgagaacgccgccgcgcagctggcgcacgggccgtctctgagccggagctcgtcgcggaaggccgagcactcgccgtaccgtcgcaaccccatggcggagctcgacgagaacacgctcggcaaccaccacagttgcaacaacaatggcaggccccaaaaggtaacagacgcatgaaagcttcacacttcagttcacccaatctgagccatcatttctcctcgccgaattactcaaaccatcgaaatgcattgcagaaacctacggagagtggcggcgccctgccgcagaaggtggcggagtgggctaaagatcaggtagccgcaagccggacggcggcgaaggagaagcaggagatcgtggaggtgcccgtggcatcatcagacaccaaaggggggaattccgggaggatgaaggcgacgcactcggtgagcattgtggccgagagcgtcgtcaaccagaagggccggtcgtcgaggagatcttcccacgacttcgacaacaatggcaactcgtacgcatccctgctcctcgaggacatccagaactaccaccagcagagcaccggctccgccgccgccccggcgccagcgttctcgctcccggcctgcgtgtccaaggcctgctccatcctcgaggcggtcgcggacctcaactcctcgtcgtcggagaacaagagcttcgagctggaccggtcggccaacgacaagtgctcggcaaacgggaggtacggcgacggcaaggtcgccggcggcggcacgctcgtcgtcgagtcggaggttgttgtgaaggacgacctgatggagccgagcctgcacaagtacgtctccgtgcgtgacatccgaggcgaggcggagccgcaggaatccgccgggagcaacagctttgccggcaacgcgtggacgccctcgtgggagcccagttccgtcgattccaccgaccggacatggacagcgtcgcagtccaacaacggcgacgaggtggagcagctcagcagcggcgcggtcagcccactggagctgtcgtggcagggcaagcagaagctcccgtcgcaggagccaagtggtggtggccgttcgcgggtgggtccaactggcaatgctcaacgcggacgcagcgctcatcgtggcggcggaggcgctgtcaatgcgcgatccgatgttcgtgctgctccggtgagctcatcgattgcttaacaatgtcaggtggagattgtagtcaggttctcatctttgtaggggcaagataggttgccgtttcagctttgagtttgcgttctttctggtgatgatacattgtttaggatgtaaccatggcggtgacatttgcaatgtatactttgttgttcatttcgctgagctttggtgatcgatttcattatgatttggtgatcggtggttgatctcctgataattttattgatctttggatgaatttcttgtcaggaatagaatgctgtaatttctgatgctgatttgcagagtactatgcatgactgctagggctgctgtaaccattttggtactgcgacagccatgaggaacgcatcagttatccagttactccagtcagttcgagttgggctgacagatcagtcctgaattcagttctcaatgaaaaccatctcagtgtttagacgtatgtatgcagcatcaaatgtagatgagaaaaaaccaattgcacaatccaactgtaaaattgcgagacgaatcttttgggcgtaattacaccatgatttgacaatatagtgttacagtaaacatttgctaatgacggattaattaggctcaaaaggttcatctcatagtttacaggcggaatctgtactttgttttgttatatacttcaaatatgtatccgtatacttaaaaaaaatttggcacacgaactaagcgcagccttagtttacatttcctcatagctacagacgaaaatcaaatgtaaattcaaggaaggaaataaaaaattggcggtcctaattgctatacgaatttgtcaatttggatttgactatctggtgacatgctaccatgaaatttgcaccaggttccagcccaaggggatgtggcttctctattccgatccatgtcccgtagtcaatcaacggtagatgtcatctgtggtgggtcacacacgtcatattcgtcttctcgattggttttctcatctcgttgttcatacatcatactacatccttattattgcctcctctctctcatgccgttaaacatggagggatcaatcaaatcaaaatagaataactgtgtaaaaaccatcgttcaaacatagttttatgtgatttgacgaccaaaacatgttgtttaaagcggagtagagattactgaaaccaatctggaatcgattttgctaggaatctgtcgggtgattttttttgttgctatttcccgtttttgttgccgttggatctgcgccgagatttgtgccaggaatggggtggacgtggtcatacgtggatagggcctcgcgttggattccctggcctgattactttgcactatgcaaatttcgatttccgcgcttgtccgtagccgttttttatttcccctcgctgatcccgctctctcctcgcatttctctctctcgctttccccttttcttctcttctcttctcgttttctccgcgaggcgagagagagatctcgtcggagtgagtgcttgctggagaggtttgtctcgtcggtgtaagtgctcgccggagaggactgtcttgtcggtgtgcgtgctcaccggagaggttggtcgctggcgagatttagtgtttagattttttttgttcgatttgattcagtccaggtccgattcaaattgtgttcgggttcaatctcggttttagttgttttttttgttcgatttgattcagtgtaggtccgatttgctcaccagaaaggttggtcgctggcaagatttagtgtctagatttttttttgttcgatttcattcagtctaggtccgattcaaattgtgttcgggttcaatctcggttttagttgtttttgttcgatttgattcagtgtaggtccgattcaaattgtgttagggttcaatctcggctttagttgtttttgaatcgatgtaatacgatggagagctcgccggagacgttggttgccgtagttttgtttagtttgtctcatcatttttgtgtggcatccaatgttttttggtcggtgaaatcgtgatgctgctgctgcttcgccaagttgcgcttccaggtttggagatttgttcttcctgggctgtgggaagcgttcacggaatggatctgagattttgttgtttttgttgctgcaaagcgttgcttttgagttggggaatggttgtttagcccgcggattcgggggttttaggggaggcttttgattttaggggtgctttttgcttagcaaatccagtttctgtttttgtgcttgttgatgtgtgatttagtggcaaattctaggcgtgaagcaatttttcagaatcatgacatggctttttgttatgtttgtattagtgaatttttttactgaattactgaatttggtagccagcaaatacatgatgtgttcattactttgtaaagcttcacagtgattatattttttatgtcaatgtaaatggatctggatgttgtacttgtgctaaagtgaagtttctacatgattgtgttttttatgtatgatttttgttgtaaagtgaagtttgtattgtttgttcattttaactcatgtccaagctgatgtttatttattgttctttcagatgcctcgtgtccaaacatcaaggttgggtaaaaatcccattgaagttgattctgatggaggtgaagattttcatgttgattatgaagttggtaatgatgtaagttatattttaaatttttattattgtattatgctgtttaagtttacctttaatttggtattacattatttttcttttttttaggttgatgaaggtcctgaacatggtgaaattgatggtttactctctgttgtgctcaggaaaatggtatgtgaatattttttttgttgagttgtgttaatttaattttat

SEQ ID NO: 61292 - DNA, 3753 bp, Oryza sativa
gttagttatgttgaagatgtgagtatttttcaagttgtagttgtgactatacagattcgtatctattctctcaacacagttcagtacagccaacgttgttgagttttttgttttttcttctctcgttgtttggcactaataccttctttgttttctttcacatatcctgcacctaagtatccttggtagctttcatgcatgcaacgtcatattcatgtttcccatgtaactaattcaatctagtattatgcaaacatagccaccataacacgtgttatggatatgttttttttgtgtgtcattgtgtctaattttttctcaagtatatctgttttgatgtgtaatttgtgttagtttgcttggattagttttctcaagtgttttttttgttctacacgcagcagcttttaatatgatatgagcttaaactttttttcggggttgtgcaggtttgtaaggttgcaaaataatagtctagtagtgatggtttctgcacttatagcttagttcaggtttccaaaattttacagacaatttctactaaaattacagtacacttacatgctatatgcattgaatttacaattgtaattttaatttcaaatcactgtaatttctacttctagtgtttgattttgcatatgtatggcagcatggatggtgctattaagattgggtgctatctcaagtatatctgttttgatgtgtgattttgtgttagtttgcttggattagtttcctactagtaaggtttcagatatattatgattttaaatgttaggctatacagccgggaccaaattttatatgtttctgttcatgagtgtatatggttgcctcttaggctttatatggttaccccctcactccctacctccctatgatttcttttgtttttattcatgctaatgtactgttctggtatatgtaattgtaattattatttctttctcttttagcttttaaatattataatttagtaaataagtttttaacacacttctacacttgttttttaggataaaaaaaaatctaaagttcattcgaagactgagccctcatatagcagattctcaacaaaatatttctcaacagttctatcttctttatctcctgatcagaagcgtattattggtgactatggttttaattctttgctgatgtttgacaatgcttatgtcccaaacaaatttgcttcttggattgcaaatcatgttgatgtgaagtcttctcaaattgttttaaaagataaagtcattgcaattaataaagaatgtgttcatcatattttgggtctgcctattggtggtatggagttcccaactgattgtgatgctggaaagtcttttattctttcaaagtttggcaagagcgctcttccatctgtgagattctttggtgataagttcatctgaaaggaaactctctctgatgatgaagttattacttcatttttgattgttgcaatggcttgttttctttgtccaaactcttctttggtccctagcaccaagtatttgactgtgtttgagaatgttgatgagcttcggtcatatgattggtcaaaatttgtgtacgaatggatgatgacttccatcaaaaagatccaaaagtttagtaccttgggtggatgctggtttctctgggcagtaagttattaatttttttttccattctctttgttccatattattattgttatttaattaatttttctttgctttttcatattttattttgctaggtgctttatctggattatgttgagtttggtgacaagaatgttcctattggcaagaatgttcctattggttttcctagaatttctcactggaagaataatatgattactttgtattctaaccttgacaaagttgatgaaaaaactttggccttagacccattaaggatttcaatgatacaacttatttcaaggtacatgttcagttcaattagttttatttatttttacttgtgtttttcttttcataaattaattcttatcattcattcatctttacaacctaaaattttccttgttttaggttgtaccccctgaaaatagaattaatacattcagagataaattggagtctgctattggaaccatgttacctgctttcattaaggagaaaatttgttcaatggttgttagtcattgttctgccaatcacattgttgacagtgagtcttgtgaagatattgctatcagcattatgctcttgctatgtgaacatgctggttctagatatggtggtgatcctgatgaaaacttaatttttgatgatatcaaccctgggtttcagcctaactatgcaattgatgttgaaaatgaaatcccttgtgatgctcataacaatggaagtaagttttcttctatgttcttttaattttattatattttttaatttttcttctatttatatattctttgatgttttatttttttaggtaccaataaatctgttgctagtaaagctaatgaaacaagttttcgccatacaccttctcatgataaggaattgggggtatgtgtctgcttcttatgattataatttatttttttagcttaagttttctaactttatgttcttgtttaggtaaatgatgattctgttattgtctctaaatctgctgttagattttccctttcaccaaactttgaaaaaggtacttggtgatgcattgttaattttttattttcttaagtttgcgttgctgttaattttttatttttgctcagatcaaggcttactaacccctgaagttggatatgctaataactccaattcacgatttgaacattttcgatctggtttgtgatttttctttgctagattttatcttaaattttctatttaaaaatttgtaaattctgttagttcttatcatagttattttgccagcttcaggtcctactgtatctgctgttgctgctgttaggaatgttgcaaataaaattaaatcaagattatctcaactcaacaatgatgacaaaagaggaccattgttccctgatttaattgattcttgtgaagatgaagctgttggttatgctaagtcactttcatgtcaaaaggaatatcttaaccctcgatatgtcacttcctcttcatcacaggtattccttttttattggcttgtgtcttttcttttttaaaaaattcttgaatagattttgtgatgtcatgtttctgtatgctttattttttgactttctcttatttttttatttgttgtagcctggtatatctttacactgtcttgacaattcacctgttcaagtaattggtataaataataatgaaggaacacgcagaactcattgtattcagaatgtgaagaagaggcgttttgatgatgttattgtatgttcttattcttgttgactatatttatatattgtcctaagttacttttttttctataattatttgtttctgcttttttttttagaattctcctgatgtggaatattttggtcattctacatttcctgattgctgcaaggtgttgtgtacccagactgataatttgtataatgccaagaacatgttgaaaagtaacaacctggatttgagttctaccggtggaaaattacctccccatggccctagaagagtcttagttccttctcggaaattttcagatccttatgttctttctgttagacgccgatttctagtgtcagatcaagaaaagagacattacaatgcaatatgcaagttgtccgagagctctaaatggcatagg

SEQ ID NO: 61293 - DNA, 2179 bp, Oryza sativa
  unsure (1)..(2179): unsure at all n locations
gaacattggttcctttttgttgttgatataaaggacagaatgttggtcctcttagattctttacatgaaaaaggtgatccctattttgaagacattgaatgcttactggtatgatattttaattttaaatgcgttttcattcagtttttttcttcttgtttttttgtagttgattgattttttttattttgtattcagatcaataatttacagacattctgggattcttattatggctcttcaattgattttactactttgaagaaagtttacccttgtgttccaaaacagagatcttggtatattttttgtgtttaatcttttctgttcaaataattggagcattgcaaaatacgttatttcaggaatgtgcagagtcacgcttgtattacattacttatttgttgatgtccaaattctcaatacttctttattttggccaatgttttctaattttctaaatatcattaattgtcctctcattggggcattgtagaatgttcttgcttcatttgttaactagtgaaattaccatgtaattctgtgagctagatatttttttattctgtgtatgctatgctcacacttttgctgtgtattttaatttgtgatattactgtggtgagtagtttgtgtttacattttgtgatattactgtgctgcatatatttttatatttttttgcgtattgcatatattcttaggatgttagtaataacacttgcccaatttttaacatactaataataataataataataataataataataataataataataataataataataataataataataataataataataataataataataataatacaagaaacaagaaaaaatgccattgtggtacaactaaattcaacaatatcatgaacagtactacctaggttttatttctttgttttttgtaatttaaagagttgtttcaatttttttttgtagctttgattctggaatttttgttatgaagtgtatggaattgtggtcaccaagggttgttctaccaaatgaattttcttcagatgatattgacaatattcggatgttgtatgcaaatcagttattcttccatccaacgaataaaatgctgcagactgaagttgaagaagttgtgctcaattggtttaatcctgtaagtgtgtttttatttttttttcctattcttgttttttgatacatttttagttatgaaaaaaatgtttttcattttttatttgtatgctcaatttgttggtgaaggctgaaatttttcagaaagatagttgctatgaaaattggtttaatcttgtaagtgtcttttattttttgccattcttgttttttggattctttcatagttttgaaaatattatttttgttcgtcattnnnnatcaatttgctggtgaaggctgaatttgtacagaagattagtcgctatataaaactgtagtgtgtgctagcatagtggaatgtataggatcatagtgaatgcatttttgcagtgccattacatattcctgtagtgaatacagatgttcacttacatcaaatacttttagtatgaatacacatatatagtgtgtgtagtgcagtaatacagtgaaaaacattaaggtctaatactttcagtctcaaaatttgacatccttgttttctgtcttctaatttgatttgttcttttttgtgcttccttgatctttaggtagcttgcttcctttgtcattttcttcatgtttcttcttcctagcgggcattgcttgcttctctattgtccctgcaatacaaaaatttatatccattagcttgatttttttgcttgcccatgtttgtaatattttacatattattcatttcttttacttgttgttgtagacttctgtattttctttgtacttcttgcaatttgcatcagcgggcaattttctattgtgtgacttgttcttccacatcttgtacaatgtttttttggctgttcttttatcttctctaccatcccttttgttcttgctgattttttcccctttgtgttagctatgtcagggtcttgaatatcttcttgctcatttgttgtttctttttctgcttgatcctcacttgtgttttccaccgtgttgctttcatcaattgatgcttgattttgagctgcatcttcaattatcaagtcaaggttgctatccag

SEQ ID NO: 61294 - DNA, 1158 bp, Oryza sativa
tctttggagaactttgcacatatgcacacgaagttttcttgtggtaagtctgtcatcacaacatatcttcttggtctgaattcttgttgtttcagatttggcgctgcatatacttcatatgcttttccttgttgtatagctgccacttctagatttagtgttcccttcaattcatcttgaaacttatcaaatatcccatggttgtataggtctgctgcttgttcttctatcatgtaatttgaccaaaaagactttggcttcttgtttctggattcataatctttcccatactcagtgtcgaagatgatgtcattgattgtttcatattccagtagaaaagtcatgacactatgtgttgggccaactccccttttaaaccttgcatttgtgccctcactaagtgctgtgctatgtataaatgggcaaaaatctgttttggaatacaccggtataaaattcttccttgttctccacattatttccagatatttgatatttttcaagttgtactgtgcaatcatttgcaaccataggctttcaaattcagctcttgtcaagctattgtgcacaatgtcattaaattctgcatagagatctttccttctcttgtctgaaaatgtatttcctgacctttctctacatttcttcaaaatgtggaacaaacaatttctatgtttgctgtttggaaatacttgacgtatagctgccctcattgccaagtcttgatctgttataattgtttctggatgttttcctcccatggctgttaggaacgtttcaaaaacccatttgaaagtttctgtagtttcatctcctaaaaatgcacatgcaaaaatgcatatgtttccatggcctgtaacaccaactattggagcaaatggcatattatatctgttagttttgtaagttgtgtcgaaactcacaaattcaccatattgctcatagagttgtgttgacctcccatcagtccagaacatgctcttaactttgttattctcatctagagtcagcttgtaatagtagccaggatcttttgcttctttttgccttagatattccatcacttgattcatgtcagtatttcttgtctctgagttaattgctgttccaacattgctgacgtcttttccggtatatggcagtgctgctatgcctcct

SEQ ID NO: 61295 - DNA, 1313 bp, Oryza sativa
  unsure (1)..(1313): unsure at all n locations
agtgcaaaatagcttaagtctaaacaatttgaagtcaatattttagctaaaatcacctcagcanaaagggtgggtgatgtatgnnttgttagttgtaaaattnctgatcaaattcttcatagctccagtgtgtagttgatatgtgttgctcatatgtcatatcctgctgctcttctagttctggagaaaatctactggttgttaagatcattgaattctgcaatatcaaaaaacagtagttagtactgatttaaatgactaattagggaattgttacataagtattcataattttttattcttacatcaaatgctggtgtccgaagtagacttgtaaagctttcttgtcctccctgcatattcatagtttacatatcaattcatttattattttctcttttttttgtcaggtatataatgtaagttgatatgcttactgtttgttgctgtatggtgacagttggactatgaattatttggtgtatgaggttagtgtagctcaactgtccttcctgcacagttatatgtttattagtttataactgcatgtataaaatagttttatatgctacatctatgctttttgattagtgtacctgtcttgggtctaagtttagcaatgtgaattgatcatatagcatttgtcctccataattgacaacttctgatgcaattgttcctatggtattgcttaattctggtgaattgaagttttttcctacgtgttgtattttcctgcatcctgcattttgaaaaagataaagatcagaatattagatcagtgtatgttgcaattgttttgttggagcttgtcgacttggtagtttagaaacttagttagtacctaaatggggcattttgctgctgcttccttcaccctcttgcaaattgtagatattaggacttcttgcatatgccagcctccctgtaaaatttatataaatcattagagcatatgttagaatcaacaaacataattgtagttacctttatttattcttagagcaaaatttattcaaatatattttctgacctggagccatgttgatgtttcttttgcttccttcaatctgcattgcatcatttttgctctcctctgattgttgtctaattgtttctccttcttgtattgcttcacgacctgtgccatgggagaaatgaagtatatgaggtactgatttgttaaataggtatgtcttttgagaatcatttgtattttttagcatgtattgagctttaacagtatatgttcagtgtggcatttgcatgttttatgtcaaacatgaatatatttttcaaatacattgtggttg

SEQ ID NO: 61296 - DNA, 6248 bp, Oryza sativa
tcactgtaatttctacttccagtgtttgattttgcatatgtatggcagcatggatagtgctatttaagattgggtgctatgttaatgtgttttgagtgtttaacccttttctagttttgataacaatggtgtgaaagtagtagtgtttaacccttaatgtattttttaatattttgcatccttcaccctgcagctgaacattttcctgtgattttttttcaaagttgtactatgatattttttttaaatttctacatgatgttcagatcaacatagtatgtgatttttttaaaagaaaatacctaattgtagtttttccttgtttgtctccccagattccttgttctacctgatgctaattttgacaggatctgcatatgacttcatttctgcaaaattttattgaatgtattagaatacagcaatacatcatagagtaatacattataacttacacaacaaatgtataaaaattacagtacacttacatacacaatgacctgaatttacaaatgtaattttagttatgtaggacagtaatttttgtattccatgtgtatcatctagtcatgttgatctaatgaatctatcctgatctagagatatagatttgatgtgcataaatgattctcaatgatgatgtaactgttgcataatgtatatatacttgtagttgtattagttaaataagtactaaaatattgtggatcgggctctgcatgtactaagattgtttatatggcagatcgagtcatcacacatttccaagatattgagtaccctagattgtttactatgatgttcttggagtgatattcttttaatcctagatttgatttgaatggattattggaaggtactgctcctatataattcctgaatgttctatataagagtattaaatgtgatctatggtctatattctaagccaaatatatagagaactatgaatctattttgctagttccaaattggaaatcactaaaattttatccagccatttgtcttaaatgagtgaatacctagtattgaggagtgaaatatgcaggtgttctgtatgacagattactaatcaagcatcattttatcaattacacttcaataatgcaaaaaattatgttacccaaatttacagtgcaattgtactaaaattacagtgcacttacatgccatatgtactgtttttacaaatgtaattttagtgcaaatgcaatgtaaatttctacttttgagcatatatgaatgtgaaattggtttggtgggttgttttttagtttctgaacttgtttttcattatttatcccttgtgcatatatttgtttttcatatggattgtgcctataccaattggtttgtaactgaagtttactgtggaacatgtcctaattcatgcttgtgttctcttaattttagtttggttctgactccatggatctcaactatcctatccagcatcaagaccaaacccagcagccatcatgcaggttagttgtctctaacccatatcaccatactactcactattgtggttttattttcttttttgtgctgcccaactgatacatatatgttttggaatatatgatgtatttggtgctggaactcctgagttcatgtttgaatagatgtattcaatttttaggtagtaaacaacagaagttgttctgtatggtctacttgtttgattgattgataattttacagtgcatttgtactaaacttacagtgcacttacatgtcatatatactgtttttacaaatgtaattttagtgcaaatgcactgtaagttttactttcagtgtatgaactgtgccctgtattttgttcaaaacactccttatgcatatgggatgggggcacgtatggtgctatgatctaagatttgtagacaattttgaggatgagcacaggtttatggaacatacctaatttggatttcttccttatttcctgtttctcccctgtgatttcactttgatttgaagaattttgctttggttcaaccttttttctcttctttctctcctactcgttctccatggtgtgcgtggtgttgcttttttggatctggtgtgttaatttggatttgtgtttgtcctttttcttttagctttcttggcagccaagttgatgcttttggacagggttgactttacttctttgggcctctcagatatgttctttgtttgatttatttttctaatttgttgtttgggccagattgcagcccatgttttatctgtttttttagtgtgttggcccagtcatttttggccttttttggctgtctgttcggtttttttttaactctattggatgaaaatctaagggcaaggaaaaatctggatgatttttgagaaaaaatcacccgacagatgcataggtggttccatctggaatcatttttcttcccgagttgctttgccgttgtgtactttcagcggctttggttcgtgttcctcgctgaaacgatagacaaaaatcactcacaaagtaaagcgcccaacagaaatcactcaggattgcaagagattggaggggagaatgaaatctccattttcgttttcgatggagatgattcctccaatatttattctctgacatgtaccaagtaccatggcctgtaaagaagggagaagatgaaaggaaaaggctgcgggtgattaggaccaaaaccatagcccatgtcagccgcatccgacccaaagggcctaaatttccgataggccgagaccatagcccatgtttctctctagaaggaagacggcccattacatctaggcccaagcgaggcgtgacaaagaaggacccgaactgcggaactgctgctacacatcaacggatcaacccttgtccttcactcgcgaagtcccctcgaactcccaggcgcgcaaaaagtcccctggggaacttccagcggcgcacccaccgccagcagcagcagcttcgccgcccgccgacgccgtagcggagggcaagccatgaagttcaaggccttcttcaccgacgacggcatcgctctcctcgacaagcgtaaggccctcggggggcacgactttcctccgccgatcccaatctctctctctctaccccgcaattcgtcgagcacctcacgcgcgtcgcgccgtcttgtctgcccccgcagggttcctgccggcgatggacaaggtgggccgcctgtgccacgtctacctcacgcccacgcacgccatgctcctccacaacctcctcggacccacggggacggggcccgacggcggagggccgcagtgcgtcgcgcagttcgccaaggacctcctcttccgggagtacagcgtgtcgtcgcggaacggcaaccgcgtggccttcgccgtcgacgtcgcgctgctccaccgcgccctccgcagcgcgctcgccgtccacgcccagtcgccggccgccggggacgcctcagccgcgatacaggtgaagctcgtcaacaagctgccggccgggtcccggtctgcctcgccgttcctcactttcgagaccaagggagcccgctctgctgtcgtgcaggacgtgcccatctcgcggcccctttcacgctccgacgtcgagcggctgcaggctgccctcgactccgcccaagagctccctcaggtgcgatgcattttactgaaatgctcgtgatatttcattagattatagatttcctcggagtcggatttggacgcccaaatgtggaactagttaatcaaagttgaataggttttcactgaacaatctctgctgggattattttggctttagatggaggcatcaaatgtacatcccttagtgtaggcttttctcattcgaaagcttgaactatggaattagtgatgagttggattcaacttgggctgccttatcaaattgaaacttgaaacctcacgtgacatactcatagttcactatagcaaaagcactagtccagtttatttcagtcataagaaactaactgcattatttgtttgtaccttgagaaaatttataaatagccaacaagactcaggatcaccgatcacaggcggtacacactaagttagtattacagaagcaaaatgtagaatagcaagtatactagtctggaactgccattcatgttttattttcgtcctgaaatcttagtcatgcttctttataataccatgtcaaggagactaaattagacaccccaactaagttttcctggggaattgtgtattcactcagggaggtttatgttgatttaatataaacgtcaagaatcacagacaactaaaagtatcttctatttcgatgattctaatctctaaatttattcttctttgcaaaaattgtagccctaaatcctaatggatgttgtcatgttgatacttggtttctgttctttctgtagactctagttcaggttccagatctgccacagttgcagagtttggtcgatcgtctaaaaaatgtcggcgatcttctgacagtagctgttactcaatatggtgacttacatctacacgttgccacttctcttgttactgttggttcagaattcaggaaacttcgtatccttggtgttcgtggtaagctgctctacattccaaagcaagtgtcaataatgtctttttagcagtgctgtcattatgttgaaattacctttttgttttaacgtgaatgaaattacttatcttatccatatttttatatgaattttctgcatttcagcaaccgcacctgttggtgatcaaaatttgagtgcttccactcgtaccaatatggcaattgagagaggggaggcgctctcagtggtattactcctaagagcttcacgttttttttttttaccatttttcatgcagctgttcacaagtttctgtctttctgtgtttttacagcaagtgaatatgaagcacctagctaaaagtctacaatgtcatttggctaagcccgactgtaccttctatggtgtgctttccagctatttctgtaatcttactgacaagttccaaatttgtgttggagagtcactttttgcttaaatactgtcctttttaatggcacaggtatttctcctggtggtgcttgcttgactgtgatattccagtatttcattccaggaactagactgacggacaagtccattagcttctactgcaggcttccagtccttgaccctggcagttaaacatattacagcgtggtaattactgacttgcttctgatatcatctaaggatatgcaatactattagcttagctactgtacctttctgttcaatatcttactatcttatgtgttatgacttgcttgtggactcaatatatgttggctcagcaataattcgctattttggaacatagcatttttattatcgatacctgcaaaactgaactgcttccactcattgttgttgtgatatcacttcgttccaagttgagccagtctcctatgcatgcgatctatttcctaactactatttacaatcccactgcttcaaacatccagatctcagtatcatagaaaaataaaaggaaaccagatttacggtaaatgataattacggaattatgttttttattaaccgagtacaaaattttcagtacttcccttttgagtgtatgaagatagtaatcatttttggagcaaatgaaacatttttttatcaatgattgcatggggcaaatgtatactcttgagccccatgtccttggtctggcataagagggaccaaaatcactggaatcattaatcttcctgtacacgcgtcctgtactagccacctcgacgctcttacatgtatggaacgtataatcctacgaacagtttttttatgcagtactaacagtaatttaacaaaaaaaagtgttggtttttacaaaatacaaataaaacttgaaatattccatgtttccatgccaaatgtttgtttgaaacaagtttatctatctaaacgttacaactttggtactgatctttcggcaagcgagcagaatcaatgtgatggtgtagtgcgtattttgaacggtgctttcgcctttagggccccaaccatttctttcattgttaatattgcggtactgccattctagaggaaggattttttttactgaatgtagaactgtaaattatctgtaaaagaagagacaggtaaattctgaaccaccagctatgtgtcaactctgcatctctgatgccatttttcacacattacatgtctggatatacctgtattccgatcagcttgagcttcagtttcaaaacgtataaatac

SEQ ID NO: 61297 - DNA, 6130 bp, Oryza sativa
tgatcatgaggaagaacagaatgcggtagatgaagatcatgctgaaaattactgagagatcaatccactttgaccggtgcacgttgatctggaatatgtacttcagaatgaagtctccagggatcttcggttggtctgggtactggttgtcaaatacgagaccatccatgtcattctggcattgcccctgtcaggttgataaaagtttggtgtcaaattttcttcaagataaaaatttagtgtgtttcccctgtcaaagagtgggatttaatttacctgcagcgcccagtaatggaagctgatgtactgcatggggtatctccaaacaggcttcggaatgtcgtaaggaagtctaaagtatccagagacaagcataaatattccctaggaaaaaaaaagtaagacgagttatgtttactgagttatgaagttctgaaattttaattgaaagaaaaagcgtttcctttgtaaggcagcaatgtaatgcggccactaaaggataggatcagcagttagaagaacaaaacataggaataagatcttgaacgacctcaagctgtctttaaactgggatgggagtagtgtacagtaatgctgggtagcgtacggtaaagttgtgctgtccagcatttatttctttgtcaagcttgctggtttatttgactcatatcagattatattagaacctttcaaagttttgtaagctctcattcatgaacatatcttaaatgccacatgatcctctgggacaatgccatggaaaaaaaaacagacttaagaactgtaccagacgggaacaaccgagttcggtgtttcgatccaatctttctatagcactatatttaatacatttggtcctaattaatatgattgttaacatgatagtactttaaagatagacctaaatgaacatccattacttcaacaataaaccaagagatataggttaagaaagcttatgaaagaagcataaagatgtacctgaatcccagctcctataatgatccccatgaggaaattagggatgacacttgcaatggccatcatcaagctctcaaccacagtgacgctggcgtagaggttgagaacgaagaagatgtagtgggagaaacctgggtgaaggcgcaccatgaagtagcatatggtccctgacaagaagcatatcaggaccaagaatggcagcgccgagattgtgttgctgatgacaaaagccgcgacaccgtaatgcccattcagccgctccctttggaaaacctgtcaatgaacaagggaaaactgagcaaatttggcatggtaattctagcatccagatgaaaccgtttgcttggaattcaccttcatttcttcaacaaatgaagggaaccctccaattgacatgaaagtgacgaatccgaagacgaatgcggtacaggcagccctagcctgttcagagtgtaaaccaaaacacatcagaaccagccaattaatggattcatgacagattactcatctgactatgttttttttaatataaacttctattacagcattccagtcataagaatcgcttatcagttccttcatttcttaccaggatggatgtgtacttggtgccgacgtcatagtagatggtgccaatgcagacggtcacgaggagatagatgaggagcctcagccagtaatacccgaagtcccttgacatgttgatgaaggagcgcttggtcagtgtgcctgcctgcatcaagaagctagcctggcttcctcctgaatccagcacagttcctttctgcaacgaataacatgggtgtgttagtgttcatcctgttattgcctgtcctggatgcagtcttaactatacgtgggggcgcaagaaaaaaaaaacagagaggaaaaagagtgatatcaatacgcgctgctgtattagggtcgccaagaacacgtaccagtcgtgagatgtcattaactctctcccttgcagcgtagtagtactgggacctgctgtaggatgcaaccaactttctgatggcttcagatgtggtcatcctgtccagaggatcgtccgacctctcgatcttcaatgagaatgcccaaaaattagatcattttaagtgcatcgtgacacgaacaagtttgagcagatcagctatgaacattggtgtgtcttgatctcttcttacccttgccttcatggaacctttcagggtggccttcaccttgtcgaagtcggagttgacgcatctcaggaaatgatccgatggatttctcagtggcgggcacgggaagccggtctgggcgaagaactgcaagcacgagcacaagatggtcacgttagaaaccatggcgaatgatagtggtgacagatatatatatatactggttgctttctgaatctggtgactggtgagatgacttacctcgcatgcctgcgatgcttggccgaagtagacggttttgccgctggagaggaggaagagcatgtcgaagagctcgaacacctcgctgctgggctggtggatggaggcgatcaccgtcctcccgtccctggccagcccccggagcgtctgcgtcacgaagaacgccgacgagctgcgcgcatgatcaagccggcatcacatcgccgcggtcagtccagcgcacaccatcagtcagctcagctgtgactggatgcagggaggacgcgtacctgtcgaggccgctggtgggctcgtcgaggaagaggaggcgggggcgcatgaggagctcgagggcgatgctgacgcggcgcttctcgccgccgctgacgccgcggaggtgccagttgccgatgacggtgtcggcgcagtcctggaggcccatctccacgatggtgccctccaccagggcgcgcttgtcctcccggggcatcttgtccggcagccgcagcatcgccgagtacccgatcgtctcccgcaccgtcagcgtcccgatcaagttgtcgtcctgcgtcacgtacgcctaaaaaaaaaccctccgtaaacctcgtgtttcaccgctaaatgcacttgctttgctatagataaatgaaaatacacttatcatatgtcatagataaatattttttttcgaataggttctcgcttgtttgcagggccggccctgacttttcagtggcccggtacggaaaaaaaatgaaggcccccattcaccataaaaatacaagataatatttaaaaactcattgtcattaatgaatttcacactaatcagtttaaaatacaatcaagaagtcacgatatgctcgatcgccgatcggttttctatctttcctctaaccctatcagatctgataccatagtatacattttttggaggcccctaatttttagaggcccagtgcagtcgcaccgtccgcactgtctcagggccggccctgcttgtttggttattggtattcactttttggaaactaaatattggagtatatatattagaaaatatctgaggacaatttgtaataataactttaaagagcagtgatgagatggcaccgctagtagagtcatttaaatgagtatataatacgtaaatgtgacggtacaaaacggcgccgtagttttggtacatgtaataatggtgtgtacactgtaaattaaaagacccgcctgaaaagaaaaacgtagattcagaaatgagctgatacttttttttcatgctgggcgagcttggttacagctttgagcctacaggtttggtcagttattaaggcattgaaatttgaaaacgaccagcaaattaaacggcccaagttgtctcgctctatgaggataaaccatcagatttgtaatactattttttttgtatgcagaaaagtccccctccttccttccattactcctgtagtataatcgttggtaggacaaaccacgcggtcactgcagctgaatggttcatgtcaccataaattccccacaggttcgatcacgaacaaatccaagtatatccaactgtctgtatttatgctatgtaggtcgccgcaccacaacctctaaatctcgtctttcgaaactactcccactagttctccatctcttataaaaaaaagagaaaagagaaaaaaaaatctcgcgtactacgccccaaatgaatggaatcagagatcgaagagagaaaacagatcgaattgattgctgcacctaacaagcagcagtacacgttatgtgcacttatgcttcgttggggggttatatttacagcctttcgccatcggggacatggcagatgacaaaagtaattaagccctgcaacccgctggatcaacgagcggacgtaggtacgcgttgcgtttgtccagtatgttttgatggcgacgataattagccggtcgatcggaccgtggtcgcctactcgtaaaacgccacttgatgggagtgtgactgtgtgtttatgcacatggcgccatcaacacaggctagggctagctagttcgttagttagcttgactattaatgctgaaacgggatggatacttattatggatgatgactgaacttatctagctaaggagacagtaaagtatagcaagggctgtggtacgagacaattttgattcctagaaatggagattttgttggataaaacaagtgaagcaagaagctaggtatggagtactacatgagtatatgatttttgtatgcgtaccgcggcgccgaaggagagcttggccttgcggccgttgaggaggacgttgccggagaggaaggcgttggcggcgaggcggccggcgagggcgtcgaggagggtggacttgccggagccggagggccccatgagggcggtgagcgagcccggctcggcgtagccggtgagctcgtcgagcacggtctgcgtcttgccggggccgagcgccacggtgaccgagaggtccttccacgtcagcctcgccgacacgtcgccgatgagcgccgccgccgccccgggcatcgccttgctgtcccgccacagcgtctcgctcagcgggctcagccccaccaccatcccgccgcccgccgacgacgcgttcgcctgcagctccaccatggcctgcccggccgccgtcctcctcgtgtcccctcctcctcctcctcccgctctcatggcgcgctctagctcgcagcgaccgatcagctagctagctgtgagcgacgacgcgatggcaagcgaacacgaacacgagagagagagagagagagagagagagagagatgcaatggctgttttgctagaggggagaggcagcaagggaggagttataaaggtgaaaagcatgcaagcataataaagaagggaagttaatggatggatggagcaatcagagagagcaaccatgggagggccactacttaacaaaccgccaaccaaaatgtcttcttttaggctttggctggcaggcagatgagcccttactcctactcgaatcgatcactagtcaccactcctgttctacatgcaacgtgtggtacccaagtatggaacacagtttttttttttcgacgaagtgtcgtgtcttagaaatggaaaatactgttggtacgtacagtactagttttgttggattataaggtgtaattttcatcattaatcccaggtagtttaatgtaacatcccgtgatcagtattctgtacagataaaatatctacagagcgtgctagcatcaaataattagagaacccataagtacaatatactgtcactatatactagcaacgaatggacgaattaaaaattttatgaaagttagaaagggttttaaataatttcatggttgagacttgatccagtctaatttatgctcgatggtgccggtgcagtcgctggatcttatttgtgcgcctgcgagagacgatgacatgcgtcacagtttctgatcaattttgatcatcattcaaaataggggtataatatgtacttcgattataagtgatcaattaccgatcaaattgtaagttgtactataataatagctgtgcgtgaaagtccttaaacattttgactcttcctagctagactaacacattcttacaaccctcgatgatggtatcaatttattttatctagattaattatttttttattaacaaaaatatccaataacaaataatacatgcacacgtatatgccgcgcaatgcaattcacaggtcgtactacacgggtag

SEQ ID NO: 61298 - DNA, 9076 bp, Oryza sativa
agcgagcaggtgcattaatagggtactggtagacgttggtgtcgtacttttattgcctgcccggccagcccagccaagccagccttctttctctccctccctctcctcctctactactctcccttcatcccgataataattctcggttgctgattcccttcatttaatctcgaccctcgccccgtcttacatttcgaaattctctttctggaccaccatcaccgcatagtcacaggccagcggtatttccctccatcgcggtgcaagacgataattagtccatgatcgatccatcatgcatatacctaggaccgaactggaagaagcaccctagcgtattgccgctagtagctagctagccaaatttgcttcgacttttgcggtgacgtacgcgcccatatacatggcaactttaggcgtcatcaccggggctcgtgggcgtgtccgcttccagatcaatggagtccagttgctcgtcggcgtcggcgccgcgagatcgagctagctagcgagcgatcgagtcgcggtcagcaccatacctgcgcggctgggcggcgagcgctactagcccatctggtaatacgtagtactgacactgtggcgcgcgtctcacctaccatctccccaacgagatagaggagtcgacggtcaaacgtcaaagctgtccgcttcggcgcgggagaggcagagtagtagtcaacgaggcgttgggaggcagcgggcaggtagaggcagagccgccatccagtagcgttgctcgtcggggcactcgcgcgcgcgcgcgcgattcgatcagtcgggcaaaccgcccggctaacttacgcacgtacgctacgccgttggacgtccgattctggccgtaatgaggtcgcgccgcgtgcagctccaaccgcgcgcttttatcattactactatctcgttccgatccgtaatccgtttccgtccccgcgcgccccacccgcctcccatccctctaggtctcacctgaccggaaaagccatatactctcaaccgcggtgacggcgacgcgcgctgccgtgcgtgcgtcggtcgaggccgccgcccagcacgcagcgcgcggtgcaagtacagtgtagccgctgccacgccgatccgtgtggggatttctccgacgcgcgcgcggtgaggacacggttggatcacggatgggaacggggagatttccgcgtgggaggggaaggttctctgtcgatctgtcactgtacatgtagcgcacctgtaaccgttcggcgtatatgccattcagggtgtcaattcctcaactgcaaaccacacgcggcgctactcaatgcagtacaacgactgtaacagtgatcggtattgagagagcccttgtaataggacgtcaaatgttacgtagtatcggtactgttcacttgtagatactagatagctatgcatactagctagcttaatagtaccacctatctaggatgtgatatgatgatgttaggtccaaactggcgtacttactcctatatagttgcggtgaagttcaccatccaagccacatacgtgatgattctgtacgtagagattaacagtagtttgttggatggtgtctctcgtctatcgtcaaaaacctgaaagtgccatcgatcccctacaactgcactactaccattaagtacacggatgacggatcagtacatataggggtagtactaaaagtactggtatagtagtagctcgtgcagttcatcgatcattcacgtggaagaaacatagtacgagggcgaaaaattatatccgacttagcaaattctataactcctgcctatctacctcgtgcatgagacttgcctgcttattcaactgaatctatatatataggaaagtaaattgtggagagttaacatcacgacgaggaacaggaatgggtatcgatcgtgaggtgaggccccggggcaacccgcggaatggaatctcggtacaagggaggaaaatctagcaggtgggcacgcatttcttgcacttgacaacgcacttggtggacgggatgtggctgaggctgctactggagctcgacctgtagcacctcttgccgcacagcaccttcttcttccggcacatgtcggcggggatgcagttcgcggcggacttcctcgccggcctccccctcgccgtgctcctcagggacgccctgatcgcgtcggcgccgtcgccggtggccgcggcggcgtgccacccgtccgctccggcccggcgcggcgccgcgccgaggaagtcgctggccttggagatgagctccctgagctcgcggccgagggtggtcgggatgccgccaccgccgctctcgccggcggcgagcgagagcttgctaccacccatggcaacggcgagcaggagcactatcaggaagcatgatctcgtcatggctgtcacacctcgtgatgttacagcggtacacatgagttctcatgtgaatactgttaccctcttatataggagggtcattgcagcgatcaaacgaaggcatggaagcatttgcatgaactacctaatttgcagtgaacatcaaacgcgtgatgatgaacaggcagcccaggtgtgaagtgtgaaccatggacggaacagcttagcaattaatcggcctgcctttccttgtaatagttccggcatgcttgctgatgtgaacgtcggctagagaagggtgcatcgccgcctggtcaagttgtttgcttgattgtagtacaattttcttttcatacgccagtaaaagacaggtgtacagaaagaggcatgtcaagacacctggttcattatatacacagttttaactaggacaacttatttcatctatcctgaagagtgtgggttttatattatagtgtggttctttagagcaagcaaaatgcaaataggtaatatattcattgagttcgttctaattctacaactaccgagcagggtttcctaaaccgccggggccggggttaccgcgccccggcggtaagcacgataaccgcggtaaccgtgaaaaaccgtgcaaaatttatcaaaaattcaaattatttttaaaatttatttgaatttaaggaggttaccgtggtaagcccggtaaccgcgcggtaaggtaaaccctgctaccgagatcattcaaccacactcatgcataggattgtaggactaggatagctttcagtcatattcatacataaatgtatataagaaaaggtatgcatttaatcagcatgtccggattccagaagcaagcttcatcaggaaggcaagaaagccaaaccatgttacctgctataataaatttaaattggatacgaaattggtgaagcgataataaaatttaagccgctcacttaaatcattctgcaaatgttttatttctacttgttatccttaagcaagcacctttgcacttgatggcatagtttctccaaggcaagataagtcttattttcatcacttaaacccacacaattctccaatttttgactgacactaaactgagttcacatgataattccatttttcagtgaaaggttatggaggtgaattccccacatttcgtcagcattcaaagacaaaactttttccaacaaggggaagtcatcatcaagtagttagcagctgcattgattcattacttgtgtcacgtcagtggctttggattcaaatcagcaataacagcttacggttctggattgccagctactcagctactccctccgtttcatattactttgcattagccatattcatatagatgttaatgaatctagacacatatgtatgcctagattcattagcatctatatgaatgtagccaatgctacaaagtcttatattgtgaaacggatgaagtatttcataccttaaggtccataacaacctgcaagatggaatcatgaaacttacaggcaaaggatattctgcagaccagtcttgctatccatcattactgattaagatagttggaaagcacctcccaacaacctgcttagcccctgcatggttgagcggaagaaaataagagactataaacgagcatgatcagctagagagtagaggaagagtacgttagttcaaactgaaggttagacttgaatgaagaactcaaaatggtaccgactaataaagttttcctttttatcagagttttgcatgtggagaatctatacattgagaataaagcaacctgtccaaccccccatgttaaatgacactagaccccccaacattaaattagtagccacaaatctcccagcagacatataacaaacaccactgtactgtactgctgtactgctgtagtatccaactatccatgatggggttaatacgttgatcacctgacacaaaccgttgacaagaaaagcaaaatagtagcatgttacatacttatatagagaaatatggtcacctaatttctaattcaatcatgattaggacacaaaagagaactggcccctccaaaaataaagcaatcaacccaatatactccacgccgacgaaatatggaaatagaagctcattggaatgacaccttttttatgctcatgaaagagggagcacagaagataagcaatttggatagattttaacaaattataaagttcttattataaacctaagaagtgcaaaaatgagttccaaacccagaaatcccctataacctttatgcattaacagtagtgcgacagaatactatgattctacagttatagaactccttcggcatgagtatttcagataagcaaatgtagtaatttaaccaagaaatataagccctatttattttggaacaaatgagaacgagaataatcaaacatggatgtttgtctggtaagaatataagttactttattgcaacacatcatactacctaaatttaaccaagagtgaccataagtccacaacaactttgaacctagagttacatgagacatgaaacattctggctaaggaactgttttctcaattcaagatttaggtgttcacagggtttattcaaacatagaactgtagttattaagtatttatttaatccaactttgaagctcataagtaaatttgtggggatattattttctgcatagtaaaactatgttcatgagcaatgatcttccaaagtggttccttggctctaaaaaggtaaaaaactaactttcatcatttggaagagaagttgatacgatagactgcaacatttccatttgcagttcagtccccagaaacaattgttgaatgcatatgtatgccatgaaccaaagcactatgtttctaatagggtgtaattacctaaacaagagtacacaacatgttgaaagagttatcattaaatcacatccaactgaaaactcccatacaatctaattcggaaaaaaaatccccatacaagatgttcttcccttggcaaatggcaactgatggatagatactcaggctaacgcatttatcaaaaccacaggttcatgagatgaggcaaacgatatgcattttcatatcaggggaacaccatgaaatgcccacaggtggatgataaatacgctatgttgcaaatcaggcttgacaacaagcaatgcgacttttctagattttaaacaccacgtcatgttatttaccaagcaagcaaggttgaacttgaaagggcatatttctcagcatatcaaggccatgcaatgatttatgttcaactaaccatcaatagatgtcggaaagcagattatgcagttcttttaaattgttgttgctgaagaatgagtgctgaattttatggctcggaaataagaagcatctgacaggttgtatgaaaggatggtctgttgagaacaataggggagaacccaactgaaaaggatctacaggatatagagaaataacaataggagtatacgcccaaaaaatgcaaaaattgacagaacaaagtaaaagagataaccaaaaattgacaggtgtacagttcctacaaacggtcagaaaaggccatcaggccgtaaaatgaaataaacggaagtctagatggttagctaaatgctcggaaattcctggaacaacattaatataacaaaacgtacacatatgagttatatatggtctaagactttcttttgcacttgaattaacattttccatagtaacctattagtggtgcttttacccactaaggaaaatacagcttaaaaaaatcaatgacagaccgattttttttacttcaagttacaacacaaagacaaagaaaattcaaaactgggagaagcatttttattacataaatattacaaatattcggtataaattacaagaccgtaaaagatggcaaagtcaactaatgcacctcactcaatctcaatttgttggggcgcatcattttgagatccctcacttgattcatcggttcggctatcctcagcaactccagaagcctctaccgtcctagtgatccattccttgagaggatcctcattcaggtcaagcctcaataggccagcaaacacaccacccatgaatgcaactggctcctacacaagaggcacgcaaaccatcactccatcagtacatgttctggctttgggaagagcctacgaaaattaaaggcaattcccttgcactgatgggaatattgagcatctgcagcttaagaatcaactcctatggaccaattcctgtttagaacgctgaaatagctatatgtaaaatgtaactcaattgttgggtaaacctaaaactcccatggattcgtcaggaacctcacaaaagggtgtgttgtttcagaatttacaactagagattttacagcttgacctcgacacatcgaattaattcatgctataagcctacaactaacactggatcggaaaaaaagaactggaagagtcggggacgatacacaccttcaaggcctcccggaggatgcgttcgtccccgggaggattgaagcaagctcgcacggtccccgcggctcccctcctactccgcccctcgaacccaacaacgaagcccctcctcggaaccggagccctcctccgcgacagctacaaaaaaaaaaaaacgaagaagcaatcagtacaaggtcaaaccctctcgcctgatcacacgagcgttcctgctccaagcgcagcgctttaccgcggcgggagctcgcgagtttgggaggaggagtacagcggaggaagcagcggcggccatggataacgcctcgagtgttcgccacgccgcgaggtttgccggaggcggaggatttttttcctcgatgccgtgtacgcgctagatgggctcaggctgggccgaaacgggattccgctgacatgcggcccgtataatatgggccggaatgggattgtgacctacgtgaggcccatggagtgtaaagtgtgggtgggccgtactggagagccggagccgagttgcacttgcacgggctgtcacctgtttacgtcagcgagactgcgagagcatacgcaaggctcgcctgagccgtccgatcctatctgcgcggcggagattgaaacagctcagagacgctcgtggcggccgtcggtgaggtcgccggcgactacatggatgcctccggtcggatcgatctcctctccggcagagatgcacaaatacgtcgatctaccgtctacgagctattctcacctcgctcatatcagacttgttggatcgatctccgtttttttttttttggtgttcctttgtggtttattgctgctgctgttttttcgtgtcagcaagcacgcgtcggtttgtcagttacctacttctctctccaggagtccagcttgttcctcgcatgacgatcgaggagaggagcaatctctccaggctgggctaggctagctagaggctgcatgagatatgtacatgtcgacgacatgcatgtcgtgtactgttgactcctgcttctccgttccgcttagtggtgcctgaccacaggtagtgaggtagagggtagagatagacttcaagtgctcacgcatttcccctgtcccgttttgagtgataattaagcttaagctggactgatggatagaagcagtaactggcttcatgaaccaaggattaatctagtaaaacggtaacgtacgccagatttgatcatgagcaacagtgggaaaaaagtgaaaaagaaatttcagaaaaagctagcaaagcatttttattctagctagctcgctacacgagaaaaagctagttcattctgttttttcagaaactattatgtgtctttctcctgaaagcaatgacaagtaaagcttatgggtgtgatatagtaccacgcaacatatcatatatagatgcacaagctaacgggttgacagaaatataccatgcaggcaaaataagccaaattaaagaatgcttcttaatccatcgcatgacatggcctcgccggcagcacatattttccatctgaataaaggtttatctcatcctgtcatatgtatagcttgaagttttgtacaagatgcacgcacaaactagcttccacatcgcacacatagagcactaaatggtaaaaaggaaaaaaaggcagaaactaaaatgggaagataagtccaaaaggccacctcagcgatatctccacctgacaagtgatgattcatacgacccaaacccccaagacaaccagttataaatgtcagagactgtaccaagtaggaatgtaattaagatcatatctcctagatggctgataagttaaaacaggctatatatgcttctcttccctgagaaaagaaccagaccacacatctagctagctaggtagcccacctcaacatcggcttacttgttttggagtagatgtttcagattagaagcaacatagagatttgagatatgggaagtgctactgctgattccagatctggtattaagctttttgaagcttgtatcaattcgaatctgaggtccttccttcacagtgttacgccaactttggagccctacaccgttgccaaggtacaaaccatcatgctatcttttaagaaaaagaaaggctgtgcttctgcttgtcaaattcttttctcctttgatttctgtatgaatcagttatgtttccatagaaattacaagaaatgaaaaatcccat

SEQ ID NO: 61299 - DNA, 26149 bp, Oryza sativa
gattttcacatgaatttggggggaaaatatatcttgttatctacatatgtttccttctttcttcatctttgtttttattgttggcctatgttattggcccattttcccttgatatggtggttttccattaattttcttgatggtttataatacatctactaagatgtagatgccttaacattatcacgagtttccaagaaccaggaaaaactcatatccttttctaggttgtttacttcttcccctatagaatgcttggtatcttctcgctgggagatgttaagctatgtatgatcatactaacttgttttgcagtaagatttattacttgtggattggtgtctttgtctatgtcatccttctttgttattccacgcgtatgtaaagtggcatggattcaaaatactttttggcgcgagacatgcatggtgtcttcgtgcgaacttttggcgcgaaacacccatattgtaacgtatcactcaagtcaaacatttgcttttggcacgtgcgagacacgtgtcagattcagtggcggagccaggaatttaaccctatgggatcaattactattagtttgtatttaagtgaggtcatttctctatttttttttctgggtttatacatgaaaaatggtcagattgatagcatctttacgaagattctatgtgggatagaattgtagaataaccatttaacatggaaaatcaccatatgaaatggatgtctaaaatggtgatcctttcatccataaaccttttattttgccacaccttgtggttatcattacctcctaacaaatttagccttttatgcgcaaacatgcatgcttcaccaagtgctaacctattggttagaatcctgtgcacaacagtaaacatttaatttattttcatatttgggtgcgtagatgtaatctttattagttacatttgcacacaaccaccttcatgttgacttttgtatttaacatctccacaacttttgatatggtcatccaatgatagaatgtattaattaaatatagaggacttatatagattgtattggcacttattaagtaggaccaaatcataggactaatataggaaactggacatatgggaagagcagtcgttttatactactcgacatcccgagttcaattccatgtgacacgctcccttccttctaaataaatgacacgaagctcctccttagtgtcccatattttttttaagaaggcaaaagttttgtctcgtatatattaatagagcaggagaaaaaacaatcaaacaaccaaacaagttatttacagggccctgccgaaaaaaaaacagagcccacaaaaggagaaactacgttggctctcctatcagggttgactcagcgagttttgcgactcccgccttgatccaggtcaacgcctcctctttgattttagtgatgatggtgattggggttggtggccacgtggtggaactgtgtttttttaagctccgctggcagcaactttacaggatgaattgcttattatagggaggatttttattttgttcttaagtagtgctttagttgagaacgtagagtacttggctggtagggtgctgccaggagatgctcaacgacttgggtttgaaccaaagttcctcaccccctctcctatctttcttaaatacattgatactaagttcctcaatatccaacatgttttcagtagtccttagttttagttttattgctatctactggcctgaattaaataatcataattatgatctgtgtctgcagccaggcggctattctggtagagtgcccgagttaggtagatgcttcttccttgtagacctttggaaccacttctacccgttgagcgcctatggtgtcggtactccggttcgtctcccttccggtcaggaaattgagcagtactttgtgccgtatctttcagccattcagttgcacaccatctcagacttcacttcatgcaagtaagtatatatatgtcagtttctttgtgtataattggccatcagatgcatgaagagtttgagagttttacatggttctttttgtctgaactgggcgtggtgacagcgagataatggtcggcaataacttgtttgatgcgaacaactacggctggtgcagtgcggcagataactggaatggtcagtatgcaacaacatcattagcgaggtatgacagcccgaggtcaatgaatggagggccatgttttcagtactttgaatgtgattccccttatgaaaggatgcctctcgcagacaaggtacgcatgcagtagtagctatagcttcaaacttcttctctggaaaggaaattccatcagtttttttttaagtttttaacttgcacttaactttaaagcttactagtagttcatagtatttgcatattccaatgaattgtacagattagttcttccattgcaaactgccatgttatatatcctctttctgacattctttctatctatcatgtattcaggtgtatgagctgtgctataactttccacccctatcatatcttagcagtattgagctctctccatctagttggatgtcagttttctggtaatttttccaaattcaaaataacttcctcatgttttttatttaatcatgtaaattcacaagtacattttagggcaacgttagctttccattaacttgaagcaggattgcagatttatttagcgtctctaatctaattgtgccaaccaaaacagaggtccattatctattaaaaaaaagagagcaaatcagttgccaatcttttatatttacttcaggtatcctataggccatgttcccgcgatgaacaagaaggacctgactacttgcttcttgacttaccatagcctgtcaacattagaaggtaaataaagacagtgacacattaccattaattttttttacttcctctctggaagaatgctatatattcaaatatgaataatattttggctccccgtttgcaaattgcaatgacttgagtttcgtcaaaatcctgctatgcaactgcacatatattggttcatgctcttcgaacaggctttctacacatagtgagatgtagtgcttcagtttttctccagaaatgaaatctttgttttgcatatggagtgtgaaattaatgttctcgatctaattcagaaacattgtgaacattttattgtagatcgtacgccgtttgacagcaaggacccgctgacgcttcccccaattggcctcgcgacgcacaagacggacggagatgtatggacaagcgcgaactccggcgaccaagagctgaccacctccctcgtcggcgcggcggactcgtggctgaagaagcttgacgtccagcatcatgacttcaattacttcctcaacagtaacaggaacctgatccactacaggtccttgaccgaagcaagtaccagtgcagtttgacatggcgaacttgactggctgaaagcggttgccggagctggttgttctgggtacaagaaggaagactgcatcgatactctctcttctttttatttttgcggtggtggtttgcagtaattggatcctaatcactgagacatcgtagttggtactgaataattgcttgttttagaccaagactttatcttgacattgagttttactttcacatgaaaaactgcaaggtgtgtgctcgaaagtatgcagccttcagaaaagggagttatttaaatgtcctcgcctgcaaatgttgggttattttgttgtagcgcagtagcatctgtggccctctctctcgtggtagcatttggttgctcggttgttcccgtgatgatttatttaggaacatggaaatctgctaattattccgtaattttccagccatgatatcaccatgtgcaatttgtggcttatggtacactagagcaaatatgcaggtgctatgattcagctcgatacatcagtaatcctcggcggccacgggaagccgagtatctgcagctgccggcggctcaggctgctccgccatgacaaactcgtacagcgcgccggccatcccggcgccgatgagcggcccgagccagtaaacccagtggtggcgccagttccagccgacgagcgccgggccgaacgcgcgcgccgggttcatggccgcgccgtcgaacgggcccccggcgaggatgttcgcgcccgcgaccaagccgatggcgaggggcgcaatgtcgccgccgccgcttctccggtcgacggcggtggcgtacacggtgtacacgagcccgaacgtcatgacgacctcgagcagcagggcgtgccgctcgtggatgcggtggccgagcgtgaagcccatggggcgctgcaggacaacgtttgtcaaagtgagacgtgggcaaacatgacgcacctgtacacgctggtagtggtagatagctcatgccaaaaggaaatacgcaaacattaattttttggttttttgtggtaggccaaaagaagcaaaatacggcgtcgctaataatgatcaattgatatataacagcatgtaagttgtaaatgtgatttaattaagcgctaatgtaggcttttggtgacgaagagataaagaaaagtgagctagttaccatgcctccggaggccagcctgaggagaagcacggcgagcacggcgccgagcagctgggcggcccagtagagcgcggcgcgggcgaaggagatgcggcggccgacgagcacgccgaacgtgacggccgggttgacgtgcccgcccgacgcgttgcgcgacaccgccaccgcggccgccagcgccagcgcgtgcgccaccgccaccaccagcaggccgcccagcgtccccgtgtccctgtacatcttccctgcagcaatccaaacacacaaaaaaaaaatcttcagacaaacgcacgggagagcgtgcgggcgttcatgcatgcggttgggttcgcgtagctattttacagaggccgtagacggagccttcggcggcgaagacgaacacggcggtggctacgaactccgacagcgccgcgcgggtggcgcccggcaccaggggctccatggcggcggcagcggcggcggcgtcagcacggcggggagtgtggcgacctggcagcatggttgacaacgaccaagctagctaggaaggatttcgcctttctttttccgttcgtctgcacctggtgctcctgcgtcctccgggtgaagtgctagttgagtggcaggagccctgagcgggacaggacgacaggtggtcagcgaggagggacacgtgtggcggggatggcgccccgaaaatcggcggcggggaaagctgaaattggagacaaaaggtgatacattagttgcaaatatttgtggaaaccatcagcatttggctatgggctttggatcaaacttagaacgcattacttgtaagtcactgatacatttgaaagaaataattctgcttgaacatttgaaagaaataattctgcttgttctatatccgaactgctttcttacaataacatgagtagcactacaatactatcaaatttgtacttctaagctgtcgtcaaaatcccatgtagcagaagttgcggctatagaaacattgaatttcatcagctgtttcagacgagattagcgatcttacagaacagggaatcaaatctacaaacttggttcatttcctccagaagagacaaggaatgtaagtcgaaacaaaaacttaaaatatgtataattaattcaatcagcattctcgctttgtataactcataactaccaggctcttaaacaacacttttgccagctcaagtaataatagaaaggttggagatactgccacaagttataatcctaataggatttacaaaacttccagctgagtatcctggaactcttcttcgatgactcaaaactcagagcagcaccagctatccaccaaggtgctcagttatgttttaccattaatgcccttcatgataaaggcgaggggccatgccccagttcagaatcatcgaccatcttctctaatgactcaatatcactggtttcagaaagtatgtgaatcctaatgctgtctgcatcctcactgctcacatgaaaaaagaggaaaagcataggtcatgacagtagcattaacagcagttgcagtaaaagaaagatccaccacaaagtaaaattagtcatactctgtaactccgaaaatttctttgacaacgagtgagccatcgcgtgagcagaactctgggagctggatattcacaaaaaaacagtcataagttatatatagcaagggaaaatacagaaaatcagacactggaccagtttgaaaaactatgaaagatcttattacaggacctagacaagactttttaatccatttttctctctgggtgttgacaaagcacggtgcatcaaaacaataatggaataagttttataccccaaattttattattctccaaaggaatttaaatcataacaataatattacctaaacagattctgttgtctttgaatctagttgtttatataacttttgaaaatactgtatcgaattcactccactgaatccataggcaaaaaaacaaacatacaagtatcaccatgataatacaagtaacaacttctaaattctaactgaacaaagacagataatgtttttgaaaaatgaaagattatcatgagctgcaagcagagcaataagtgccctatcaagccttttcatttcagtacagaggtcaagcaaaatctggcttatcatcaacagaactggaccttttggtcaagagaaataaactatcaacagcttacctctgataagtacaggatttttccgaacaacgtttgcacagcaagcttacgcttaaaaccttgttctgtaaacccagctaagtccatgactactggtcctgcaagatcataaagatgcaaaatctcttgagtacttctcacagacttgttctcgcaaaccagaagcataacctcatgattaccaagtactgataggtgacaggagataaataaatcataaggaatcaaggatactctccttacgtatattcatactatatggctcatgcatctattgtatgaagaaattttgccttcaagcagtaagatcatagatttcaactgacatatttaaaaattcaccaaataaagcataaaaatgtacaagcataatggtatggcttacaagtacaaaatgctgcgttgatttcatagaatctttttcagtacttttgaaaaacagttaattagtttgcacctggcataaacaaaataacaaggaattgcagaaattttattactggatgcggattgctaccccacatacatgtatgttaaaatgcttcttgggaaaacatgacaacagtaagtcaaagattttacattatgatacagacatgtttttcacgcttggacattgtactattgcacgaaacaacataacagaaaatccccactactaattgtttgtcatggacatatctgaaggctagcagagcatgtgtaattgagaacgatgggagatacaaccgaaaggcatgcttagtatataagcaggggatgtcatccttcaataagtgttgcacaaatctttaagcatggtaattgcttcttcttctaccttgatttgttctttaaagtgcagttcccatggggtagcatataaaaacaactcgataggaaattgtgggacacacaactatcaattaccagaggaatagcattgagttacaaaagtacacaagccagagttgaatttaggaaatacatgtatccactattaccactagaatagtagaatcagacccaaagaatgagcaatacctttttcccgaacaattcgtcttgaaatctcattcaaaatttcagcaacttcagcatcttctaacattgacgctttcctaagatgtatgagatccacgactacatcagggttgaatggtttttcattcagtgtgtatcgaatgtacttccttactacatcatccatgtcaaatcctgtctgaatacatgccaaaaacaacagttaaatcatgtggttggtagctttgccactaaatacaaaggcatcaaatcattcctgaaacagaagtagatatcatcatatcaacaatggatgtattggtgcaaagaattaacaaattactatgtccaaaatcatcattctactttgtgcagcaaattttctaatttagatcataatcacaatgtggctagcaatctaaagatgtataccacaggataccaatatcaccatcagcagttgattgtcataacaagatttcctgttatcacaagatatccattaactaatgccggctaaagtacactcatcatccataaatagacaataaagcaagcatatcatagaactagtctaatataaaggttgaatcaagggcacaccttctccattagttcttggagagctggaaaatccactgcctccctgcccttctgaaacaactcatctagtgacttcagcaaaaaaatattcttgctcacctgcaaaggaacactgctttaccattaaataccaagaaggtatagcaccataattattctataaataaagtcaagttcaatattgcagtaaaaaagaggaagcaaactcagaagacagttctttgcatctgcgtaaaggcatggaggagtgaaattaagtcatggttgaaagaaaatcattgcaagttcattgcccttctgagtatgctaagttataatctagcttgaaacatcatgaatgcataaagtgaatatagttgatcctctctactcactagaaatactagactgcaacattaaaggaaataccatatacttaacaaactcaatcaaactgaaatttttagtggggtatacactactttatgcctagatataaacttccaaatatagaatcccctgctgttcccatcgcctatagtcactgacataggtaaattaaatgctagatcaatcctaagaaactacttttccccatgatgtacctaaatttccaagaggttaaaagtcgatctcaactctcaagagaacggccagctagaaaacgtaacagaatagaataatttcgatcttatagagcagctacctgatgatataagtgcaattacattccgaatcacgtcacttccccagcttcccaatgagcaccaaactataaacgatggctcttcactgggtatcaaactacaaacgattttgacacggaaaacttacccttcgcttcttctgggtgcgcggggaggtgaacctgcggacggtgcggacgacggcgagcacaaacgacacgcctacgtaggcaagcggcacggagaggagccacggcacggggctggagccgacgcggggccccggtatggcctgcgtgacggtgccggtgaactccacgaggtccagcgccttgtcctggatccagggcatatactactccacctccacctactcgttcgcctcccgctttggcacgtcgctggggttcgcgggctgcctcgaggccgccgcggtccggctgccggggcgcttggcccgcgcgacgaggaggggcgtcggccgccggagaggcctcgtgcgggtggggaagggcagtgcgagggtcccgcgacggagccggcggcaccgccggcgccggcgccggcgatgggggtcgtgagcggctggaagaaggaggtggcggtcgccatggaggcgggcggggtggcgacgattagggcttatcgcggcggagggccggaggttggaagcacttttgtcgaggacggagacccagtgggaagtagctgaaccaaacttgtgaagttggtggtggaagaagaagcaatgggccgaaaggccgaacttggagtactatcatatttgggcctcttgtcatagtgcgttggatgggccgttcttcagaaatctgaagaaaccaatcggtaaattgaacatgtttttcctgtcacaaattattactccatccatcccaaaatatagcaagttttatttggattggatgtatcctagtactacgaatctggacatgaggtccaacaaaaagttgctatattttgggacggatggagtaagtcacgcatatatatgaatgtagtcgaagttatatgtgctaagtgaactagagaggcgaggcaagcagtgaaatagcagtcgtctgatcagttcacaagcacggacctcacctcagacagctgatctgacgaacagttaccaattcaaggcaatacattgatccatcattagctgacagtaatcgcgagaataattaactttgatctttacccactcgtataatccgtctagaactgacgtcatattacaagttcgtcagttctccatttgaacagtaagtgtttgttgtaaattaaattgtggaaatactacttatttccgccgaagtgtcttggacgcttcattgctgactcaaatttatgtaccaccatctcaaaaacaattgatctaatacggaagcactcgtagaagaaacaaggtgatgttgtgtgtcgactggtggaggaatgcctgtatcagtgtatcagccaaacaccacaccatctaatcaaagctttggcttagattctctggaccatgctggtgctctaactttcaggttggacttctcagcctcctcgtcattctcctcttcttccaaaatctctttagaaaacgcctctggattgattttgatgcagtcctgcagtgcgataaaaggcttcacacaatctgatccctgcgaaggcaaagagtccaaaattgtagttactattccggagaaacagacgatgaacaaaaacttagcattcttccaaacgtgaacaacagccagttcttgagattttatttgaacaaataacaggtaaccgaataagtgcctttaattaaaagaatctgccctacattaacattgttgtgtaaccaatttgatttgagaaaatcttctttatgcactcattgcagccctaatctctgttctgccaccaacttgacctggggaaaaggcatactggtgatgttacgcagtgcactctcccatcgaggctagagcaagtgagcaacccaagctaaaaaattctcctgttatcacggccctgctatcacttctgataagagaggaagccttttctctaagatagaagtggcatctatggagtaaggtgactcaaacaacaccgacccaactccaagccgtagtgtgaaatcctgaccagattacttcgattcacctcaaaacttacacttctccttgtttggcaccactgtccagttactcagttgcccatcaagtttgcacctaaaagacccttatatagcatcctcataatttctctgatgtcaaaattttcaagaaagttttaaacatttaatgcaacatagatccctgaagttcttcagtttttgtgacattttgattttccatggattctcaaaatgcataaacacataatggtcttttggtgaacaattggactgggcaataacaatttgttggtagaggagaatatgactgcaaagagtggcaaaggaaaaagacaaagaatttttgtgcttttattatattggggtcataaaatgatttgctcataggaaaagattgaccttatgttcaattagatcaacgaacaacttgagggagctttttatatttgtataatagaaagaaacacagacacatttcctacagtggcatggcttcagcctgaatgcccaaatcagctggaaattatcagatatctgtaaaaacaatggattacatagaaatatatatatggcaaccgatagaaaggttacactacccatcagcaagactgcacatgagaaaattgcatccataaaacaactttttttgtaaatattagctccaaattttagaatacttattaatgtgattcttatgttgactaagtttttcatgaacaccattaatatattatcaccatggtgatgtgcatgaatcattcttgcattgcaaattgcaagcagctcggtgccatggagaaagaaataggaccttttcctcttctgtgcttttcaggaagcaagagaacgcatcaacaaattgacttccacaaggaccatttttcaactcagctacacatggacagtccagtgctttctgtaccttcacatcaattgactgaatacacaaaatactaagttcactgatcatccagggtgccaagaaatagtaaagcaaataggatagtgatatataagcatcccactcaaaagtcaaaagcaaaataaagtaccatacctcattgccatcctcgtcaaatgacatagcctctgcatttaaggaatccaacctcagaatgctagcatgagaaactatggagaacttaagtgatgcatttttttaaggaaaaaaaagagagagaagtccataatattgatggccattgcagtaattttgactcaattttttttgagataaaaagaaacgcgaatattagggaaggacctaatatcaaataaatataaggggtgaagcttcaaacttaggccggctagcctaccaccttgtggagctagctataagacccctgggttttgagatagcaagcttgctaggaactgagagtagtgaaattgccactaatactatattagctcagtgactcctctgacccgggtgttcttattcttttgagagggacccgggtgttattaacttacaaaaggatcagacaaaaggattgcctgccgatgcattaagattttgggggaaacaaggtacagtgtaattgacttattacatcacgtgcatgacattaatattttaatctatctaaattgtcaattccggcatgaatgattggtaagatatcagctatcatcagttcactatccggtacacggcctgccctgcacaatcacatactcgaattcgatctaaaaaaagagagatttggagggagagacttcgctccaaacattttcttaagaatgaaattatgagcatgttagggattgaacacagaaatttggtattaaaaccacacacctcttgccactgcactatctactgcatctcaaagcttcccaaatccaaagcaacacaacaatctagcgcggctaccgcatctcaatgaaaagtcacgagtgcacgagaaaatcgccattggatcacaatattcagagtttttggcatgtacctgcggcgagcgcctcgagggaagatggcgccggggcaggagacggcgacgacgacggcgccgcctcgacggcaggcggagaaggctcctccaccgcctgcgcgggctggctcagaccttgacccatcgaggtgtagcgctagagaagaagcaggcggcggccacactctctcgtcttcccgggctgcgacggcgagaacgggagcaagcggcggcgcggcgagttggagcgtggtcaagtcggccggcgtccaagtccaactaaataacaggcccgagcaccaccacatcaccggaagcaaaattggacccgagttcaactccggcgagcgctttcccagccgtccaaatcgcatcaagattcgtgcaacgcggagacaggcttactgggccggcccggcccgtttggtgaatggctcgcgacctcggagaacctaaagcctaaaccgcggcttgggttcgggggagctccaggccgccggcgacgatgggaaagccgctgggcgacagcgtgttcgccggccacgcggccgccggcgtcgcggcgatcaccgcctccgcggtcgccgtccacccgctcgacaccgtcaagaccctcctccaggcgagcgcccccctcctccctcagattctctcgctgatgctgttgctggccccttctcgggggctttgatttggtactcattcgcgggtgttttactttccctcctgtgctggctgtgcagttgagcgctacggggtcgcagcagaagatggggctcggccaagtggtggaccggctcatgtccgcctccggccctgcaggtttgggtttcttgcccagttgctagataattagagatcttccactgtttttagtggtggtaatcccatatcgtgaattgcgttagggcatgtcgatatgcatagctttccaacacctacaagctactgggggtttatgaggataggtgatgtttgagttttgcggttagtggtgagtgactacttgctcagcctgccatccaaaaatcatggtagcattgggagactgaaaattctaaaatggatggtaatttttatgtagtgcccacattataaactatcaaatttgtaaaaagaacttgctgcaaattgatcatattggtcatacttggcagctggtgttgtaatagaattccaggccacctctttagtttttggccatattcttaggtgtctgttccttataaaatttcctggtcgagaaatacagggagaaaccatgtgaatcctgcccttttttctaattcctgtgtgatgatttctcatcacctatatatatgttacattggaatgaaattattttcctttgaatttattgtgtgtgcttttaggcctttacagtggcattggatggtcagtattgggcaagctgcctgggttgggagcacgttttggaacttatgaactcttaacagccttctataaaggtacagcatggttccagaaatttattgctcaggatggtctgccttatagaatcattttgtctgtccatttgtttgcagttatgaacaaacaatacactcatttaagtatatgatttgccaacttctctgtcatattctcttgccttcctattatcattttcctctattacagaatggttagcctccttgtatcgtttaatgtaataattgccaaatgctgtttagttatttgtactatgaattaccgttgacactgcaattttttgctgctgtccaatgcaacaatctgtagatcattttgaaatgcatgcgtttctggatagttaaaagtattcctttcctaatgcaagtactttcttatgaattgtttgttacgcgaaacatcatatctataagtactgcaatatctgattataccagattcgttggtgacttcatcacttgatggtgaaatatgacaaatgacatttgttttgtatatctcccgcagatggaaaggaggacaactatgtttcttactctgaggctatgttggccggcatagctgctggtgctgttgagtcagttttgtgcacaccatttgaacttctgaaacttcggagccaagttggttctgtgaaaccaatgaaagccacagacccagcaaacattacaaaagtgcatttccactgctctccaaactgttgcctggttatgtccctgacatcagagtatggaatagcagtgtcagccttttgtccaatctttccccaaagcatcctgacatgatgggtgccctgaaacagcatccgtggatgcttactggttcagggaagcccccattgccctctgatgttcaggttccttcaagagtgatagcacttgaaggatggggtgctctatggagaggacttagaccagggatgacccgggactgcgtctttggaggaatgttcttttcaacttggcaattcatacacacagcgatgcttacttggagtgctgttaatatgaaccctcaacccaggtaatggaatgtagtatttttttttcaggaaatagtgatagtaatcgaatcataactgtttatctttttggcattaggtctagtctaaccttttgatgttctgttcttgtcagcaaactggaagaagcaggccctgtatccccttttgcttctagtcttgctgcaggcttctcaggagttgtagcagctgctgcttcccatacatttgataccgccaaaagtcgttcggaatgcactgttataccaaaggtattggcatcgccctactttgaatagtttgttctgttagtttactaatgcaaatttgtagttcattgtgttagagcttacaacttgtaaacactcaatttccctatttgcaagcatgccttacttctgcttgtattacttcagtatatcgcgatggagaggaggcttcttaaatggaaagtaccaggaaattggatagagagaaagacaggaatatctcctgccgataggaatgttctgttccgtggtattggtcaacgaatggcccgaagtggatttgcatcttttctacttgttgggtcctactattttgttatagatcagttcttgtagacgacatgaagagacatcatttaactaagagatctctttaatgaatttcaaacattctatgtgcatctggtgaataattgaagaacaggtaaccacttgggcatccatgattgttcctgtactttgttcatctcatccttgttagagctgcgtgttccaagttataatattggctgctaaaacatttttttatgtcaatcagaattcaaggctgcctcttttggtatcaggcttttgttgaagagataacaagtatcttgtatggaaaccgtattgttggtaggatgactgatgagtagcaactactgaagatcctttttaagtttttgataaggattttgtgagaaaaaaatatgtcttcattattgttcaaggttaatttcatcataagattttacttcttctctcttttttcttgtcattagaaagtaaacggtaaggctttttgtgaatatttttggggatgccataattccctgaaagctgccttctacttctgtttacggtactattcagcaatcctacaatatatcttggaatattttacttcaattgtactggcattccatttggatgggtggctgatcttgtgacgcatctatatgtctttagacaatggaaccaattgcacatatggttggttagatgatttttgttcttaactctgaagttatattataactcttggtcaacaacgcatcatccaaagccactttacatttgggcaaacttgacgttttatagtagttcaggttgaatagtgcccggttttaaatataaagttacttttacagtaccagaaaagtttagtattgtcaaaataaaaaggtggtagtcggtcacactgatgactatggcaaggagtataatgtttttggaaaggaatatgttcctgcctgaatacctgatagcaatattattgaacagaaacaaacctagtggtaaagaatagaattgatgtaaacagcaatcgtgtatgattaagagtaacatgtaaataacataatacaataatgatgtttctttataatttggagtctgtaaattgtagccatatatgtgctcacggcagtaggcaaactatatatgcgccatttcgcgtggttttctttgtgttatttggcacgcatacttgccttttggaccgattgtagaacatcagacaaaggcttttgaaacgagcgtgtcaagtttcgttttgttcgcttgtgtagttgtatctcagaacactggaaactgtctagatgatatagtcgctgcagcaggatcaaaatgtgacagttttcacagtactcagtatagatcaaaaccaagccattctgaagggaatcctgagaaaatggatccacgagtcatattggaatcttttgaaatggttagtttttttcttcttttttttttggcaaagcatttcctttgtcagaataagattcgcctgtacaatgctcttgagattatctccaggccttgtttaaattttgctgacaccacaatttgttgggacaaattttgtacacttcattcgtaccacgtctggcttcgacatggtatactagagcctgaacctctgaaagacaacattcacattcttgctgaatatactgctactgacggctgtcttctttgttccaaagtggatctaatggaggaagatcgtagtcgtcaggttttagagccaacgcaaaatccggcaatggaggcggtgttccaatgaccctgcagattccccacaacgaaaaaattcatcacttattgaggttcacaataccctgaacatcactagatgtagtactatttatgttgcaagaaattttgttgtatgcatattacaccacaaattcttagtacctctcttgcgtatacaggtcctgattgatcttgaccttgcttgaagcatcttttggaatcttgtcaagcatgtacttagctgttccgaaaggagtggggctcctgcaaaattccaggtattgacttcagtatccatgcttaagagtggatttttacactgaacagcaatagctattcattaaacagtatactgagtagtatcagtttaccatcttggtaaagttcttatgctgagaataaaacataagaaaatttgaaaagcgaaatgctcaaaaggtaaaatgtcttgccttgatgttggaggagttgcatggaaggcttcagaagcccttttgctttctttcagaaattcttctgaagcttgcaaggcagctactgccattccatgagatttctctgtgtttccctcgtctagaatcaaaccatggaaatagtatgctgcagcctgaaaaaaagtgcacattagttttgagacgtacaattgcaacttgaagtaatttaacatcaggaaaataaaggttaaaccaacttacacacctttgcttcaacatacttccacttaacaaacaataaatgctttttcccccatccatcggataccggaatttctggaatgctctcctgaatttgatgccaatatttgaccatctcgcaagctaagcgccgttttaccgctagagtggcctttgggctatcaattgccagaccaagttgcatgtcgactccctataggtcaaagattaccgattgctcaggacatgatatcaaatttactgaccagagaaagcaccactgcaccgagaataacttggaccaatgtagaacagtgaatcatgaaatttgctataaattgaattagtgctaatagtttctacttcagcccacagaaaaaatgcaaatagattactaagcatcattcctaatcagaatataggagcttcaggggtaatatagcaaatatgtcacttgggactatagcataaaagtttcagcttcataaaaagtactacaacaaatgtaatgcccattaggtttaggaatgcagttcttgagttcatttacgaaagagccaaatgagctgagcccagaaaattgtacctgacccagagcttgcaggctaagagctttgagatttccttcagccagatctactggaagttgtctcctgtaatgcatacattgaaatggatgtcaatacaccttctttcagcttaaatcctcaaaatcatctactcagcttctcaaaagttcataaccttaactccgacgatatttggggtagtacttgtctaattgcgcagtctaggtagccagatgccttcaagaaaacatcaacagtagctcgtctgctctctgtgtacattggcaatacatggtgcattattagcacaaaaacactgaaagaagtaactcaatggaaagcaggacatgaacattttcatatgcccatattgcttcagaagttcagaaaaacagttttataccttcagaaacccttggcgcataaccatcaccgtatgacctgggaagaagcagagaattggcctgcaacaagcagaccatggccatcaaatgcagaacggacaacacttcataccatgcatctgccatggccgtttcctgcagttggcaattccaatgttagatctaatggctactgtcgggcatcatggaggaagatgacacaccacatttttaggacccaacacatacctcagcattatcctcttggttagtccagacgaagtgcactccgtgccgcaattcgctacctgcagagttcacaggctgaatcaaacgaaacaacaagattgtcaaccaacagaacaccaatccaccatatcggagcaattcctcaccttccttcaccaatcctagcagcactggcagatagtcttccagagcctgtaggagattagcagtgctcgaacctgtagaaaaaataaccaaagaaatgagaaccaatccaaattttgcaggcaaaaccagccagcaattcagatgcgctaccaccaccaccctcactcaccgtgccgcgccgccgcccgccgcttcggcttcagcgccgccgccgattcttgcattgccatgtcgacgacccgcgcccgcagcgacgacagcctcgacgaggcctcgtcgaggcgaccggcgagcgcctgggagaagtccacgctcctcggcacccggagccccgggaggaacacgaccacgtcgccgacgctccccggccgccgccgtgggccgccgccggcgtccttctccctcgacagcccacaacccatggtacgcgcgcggcagacagcctacgacttagctcacctcaccctgcaagaaccacggtgcaatagaacacccagcaatcgaaaaaatatcagttactcgccggaaccatccaaaagggtaaaaccaagataaggtataaaagaatgaaacttatcaaattgagtaaaaataaaactacaacttgtaagcgagtacggtaatttcgcaattggagagagagaattccatcgaacaagaacaaaaaaaaaagggtgaggcgatggagaaaagctcttgcctttattcttccttccacttcggctttgtgcgtttcttcagacaccaagaaccgctctgattgaacccaccaccactatcttctcttcttcttcttcttcttcttcttctgcaggctggcgcgcagcaccacaccgaacgcaaacacagtggagggacaaaaggaagcaaaactcttatcccttggttcgtaggggaccgatcaacatcagagcaagagcacaacttggcgtaatgtacggccaaattggcatacttttcgcatcgaaagaggtagtattattctgtgtttagaacagttcctccaacttgtgccatcagaaagaaagaaaaaaacttaggaaagggttgcaattgcaatgcgtcatccgatatttagcctctgatatcagcgtacctctactgcagtttaaaaaaatcgacaaagtgcattcgcaaacttttctcaaagatcatggaaacgaagctggaaaatccggaggaaaccaagaacctacctaatcttggagctggaacgtcatgcgagcgaacgttgcttctcgctgcaagccagaggtggtctagaaccacaaaatcaggaagggctcaactgttcaagtctagggactagggagcatgcaacttgcaagaagaggaaaccagagcctattgctgctggtcgagcagtcagatggagagagaggcagagagagatgtttactaggctactcctgtgtatgacttgtcctatttaaaggggagaagctttgtgatcgtgctgatgcaaatgcaaatctaccccacaattattaagcccacacaccagtacaccacacagcacagctggtcagctgcacggaggccatcggaggaaaaaagatctctcgagccctcgacgacgcctacttcttcgacggagacaaactagctagcgatctcctcctcgtctgcacaccaacggtttaatcgtcacgtgaactaccaggagattcctcgtgtgatttactactagcctaatcggggacacctgtgtggctgtgcctggtcttcggagtagaaatgtagaataatgtcggtcgccaggtacaagtactatccgtctaaatgcgttgaaactgggaactctcctgtgaaaagagaagctgccactgcttaataaaatcgtaatcgaactgttattgtacagctgtttctgtttcctacgctaatagtggtcaaccatattaaattttgcctaaattttaattctttttaaaatatacgttcgaatttcttacaactccaaagttcttttctttttcgaggtggacgtggccgtatatactagatgctgttgctgtaggagaagccgtagtatatttcaagtaggtttttcgcaggcctaaccaaacgtcacaacgtaaccaactccagaattggatcatggcgtgacataatcaccacttgtttaatcctccggatcagattaaataatcatatggctgccaccgctcatcatagtatagttgggctcagactgctacccgtttggagtatttatcggtggtcatactaaatatacgtgcttaattaaaccatataattttaatcactgcttataacccttgtgagcaagtgggttagataccgtctgcactctggagtactgccagtaatacagccaattcgtgcccaatcttcagtttgtggatgcagattcttcagaccaaatctttttcagcaaatctgcacgcgtatggatgcatgcattcgctgctgaatttggttcgtctctttgccagtgctaatcccatgcgtatctgctgcagatgccatcttgctgtaatgtggtcatgtgtaagagaaacagtgaagaatctgatggcacctaccgtgtctgctactaacaaattgtggttgacatcaacgcgtgtgtcattctcgtgccgaaaggggaaaggcacggtgcctcttgagtgttgttgcaggcttcctccttttttgtggataagtataccagcgtccttcttagcttccaaacaaaggtttaggacacaggttattccacacgtgattgatgttatcgtgtaatcagtatgaacgacactagtacatggctaatcatttgacaagcgaggagacaattcctgctaatctcttggccgtggagcaaagctgtattgtgtgtgacatagattcgtagttgtttccgctaattacaccaagaattaacagttagcatttctacctcgcagaagattgacactgtatattctgtggagtgtacggacagttccctcttatcgacaagctagtgagctgtgcaaacttacgctacaatctgtgcagataaacacagcgaggaccaacagcagagctaggtagcgtgagatacatttctgatatcacacgcccgttgctaaatcctcgctaaaagttgaacaaaagcagggagaccggcccgagcatgttactactagagcttttcatgaccttttcgcccagagaaatgataaaagccaactttatacaaaagggcgatttttagattgtggatgatgatatcgtcgcctcctttcttgttgcagtaagtcgcttcagcttagccttttctgcttgcttgttcgatgatcataacaacttccaaaagcaacagtatggccaagaatttcaggttgccaacaattgcaaggcaacaaagggcatgaacagttgcatgattgcaacgaagagagactaacacgaactgtatttgacagatggcacgatccaatcgatcccgcgctcttatgtgtaccttcatgttcataaacaatttcagaaggggaaattttgtccggacaagtggcacaagtaccagatggtgtggcccggtacattgaccttcaagctagcgatatgatcccaagtgtcaaattttgatatggcagctgttccatgggaaatatctagtgcgtgtgtgtggatgcaaggacggccacggcactggtcaataatgcgattgcaggtcaataggtgaaccagttttggagttctttattgcttaagctcgatcagatttcgttttcagtagagatgaagtttgtgaactcctaaaatgagccggtgtgagttgtgtggccagcgtttcgacagcagctcaaactcccccttgagaaaaagaacggtcaggtgcagggtgaaaattcagtccatgaatctaggtaatggaaatctgaaagaaacaattatcttttctcaaccaacttctgaaatatgaagaacaatcgattcgtagcatctcatttccagtacagttaacaacgtgaatagctatatatattagcagtactgatttcagtgtcgcgtacgatgcatatggctctggcgggaagaagcttctggaagcaggatagaaggttctggaagcaggatattacccgggagggaaggacgcgatcgaaaggtcaggtggtcagaatagcagtcaaagcttcggctcggaaggcgccgccggagctaccacggcgcgccacgtagcacacccctccctagcccctacgccggccgcttgccaaactggtccaaaacctagctttctgcttttccgtcgtgcacgctgcggccggccaggcccggggcctcacctccgtaaatatcccgaaaaggccatggcttggctgctaagctcgtgcccgtcgcatcaacccgtgtgcgagcgcgcggagcggctcggcgggtaattttcccttcctccctcggcggcaaggcagccccgtggatggcccgcgggtcgttaccacccaaaagcataatacgtagatgcatcataggtactggggtgccaccgcggccgccaccaccacgtagccgcagcggtccacgcaaacacgcgacgtcgcgcatttaatcgcgcgcgcgccgcacccacgcgtgcggtgctgcacggccccggatccgcgcggacggcgccgtggcggaacgccaccctcacgtgacggacgacgtagacccaccacccagccgtgaggctctcgtacgtcctgtggccggacgaacgggtggggtggcgcgcacgcgccggtggtgggcgtttgaccggacggttggcaccgtgacattgcgcggattggccgggcgtggaggtacaccggtacgtacgagtacgatctttcaccaggtttcgccgagcgtcgtagatagtagggtggtggcgcggtctcggccggccggttcgagagatgcgcgtcaccgtcctggggctggccggatgtgaagcttcgacaaggaggcggcgcgggccgatcgcctcaaggatggcagcgcactgtgggcacacatgtacacgcgcctggaccggcaggggtaccacggaactcgagaggtaccggccgccttggctggatttgtttgaaaacctggtgctcgagggctaaagatggtccaagacattattgcaaatattggttcgagtatttttcacgggggagggagtcgattttgtatttttcaaatttgtaggaacccgaataaatgatgtaaacttgatgtcatgcagcgtcacattgcttggagattcgtgctcgccaccttcttctccaccaacttagtaggggcttctttttaggggtgggagtggcaccattataacgaaaacactatcatagcattaacaaattaatgctctaagaatactgtagcgagtggactgatatagcaatcgatctagacaatcaatccattttactagggctgtgtttagatccaaactttagatccaaacttccaattttttccatcacatcaacctatcatacacacaacttttcagtcacatcgtaccaatttcaacccaaactttcaaatttggaagaaactaaacacagcctaaatcagacggtggacaacaggggcgaacatcccatcctatgcacctctacggatccatttctaggaaggggtgatcgtgcacgtaaagtcaagtgtagatttctactatactatttactacctccatcctaaaaaaaagtgcagccgtggatatccgtgcccaacgtttgatcgtccgtcttatttaaaaaatttatgaaaaaattaaaaatatttagtcacacataaagtattattcatgttttatcatctaatagcaataaaaatattaatcataaaaaaatttcaaataagacgaacggtcaaacgttgaacgtgaatagtacaaaactgcacttattttgggacggagggaatatgtgtttagcctaaacatgattagtgtaatactacctccgtttcagattataaatcgttttgaatttgatcaaagtcaagctactctaaggccgtgttcattgcaaagggttcccaacccctctccctcgtattccacacgcacgcttttcaaactgctaaacttttttgcaaaaagtttatatatgaaagctgcttaaaaaacatattaatccgtttttgaaaaaaaatagctaatacttaattaatcacgcgctaatggaccgctctgttttccgtgcggagggaatgagttcccatctcccatatccgaacgcagcctaagggtgtgttcggttgggctgtggcttttgaaaaaatagctgtgtgctgtgactttttgaaaagtagctgt

SEQ ID NO: 61300 - DNA, 15607 bp, Oryza sativa
  unsure (1)..(15607): unsure at all n locations
tttttaatggcagtggtaggtaattttttcctcgaaagcatgtgaaagcaagggtagaggtgtgtttgatttgtactacaccaaaagctggctttgggaaaaaaaacagttgtagcttttaggccttggtttttggattttgcaaaagcaaaagcaggttgaaaagcccaacctaacacaccctaagtttaaataagtttgtggacaaatatactaacattacaacaccaaattagttacattgaatctataattgaatatatttttctagtatatttgtcttgtgctaaatatattactatttttttctacaaactttatcaaactagaaccattttgactttgacaaaagtcgaaatgacttaaaggtcataaattgacaaacaccatgagaaaccattaatgcgatcccagtgatctcctatgtgatgtctgcagtggaagtagagattgtagtcttcgaaccgctccagggcttgtcatcgatatgtcgaagtagctggagcggtggcacgtacaagatcatcggtttgattgcgaaggggtccattagggtggtagcgtccctctactctatgccacctcgactactcaacaagggcaaccgcacgttcttgttctagttctagtcattgtctactcaatatgcattcatgattggtcttgcgtatttgagttggcaatgactacagggagggagggattagagacatgagataggagatggtttggagttaatttacaaagataaatttatatttacaagataatctattatacttattaaaaaaacagcctaaaaagtaggagattttttaaagataaattttataataataactaggagctgccgttttattaatttggggatataaattttatacttcctccgtttcatattataagattttctagcattacgcgcacgcgcacacatacatacacacacacacacacacatatatatatatatatatatatatatatatatatatatatattctagcattacgcacgcgcgcgcacacatacatacacacacacacacacacacacacacatatatatatatatatatatatatatatatatatatatatatatatatatatatatatatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttattttgttgataggtataggtatgaatcgagttattataactaggtatatactcacaatttgaaaattttgaaaaatttgagtgattttgtgtatttgataccatggtgcccgagcaccatggtgccccatatgagtgtcctatatatatatatatatatatatatatatatatatatatatatatatatatatatatatatatatatatgtgggtgcgcgcgcgcgcaatgctagaaagatgaattaatgacacacaaaaagagactgctcttcatgctatacaaatatcctatctacggtccggtcaaaaccggcctcgactcgctttgaagcacgttgggctgggagctatgctaatcgctgcacatctccagttttggacgcttccttcaaaaccatagatgaacacgcttaggaagtggacatgaaaagctgcttcttagcttcttctcgacgaatcactctcgttagcttgtcaatcgttatcgtccatgatgttgccgtattcgttcgtgtgcaggagggagcaaattcactccgaaaatgactgaagaaggatggaggcattcggtcttggattcagcatcgcttcgaatagacgcggcgaagatgatggcacgcctgggccgtgcggtccaacaggcgtccgtggtccgggccaaaccaaattattggaacacaaagccctcctcacgctgcgatcagcgagctattcagttacggcccaatcccacgtactacagctgaagagaggaccaattcccaaatcccaagtcccaagttcccaactcgatttttctcgtctcacggaattttttttcttaaaagaaggggaaagcacttgccgtgtatcaaaaattcacaatacggggaaaaaaaaacaaggcagctcgttttgggctgcctggattttgacaacagggggggtcaaggacacaaggcagcagagtcagagtcacacaaaacaaaaattaaaatggagatgcgggggatcgaaccccgtgcctctcgcatgcaaagcgagcgctctaccatttgagctacatccccttgctgtatttcgagaaaaatacaatttaaacatcctataaatgtctctgaatatgacaaagttgtgtccccgcactgattttgatctttattcgggtaggatcagcaacacagaattctcgtccggtgccggtggtggcctgcgccttgtgtaggtaaccagctctatcattttcttttcgaaatcgaaaaccaatatgaaaatggatcatacataaataggagtgaatatcataatgaatatttgtcgaaatataaaaccctctaaactgagcttttaactttttagtaagaaaacacatcttcggttcggctcagtctttagtggatggtttgtttttgatcacccctatttgactatcttaatatataggagtagtaggccctactatttgggttggaccaaattgatgtttggtaatatgggcctttacttcaaaattctaagaatttttcaggaagtttctaggcaactttcgctttcctatggatagtgcctttcatttccaagaaaaaaatcaaatttgttttcatttccaaaattttctaaaaaaaatactccgaccggcactttctgtttttaaaaataggtcaggagtctataaactttccaaatcattttcgctcctagttgtgtctatgcgagatcatcgtcagttctctttctatttggttattaccaggttgacctgacagtttacctatttgaaaggccttgcccatattactaaagtttgggcaagggcaagggtcgcggcgtcaccggacggagtttggagagttagactcaggcgaggcagagagccaacgcgatgcgaggaagaataggaaattgtctcccctgcgtccgcgtggtgtgctatgcttgtgtgtgatgcgtgcgttgcgttggtttggccggcctcagcgtaggcgcggcaaataagcagcgaagaggaagacaaccaaccaaagtcacacgcgcgctgacgcgacgcctggcgctcatttcactccttccattcttcctcctccacgtgaaactcggctattggcgttgcgtttttttaggggtgtttagatccacggtaaatttttttcccatcacatcaaacatttgaacacatgcatgtagtattaaatgttgacaaaaaaaaactaattatactgtttgcgggtaaattgcgagacgaatcttttaagtctaattgcgccatgattttgataatgtggtgctacagtaaatatttgctaataacggattaattaggcttaataaattcgtctcgtgttttacaggcggattttgtaatttattttgttattagactacgtttaatacttcaaatatgtgtcatatatccgatgtgacacgccaaaactttacacccctaaatctaaacatagccttaatagatgatgccccacgttttgctgcgggatatatgttagataatggagaaatgatgaaataatttggattgagatattatgaaaatgatttgagaatgatgatctagcatgtgtatgtttagttttagaatgaagtagattatagatataattactatatacttttatatgttgagctttgtgtgtttaatgggttagtgtggcatacttgcatataggttttaaaagtgttaataaatgcttgtatgttgaactttagatgtttagtggatattaactttatagaaataagatattaccgcaaacttctcgctatacccttgaaacggcccattaggtctttgggcctattgttctgtgggccacatcacccttccccgacataaacaatgacgaaatgtgaactggctggcagattcctgccaaatggagcgaagattccgaaccaatcgcggaagatcggaagatcccgctttgttttcttccacctcccagctctataagagcacccgcaatggtaaagtaaggtgctatctataaaacatgtacacctcagcaatagactagattaatagtaaaccacttcaatggtatgtctacatgggtatctatagctctgtaatccattgtctcgtttttctctatagactatctccatttagtagatagttttgctctctttcttcatttaatctcttccaagtaggaaaatatgctgacatggatctcttgtagagagagcttatagataaccattgtgggtgccctaactgacatactcctccacctttcgatcagcaaagccggagagcaccacaagtgtcgcggcggcagagcaccgcgaggcccatgaccgccggccgaaacaaagggagacacgcgtggctggtcgggagctatagcttttctaatcgccatgactccctctgatcacaccggcctcaccttacttcccgcgtaatcgccagcaaccccagtgggtgcatgcgtggacggactgactgattgatttgcctttgtggatttagtatttttcaacggacagctcgatatcggcgaaaccgatcgagtgattggcatcgtccttattttcgctcgctccagagtattagggatttaatggtcctcctttccgttgggattttgctgtcatgctactctttaatcactctcctccccacaaaaccgtttcaaggaaacgaaaagaaaagagaatggatcaatgggagaagagaaaaccacttttttttttctcttttcttttgatactccaacttctttaactagccacgttttcttttttaacttttttacccacatctattttccttttcttgtgctactatactacaacttctttaactagtcacatagtcgtggtttgtgtgacttttgattcaatttaagaacttaattttgtatataatttgttagtttatcttagctttcaagaaggttttgatgtaagttcatttaagtatcaattggtctagccaactatatatttagctaaattatattagattactttataaataactagaaggttcctatatatatctttttcattgtctttgcctctttctctctctccgtgtttatgtgtctaacgggagacattataaatctccgaaaattttcatatgtttagtttatttgtgtattttttttaaaaaaagtgcatgtattttgattcaatggtcgtcgtttatccaaactcttaaatatgggcggctaatatgcttttatgatatgatgcattcttatgtaaaaaagcttgttgcttacactatggctgtgtttagatccataggtataaagttttggcgtgtcacatcagatatacagacacatatttgaagtattaaacataaactaataacaaaacaaattacagaatccgcctgtaaactgcgagacaaatttattaagcctaattaatccatcattagcaaatgtttattgtagcaccatattgtcagattatggagcaattaggtttaaaagattcgtctcgcaaattacacgcaatctgtgtgattagtttttttaatatttaatactacatgcatgtgtctaaatatttgatgtgaaatggtgaaaaattatgcatagatcatcgatataaggagagagaggcctggataaaagttaatcgccgaatggcccacagttgaatgcacccatgccattctaatcgccggaaaagatatcgagattatgcatggcctacttaaatttggccaaaaagttcactgcagcccccacacaacacaactgtaagatgctgggtgcgttgcatttggacaagccaagggaaaaccaaagagttggttagctgattcatccgtgacacaaactgcaacaccaccgaataaggagcgcgagaaggacctataattaaaccgccaaccaccaggtcttgtctgctacgcgaaacttttcttttcttctttgccttttttttttatttgatctgatttgtttttaggtgatcaagcagaagcaagctgctgcgagcttttgattggaacacacgtagctcaaccgtagctttacactgatataagccatgcatctgcttctttatctaccacatggtggaggtccatccttgatttcatgtaatctattagtacgtactatcctctcctcctccattttgctttctgcaattctgctgcatgtattctgacgaacaatttgcacctttataaggctccatttcgtggcgcatgtccctgcttccacctagactgggacaccggtagagtgaaagggtgactcgatcgcagggtatcagtagttcttctgcaaatctgcaatgcacacaagtcaaatggagagtactggactagttcgagaggaatgcaactttccctctcaaaaataataagttgattttttccattttgctttttccaagtaatggtggcaacgtgacatccctcacaaggtaagataatcataaaccattttttaaggaacataattttaataagatatttaactatttataagataccattgaacccacatgttatagacacatgaaaacgcacatgtcatagactgtaagtggtaaatccttaattgtcacatcttaaaagtgacaaaaaattaaatgcttaattttaatatccatgatataaacataatcaattgcgtcgatcaaatggaaaatctttacttaccgttttcctgttctatatagcatgccacaaccgtccgaataggaaatcgtgtgattgtatcatggcatgtatcaatttgcgttgagctaatgccaagatcatatgttttcatccttatacttgtaccttcgccaacatgaaattttagtagtttattttagaaaatataatagcatcgtagcattagtcatcgatattttttccttaagtattattaatttttttacaactgggattgcttcaagatccgttcaaccctaatttatttatctaaccaccctctcctcctcaccacttctagccaacctgacttgattgccgttgtcagtctcttggtctctaccagtctctgtcaacccaatgccagccgattgccgcttcccccctccttctccacaagattcatcattgtcatctccaagtatgtcgccatccctcccccttgtcttttctcaaccatgagatgtcggatcctcaaccgctacccccaaccttctaactagaaggcctctatcactcccacagctcacttcacccgctgccctccttcgtgcctatatctctggctatcaataccttgctgcctgtccatatccgctccaaaaccactagtcttccaacacttgaccattccattaaagccattctcattggcccccatcctcttaccgtctttaatgtcaaaagcttaatccgtcaaagcctactagagtttaggcgtcactgatgttgtcaccaaaggagttcaagttatctttctacctcactcttggctagatgtgaagaagattgctaagccgaccattagatcttgatccaagggcatttatcgatagattgagatatgaggaaaatctcaattggccgaggaatatcaaaaggcaaatgttatcctaactctattgtagtagtcatggattgcaatggtcagtaatagcctcaaaataatgttggtttctaattggctagtcagacatacatgagatggttcaagatccttaggctttgatcattgagaaatagagactttgcaaataaaagcagatgattggaatttcattgctgtcaattatttacgttcccaatatgtttataatgttgcacctggtggatctttagcaagcgtgtatcatatcttaagagaatatagcatgggatagataacccataagaattatccatagtagaagatggattatagccttttttttccgagaactttatacatggggttacttacactaatgtgaatggcttatcaatgccacgacacgttgatacccccattcttttcttttgccatgcgtccgggtggaaccaatagaacgggactttgcaaattgcaaacactgaaagtaagcaggcagggcctgacctgtgtcattcttcacaacctaacttgcacctccccgactaaggaaaaaaaaacagtaaaagagctagctcatcaatgtttggtgggtcatcacttttcacacgcatatccttgttctcatggtgtaaacatatccagctggtataagaatatgatatagtgccttaaacgcatagtgggatgagctactaggggggtcatatacatagttaaatatactacaaagcacttacgactacagtaactgaatatgcatgcggtgtctgcatccatatacatttgccattggataacaatgaagctagcttctcctttccattgagctccaagtatatctaatttgacgacataccgatttagattttgaatagaccaatttcgcaccagatacatgctactttcacctttcagacactaataatctatcaatatgagataacacacacatgtcctctttatttgtatattccagtccttatctattctagctgtgcatagggaatattttccacgcaaaacccagcgcatatcccgcagtttctccaccttttctcatgtttttcttccttccttttttttttttttgtcacagcaagagtgctttagctatagtcaatggaaggccaaactaaagttatccactttgacctctgaaatcaaaacgccagctcccccaacaaccttttaactccgatgtctatctccatatgaccatatcccacgcaacaacacagagcatggtcacaaaagcaacacataaaaaaaaatccaaacgagacatgtacacattgccagatcgcatcatcactgacagggaagccataacgcacacacatgcgcatgtcctgatcagtgatcacagcacatgcatgctgctgccggccggcgaactgtcaactctcgatcgagggcgcccgccgctgatcccgccatagaaaatgacgaccgagctaacgaccgacgcgagagcccatcagctcgatcgatctgcctgcctgcctgcaggctggctggatcgatcaatcgatatatcggtacgtcggcaccaacccaacccaacccacgaggccacgatcggtggcgcgcgcggctgccaaccggggacggttgggtgatccgactcggtgcccggtaggacgcgacgctgactcagtgcaacgtgggcgtgaaggggaaaaagcaggggaaaccgcgaaagtgcgcgagaaaaaaaaaaggggggggccttggtgaccgaacgtgtgacggcgtcttccatggtcgcgcggccgcgtacgtacgtacttcttcgctcgtggtgatcgtgtagtagggggggttggacccatcgcccagtttatccatctgtttccgcgtcatccccgtcgtcagatcagcgcgagtgcgtaattgctcatacacatacacagatgcgttaaaaagagaacttggagtgatctgtgcacacataggtgctcccggcgcacttggaatatatctttgtgttaaccaagcgccggtgcgcgcgtataaagatccattcgcgcttggcgggagaggcaatgtcaagcacattcacgccacagaccttttaaattgggttcttcccacacttaattcccgttatcccttcccaaatttggtaccatgtgtccatgtcataaattatccgtatcccaaaccgtatccatgctataacatgcatgcatgtacgtgacaactggttggatgatagagtatcagtccatgcttggatgactgtacaaagctgcagtgcagtagtgggcacctcccctcccctctgcacatgcagcacagcactaggtgaggccagctccatataggaaaaaactccttttatcctgaatcccggtgggagacggtgactgttccattcaaaagtgtactggataggctccaaatctttttaatttgatccttctgaggagaaaacccttgtataaaaggcacccctcttcctcctacttgaagcacggagctcgagcaacaaccacccacgcacatcaaggagtcatctcaccactcaacgacagcctcgcacaagagcagggaggaattttcggttgttcctcgtcccaaggatcaatagatggagaaggcagcgtgcaacgagcatgtgatcgggatcccagtgagcaacagggctttcggcatcgaggagccggatttcccaagcgaaggagcagccgcctaccacgccgaggcgaaaagctctgcaaccgcgcgtacgagctccagatttggcaggacaggggacaggctcgctcaaggcatcaaagaacatggtacgttcttctccagtccatcttggaccatactacttttgatcttggatgagttcgatttttcatggttgcgaattggagaattggtactgaacaatcttttcttgatgatttgcagtgactctaggaccaaaactgtacgagaccatgaaaggcaagctgacgctgggcgcgagaatcctccaggcaggcggcgtggagaaggtcttccgccggtggttcgccgtcggcaagggcgagaagctcctgagggcctcccagtgctacctgtccaccacggccggcccgatcgccggcatgctcttcatatcgacggagaggatcgcgttccggagcgaccggtcgctggcgctgaccaccccgagcggcgacacggtgcgtgtgccgtacaaggtggccatccctctgaggagggtgaagacggccaagccgagcgagaacaagcaccggccggagcagaagtacgtccaggtggtgaccgacgacggcttcgagttctggttcatgggattcgtcagcttccaggtgaccctgaagaacctggagctggccgtcgcgcaggcgcagtgatcgatcgatctctgatgaaacaaacgtcgaagttgggtcgtcggtttcttggtcgtgtgccttgtgtgtggtctggttaatctgttgtgcatatgtggtagcgtcgtaggtgtttgtggtggattgcttggcgtttttggctttggagcaagtccggtacacatggtaggagaaattttagtgcatcaaatttcttgattggtgttggagaaaatagggcacggcaaaagtgccatcatatacatgtggtatgtacaagatcaatgagaaatccaaaaatgtttgttcaacactacatactacagtacttcagctcatctcttcttggcttttattctagagaactggtatcgcagactataaatgatttattttgtgtgtgtgtgtgtattattggaactagctaattaatatgctgaattattggcaagactgatcgacttgatgaatcaagacctttcatctgaaactatgcgtgtataacctacttttctcaaaaaaaaataaaataaaataaaactaccagcctaaaaggtataagaggaaaaaatattatgcgatctaatcatgtcagcatcactctaaaacttgttgattgcatcagtttacttccaataaaattgatcccacagctatatatctactatactatgcatgaattattggcaagagtgattaggtgcattatgtcaccgttgggcactttaattcattgaactatacttaacgagataaatatatcagaataaccggatcataataatatgaaataaaattatgaatataactcatttttaatagagaaattacgaataaaccggcatgaactcaacagggccatgctctgtgtgattggcattgccttggcttttcagaagctttattgaagagccaagctaacgtgtttagccactctcgacattgtatatctagccaccgtaactgtcaatacttaacaaccaagcaaccaactaggccagttcagttcggtgaataccatcgatcgttaatttaagtacataaaaaccattgacatcaataccttaaatatttctgttgaatatttggaaatccatgtgcagatttgtctcgtaaagtactttcataattaattttagaactttttaaacgttttgtaatggacttgatcgatgtgcagatttgtgttataattgtattggggtttttaaacgttttgtattaaaaactattggttagaattgtattttgattaccacgtcgatgtgaacttctttttaccaaagaaagtataattttagaacacaagttatagagaaacaagttggatttgtttcaccgttttaacataggtcaatccctaaatgaaattcaacacaagtcaatggaaaattttgctatagaacattcaaaatttatgtaatttgtgatagacatcacaaaaatgtgttatggttggaggaaaaaacaactaataatttagccaagtacattcagttcaaattggagatagaaattattaaaaagacagaaatgtccctagagtaacgagaatttaatctgacattgaagtaaagatgaaatatgatatctgctagcaatatactttaagtgatggttgattgagagttgcattattttttagaatcttgttttttttaaagatttcctctctccaactgttccggaaatgttctcggataaattatctgtttttttgtgttatcccatcgtgaaacttttttcgatgtccagtaccaataaattttttaagaaaagtagatatcctatagctaaaattatcgtcaatccctcttaaggattttggaagcagttgggatgggattttgaatagcacgcgaaatatgtaagtcattaatgcataattaatagagtattaattactatatagatttatttattttttaaaaaactttcatatagaagacttttgcataaaacacatcgtgtagtagtttgaaaaacattctttccaaaacaaaaaagttgtggttccctgctactctgccaaactcaacttagattctgttgggtgtgtttagttcacgctaaaattggaagtttggttgaaattggaacgatgtgatgaaaaagttgaaagtttacgtgtgtgagaaagttttgatgtgatggaaaagttagaagtttgaagaaaaagtttggatctaaactcggccatacttttaaacagaaccaaactacgatcctaagagggaatttcaggtgcaatcgcagctccagaacacctgaaattcacacccagaagaacacctgaaattcacacacagaactcggactgttctctcgtcgtatctagaaacaccacatttcgcagatgaaccgtgtggtagacattagtacactgcatgacaattgacaacaaagcatcatcattgatgttacttctcctgccatctccttaggttgtatttagatataaaatttagattcaaacttcagcccttttccattacatcaacctgtcatacacacaacttttcagtcacatcatctccaattttaaccaaaatataaactttgcgctgaactaaacgcagccttagaaaacagcaggatcgtcctgaaaacgatctcgtcggaagtgtcccccgtttctccagcgacttctccggccctgcgtgggcacgtactccgcaggaagatacgctgaagtaatccaggcgcagggacgagcccgagccccaccgccaaaatctgtttccgagcaggtagccacacgggctttccttgtcgttgtgacaacgcagcgcagcggtgcagccgtgcagcgcacgcagcgcattgcgttgtctgcgttgcacgcccgtcgcgcgcgcggacgtcgctcgcgtctgcagatccagaagcagtgaggaagcgccgggtcggcgtcgcaacggccctcctgttgccggcttaaatgcgggcgacaaggacggcgcgtgggcgcccatgcgaccgcgttgcttgccttgggcagttggcaccacagccgagcggacacgcgcgcggggggcggacggttacatgcgcgcgttaggtgaggtcggggccttgctgagtcggtgctgcgtgggatgtgaccaagacgtctgggcttggtttggtagggaaccttgaagttgaagaagcagtgcacagcacagcacagtcgtttttgcctctgcttcctccacatcgatcaatcacctgttcgccgtggatcccgtgcggccgctatctcggggaacaattctcgtgcacgccacagtgtgtgttcattcgagccataacgtctcggtgcaatgcacgaagaacgtagctatacaagtggccttgcaaagtacgagtaacctagcatcggctcggcgcagtggggcccctttcgtagctcccgacacaataccggcccctttttttcccggggatccggtgcgtgcaggaatgtgcaggcacatggggcgcttctcggaaagcggcagccggcgggcatggccatctggccgtctcgataccatagagaaatctcgaatctcgctttcgagcaatgaatataccacacctggccttcacatggaaggtggggctacctccaaaagctccatttctagccaggccgaatggccgagcggatgacgcggccactcacgaaacgagcagctgcaagcctgcaaccagcaggcagcaagaggagggtctacgccttctttacgcgaacgtggacctcgcctttctgatccaccggtgactcggccggcccggttgctgactccgcaaatccactgcgcgcctttgcgaaaaggatccaccaccccgccgcgacgcctatataggccgctctccgtggctgcactccggtaccaatccacttttccttccacgctaaggcaaacagcgcaacgcagcacacaacacaagcactagctgctcgatctcgtgaggctcgtagtaagcacactagctgcagatcgagcgaacagccatgaggaagtcaagcatcaacggcgtccatgtcatcggagtcccggtgaccgccaaggcgtttggcatagaggaggaggtgtcgttggccaggggccagtcgttcaggaaggccgacggcgatcaccttgcggtctcgttgtcgcaccccagcccttatacgtctttcggctataagcacagtaagtatatatattggtcacgatcacatcaaaaccgtcagatcaatttctgatgcacgcaagacatgtggtttctaatgtttatggtgatccttgtatctctgcaggcagcaagggtcaggttatccactgggtgagcaagctgagcagaagggcacagggcttcagggagcatggtgagttagcgttcannnnnnnnnnnnnnnnnnnnnnnnnnnnnnnnn

SEQ ID NO: 61301 - DNA, 716 bp, Oryza sativa
gactgtgattatgagggtacaactgtgccttctgcttgcattgcagacactgatttgcaaccccctccctactcttccggcaggcggcagcatatatatacatgtgttttgaagcatgtatgtatatgctccagcctccagcaataccagtatcttaccaggatgagtacagctaagctcttttcttttgcacatcacagccatatatcttacctgaagaacttaccataagatgtgagatcaaccatgaaatggttgccccttgctttaaaagcgccatcacaaataccaggcacctaacaggacatttcagaaacacacttcctggaccagatacttcaaacaatacatagaaaggaagaaagctaatgttgaagtatcatttcaacaaaacaaaacaagcatcatttcaacaggaaaataaagaatagtccaaccattgtattcagaaacttcagtccaaatctcatgtattaataagtctatactcccagcgttgcccccaattctccactcattgttttaggttacacgaaaaggctcaaacgtgaactattttgtacatttacttcaagatgtaatcctcatgttacagtcgccatcgtactacacttcaacaacagaatctaaccacaataggggttacatctggtcccaaatcaactaagtatgatatatatatcagaactccatcactggaccttctcagattcgca

SEQ ID NO: 61302 - DNA, 1360 bp, Oryza sativa
aaatttgtgaatactcaaaggagttttttttttcaaaataatagtatataagatacccctgacattgctaaagctgagatcaaacgtgaaaacaatatgtcagattttttacgaaaaaaataagcaaagtcaaatacggatcatgtgaacatattctgaaaattcagttgtggttggtcttgtgctgttccaacgtaaccaacctttcctcctcttccctatgcacatgtgaattgtcaagcaaccacaactctttccatcctctccaatcttaagcaggataacacaacgaattcttccttcccattcccattcacaatccttccttattcaacaatttgtctgatacttgcatgcccacaggcagctcaaaaagctagctacttgtttctgacttgtatcatttctacatagatagctcaaagcctctcaaaatcctgcatttcttgctcaaatggatttttcaaggcatagattcttcaaattcagatcagcagctgtctccttcctctccatgtaactaatttcaagctctcaagatcagcaagttcagcaatcaccagactagctaggctcactccttccacatatagtcacagctgctctcatcaatcaatctatctttccagcttccaggtgacaatcgagacctgaatttctgaacttttttttccctctcgtcacttcgtcagtagaaatccaaggtttatattcctctgtactactacacaacagagtgagcgtagtacgtgtctcatcagcatcaaaaagtgacatactgcaagcacgccacaattgaggccgattgatagaatcgaattccactcaaatttgcacggtggaagagaatcccctgcgtgcttgatttgatcaggatttatattggaggcatccaattccatcactcaaccggagctgtctgtctgtagctatcgccctatttctgctagctcgtggcgtgctagtttaatttcttccaaaattctccggcctcacctcgcgtcgtgtcgtgtcgcgtcgcttgcgttaggaggtgcctaagtactggcttgtcggcgtcagatgagtgcagggccgtgctgctcagaggcgcccatggcgtggatcgactgctccctcctcgcctggctcctcttccgcgtcgtcttcttctcctgccacgccaagcagttcagcatcttctaacactcgatctcagctaggctgaaaccacatatactccagcatatatacacagcaactgattaagtaagctgttgctcgccgacggtggccgagcatgtccggtgcacggcggtgcggtgaccggaggtcggagagaagttcggtggtgggcgacaacaggaatggatacgtcgag

SEQ ID NO: 61303 - DNA, 2629 bp, Oryza sativa
tctcctcttcgccgacctcctctcagggatctctctgcggagtggggcccacatcgtcagaggggtttcctggcccacatggaaaagttgactggtcaagaggtataacaaagtgttttcatcttactttccaatatatcaaaaataacgtgctattctaatctaaatatggttctagctatagaagataaaaagttgggttttctacaaatcacttgagaaggtagaagaaacttgcataaacatttttacatgcagtttggaaatgataaacatttgttcagaaaaaaaaaagaaatggtaaacatgacgtagtagcatgcatgcagatgataatattgtggcaccaacttccaaatgcatgtatacaaacatgtagcttttgttcatttgcccaactgcttttgttcctagctaggcaagaaattaaatttcctagtcaccatatatatgaacagagaaattggaagtcagacgtgcaaactactagaggtagttagctagcaaggtggttgatatatctttgtccatttgtcgttgctattcgtgccaatcctgtgacaccaatacatgcgtcagcgttatatcgatcgttttgttcctagtactagctagtggcagcttacagacagccatgcattaggttcgtgctgcttaattgtggctatatatcactgtcacaattgatctctgcagagacattttagacggataaaaattgcgttcagttagtcgtgttacaatcatcatcccggcggccagcagcataaatgtcaaatggaatattagtcatgtaacatacacatcaatcatatatcctaggcactatacatacacatggtacatatatagctcgccatttcactgtcatcgaccgcatctttattcatatccattcatttcatgcgcacgttattaactgcactaaccagctagtggtagtacttgtagtagatgatgttttgaattgactaatccgtttgatttgatgcatggtgtagattactgttactaccctccaagcagcgtcagcgtgagcgacgacgatgacagcagcacgagctcactctctgctgcagtcagcgcaatcagcctgcagcagcagcattgttcggcctcttccagcagattggggccagcatctgcatcagcatctgaagacggaggaggacacgccggacggccacggcagcgagagggggaggaggagcggcggcggaggaggatgagtcggaacaggtcgatggtggacatgcggagccagctgctgcacaggacgctggtggaggagctcaacaagcgcctcttcttcaacaccgtcggcgccgtccacgacatcggcttccgcgaccctactacttacggatcgtcgtcgtcgtcttcttcgtcacagcatcgccggagaagcagcagcaaggtcgaccacaagcaccactacatgttctgaataaactttttcagagcaaattagtactctaatttggtatgtacagaatgatcgatcagatgcagagtacgtaagtgtgcagctagctatctagcccgcggccacaaaattgtgtatatttggagagaagtgcatatatgagtgttgttcatgacaattttgccatgcgacatgtgaatgaatatatgagtgatatttgtacatatggtatgagtgatatttttcccaaaataggtaccccagcatatgcatgcgctgctgaccagagttttaactgctgaacagttcccctcaattgcactccttttgtttttaagtttcgattttgctattaaaattggctctcttttttgtttaaagtgttttaaggttaggtgagtttgctggtcgttctccgaaatcttttccaatccaagtattttccccgaaattgattgtggaaatcacgaggtgcctataaatcaagcgcccaatttttttttcaaaagtcgggcgctgtttcaccgagtagatcgaacatgtttcactaaatagatcgaaaatgtttcggtcttttaaaaagttgaaacacaaccaaataacctcatgaaacattttgctacaacgtatgaaacaacggttttcaaaaaaatcagagttgtttcaccctatttaaaaataatgtttcagcaaatagcaaaagaatgattcaattcttagaaaagtgaaacacggtcagatcgctagatgaaacaatttggttcaacgtatgtaacaaacgatttgattcccgtgtacatcaacaaaccacgtgtccatcaagatagaaaatattaaacaatataaaacccactacaatatttcatctatgcatagtgaaacatcatgagtacacttgctgaaacattgttggtggaatgaaaaatgaaacgaattctcttaataagacgtttccgtaatatatggtgatttgttgcaacggcgcgtgtggtggggatgacgcggaggcgcagtagagcgcgggtgcccgatgtatgcgtgccagcatcgggcgtccgatttgaggcatttaagtggaaatcaacaaaattttctacccaaataatcatgggctctggacacactgatagccctcccttccggggccacgtccatcgatctctgggctgcagtattgggccttggcccatcaccgcgcgtgtg

SEQ ID NO: 61304 - DNA, 2598 bp, Oryza sativa
tcaatgtgtatctagctgatcatctcctaattaaaagatagtaaatttgatctgtaattctaacatcaatgtgcatcacagcagtcagaaataattcagaaaactgcaggggaaaccaaagaataacgttccattaattgttgcgaactaactagcaaatcgatctcatgtgtatatatgtacatagtttctgtatatcgaacaaatcaacaaaaagaatgaaacaagaaaaacaagtagcgtgtgtcatacactcatacatacacaactaagatagaaagcctacagaggagggagaggaagagggcaaatacgagtagctagctaagctagtttgtgcgcttgctggggctggatggctgtggcctccctctgggcttcatgcttctcaaccaagacagctgctgctgcatcacttgttcttcagtcgtcgtcgtcgtatctgctgatgctgtctccgattcgtgcttcagctgtggctgcatcggcgtcggcgacggaagaggcagaggcctgctgcaactgccgtggtgtgcgaagaagacgagcaggaggagcagcacaagcagcagcaacgacgacgacgagctgcagggcttcttgttgcttgacaatagcaatgtggccattgttgtgatctccttgtgttggaagctaatatggatggatttgcagaggaattgaagcacaggtagctatccgggatataaatacaagagataggtagccgcagagcgaagaaaagggggcgtttcaattaaagtcaatggagaggagacgatcgatggaattattaactcaagctaagacgtgtttcctcttccaaaagattagctctcaagacgtgtggaatggaaatatggaatcaattaagccagttttgcaagctggaaggaagaagcagaagaagatgtagataaagaagacttggtgtgaggggaggcgtgcggatcaagttgaagctagctagcaacgatcgatggagggacgacgcgttttgagtagcaagctccacctggcgagaccgtgtagccgtctacacattgatgccactagtatactgtacattcttcttcactcataggctgacaggccacgtaccgactttctatcagcacacctctagcttgtaagcacgcatctatcagtaattccatttaatttgtaacgaaaatgtttagctatcgtgcaaaacgctaggccccataggcccatacgatcgaggccatgtcttaccgataatgggagtattagagttgtaagcgatagaccacaacaacaggattgtaaaaggtctcagataaaagcccaatgtttcactggaccagtagtgactatgtctttgggtgtgataatcctattgagagcgttgtcgaggtacacgttctctttctgtgaggatttttgggtgaacaccatattcagtgtatttggacgggcgacaacaacgtcttttttatcgcaaacttcgtggagacatcgtttttttagtcttctttttgtggtgttgttgttggcctagtggtgaccaacctcgtatatcagtggttggtttgggctcggtttctctcttagcagcttatgtttgtatggttgatatgtgatgcagggtatgcatgtactttgatgcacattcttcttgacaaccggttggcgaaaaagaaagaattatattcgcaatcatatatatatatatatatatatatatatacatacgtatatatacatatattaaaaaattatatatattataaaatattgtcaattaaacacctcaaaatatccataataatagctgatacatctcaaaatatatatacagaatcactgaaatatatatatatacatggagaagtcaggtggatcagcacgtactcaatcaaacagaacgagttagtgactaactaaatcacaaatagttgcccttctatctcagtattaatcttctaccactagtggagaagtgatttttagtcccagttcgtaaaccccctgtagtcccggtttttccaaccgggactacgaatccgggactaaagatcgctatctttagtcccggttcaaataaccgggactatcgctattgatttcacaccatcccctcccatatccaaatcatcacatatcacaggacatctccaaatcctcaaatccttgaataaatcatctccaaatacatcacaaactcttaaaaaatagatcatctccaaatacatcacaaactcttaaaaaaattacatcacagggttctaaaaaaaatcatcacagattcacatctcacacaaaaatacatcacagattcacatctaaaaaaaaaaagaaaaaaatccggccggcggccactgccgcctcccctcctcccctccgcgccagccggccggcgcctcgccgccgccgccgcgcgccccccgcgccgccgaacaagccacctccacgcagcccccggcgccgcccgccggcccgccaccgccgccgttgccgcgtggccccacgcgccgctgcgcaggccgcctacgcgccgtcccccgcgccgccgccttcgccaccgcggcgccggccgcctgcacgctttttcactgtggggtgaaggaaaaaagg

SEQ ID NO: 61305 - DNA, 5163 bp, Oryza sativa
  unsure (1)..(5163): unsure at all n locations
ggtgttactaaccgggactaaagatcctaggaccctaacacggcctgacatggaatcaaccgggactaaaaatgaacttgctaaagatcatttttagtcccggtttttaatggaaccgggactagtgtggatttgggtcgaccgaccaaagatggtttctctaccagtgtacgtaagtacaagatactagttaatcagccaattaatcaatacagaattactacatacagtgacatattgcagaatactacaatatacaacatgttcgacattcttttttcagtacaactgcatggccaaaattaaagcgaactctagtacagcacaatccatctgctatctgaatttgggatcagtttcatcagaaatagtgtcatgttgatcgtgacagaggagcactctgcacgccaccatggtctcacccaccttcatccccggcgtcacggtgaatgcaactccatctccttcgccacgaccagcatcggcggcggcggcggcggccacgacgctgtccatgtactccgccgcgtacctgctccctctcctcgcgtacaacatcctgacacttccacggccacaacatcgccggcgcgccgtcaccgccacccgcagcgcccacgccgacctcgccatcgtcgcgaacgccctgtagaaccacgtcctcgggtgcccgcctcgcgacacgaacgccctcacgtncagattaattctgaacatagctggctccatctctgacgacacgggccgctaagtactttgttcgacagaccctcgccaaactggagttggggttgctccatcaacgcgtccagagggtcacagcatctcatgattcgatcgaagcgagcaagatcgagttcgtcgtcgtcttcagcaccatcatgtactgcaagcattgtccgtgacaggtaagcttccagtgagtacctcttgtatggtgaatgttcgtctgcattgttgggacagcgatgatcaggtgaggaaatcaagctaaagatcagctctgcgaaatcatgcaccgatgtcgatgcaaccttgaacagctccaagactgcactaggcgtcgtcaattttttcaggacaatggagtaatccttatgatggttaactgatggtttgctgctactgatctgtttattcagtctcgaattcgcactcttcagaccatccagctctcttctcaacagcataatgtctgaatctttcttcctcgtctcggcctccagttcctgcaccagcgaccatcgatcattgataagtgacccaacgctgccattccaactgcataagctctgtagagcagtgaccgagtcgagctcgtaggtgatgatctcgtcggcgaaggcaatctttggacgattataagggatatgagctttctgcagcttgatgtaggttgacttgagagctccgatttcctcaaacagtcttgtgataactagcctctgatcatatccgccacaataatctccaaattctgtcttcgtgtcagcaaattcaggcgcggcacaaatctttgtgattttgcagagtttggagaagcctaatacgagtccaggaacattacaggtgctccttgcaactgaacttcttggtgttcttgactccattggggctgattcagtgcaaaccaagaaacaaaagaagaatctttgagacgacatgggagagtatggtaaaattatctacgagaaaatcaatgtaatcgatggtttgaacttgctttacttctctaatttgatagaaagactaacaaacctctgtttatgaccacagaccaaatgcagcaatatctttcattttctgagatgtaaacccaagaggaaaccacagactacatgggcatgatgcaaatcttgtgctccatctccactgttgaacatgaagggtagaagagcaagcatgcatgaagtacctgagagggaggctgggactgaccagtgaagtgctgaattgaattggtgcagagtgaccaagaggatagcctggtttcccccggctaaaattgaaacatttctaagtctgctgctgctgcttgcaagctatgcagagaggaaagcgaaagagcaagcaggagcagtagtacaatgaaggacaagaaatggacatggcagtggcattgggaacaacaaaagcaaaaaggttgcagagacaaggtttttgcgatgcattgtgggcactggaatggatagtgtgtgctgtcccctcccctggtggcccgttgtctcaaagcaaaagtgaaacaaagtggtaaatgaacgtattgagatgatctttcattccaaccaaaccttttccaacatttgactacttcaaaatcaaatttcagacactttccgatatactactagtagctaggtaaatatatatcacttccaacggtgatatcaaataatggactcttttctattgtcataataatacagaaatttaagtgtatgtaaccaaacttctgaagcttccaaccaattaattacatttttttctaaaaatagaaaaaatgtcagctatacacctcaatatactcttgcgtgaaattcatctgtcaattatacatctcaaaatatacttgtataaaaatactagcggtatgcataagcactgactgcacatatgtataaaggtcaggtgcatatatatatatatatatatgctctcaatcaaatgagttagtacttctctctccgttccaaaataaatcaaaatatgattggataagataaatctactcttctagtttgatttattttgaggcggtggtaggatagagttagtgaaatctgagatagcgtcagaccatgttatctgcggtgctaataatgtcatctgcggcggcgacggcgacgtcagaacggcagagcgggcatgttgtgcggttgcgcagccacttgacgacgcaatccttgtgaaacgcgtgcgcgcaccccggcagcatcctccatctcccccgctcgccgccgccgtcgtcgacatcatcctcgctctccgacagacagatgacgcactgctcgttgtcttggtcgtctttaggtcgtagcagcagcctctcgatcagcatgtcgtacttgttattggcgtcgtcgttgcggcggcggatgagtccgaccaccgtggcgatggtgagggcgaggaagcagagggccacgccgatgcaggcgaggaggaagaaaaagatgatgccccacatgagacagtccacgatatcctccgcgtccatgcctgccaatgcactgcacacacactcgactcgatcgatatgtctcgattttcttgtgtacgtacgtatatgtcgatggatcgatcatcgactctgaattggattagcaaaaagtaaatccgattctgacacgtgaccgtcctcctgcgccgcagccacggccacccttttgcttctcctcctcatcatacattcatactcatacatggacagggcctcgtcgcgcctctggaagcagagcatctcacagatcgatctttttttttatccggtgattaattaaagatccaatcaacaggcaataataatatcgtagttgatccatttctttcttgtatgtatgcagatcataacaatatttttatctcatcttaaaaggattaaaaatcaagtccgagctaacaagagatccatatattgtgcgtacagatacctaaaatacactgatgctactattttttttttgaacggaatgctactattttaggatctgcatatatataaagggtgcaacatatatagctgattgatgcttgcaacacattattacgcataaatgcatgggcggcgcagaacacaattcaagtggaattggaaaaacagaaaataaacaatactatcaagatatagttgcgcgatgctgttcttgaaagagctgcccatctggcaagcgttcgggttttccttattcacaggggccctcgccggcagcatcctgtacgccgtgtgcgtgctcctcctctgctgcgtcgatcgccgacgtcgacatgccggtgcgccgccgcctgatccgaagatctggctgccggaccacgcgcaccatcgccggcggcgggatgagtcgtcggagatggagtgcagcatatgcctgggggaactggaggagggggagaggtgctgcacgctggcggcgtgcaggcacgagttccacaaggaatgcatctaccgatggctcgccaaccgcaacacctgccctctctgccgccacatctccctcccccctgcttcatcaccaccacctgcgccgccgcctcaccatgcttctcctcctccttccaatgtactggctgctgctcatgtttagatcatcatctgaagagattttgtttcttaaaataaactaaaaaggtttcttccggcttaatttgttttgaagccaacaaaaaaaaaagaaacgtctggaagaaaaactggaagcactgatggacgattgctcttttacgtgatcatatatgttcaaaaactttactattttgatataataaaagcttagaaaaatacaacttgtgtgtgatatatggcgtcggcagccactcatccatttttgggcgttatgtaaaatttcctgcgcagcgccggcgcccgtccctctcttgcgcacgcgtaattagcaagaggactgctacagtctacagtacaagatatatagttagaaagctacactttaataaacccttctcttttctctacctgcataagcaactaaccaactacgcgtaaaacacaatgtaccaagagataattcaaggaaaatcaatagaaataatttcaattctaggaaaaatctaataaaaaataacaacaaactactcccatagccagaaaattcctacatattcccattgcccctaaaaacaagcaatcaagcgtaggaaaaagcacgcaaagtccttcaatatgactagctaactcaaatcaatgagcaaaactagcctgagaaatcacctctaaaaaatgcttaaaaaccacacgaaaaaccaacaaaaaaaacttgccaatccgattcgccaccacctcaaaaaagcctcaagaatggcccctgcgatttcttcacctcgagttgagttggttttccacaacagcacacaagtcgttgttgaccacacggactgatgaccacatggtgctcaccgcccatgacccatgagggtgaaaggggaaagggg

SEQ ID NO: 61306 - DNA, 2321 bp, Oryza sativa
tactgacatggataagatgtttaagtagatgattatttagtcacatgcatgttcggacgggagactgttctatagtattttcagattagcaatttggaaaagctagatactggtatcccgcgcctagcacccgcgacggtatcgtctccctcattccctagagcacaagcgtaggcatgcggcaacggagcagcgcaggcatgcggcaacggagcagcactggcatcgggcatgcggcagcggaggaagaagggagagaagggagctcactggagaaggcccccgctgcctcgcctcactgcttcgtcggggagcacatcaccggagaagatatgcagcaccacgggtgatgagttccggcatgggactaacgagcctcggcgtggggcgtgggaagacgcagccaccggcgaccagccctggcgtggggcgtgacaacagaggacgcggtcgccggcatcgagccccagcatggggcttagacagtggaggacgggctcgatgtggaggacaaggctagcagtgacaacgtctcggtgaccggctcctgatgcctagtaggaaacacatgatatctggcaggtatcgcgctctgtatcgacgagtatcaagtggtattaacaggtatcaacatctagtaccaatgggtatcagtcaatacctacaagtattacctgatacctgacagaaatcgtatgataccggttaggtatcagaggatatgatgataatggttaaatgccctgatacttaataggtatcaaatcctgaatcttaactggatcattccgtccaacgagattatgtatagcagttagatggtctattttttctctatagagagcttgacaggagatttggaggtacagttgaagcgatattactacttgataggtggcaaaatttggataagatagggatgcgatacacgttatcataagacccttcaaatgtgaaaattaaaatcatatataaaagtaaattcaaatgttaataaaaaaattagtttatcaaataaaacttaatttgtaataaaatattattgatcaaatatttaaaaatttgaattttaaaattcgtatgtgtcttgttgagtggatcgagcagagggggtaatattttgctcatcacctagacacttgttaagagaatatttgtaagttgtaacaaccaagacgggttagaatatatccccttcatccttaaaaaaaaatataatctatgagaaaatatgacatagtctaacgacgaatctaaacatgtataatctaacaccaattcaacttctcctcgtcggagctacaaaacccctacaggaagctggtgtgggggcatacgccgcaccatgccctagtgggtgggtccacgcctaatactcatatgagcacgtgtatacatggcgatctgactcatcagcgtcagcgtgacagcgtgtacagtacagggatcttctactacgtggagtatatatgtacatgcatgatctagacatacgtatactctagaaagaaattaaggaagagaagagagacgaaaagtcagagttgtgtggtgcggaggtgtacacatgcatgtgtgcgtgccgtgcagacgtggcagtgatccagcatcatcgatctatatgattagaggaatttttgtcactattttcattattgcgacgaccctatccaactgcagccatccatttgttcagtgcatgctctagtatattctcaattactagtctcttcccgtttcttaaagcttcgacattaatgtattcaaccatgtgaaacaaatacaaatcctagtttcttatatttggtatatggagggactatgttatttgcttcatccaaaaaccgacgggtaaaataaatttatttatactacaacacctacatatgctcagagatgataaatttcagctatttttatttgctctatccgtaccaaaatataccaactagtaataaattagatataataagtacattgtgtctaatcccgtatttactatattttcggatggtggaaaaaattattggtaaattatttatgctgatatgtacttattatacggataaattaaatattttaggaaacaaacttgcaagaaaagcttaaaacaaatagtctaaataatttaagtaaaagaacttttctttgagaaaacatatatttagagctgtatagcaaataatctattgcactgacctgatgaacaagcttgaaaaaaaagcctagaattaattaatggttataactgaattttgcacaaataaaaaaaataattacctcctcttattccttttttcttaggaaaatcgtttatcact

SEQ ID NO: 61307 - DNA, 3517 bp, Oryza sativa
agaaataatatggatcatgtattaataaaaataagaaataatttggataatgtattaatcatcaagtgctagaaacagtgggggtgagagaaatgcactactacgaaaacagtttttctttgtgggggaaaaacagtttttacgtgcggaggtggcgctcgtctgcccggaagtgtctgcaaaaataaggatttctctgtgcggacgcgaaaaataaaaatctgaaaaaaaaatcaaaaccctagttgccgccgcagctcgtcatcgtcgtagccgtcaccgccgccattatcgccgtcgccgaatccgggcggcggagggcgggagagaggtgccaccgccggatccgggcggcggagggcgggagaggggcgtcgccgctggatccacgcgggggagggccggagaggggcgccgttgcggggagagcgcggggatggccgccgtccgcctccgctccggccaccacctcctcatcggcggggcggcgtggattcgtgggaccaacggcgctgctcccggccacctcgtcaacggcggcggtcggtgccctgctcctctcgccgttgcccactgccgagccgcccacctaccgccgtacgtgagtgtgtgagaggagaggagagagagcgtgcctggcttagaggataaggataaggaggtgagagagttggaggaaggatattaggatgtaatttttgaagtgttgaggaaaaaatgagggagggtattttcgcgtgcgacggtcttaaaacgcccgcatgcgaaactcaattttcgtgtgcaccctattaagaggttcgcctgcaaaaataggtttatttttgcacggggatccttaagaggctcgcctgcggtcctctcaaggatccgcacgtaaaaataggaggacgattttttccagacgggactagttacggtccgtctgcaatctaaagaggaccctgtacaggaaaatcattttttaagtagtggcggcatcaattatgaagtgaattaattgacagactgaaaggcgcattaaagtacataaaaacgcaattgagatcccctgtagtactgcatttgcagctcactggcatgacatatgggccccatgccagtgagcagtaatacacatgcagtactgcagacgacttgcatccataaaaacgatcaatccacgctttcctgagaatagatctgttgatccataatcataatagaggaaatgccatcttatgaatgaatgaagacggaattcactcgaaattacttcttgaggcaatggttcattgattcctaagaccgtggatagttcttgaggtggatgaatgaagccaggaatttggtgcacatgcatgtgctgattcgtgttccgataaatgtaccacataaaaccatcggacgaatcaagccggggttctagacaagattcaatgtggggctgagatcaagttcagcagggggacaaaataaatcatcagaagcaacagagaacaaaatcaacatcaataatagatgccactatatcaagattgttcttacttgatggaatactccatacccacgtagaaaaaaaaataaaaatgcttgatcgtatttaataagctagataggagtattagataaaaaaacatttagtaatcactattatgatattttttggcccctaagaattttttcattgtaactttgaaacctttaattcctcgccaataatttaatgaaattgcagttctcctgcaatttaaaataaaagttactagcgcttgtttcttttcaacatagttgttgctctgagtaaagataaatggtcaaacgtcacattaagtcaacaattaatggtgttatctattaaaaaatcaagagtaacaatctacaaataaaatgggttgcttgggaagtgtgtgtagcttaactggttatattccttgtggtggaattaccccacccaggtttaagtcctagactttacacgatactactagaaaaacgatttttaccgacgttagctttttaatttttcaagaggacaaaaaaaaaaccctcttataaccatttgcgaaaatagctaaagagcatctagatttaactctgcctgcgaaaatcaattttttcagtcggaccccttaagacgtccgcctgcgaaagtataccttaagtggtccgcctgcgaaagtattttcgcaggcggaaccttatgtggtccgcctgtagagaaaatatctaagtcccatccttatattctcctccaccatccttatcctctccaccactcattttcctcccccttctctctttctctcatcacacgcctgaggagcgtcagcggctccaaggaggtttgccgccggccgtgacaacgactgggtcccaccgccagctgcgatgacgacaacgactccgcctggatccaccgccggctcgcctcgggcacgcggatccgctaccggccggtctcgaggaggggaggggaggccgcggcttggctgctccctctcttggcgatgatggtggctcaatgacgaggagtggagcgcgtcggccgtgaggaggaggtgaggcggtggttcaacttctccctctcctggcctggcgacggcaaagatgaggagggccagcaatggcttggtgatgaggaggggaggcggcagtcgtgctccaatccccccttcctcctagatcctgccggcggtagaggcgagctagccagcagtggcggcgctctcctcgggcagtcgggcagcagcggcggacggcggacggacggacggacggcggacggagggggaagggctagatggggaggccggcatcggcgccagcgagcaggggtggtggcggcggatttttttttgttcgctgaaaatatttttgtaggcaggtggatctaacgtctgtgaaaatcatttattttcgtaggcctttgcttacaagcggtcctttcccccacttgaaaaaattattttttggcagcctaggaaaatggttttcctagtagtgtgggtgctcatctttatggctaattattctttcagtgctaggcgacgtactcgtcaacagcgagacgcctgcgatgacttcattaatttcaaaatatatcggtccagtctttcggatgtgctcataggaatagggtgtacgtgtctacgtttgtaaaggtgaatatacgctcgttgtgagtttctgcgtttgtattgtgtttataaaaaatgggttgcttggtttaattggatgaatctgataagtaattggtattttcgttgattttgttggaaggaataggacatgtaacgattcgtgttgtatgtgacaccccgacgctgttgccattgcaacgtaaggtgtacattcaccagcttccctttccgttttcgagcagcaaatttcaaatgtaattccttttgtcacacgcaggcaacacaacgcatgaactccacaaatcgtgtgcaataattaattttggacaaagacatttcttggaagtggcacagatttttttcactgtcatgaaaggcttgattgatgcaaacta

SEQ ID NO: 61308 - DNA, 15687 bp, Oryza sativa
tagtaacttaagtaattatttttaaatctaaggtcaatatgcataacaacatattcagaaaaacttatgaacaagctgattgttcattggtaaaatatagatatgccgatgtcaataaaaaccgacgatgcctgaccgaaacaaatactacatgtctacatccatgctaaaattaaataagttcacttctatacatgaatttgactatattcatatttatgtaaaaaataaatttatttttgaatggaggaaataagtatatacggtgataattgaataccgctcaccaaagatccagctagtagcacacggataaatggctgcaagccaccaaccatttccggtggtccaatacctgaagaacagccagcccattgatgagtcagcaaaggatcagatcgtgagagatgagccaatgccatgtatttgagttactccaaaccaaaacacaccatcacatggaaaaagtaattaatctaacaaatgcctcaattaacattggttatgcagaaaataaagctgcagttaacggaatcagattaaagaaggaaacaactgctcattttctgtaagacagcatcacggccttcagatctataaataggattaggcaaggtgattagtgatacattatgtgctgtacctgtttcaagaacacaatgatgagctgtaccatcatcaattgtgaaataattaattaaattatcattaagccccaaaccgagccaagccaagccaaatgaatgattgctgtggtgaagggcgacgactagtcagggatgagtcggatggatatgctctttatgtgatgcggtgcccaggaaacgcggcccaaccaaatcagggtcattaacgtcaaatcattctctgctaataatgcaaggcaccattgtttcttctccaactctctccctggcggctgcctcctctcctcttcttgctcggttccccctgtataaaagagaaccccgtcttctcgctctcctcgcatccactccacatactaccactcaaaaactctctctctctacccaaacaggttttgagaaagaagtggaggacagatccaaaaagttcaccttttgattatccaaacaagtttggagtttgttacctgaatctcctcttcttcctgtcaccggaaggtatgcagttcctctctccatatcatcttctagcgtttctttctacagattcttgattgctcgcttttttccattattctcttttgctccaacgtaggggtagggccacatcagttggacaagtagaaattgatggcacatcaattgagtagatgcggaaatttctggtttttagttaaagtttagaccatgccgatgccaaagtgctgccgtttaatcgaatacaacgatatatactcttgcaatggcatgtgtcatgaggtgtttgggtttggcgaggctcagttttcattgaatttcccctccttcccatgtggccgtatcaagcctaatctttgaaaaatattcacttcatgtggatgcggaatcactagatgcagcttgactccatgcaaatcctaactcctgccatgtgcccatgtgcctgtcccttatcctgatttgcatctgaattcatttgctcagtaatttgcttgttcagtgcctaatccgatagacgtccaaacaaagttttaattaggagcagaagatccagcaatgttattttttctgaatttgtaatgtcttggtttctgaattcgtaattgactatttttattaatcacctttctgaacctgaacgaaagatgcataatgattcacatcggttgcaaatttactgaatatttcctcttatttctagtgtgttattcatagagttccgaaactcaatttcccttttttaaaaaagcttctgatttaccattccagatttctgataagtacttagttaaagttccttattatattaattatctatattatctattacacaacacgttgaactcatgtaagttctgattgattatagggaacacttatattatataagtagtaggtataattatataaaaatgcagttagtactacaataagctttcaaaattcttcgtagtgacttttgtttggttaaagttcttacagacttccagattattatacgtaccttgttagcgacattcaattactgaatctgatgcctggttttgtttgtgcagggaaattgataaaaaaaaagcagtgaaagcctcaaggaatgctgaaagatgtgcttgcatagaagaaattttccgtgtgagataaagcagattgctggttcactagtgctactgatctgctcaagtcttgatgtgagtgatcaactttcctgcactaattctacaccatttagactccgaaacgacgatgatataagaatgttgttctccattcatgatcatgaccttggggaggatggctaaagaattgcagtccatctgattggtggtcaaaacatagtgctgagatttatatctttgtgggcatggagagtagagggaagatactaatggagaggtatgagttgggcagattgttggggaaaggaacatttggcaaggtgcactatgcaaggaatctggagtcaaaccagagtgtggccataaagatgatggacaaacagcaggtgttgaaggtcgggctttcggagcagatcagacgtgagatcacaaccatgcggttggtggctcataagaacattgttcagcttcatgaggtcatggcaacacggaacaagatctactttgtgatggagtatgtgaaaggtggtgagctatttgaaaaggttgcaaagcgtggaaagcttacagaggttgttgcacataagtacttccagcaactcattagtgcagtggattactgccacagtcgaggtgtgtatcaccgggacttgaagcctgaaaacctgctgttggatgagaatgagaacctgaaattcttagactttggactgagtgcgctttcagagtccaaaaggcaaaatggcttactccataccacctgtggaacacctgcatatgtagctccagaggtgatcacgaagataagatatgatggtgcaaagtcagatatttggtcttgtggtgttatcctgtttgttcttgttgctggttaccttcctttccagggcccaaacttgatggaaatgtatcggaagatacaacatggtgaattcaggtgccccggttggttttcacgcaaacttcagaagttgttgtaaaagatcatggaccccaacccaagcacaaggatttcaatccagaagataaaggagtctacctggttccggaaaggtcctgaggagaatcgtattttgaaggaaagaactttgaatgaaaacaccaccaaaaatgttgctctggtgcttggtgtgagacgcaataaaaatgctcatgaagatgtgaaacccatgtcagtgacaaacttaaatgcctttgaaattatctctttctccaaggggttcgatctctctggcatgttcattgtaaaggaatggagaaatgaggcacagttcacttcatataaatctgcctcaaccataatctcaaagctagaagatgtagcaaaggcgctaaatctcagggtaaggaagaaagacaatggtgtagtgaagatgcaagggaggaaggagggaaggaatggtgttcttcagtttgacatagagatatttgaggttaccacttcctatcatatcatcgagatgaaacaaacaagtggcgattcattggagtaccgacagctactggaggagggcatccggccagctctgaaggacattgtcttggcctggcatggagatgaatagcagcagtcgcaagagtagattttgatgtctcaagcatttagtttccgctcctcaaattcattaggttttagctcaaatgaatttatttgtcttgcctatgttctttttagcatctatgtttttgtatctggagagttcatgttgaggcaatctatgcacaatttagatggagtctgtcgagagtaattttatgagaagttgagctgcaatataaaagttggctttgagcctttcaagctttcttcatatattcgtccttgtcctgtcataaagctatgcttgggtgcaatgttgtgacaccattagcaaggttactgcagcatgaagtatgcaattcttggtattcaccagtcgctcaagaatttctagagtttttaactttttattaccaacttgttgacgaaaattctcatatcaatagtgctacagaggtataccttatcagctattgaacataagtctttatcaaacaaataaaagaaaaaccgaagcgacttctcattctgcggacgaacaagataacacgagtgcgcaatcctacaagatagtagcaggtaggcaacgaaataccaaaaagctgcagtttcattggaaggccaaaaaaaagatttttttttaagaataaggatatccttgtatttgccaaatagccacagagagcgaagttattggtaaacaaaagaaaatataatacacatgttgaaaaatctgaacaaaagctatttaaacactagttgtgaggaaaataaattgtccctgtcactgaggatagatccaacatccaagagctcatttttcacggtactaattgatcacccaacatctttccaagatgttaataatactgctaatcagactgtccaaatgtcgactggatttggttaatctcaacaacccaatcgtagctgtgacaagttgtacatatgacaaagactacactcttcataatttcatattgcaacttgcgaatttcccacctagatgcttttgtcctttgtaagatttgagaatttttttttgctttgagaaataatactgagatatcattatatcaatgatagattcctgataagatcgctgtaaattagagagagggagaaaaaaaggttttaagataagtcatgttgtcatgcaaaattcagttctagtgttctactactatacatttatatatctttcagatgttgccagtttatatacattagtgtttgtcttgataggatatgttaaaaaaaagtctggccgacaatatgtgatgacgatgaggtaatcctttatagctagtaaagcagaacagagggaatagtagtctgaatttgcaagagatggggaaaaaccttgacctgctctgctgtcctgtcaccttgaccttattatcctcttggagaggagatggaagaaggaactaggctttgatctgtacagcttgcgtgccattgatctctgcaacgcggagacaccgccaccctgagtggtgtatacctggccggacctcgacatacctcggtcatggttgccgtttcagccgaagctcatcaacctcggctctggcagattttgtgccgtcaagatcttcacttctggtggttactacaacgactctgatgatgacatgattcactctgattttgctgcggattttgctgttttcactggcctgcagatgctgcgtccccatggtaaagatgatccaagacaggttcggatgatcgagcacaagtccatgtattagtacattttcaacgcctataacattgaatttgttctctaagaaactaatttcgagtttttatagatgagaattggtgtattgaaagtaatattatttttctatgaatcaatatgattttctttctatggaaatctatttatgatgcacattaattaatttccggtggactcacagactcacagtagcctgtaggctgtaggagagtactgactactcactactcagtggagtcggaggctgacgattttcttttcctcttgcagacgcttttacaagtggcattagtactactacgcacctagacacccaacaggttaattcagaaacagcaacgggcaagctactttgaatcgaagatgaacaaagtaagaagcctatattgaagtagtataattttaaaataaaacgttactgtccaagcatcatctgagaaaactaggttacagtccagccattttattcaaaacattatctgttgcaaggaggaaattaaaatgaaatttgcaagtggagtagtagactggggcccccgcgtcgccctcccctgggcggctcgggaggcgacgcgcccgccgccgccttcctctccccgcctcctcctccgcctcgccgccgcctgagcgggcgccggcaaagccgcgtgccgcaaggacggcggcggcagggcctcgtctcacccacattgcactcagaggccgggggagctgtgtgtggcggcaacggtggtggccagatccgcgccgtgtccggccagatccggcaggggggtggccggcggcggcggctgacggtggtggcggcggcggcagcgctggtggcggatatggcggcgaaggtgatggtgatggcgacgacgacggcgggccgcggcgcgtgtcgcgacgccggccgggctcgtcaaggacctcgctgccacgagacctctggcgcagcaccctcgtcgacgctccctccacgacgccgatgacccgcgcggcgcggatggcggctgtggcggcggcggtggcggctggcgacggtggcgcctgtggcggtgatggttggcaggccatcacgaccgaaggggctgacggtgtgtcgtcgtcggcggcagcatgtggaggcgaggaaggagtctggcggcggggaaggagaccaggtgtaggcgtgacgttgacggtgggaagatctgtggcagtggcctaggccggatcgctgaagggacaatattgtcgaccggcgatgatccttcttgtgcggattggttgtgggggtttggacagggaatcgctagcaaaagcctcgccgagccgtttggccggctgatgacggcgacaccttttggcgtcgttcccctccctgaaggcgtcgttttagcgtacccctctcctttccctaccattctccaggtgaaaaccttgcttcggcttccgaacgagcggtggcggcgatccacgtcgcgtcctccttgggggcaccgctttggagaaacttcttcgtgcaaggatgtcgttgatggtctatgcatttgctttgaagctttttagccctagcttttgatgaggccttctatttctagctccaccttttgttttgcggtggacgacctcgctctttttttgattttgttaggtggagtcggagctgctttgtccgagtgacgaagctgggcaacgatgacacgctgcattttctttctaggggttttgttgttggccgtgaatagattgtggcgcttaggcagctttggttgatgttcatcttgggaagtcgaaaccacttgatcatttgcagcatctaggttccgatggtgcatccggtttgaagtcgaagctgctgtgtcgcttggcggcaagcttggcaacgatgacacggttgaaaagtcagaaccccctatgctgttttggtcaaccttggtaacgacatcctacgttgggctccgtcagtggtttcagctgttagtgagttctggcgtgtgctgtgtaactgttcagccagtcggtggttggtttttcttttcttgtaacccgtctagggtttttactactacttattgaaaatataattggcagctctcctgccggtttagttttttttttaaaaaaaaaagtagagtagtagacttcacctatcgtgcagagttggaaaaggacggcccattgggcccaataatgaggagagttatgttaatcggaccaaagaccgcaggttcgccttcccctagcgccggtcgtctcggactgcacctccgccgccgcccgccgtcgatctccagctccactgcatacaatactacgtacctccataatatttggtgtaaactccagggaaggaatttctgctggtcggtaggtatgaggttaatttcttctttaatttctctctccatttattattgatcttctcgttgctagctgtgtttgcatggtgtgtctaatctggattagaatcaggccggataaataagtatcgtctcggcgtttggagcagatacgtaccatgggacgacgacgatttgtgaacctggtggtgcagggcgccggtggactctattctctgcgccgcatacccgcgaatcgtctcttctacccatcaacaagagcagctgaagaagcaacggcaaagtcacaagaatcattcatggaggagcacggtggcaggaagcatccaggcctccacaccatggagatgttggagaagcttccccgttcgacgttcgccttcgagccggcccccgtggatcgctaccatcttaggtctctcgacttcgcctgtctcctcggccacgagagcaggatgctcactgcagacaacaggggaaacaccgtcgtcttcgacgccgactcctcctccgtcctcgccttccccaacctcatttctcccaagaggtataacgccatatccctctccattatcaacaacgatggcagcaacaacaacaacgggttggaaccaccgccggaggacggcctctacgtgatgacccggagtcccgacgtccacagaatcaaggatggttgctttgaggtgctcaactactcttcttcctctgccgatttccgtgagatgacccctcattgggtttctctgccaccaccgcccttcgccggctgcatgaacgccgaaattacctcctacacggtggttcacggcaccaccatctacatttcttgcaataagccaatccattctacttatgccttcgacacggttagccatgagtggcgccggctgggctcctggacaatgccattccatggcagagctgagtatgtgccggagctcaacctctggtttggactgtctgctcgccacccctacagcttatctgcttttgatctcctctccgacgactcatccgtcgcagcaaaaccacccacggtgcaccatacttgggtggaccttgacatacctcagtcctggttgccctggaacattcatctcatcaacctcgggtgtggcaggttttgcatcgccaagtgtcgaaacatgaattcggcaataataaaaggggtagcgcacgagacctaaaagtggatggatgcagagacaaaggatttagacaggttcaggccctctcaatgagaggtaataccctactcctgtttggggatttgaatccgccgggtgtattatagatctgacaatcatatgtgctcctgccccctagagggcctccttcccaccttatataggatgggggcaggattacaagatagaaaccttaaccaatacggtatcggtttcctaaatctattttacaatattattaaatcaggactttaggccgctccataatataaaaggaaacgtaatacccaagtcatgattcgttacatattccatagatataagctatcccctatgactagtcggataaccatgccgtgtgggtatggggtacccataatctccacagtagcccctgagaccttcatagtcgaaaagataatgttctctcgaactagattactccaaagccgagtgcttcaatcatctttgccatggtctcccgagtacttttaccaaatctgaagactgtgtagggctggaaaataaagtcaggtgcatcgactagatgcacctaataggtgtgtggttaattgaacaaaccaagcatatagtcaaggaaaataatccaaccaactgagtgatttcgataatcgtagtcaaccaagagacttgatattaatatatagcatatgcggtgtgaatcccccaaataacatgatccatgtgatataccgactgcgttgtaaaaattgatgcgagcaacctaaagttgactacattgaaaattcacatagcaaaatagctataaaaagagcttgatgttgtgaataaagaaacttccaaagtattgggcatacaccatgcgcacactgctttaacaaatgtgcttaagtccctaaaagacacatgatttaaccacacctggaagtatatggcatatgtggtgtaacatccgagtaaataaactcataaggatttaccaaccgtatggaaaatgaccaaaatatataatcagcctaagccataatattggtcaataaaaatgcacacttacgtggcaaaaggcaatgatattgtatccaatcaattgctttataaacccaaacagcgccatgactatataaaaaagtcagcggggcagctatataaagctttactgtttgacactttttaagatgcattgtaccaactcctaaaaagttgagtaactgtggtataaaaggattttaaggtattgagcacttgatcacccgcactttagcctaagcaaaaagtgcctaagtccctaaaagaacgtgacagggcacacctgaaaatatgggctgcagacatattaggcctaggccaaaaaatatgccttcaacaccctttaaaggatggcgcatgtaacatgctcccgagtaataaatcttccgggtgatatagaccaagtgtagctcataagaatagcttctgatctgagtgattatctcttatggggtactccaaaatagatataaaaattgaatcccgactggcgcaagtagtcggttgatagcccttgtggggaataatgaatagtccagccgttaagcatatgaaatcgactcgtgaccataaattcatgttgaatgtatccggaacaagtccaaattgaagatatgatccttgtgattgagttgataagcccctaagcatatatggcttgtccttctgtcatagtcaaaattgtccattggcaatagctgatgcagtcgacatgaaggcaagatgatgaacatggggatgatatcgcccgtcagaggtgacaaaaatgttggtggtggtaaaaacggtgacaccaatcaaagatgatgaagtcgcatagccatggaggcgaagaaaccagtcggcagcagttaggtcagctagcagtgaagatgaagacgcccaacaacaacgacagagtagtcggtggcgacgaaagcaagccgacgatgaagacgtagacacgtatcgatggtgatggcgaaatccaccaattatgaagatgaagaaaatagtcggcgatggcaaacgcatccgacggtaatgatgattagcggcaacagagatagccggctatgatgacgaagttgcccatcaacggcagcagagtaggctatgttgaagagacttgacaggatgttgatgaagataaccatgtcgttgatccagtcaatagtagtgtagcagtccatgataacgatgagatcctctatcggcagttgcatagtaggccacccgtgaagacgaaataacaagtcggcgatgaaagtcggtgatgacaaaagcaaccgacggcgaggacgtagtcaccccttagcaacggcggagacgtcagggccgatgaagtaaacgtgctggtgatgatgtcagtgacaacaatccatcaaaccattgagaagatatcgaagcttgagaagtttccttgatgtgagcgtgtgcataaagaaaactgatgcaatgcttcttgatttacgaagatgactgtagaacttagtgttacagctgttgtagatgcttcacttggaggaaagtagatgttgttgtccaactcgtctaaaccgagctgattggttgataactccaaactcccgaacatgtagattaaatcttgaacttgatacttgagaattttggagtagattatggcagcgctgagaagccaaaattgtcggtgaaataattgaagttgctgaagtagaacatctgctccgaagcaaagatgaagacaatgactcctggataaattgattgcttcagcttgtcgaattttgagagtcttgtatttgtgtagctcccgactctttggttaattgggaaacaactgaacatagagtcgagaactgtagcttcttgtcatcgagtagtcatcacttgagtgaagatacatgttgaagatgtccgagtagaattcttgaaaattggaaaaccacttgttgtaataatataacacgacatcatagttgataatgcatgccgagatgtcgaagctcctatagacgtcatggctggtgaaatagcaaaacttgcgaagtagcggcaattgagtttgccgatgccgaagataataaagatgaagtcgctccaccatggtgacaaagttgcaaagccgtgataaagtgaacacgagtcagtggcaacagaagaaaaccggtggcaaagacgtgtagttgtgaagatagatactccagtcggcggcggcataaccagtcggcgacggaagacgatgatgtccattagtagtggtagcggtataaaccagacatagaggcgagggcactagtcagcaacagacgagacaactagtgatgaagacgataaggccaatcaacactggcagaatcatgcagccatgggagtgaagaaactagtcggcagtagacgtagatagcttgtgttgaagatgatgacgcctattagcggtgatggcgacgtagccagccgtgaagaagatagcatcagttggcgtcataataggccagacgtgcaggcggaaacaccagtcggcggcggacgaggcggccggtcggtgaagaggtagacgcccaacaacggcggcataataggccagccgtgcaggcggaaacaccagtcggcggtgaacaaggtggctggtcggtgaagacgtagacgcccaacaacggcggcataataggccagccgtgcaggcggaaacaccagtcggtggcggacgaggcggccggtcggtgaagatgtagacgcccaacaacagcggcataataggccgaccgtgcaggcggtgacaccagtcgacggcagacgaggcggccggtcggtgaagatgtagacgcccaacaatagcggcataataggccagctatgcaggcggtgacaccagtcggcggcggcgaaagcaaaccggcagtgaagatgtagacgcctaacaacggtgttgtgaccaaccaaccgtataggcgaagacaccagtcggcggcgacgacggcaagccggtggtgatgttctgactgatccattcctggagcgtaagagataagcttaaagccataaatcccttttatgcatatctggatttggatcctacagaacaaacatataggatgagtagtatctgatgtaaatataatacttgagaaaaatgcaagtattttaaaatgtttataaatatgtatttctcctcttgtcaattttgatttccccgagcagatgactccttacgtttaaacactctgcctgactagtcatagcccccaagcaccgggagttggcctaggcacttcccaaacatgcatataagtgacaagagttcgtcattaatggaacaaagtttcacgaatcagtatttactactcgggtacttttgcaattgtaaagagcagaaaataaatttatcttatctccatgcttttgatttattctgattaatacttagcaccttgcgttactcggtccatataacgagcccccgggtgctaggaatcggcccaaaggcaactatccatcgacaaaccaaacggaaagcatacgaagatagaactccataactcgataggcacttttgtactcagattatgtcgcaagcaatcaagataaatattatgaaaaattgtttaaaaaatatgatataacatctgtagcccccgactcactagtcaacggcaaaccagttgatgtagtgaggcagaggaaaaggaaaatatcatataaagaagaaaattaattatgacttagctttctagtctttcccttggtgacgaccgaggtggccgatgtgggaacaaagtcatccattaatagcaatgaaaacaccagccatagaagcagcttgaggcaactgacgatgaaagtgaagatgcccatcaacggcggcataataggccagcagtgcagacggaaacaccagtcggcggcggcgaaagccagccagtcggtgaagacgtggacgcccgtgaacggtggtgtgaccaaccaaccatatagacgagaacactagtcggcggcggcgaaggccagccggtcggtgaagtcgtagacacccaacagtggcggcataataggccagccgtgcaggcgagggcaccagtcggcagcggacgaggcggccggtcggtgaagatgttagttggcaacagcaaaggtagccgacacgggtacatacaaaataaatcaatgaacagatcatctgcttagtaccacgtaaaaaaatataggtataaagaagcttgtgcatgtatgtttgcatatatcaatgcatatacacggcttgcatatattgattaattagccaactaatctcctgtggcatgaacgctagacacatccacacatcacccgacaggtcctgccatgcgctcgcacagatcgcaggtccgagtccagatcaaatccccgtcagaagcttcttgagatggggatcggacacgttcgactagtggtgcatgcaaaataataaaccacagatcaaatagagattagtagcaaaaagaaataaaaaagtatagatgattatggatgttaatcgatgcatgtatgtttgcatgtagatcgatgtgtagaagaagtcggtgtgtcagccagcttgccaggaaaagcattgattagctattaaaagaaaacagatgctttacgatctctatgcatagcgttattaggtaaattgtgcatcttctccatagcttgcatgcatgctcctgtttgcacacgctggctgtgcatgcatgccgccatgaacgttccagtggacatgtgcttgtttgattcgtaaatcaacaaatgcacgaatttgcttctggtcgtcgggtgttcctatgccgaacctgcggcatctccatctgcaaggaaaggagcactcggacacggctaggcgccaaagtaggcgacggcgatggctgtgtctcaattttagccagaacgtgaaaataataaaaataacagtagattaaaaaatcaatctcataaaaataagattggaacgacaaacccgattgaagattagagccactaaaatcaataagattgatctcagcgtttcttctgaagttgattccatcgcacttttcgacgggtaattcgacgcaacccctacctggcgcgccaactgtcgaaacatgaattcggcaataataaaaggggtagcgcacgagacctaaaagtggatggatgcagagacaaaggatttagacaggttcaggccctctcaatgagaggtaataccctactcctgtttggggatttgaatccaccgggtgtattatagatctgacaatcatatgtgctcctgccccctagagggcctcctgcccaccttatataggatgggggcaggattacaagatagaaaccttaaccaatacggtatcggtttcctaaatctattttacaatattatcaaatcaggactttaggccgctccataatataaaaggaaacgtaatacccaagtcatgatttgttacatattccatagatataagctatcccctatgactagtcggataaccatgccgtgtgggtatggggtacccataatctccacaccaagatgttccattctattttgggtgatcgcacattttgttcctactctgacagtgacgatggcacaattgaagactctgacccaattcatgggagtttcgctatcttcactggccttcacatggttcgccctcgtg

SEQ ID NO: 61309 - DNA, 5208 bp, Oryza sativa
aattcactttggtatttgaagcaacgcagctttaatctcatatacatatgtccatgtttctagctacctagtggtctatatatcagagactctacttaattggattggagtagtaattagtaggattgtaagagactcttctaaattagtagtggtttctaagcaattaatatttctaaattaatagtacctaataagtgccacatcactgccacatgcgacgaagacctagtcaaaagaggcacgtaggttccacgttagtcaaaatcggggccaataccgccagagggcatcgtttgcactggttttgtaagtttaagtttggagatacattgtatccgttttacggttcaagaatgattttgtaatttggtgataagaggagggacctctggtgtgctttttccttaaaaaaatggagcaccgtaccactcgagtaaaaagtttgtgggtccatgggccaaagacagctgagcaatccctaaaagcgacgattttcttttatattcactactacaaaacgattttcctgtacatgcccctctttagattgcaaacgaaccgtaactggccgcgtctgcaaaaatcgtactctattttcgtggcgggtccttaagaggaccgcacggaaaaatctaattctgcaaacaacacttaagtggacagcaagcaaaaatgaacctattttcgcaggcggacctcttaagtggaccgtacgcaaaaatacagtttttttatcccatcccctctctctcttttccctctcactcacttcaattttttcaccttctctctctctttctccctgcctttcctctcctctcctctcctctcctccaatccaagcgcgtggggcgcgggaagcggctagctctccgccgacgacgaggcagcggccgagaacaggcgggaggccgtgcggcggttggtgatcggcggccgagcactcgacggctggatccatgctgccgccgctgacgacaacgattaggcggctgggaacgatgggctcaggagcggcttggtggatggcggaggccgtcccccgcccagatttgacggcggtggcggcgagcaggcgggctcggacggtagggaggcgtggcggcggcagatccggcaacggcgacggtgatgacagcgaccaggaggagggcggcgacgacggcttctagggttagggtttcggatttttttcttttttttttttttttgcatgtgggcaacataagcacccactcgcgaaaatcagattttcgtgtgcaggtgcgccacccgcacacaaaaatagcgattcttctagaccctatggcgcgtgcggttagcccttcctcacacgaaaacccctttcggaccgcacggaaaaaaatccttttttagtagtgatttattttttaaaagatttacaaaactaaattaccagttcgaagttatgcagaaatgtactccttatgtcctaccgtaggacaagacatataaaacgagacatataaatcatcctatgcttggacgagaaatgtgacttggcaaacgaccggataggcgtgctgtttaaattttgcgagcaaggtgctgcctctgaaaaggcatgacgaaatcgctctttgttagggcaatctactgttgcaatggcttatctagaaaaaaaaataagttgggtggcaacggacatattttacaagtgccccctcccggtaataaatcgctctgcaggaggatgagtctcacatttcctattctacggtaggacgatttatatggctcaacgcaccatagagaggaggagtatattcatgcaaaatttcaaaacggtaatttaatttttattttactaaaaaaataatataagaaaaaatcgcgactagcaggacccagacggccctaatccgtgccatcgcgctgaggctgagcctcggcagccgccgccatccttcctgacttgtccaaccctcctccttccttcctgtagattgcacgctgcccctgtagatcagcagcttccatctgatctgcatcccggccgactgtcacagattgcaaggaattgaaaggaaatccacatcctttgctgctgctgctgcaggtatgggtttattttgctccatccattgttgtttcgttctattggttggtctggttgctcgtcgtgttttgttcagggttctaaatctcccgctaaactgccgctatctcccgctatagctctttcagaagagtttcagctatttgctctcatgtacaatttaaccgctatagatccatttagcccgctatagctgtttgagaaactaaccgctaaataccttagcctgctatttaaaacattggttttgtttcttttattcctttacggaattactaaaattgtgtctccacaattcttggctgattatagtcagatttatcaacatcatatcgattctcagattcgttctattgcacgcatgcaagcccgttttgaaggccgagttaccaactgctcttagctggcatttttcttcggtcaatgtagtgtatgataaagataaggttaaaaggtagtcacatcaaatttgaactacaattacatgtcacttacattacagttacaccgtattaaaaaatgtaggtttagttctatgtgcatgtaaatttatatttttatctatttttgcacagaccttgcctgctagctttggtttttagctatgcagctagtagttatgctataagttcagtactgtcaaattgtttcatcagtaatgagcttttgttttgtgtgttacaattgttttgtcctggccgttgatctgtaatggtgaaaaactgactgtttttaggctgaaattgtggcaacagttatataggcactcccacccaacaatagaaatatagaatcatcccatcagataagaagatcagttttggttcggaaaaagatatggggaggcgatttctgaaccttgtggtggagaacgcccgcagtggactgtattctctgcgccgcatacctgcaaatcatctcttctacccatcaacaagagcagctgaagaggccacggcaaagtcccaagaatcattcaacgcgtacgttaaggagcaccatggcaggaacacccaggcctccacaccttggagatgttggggaagcttccctctcccatgctcaacttcgaaccaaccccctgggatggccagcgtcgatataggaatctcgagttcgcatctctcctcggcaatgagaacaggatcctctttgccgaccacagtggacataccatcgtctttgacgccgactcctccaccgtctttgcctttcccaacctcatttctgacaagggttgtgcagccatttccctctccatcaaaaacaacaacaccaataagaacattagtggcggcatgtgggatgaagacagcctctacgtgatgtcccagagtgctgaccctgaaaccaaggattactgctttgaagtgctcaactacacttcttcctgtaaggattttcgtgggaggactccctattggagttctctacagccgccgcccttcgccaactacatgcatgccgacattacttcctacactgtggttgacagctccactatatatgtttcttctatggagccagatgctacttatgcctttgacacagtggggcatcagtggcgtcgcctgggctgctggacaatgccattcgatggcaaagctgagtatgtgccggagctcaagctgtggttcggactatccgtcaaccacccctacagcttatgcgcttgtgatctcctctccgatgcagcaaagccacccacggtgcagcagcagcacacttgggtggacctcgacatacctgaatcctggttgccctataacattgacctcatcaacctgggcagtggcaggttttgcgtcgtcaagattttccgtcatatggcagatgactgcactggtttctccgattacgatgacgatgacgcaatggactctgacctgattcaagggaaattcgctgtcttaactggcctacagatagttcgcccttgtggtaaagatggtgatgatcaaggtggtgtccggatgatcaagcacaagtccatgtactacaacttttgggactatgaaatcgaatgggttatctgaagctgagggttttactataaaaaaaatgggaccaatctagaaaggactagattgattttgaattaaggagggggtgaggctcgaacccggaccggctagctcgcagcttgcgttgctagccgggaagaccccaggcctttctcatgagggttttactatcaagcagctatctagaatatgtgccctaatttcattttgatatttgaagcaattaattctagctttaatctgataagctttatatcatgcacgtttctagctagctagtggactgctgtaaaagaccctagttaattagtaattaataggattggatttctaaattagtagtggtatctaggtataatatttctaattagtacctgatatgtgtgtacccattctaacgcaaatcgaattggttctgaaactaatatcattttgctatatatgaagcagaatgggttcgcctaaactgatttcattttcatatgaaacaatatgcttcatttgatatgcaatttatcatccatatttccggtggactgtaagggactagtgagtaggattgaaaatttggaactctaaattagtgcatgatctgtaagagtctactttgctaattgtatgaagcagtatcactcttgctggttgtatcttcaagagagctatcttgtcagaaatggaaaggcagagaaaacagtggagactgaagatttttccttgtcagctgaactaaatttggccaagtgttctatctgaaactaatattatcgttatgatttctatgaatcagccaatatggcctaatcttattcattttgatactctgaaaactgaagcaatgcttttatctgatatgcaattttgcgtccacatttctagtggactataagagactaatgatcaagtaaattagtggtggtatacttaacagttaagtaggattggaattctaaactagctagtggcatgaaatattctagtgtcttttggccataactgaatgacattactgggctggcgtgtcattgtgctagctagttagtggtacagcaatatgtatcttactgtcatctcctgattttcactacctctctgcaaccagaa

SEQ ID NO: 61310 - DNA, 1546 bp, Oryza sativa
gggcaacgagttcagtgcggcagatgcaacagcctcccgagcagggggaaatcgcaacggcgaccctaggggaggtaggcaaatgcagggacgccggctcaactactactcgacctcctcctcccttctttctgtgctagtacagtagaggcagtgatcgtcggagtggacgacgacagcggagacctattggatgtcggcggcggcggactgtagtcagtgccgtgctcctcccaactcccctcagcgcctccactcaagtcgggtcgtcgggagatgttgaaaaagattaacccgtccattgattagttcaatcggatttttccttttccgatataggtgtatatgtttgtttgcacagcagtatcgcagagggcaagatctggtttgggaggtattcacgtgttctccctcgaatccctacccattcaatttttcttttgtcttttctcctctttctctcgtgctcatgagaagacagagctcgcagtccatggcgactgcctcgatgcgccacggcggcgcgacggcctcgatgggcggtggcagcggcagcggcgacagcggcctcgatgcgcgatagcggcgacggcctcgatgcgcgacggcctcgatgggcgatggcggcgcggcgtagacggccggcaacctgatacggtagatgagagagaggagacctcatttttgttagcccgattatacccctcttaaaccaacggttagattagattggtacctcgtacctcatagtacctcgtggtacctcttcaagtatgggaaagatgctaatataaataacttgtttgttttcagacaatgtaaatatgatatctgatataaccctttaaaagggccaagtggttcggttgtcttctggagtagtttatcttctagcttgccaccttagctaatttccactttatatttgggctgttatcttttggtttaggggtgatagatttaaaatgttctatctgttatctccttgtaaggtggtgtcctctacagttacctagtggtaccaaaaaaaatccttactatgtttctttcaataaaagcatcaaaactcctctcctttttttcaggaaaaaaaaaggggaaagggggggcaaatcagttgagaagggcacattttatcagcatcagagtttgtacagttatcaccatatatatagagtagatgataggggagcaatccaatcagaaaataatcaacattcttgctggttgtcagctaccgtgcaagaaccaagaagaaggccctgtattctctgtttcgccttcatctaatccatctgattccaccgccgcttctgctaataacttgttctctttgattcgattgatcagagcgacagatcgatgggtcgacggcgatatctgaatctgttggtgcacaacaaccaccacgacctgtatttctgcaccgcatacccggtacccgccaatcgtctcttctacccatcaacaacagcagccgaagtagcagccatggccaagacacaagatgcaaccaagtcctacatcgatcacgatggcaagaggc

SEQ ID NO: 61311 - DNA, 5199 bp, Oryza sativa
  unsure (1)..(5199): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttcatcatgtgtttgcagtgatttgttttcctgatagaagcatgatttgcatcaaatggatttgcagattttacatggtttcttctagtggtaactcgattagaatttggcagttactagtaggtaacgatgcatcaattgcggattcttaccatgcagactgcagctctgacaaacaaaacgtgaaacgcactaaataaactaaaagactaaacacgggtctcaagtccttacccatataggaaaggaaattccacctgaatcaagcaaatttcgcacaattgggtaccatgctgatttcggcgagggaagaggaggatcatctgcctgcaaaattgcaggcttagcacgaacatggcagttaaggtggaaggcttactgaattcggggcggggccacattctctgcataattcagtagtactagtaaacagcccaacaaactggaccattgatccagaaaattaaacaacctgcaaattcgacgtgaatcaagctaattgcacataattgtcaccgaggatcaacctctgcaaaattgtaaatttaccatccagtggggaagtttttggtgaaaggcttactctgcatatttgggaacgattttgctagatctttgtcaacagattttcacccccaatatttgtcgtttttctatccgtaggatttgcgccatgattcgtgcatttccctgtgtggatgagaccgtgtggcgtgtgagcagatggcctgggagtcaatgtgggccaacccatgttaaattttggattccgcgctattatgtccgtaaccgttggttgtttcctcgctctctttctttattctcgctctttctctaaatctctttctcctctttcttttctcttctcgttttctccgtcgagagagagagagagctcgccggcgagagagagcacgagcagctccccggcgggagagagagagcgcgcacgctcgctgggggagacaactcgagagagagttttttttgagtttcttccctgatttgctggcatcattagcttgtgttttggttttttcaatgtcaatagggctaggtttagaagattcgggtcaatatatgacgattttttttgctcccaacgtatggatctgattcagaatcacttgttttagttttggaatccgtttagattttggattccctaagtttttagttatagtttgattcagttcagtctagggtgttttgttactagtccattgtttgcaaacgaccagattcgatggtgttctatgttttttttctaatccacgagggtttttgtatttttggttcgatttttcttcaggggtgttcatgttgggggttggattcaggggtatttgatggagttaaaggtttaattcgaggtggttttaggggttttttctaatcacccagatagttgatcattttttggatccctgcatgaattttcttcagggagggggtcagattcatgagttgattatttttgctttgatttatgtgtgatttgaatatagtagggaagcatcattgcaactttatctgaatgttgcatttcactttcagtgattagttgactgatctgttaaactccttgcatgagtctgaatttttctgcatgtgaagcatttcgtttcagagatgatttatctgtcaactccctgcatatatctgaattcttatgcatctgaagaatttcgttttacatatgcatgctaactgaaccccaagtatgttttgtgttgccttctgcagcatatgaatcatttcgtttcagagatgtacggtttgatttcccagtatgctgagttgcttggttaaattaaacccaaacccctacatgcgttctgctttcttcagattgtattctactgtactatttggtttataaaattcctgtacatgttctgaacttttcagtgctgatctaaatgagttagcagcaagccaatacctgaacttggtccctgttgctttgagaaattatgggctattggttgcatctgctctttcttctcttctgaacttttgttcattgtcaatcgctcgtaaatcgtaaatctgtttgaattggcgctatttctgaacttgggaacataattggcactatttctgaattgggaacaggggatagcacgctcgtaaatctatttgaattgtcagtattttttgaatcttggagcaggctattgaacagtttcagtcgacatgagctttttaaaatctcatacttcagcaaactgaaaaataatttggagggtttcagtctaatgttgatctaatgcatttcaatggtagcaaaaccaaggtcacttgggtgcctggaggtattcacatgcctgaaatatctgtatgattttttttcttctttattctgaatgacccatcgtcccatcccaatattgttcccatgttaattatgtgtggagcttgttagtcagttaactcatttgctgtgaaatttaatcgggaggctcaacaacaacaccctgtctggtccattcccttctgcatcagctaacttgtcacatcttgttgtcgagtgattttaatatatgtgcacagaagtttgagatatgtgcaaattatgtacaaaatttaatatatgggcaaatttgtacacaactggagatatgaccgtttggaccacaatgctctgttttttttttatcctaggctctaatctaattgttgtgctttgttaaacaccactgtctgaagatgattttcacttgaggaaaatcttcagtccattgtgacaaagtgactccttttctgaagaaattctttattttttgaagaaattcaagcatgcttgcagttttagcccagttacagtctatatgtattgtagttacatatgtaacttttgttatttctcactgtaactgaccgtagataaatagttctttatatatttgtaacataatttagagcttgttatactaggggaaagtgttttaatgttgctgcatgaatactgaatttttaaagaaatttaagaatgattccatttacaacccagttacagttagatgtacagtagttacatctgtaacttttgttatgtctcactgtaactgactatagatagatagctctttatatatttgtaacataatttagagtttgttataattggggaaatgttttaatgtcgcagtataagtactgaattttttaagaaatttaagaatgattccatttacagcccagttacagtttagatgtactgtagttatatatgtaacttttgttatttgtaactgtaactgactatagattgatagtttttgttacgagtttttctgaaaaagttacatacttttaactacttgatctaaagaaatttcctattccaagcacttttctccaaaagaaattcactattccaagtgcttttctccaatatttttacagaactgagttgtttttgtttgatttaaaagatgactggcagaatatggtgaagtcaatggggaaaggtaaaggtggattttgtgctaggtaatttgttacctggaagattatgtcttgttgatttcaacttcttgacctcaatgttcttggtaagaatttgcttcttcttctttttctcgttctcctcactgtctatggcgtgctcgatttgttttgctcgatctaggggatttgtgcgaactggtgtggtctccctgtgttattttgttttttttctgacctttattggatgtgaagttgatcattatgggccgtgatgtatttgcagttatggcctgtataattttttgtattgttctatgggctagaattcgagtccatgtagttttgtgatctgactagtcagagaaaaaaatatgtagcattttttgtgtcctctggatcttaatctaacggtaggaaaaaatctgggtgattttgacccaaggatttgtcgacaaagacatagctagttcctttgggaaagaataaacggcccaattaacttgcacatctatctatggaataagttcactagacgtccctcaattttacataaagtctgcctgacattcctaagccccaatacctgaaatctccacctctaaactatacaaaaccatgcaatttggatcctatagcgctatgaatctctggttacgctaatgtggtatcatagtcagcaaaaaatgaaaataaagaaataatggggcccacatgtaagtggaaagaaaaaaaatgtggagtccgcatttcttccttttctcttttcttcttctcttctcttctcttctcttcttcagcaagcctggaaggccaccgatggtagagggtgctgagcggagtggcggcgggcatagcgacggtagccaactctagcttgcatagtgcttcgacccaccccatgtcgctacggtagccgccatcagcaccgattccgaggctgccgctgtgatgaggacatcacttcgtcggatacgctcataacttcacacgctccaatgataattccaagtccaagtccagttcggcctccggagacagcactgacttcaaacggacctagcgccttcatgccaactccgatttgagtgatcttggacttcgtggaaagcttatatcgctacctttcaaacgcatctggtctcatgtccaaattcatctcgagtcaacgggaatcgccaaaacaagacagtgctgttgctgaaaccgaacttaggccttgggccttgtaatagactaggctcatctcgaaagtgtcaccctccacctccacgaattagcactgaaccctagctttattttcctctataaatagctttgttcatcctcaaaaacatttgagttttgtttagttgaattttaccaagtgccattcaccttgtctctagtcctcgctcgattagtcggcgactatagattcagagcccccaatagttggtgtgttgatttgccgggtcgattagatctaccacttcaatcgtaactattcct

SEQ ID NO: 61312 - DNA, 15625 bp, Oryza sativa
gtagttttctatgtaactacacatccacacgcacaagcacctggttggttggtctttggtcatttgatttttttttcttctaggcttgagtcctttgtaatcttatttaccagctattccatttggtagataccgcttgccaaaaaaaaaaagaaataaagaaaagtcagaaggtgcaaaaaaaagaaataaagaaaagtcagaaggtgcaaaaaaaaaagaaaaaaaaagagccgcaccaaaaaaaaaagaaaaaaaagaaaaaaatcagaaaaagaaagtgtggaatttttttttgttggaatcttagagagagttgcttactatagcgagttgtggattgtccgagtgtgatcatttgcttgcttaagctaggattgagtctaggctacgccagcaattttgactagtactttggactattattcaatttcgcaaatctgtttgatttttgctattccttgtgatatagttaagcctaccaagatccacatactactaatctttacatgtacgaccttgcaatcgctccactcatcaagcgtgtcattgtgccacgaaccagccacggtgattgacctgttttgcattctttgagaatattataagaatttggtatatgcttgagtgttgagtgccttcaaaagctccacatatatatagattgttaggaactgacactttcttgtgagtttcttttgcttgctaacgatgtcaggtacaagttccgatgaaccaacactgaagaatctagcgcataaactgaagggcatggaaaattggtatgaagagttgatgcgtaatagtaaatcatacaaggaaagcacagataaacatttaaaaaccttaagtgaaagcctggtgaaagtagtagatcaaattgagcaaatgaatcgatcacataaacaattaactgaaaacattcagaatataaatattggacatgaaaatattgtgcgacgcattggtttacttgaggctgcaggtgaagaaggtgtaggtgccactgctcatcgacaccaaagatatgacgatgaagacgaagagcaatctgttgctgatgatgaggaggaagacgagagtgttggaaatagaagacgacgtcgaattagggacaaagatgatcctttatctaaggtaaaatttactatgccttcttttgatggtaagtttgaaccttctgtttatctagactgggagctagctgttgagcaaaaattctcttgctatgattttcctgataataagaaagttaaagctgccagtagtgaatttacctcctttgcatctctatggtggaatgatatatgtggtagaggacttagacctagaacctgggatgatatgaaacgtacaatgaggtctagatttgttccttcttactatgctcgtgacatgttaaataaactgcaacttttaagacaaggttccaactctgtagaaacatactatcaagagatgatgattgctttgtcacgatgtaatttgcaagaaactgaggatgctagaatttctaggttctatggaggtcttaatagagagattcgggatattcttgaatataaagaatacaataccatgaatagattattccattttgcctgcaaagctgaaagagaagtgcagggacgcaacaagcataggagttctcttgcaggtgctacttccacacgacagtcaacaccacgtcaatctactactgttgttcgtccacctacctccatgccatcccatgctcaagaaacaagcaaaaacgcttcagttcagactccagccaagagtgcaacttcagtagattccactggacgtacacgtgatattacatgtcataggtgccatggcattggacacattgcccgcgactgtccaaatcggcgagctctatttgtgaatgctgatggtgagtatacttctgctagtgattgtgatgatgaatatgctttagctgccactgaccacgcaggaggacaagatgatgaggacatcgaggaagtccatttgcatccagagtcgctagatcagtatcctagcctaattgtcaagctagcacttagtgctaaagagaagtgtgaagagcaaaaccaacgtcacaatttgttccaaagcaaagttcttgtgaaaggccataccgtcaaaatgattattgatagtggaagttgcaacaatttagcaagtgaagagatggtcaagaagcttggcttgactacccatccacatccacatccgtatcatattcagtggtttaatacatgtggtaagatgaaggtaacccgcttggttaaaatacctttttctataggctcctaccatgatcaaattgaatgtgatgttgtacatatgcaagcttgttctgttattttggggcgaccatggcaatatgatagagaagttgtttttgatggtaggactaatacatataaatttatgttcgatggtaaaagagttgttttgcattctatgactccagccgctgctttgaaagatgatcttgcaagacttgaatgtgaaaagaaagcgaaaagtgaaaatcagattattgctaaacatcctgcttcaaatagtaaaatagaaccaagtaccacaaagaatgaaattaagttgaagggtgctttgttggcttctaaatataatatttgtgcactagatgagccagattcttgttgctatgctctattttgcaaagatcctatactcacattggctactgctcctagtactttatattctttgccacccgctattactaaccttttgcaggaatatgaggatgtttttcacgatgagatacctccaaggatggccaatggacgagagagtgcacacaatcaagaagatgggattgagtcgaggacgactccaattcaagaaggggaggatgatgaggacatcacttcgtcggatacgctcataacttcacacgctccaatgataattccaagtccaagtccaattcggcctccggagacagcactgacttcaaacggacctagcgccttcatgccaactccgatttgagtgatcttggacttcgtggaaagcttatatcgctacctttcaaacgcatctggtctcatgtccaaattcatctcgagtcaacgggaatcgccaaaacaagacagtgctgttgctgaaaccgaacttaggccttgggccttgtaatagactaggcccatctcgaaagtgtcaccctccacctccacgaattagcactgaaccctagctttattttcctctataaatagctttgttcatcctcaaaaacatttgggttttgtttagttgaattttgccaagtgccattcaccttgtctctagtcctcgctcgattagtcggcgactatagattcagagcccccaatagttggtgtgttgatttgccgggtcgattagatctaccacttcaatcgcaactattcctttgtgcttaattccctattcgcagtatttagattgcatcttatcttgttcttgcagtgttctctcgtttgcattgcagggatcatcaaccgcgcgtcacggttggtacgacatcgtttgtggtgtagcgattgcacggcgtcttggacttgttctggttggtagccacgtcgcaaacgtcgcactcgatcaaagcgagagttatccccctcaccagaagatcgggccacgagagagagtgtcatcacgctggagggcagaggcagtccattgtggtggggatctcgtccgccgtgggggctcgtaggggcattcgctgctgcctccgccacggggacctgtggaggcgttcgccacctcctccgcgacgctgcgacgcccaccgcagcagtagctgacccagaggacgctgacatgtggggcccaccatatgccacatcggcgaaagcggagaaaaattgggtcaatactgctttaggatcttttttgcatggtttgtgatagttgaggggtagagatttttggtattgcggactggggatctcaaacaaactcaatgtaaagttcaggaacatcaagtaaacttattcctctatctatctaaagaccgaaggtccgctccaaacataagagattgggcctaacttgtttgtttcacgaaggaagagtgggccaacttgttactcggttggcaaaaggcttggccttccctatctcctccttccaatcttctactgtacttattattcgttgtaatcgtgttggttttagctgtagttgctgtagctgtaactagttttccccctgcgttttgcttggtgtgcgatccgagcgcgcgcgttcgtggagtggagtcgtgtgccagcgatacgatcaggacgtgttaatcagataaccagcactaacaatgccatcttttgtggtctcctccctaaccctgctggctggctgtttccttcaagttggaagttagtcgtcatggtcacgtaccacttgtaatcttagagtggtcagacgtctgtaaactctatccggctgcaggtacatctcaaggaagaagatcgaaacaactcgagcccatgctgctcaactaggagtaattattaaggatcaggctgtgccattgccaattatattgacatgcatgttctgatgcgtgcttgcagggagatcgatctccacatccatcaatattgattaacacatctaatacaacaaggaatctttcgtcccatctggggtttgattcttcacagcaaatcccaccaagagaattttaatttcttgtgctcgatcgcttgctacggctcttgttaatttgtttactgtcgcactgcactatatgcacgagcgccatggatcgatgatgacaaaatgttatattctgtcgtctcaagcccaagatgtacaccaaacttagcgttaaataaaacagcagtcgacacacaggatgaattcagagcagttccagagaggaaaaaaaaagggcttcaaagaaaaaaaaaacgattaaggggtgttgcgagaatcgaactcgcgacctctcgcacccgaagcgagaatcataccactacaccaaacaccctttctgaagactatggtatgtaaattttaattgtattttacattttcagtctattattctaccataattcaaaatgtgaatatcatgtggctgctttacacagtttcaacatgtacatgtgattatttgtgcttactattagattcacacatgtcgatttcgactttcaagcgtccgatatgatgaacatatgccatgtcggatatataacgaaaaataaaattgagagtggttcatagcacagacaccagaaacttaaaattaagaggccgaggttctcaatactagttgtgttgtattaatttatgagtgaatctgaagtatgtgctagatatatctatgctattataaaaactgaagatatttatatcaaaattttggtacgtcatccgtatttcatttagtttttaagttagttataggtcgtcctcatctaattcgatgtgagtctagaataactatttttttttctttttctccttttctttttccctgatcctcttccaatctcttatattttctctattttcctctttttcttttctcttccaaacttctctcctcataaatatttttcttttaaaattataattgtttaagatgtgtatgctgcaaatttgttactttgcgaatgctttccaccaacaatattttttcgtaaattgaataattaaaattttaatctttggtcaataaggtatagcaaaatacgcatgcgtcaacttatggaatagccacccaatcgatatgtaaggctatagaacagtatacatgaaggattcttcatatgatgatgtatgaagcgagcttactcaatgctataaaagatttctgactttgttttgtcattgttttgtttgttttgtttcggtttgtcatttaaattgataaagtttttatcaatcgtgaaaattgttttcaactgcgcacaaatatttttgctagtatatttttaaaaaaaacaatctgcaatatgtatgcatgtcgatatacagaagttagaaacatgtcgctagctagctgtggggagagagaattgaattgaagactgcaggagatcgatattggaagggatgattggttgatgagaacccgtgatgagagaaggtaagagtatttggagggacgcacagctcagagctcacgagaccaaaaaagctgatcagaccaattacaactaaacacaccatatgcacggatggatggattttaatttttttttcatgtcatgtagattgatcatgctgcagagaccaattacaatgaaacacaccatctgcacggatggattgattttaaatttctttcatgtcatgtagattaattgatcacgctgcagatcaaattacaactaaacacatcatatcatatgcatggatgtatggattttaattttctttcatgtcatgtatattgatcatgctgcaaagcatatactatatgcatctatatatgggaatggtatggcaggatcgatgcgtacatacgatcgacgactgcagacgcgtttgcgtcgcacacaagcatcccaaatgcacccagagaccttatcatttcgatcgcttttgacgcctccttctgaaacttaattaattttcattagccaggatagtatatttaatttaatgcatgcaaggcaggcaagagatgaaataatccaagctttagtgctctctccgtccctaaatatttgacgccgttgattttttaaaatatgtttgaccgttcatcttattcaaaaatttttgtgaaatatgtaaaaatacatgtatacataaaagtatatttaacaatgaatcaaatgatagataaaaattaataatatgacaaatgatcaaacatatttagaaaaatcaacggtgtcctaaataaaaatacttagggtactgactagtgatgacaattttggcctgggtgccaagcgataagcaagcacgcgtgcaagcagtcactatatgtttgaccaacccatccttctcatcagttacgttaatcatttgctgtgactctctgcactagctacttgactgaacaaaactacacatatcgattgaaacatcgatcgatcagagacagtatatactccatccgtctcaaaatataaatatttttagactatgacatggtctccgagatactactttgaccaacaatatctataaaaataagatgttttaaataaaaagagttgtatatttgatagtttgtttaatgataaatctagtaacatcaattttacatgattgatcttttttattttttttttgctattaatggtcaaagtttaaaatgtttgacttatcattatgctaaaaaatacttatattttagaacggagagagtatatatttctgagctaggcaggagaacacgttaggttaggccgggtgacatgttctccccggcatagatagcactagaaaacaaattgatctgtttgcattttgtatacatgttgtgtaacaagacgtgttcgatgtgtatatattgattaattatcagtttattgtattggctaatgtatattgttgggtgaaagctacttgacgcggttggaccgaaagctctagctagctaatcactacgtgcctgataaaaggcgtacatttacgtgatccgggataaagaaaatgacaggagctcgatcaggagaatttaaagcagagtgatttgcaacacgtacgatattcgatatcaagctaattaattataagtaggagtatgtaattaaggctactgtagtcggtagttttccgtgtgtcgtctcgacatataatgttatcaattagaaggaaaataaatgagctaattaagcatatatatatatatatatatatatatatatatatatatatatatatatatatatatagctgagacgacgacgattctcgcttcgcttgtactactcaaactccattgctcagagtggatgatcctcttgcaataatcaaaataaaatagtaaggaacgtgtgcatgcagaacaaaacgaagaaggcaaagagacaaggaaaaacaagatagagtattagttttgtcttaggatccatcctcaggctgtcaggcaacacaccagtactgcagatcgatcatgtgcacaccccaacaattgcaattatcaataccatacgtacgacacagcaaagtactgtactgcccactgatcatcatgcatatcatcgatatcactcgttatatatatatatatatatatttcagtcccccctcgtatatatataatgaccatgcgagcttctgattgatcgatctatatatatgatcgagatgcccattacaaactagctaagctagcagctggtctctctcttgatttgtgtttccccagagagagagatctagggagagatgtcagggaaagatcaaaagaaagcagcagctttagaagagaagctcgagctctacgttctgttacaaagtcaagtgcggtacgtaatttaattaacttaattagtatccatgttataattactacatatgcatggttcggtatctctcgatcaatttgagaatatataaaatgagctatattgacttctatctacattggttacttctaatttttcctattgcaataatcgatatgttttcaccctcacctatcttttctcctaaactggaattttaaaaagaccgggcttaaaacccaaatctaccggcagcgatactgtgccaaacacactattggttcaaaaacttgtgcgcttccagttatgaatcgatagtaatagaattttctgcagcagtgagagtttaattatattaatctaaacatagcatgcatgaatgtatgattatatgcaggcaaacgagacatcaatcctcgtagatgcgtccaagtacatcaaagagctcaaggacaaggtatctcaggagcctgaacagctgggcagcactagcagttccatgccaatgccaagagtatgtgcatcgcattgttacttacttgtccatctctctgtttattttctaagctaggacaacgcatgcatacaatgatacaaagtgtatatgggtaaacaagtacaatgtgtgctaatacatctattataaactagatgaaaccccacgcgttgctgcgggagtttggtataataataagaaataaaaataatatgtaagatagttagacgatagaaacttgcataagttattgtggtttatcataatttaaatagtatatagaatgatggtccaaatttaaaagtaatttgatgtggctttatgagaggagaaaatgagggaggtaattccaaccatagattaatcatttgagggctagaaacaattgaggagatatggcttaatgagagaagagagaaatagcattaactaagtgaaaatgaattgtataggtatatagatattatacaaaatgatggagagatatattgaaatattttgagaattatgtggaatgatgatttaacatgcttggattttttaaagctctaaaatttaaaatttaagtgaggatatactatataggcatataggatattataaaaagtgatagagagatatattgaaatattatgtgaattatgtgggatgatatttaattaacatgcttgtattttaaagctctaaaacttaataaattaacatgctcgtatgagatttgagatgtattaaatgttagtggatgatgtggcatatttgtatgttgagctttaggatatagtgggccttaactttatagaaagataggatattcaaacttttaaatttcaccatcaatatatttacatcaaaagaaatttatggaatctaataattaagtttatgatattatgatagtatttttttaaaaaagcaaatatatacatacctttaaaaaaaccttcgagaattattgatgtggttatgatttatccaaattatattttaaacgtgaaatatttaagattggactgagtacaacaataatgcaaatctatttagttttccttaaaaaagataaatatatatagtctaattaacacaagccttcaccgatggagcgaactaagttatgaagaatatagctttggatcactcctcttcagcaacggagatagctcgcgggcaagtcttgtacggtgtccacgcttgggctacgttgctaccgtctccactgtagatagccgctaatacctataaaaatcagtcgatcactgaaaaacactattagttgtctgggttcgacggtggtgatagctccacaactgctcctcatgatactttaagtttatagctcatcatagcataaaatgtgactcttccttcaagttgggaaaaaaaaagaacttaatgcagcattgaagacgtatggatgcatgcaggtgagtgtttcatcggtagagctagagaagaagagaggttttcgaatcaatgtgtcgatggagaagagtcagcctgagttgctgacgtcggtgctagaagcattcgaggagcttggcctcgacgtccttgatgctgacgtgtcgtgcgcagatgacaccgcatttcgttttgaagcgtttggatccagccaagtacgtaccacactaattatctatcgatagattaagtaatttcgttgattaatttggctaattaagccggcccctttcttgtgacaacggaagaattgtactcgttgataatacttttgacttttttttagtcaaagttcttttgatttaaccaaatttatagaaaagattagcaatattttcaaattagtttcattaaatttagcattatatttatttcgatacaatgtttgctacaccgctttgcattaaaaatattattatattttgctataaactttaccaaacttaaaagtttttgactataaaaatcaaacaacttataatatggaatgtagggagtacttacataataaatcttgatgaatactacaggacggtatcccgttcgaacggggtgacaccacctgagatattatcccgtccaaataggatatcgtcttgtagcatttccctaactctttagtgaattatttattagtacttagttgttgtatttgcagagtgaagctgcagagagaagcgtggatgagcaaatggttcggcatgcagtgctgcaagccatcaagaaatgcatggacggatcatcaatttgatccagaatgaactactttatgtttagttctaaaaaaagtactttatgtttcgacttaatactcatctgccgtagcgcaagcttattgtgaggatactaaatagtatactatctatattttcagttaattttgttgtaaaaatttgctcatctcttggtgctgaatgaacaagaacggcgttttgtcgtttaaatattcgtgcaaagaatctaaattgtatatattgatcacattaattccagagatatgcatgtactatcatttaattacacttatacatcgtacgtcgtctaactaaattctaaacgaagaaaaataaaagggatattaaggcgtcttggcgggaaatgctttattggcaagcagagcgcgggtgatctggacgcaaagggcggcgttcctgacggcgaactcctcgtactccggcgagaacaccacctcctccgcgtgctccaccaccgcccccatggcgcgctccttgagcgccgcgctcgagctcagctccgccacctccagcgtccgcagcacgttgcccgcctccacccccgccgccagccgcgcctcgcacgctcgccggaggaacggcacgtcgtacttgtcgccggcgaccagcagcgcgtgcaggtgccgctcctccgtgcacgtcgccagggagcccgtgtagaggaaggcgaggaggtgggagagctcgtcgtgggtcagctccggtagcgacagagagtcgccggcgggggccttgcagtcgtcgtcgccggcgaggatgtggcggaacacctccgacctggtcgcctgtatatagctgggcctaattagtttcattgggcccaatcaaactaaaagaaggccggcctattgggctgaaactgagagagagagagactgacaaggatggccttatgggcttggattgggggcccagttccaggcctgacggcgatgtcggtgtggatgccgtctttccacgccgccgcgaagccttgctggagaaacgatgccctctgcttggtctcctcctctctgcatcgcatctgcttcacctcctcccacgcatctctcaatccctacattgagtaacacgcacaaatgttagcagttagcactatgatgctgataagtgtagtatgtatgtcccatgcacccccaccaattagcattaatctgtgactgttcagaattaattctttctgaagattagcataacaacttgtccaaggcatgcacctttatttcctcattccagctattgcaatcaaggagaatcttgtgtatgtcatgccggtttggttttttaataaaaagataacatcagctgttgaagcacactagtatataaaatacagcttctgaaaacggtctttaagcatcgatcaatcatgaaccttttgacaatgagatttccaccaaacctatcattctcatgcaactctcgattgagacttgctcctcaccattaaccaacacaacgttgacagcaaacctgacgcatgcgtcaatgaaactgaatgatgtaaccaatgcaacaagagtttatattgcattacatgtgagatggaattcctttttatcaattcattctctaccgaaatttctctgcttctagaatctagaaacacgcaaggctagatttttcatggaagtagagcacacggcacaatcgagatggttgtaaaccgaacatagtcataccaatcctaaaggactaattaataaaggagcaaaatgagatatgggaaggtcttaccttggttgtgctattgagctttgtcaatctgctgggcttcaccgagccttgatcagcatcggcgtgctcgtcgtcgtcgtcgttgaagaaggcgatgatggccttggcaccttcatagcacgcagcgcagatggcgttccttggaagcctgtacatggacgccatgggactgcacacgcagcaatccattgtttcttctggccttctccttctcctgctgcttccttctgccttctcttccttcttccttctccttgtggcttggcaacgacgtgaacagcaacgctagcattgtgtttttgagctgtggtgaggctataaaaacgaatgcttgggacgacagggggatagagaggaggatggtgtgttggctatttcgttttcagggactaatgtattgtaatgagtggtggttgctaactaagacagccaggggaattaaaattctcctgctctctctctttcttcagtacacgtttgttctccacagagagaaaaaaaaaagataatgcaaaatatgcaactcatgaatgtagtaggtgcatttagcacttttttgtttcagtacattgactaaaatggccttacgtccttgttacaaaatgaagtgcatattaatgtacagtgaacagtcggtcattcagaacattcaagttgagtcctaatcctacgggactaagagaatgccttgtcaattaagttagagaaagcatgggatttccttttaatggaacgcaacgtacaattgtctatttagcccaaggccaactaccgtttaccaaaaacagtctgttcatagaatgtagatattaaattttacttaagaattactagcgatgcaaataaatatgggagcagtagtagcagagttattgatcaatgtcgaagactcaaagtgctctctctttatacttagtggtttcttttcggttcatgaatcttcatcttgcaacttctttgaaaatgaaaagaacaaaacaatgtgatatgttttgaattttttttaagataatagaagctttattatgacttagtcaaataacaccaagatgatacattccaactgagcccatcccgacctctgcataaaatgcacacagccaataaaaggacaaaactaaatccccatcacgaaacataggtactagtgactatcaatccgtagactagatcgtcacccttgggtaaaagcatcccgtgccacctagtccaaacgtcgagataccactgcaatagtatcccataatcccgacttgtggatgatagcccagatacatagccacagagtaactagagtaataacctatgttttgaaaatttttggcatgatattttgttgtgcatttccttgcgagaaaaaaaactgtgatatgttttgaaaaaaagatggcatgaaaatttgctccgcaatagtatcccacaatcccagcttgtggatgatagcccagatacatagccacatagtaactagagtaataacctatgttttgaaaatttttggcatgatattttgttatgcatttcctaaaaaaaactgtgatatgttttgaaaaaaaaaatggcatgaaaatttgctgtcctatgcgttttctcgcaagaaaactctgttttaatatgaatactatgcatattaccaaggaaaggaacacctgaccaatatagttgaggggacaatactgtcttttcctctcaagatataagtagacctcagaagaacataatctgaaattaactcagacaaaatgatgaattcatgattatataatgcgtgaaggaatcatagggagaaggttgataaggactttccaaccttataagagactttaggtatgaagtaggagttggccggaggcatggagggtggcacggccttggctaatgtgttaacaagctaaccacttccctcccactcctcacccaacggcctgtgttcgatactataacaaagcagaaaagtatgatatgatataccagagaactagatatgatgatttaaacaatccattttgctgctaagagcaggtacaataacaagctataaaccggctgcaaacatattttaatgagataaaagataagagagaagagcagcggactacaaatctgtagccagctgcagcacggactctaagacataatgtgtgtatgacagtgggaccatatgctaatagtatagtaagcaattattgtataaattgactattagattagctatagatgaattggagctagtagttggctgtactattaaccttgctcaccagaagctggaaggatgttcctggcttcctgcaattactgtctcaggatgagctagcaagctataacagtacaagtagtaacatagtagattaagctacttttcaaaatggttttactgtaggacttcttaataatttgattgtagcaggaacaaacatatgcatgaggaatagacagccctgggcttacagaaggtctacactagtggggaattaaggcagtcctgcgcgctcctgcaatttgtgttgataaaaaatggaaagggtgaggacaaatttggcgggagaaacgtcggggaatggatatatatgttggttggcacataataatccatcatatatatcctctccatgattggcctagtgtagttgtagagtcaatcaatgaaatggatggatgtaagcatctcattctcattagcaagcttattaaggatgcctccatttatcctctcttcaagagaattcttaaaatacggagagcacatt

SEQ ID NO: 61313 - DNA, 2424 bp, Oryza sativa
atcttgcagcaggaaggaagggtagcactaccagctccacctctcgttctcctgcccgtcgtcggtggtggccggcggcagctgcgagtagaagtcgtagtccaagctgctgctgttgttggtcttggatgatgggttgtagtagtggtgcgcgagggcggcgccgccgaggacggcgagggtgagggcctgcgcgtgaagcctggcgtggatcagccgcatctgcggcgtcttcctccgcccgtacgccaccgatgcgcccaccgccgtcgcccacagccctcctgttcgtcacagatcgatcgattgactgattaaggagtactgtagagatgaaggaattggattgaatcagaaaggggatggatcttgcttaccgatgctggcgagcttgtgttcctccacccacgactgcaccgatgagctcagccgctccattcctgatgaatactactgatttcgacgactctgaatctgaatttgaggatgtgatttgggagtgagagtgagagacagtgatgagaaatgggaagctatcgcgtagaatttataggaagcaaacagataaaagagaacgtcagcaaaactgtggctactgagaaaccagtgggcgggccgtctgtttcactccacctgctgctttggtttcttcttgtgggccgccgtttctttgctacaaggctccccaaggttgttggttttgcttcctcccaacagttggctctatcggttttggactctttggtcttccttgtctgttggctactcacatggtttcttctcttttcttctgttgccatggcatctgcctcgttcatgtttgcctcgcatgtttcacaagtgttgtgttttttcttactagtaacaagtaaaataaaaggcctaatcaatagccattgtattttacatttgctaaggcttgtttatttcacgcaggaacatgatgatttttttttaaaaaaagaaaaattcataagacttcaatggcaaaacagatcattacaaaacatgaaaattaacgtaggaatagccgtttggatagctactaataaaacactaaaatttgagaaggggatgatagatagataccacaaataaaatttcaggtctttattttttattgaatgaggcatttcacaggaattttataggatcatacccattcttcatcgaaatgaatatatgcaaaagttaatgtaagatttaaaatcatgcaaaagtctcttattttgttgttaagaaactcccctaatcgagaatggcatcttgataaatccaagtacagaataatattttaaccaaaccacatcatcaattaataaccctcctacccataccgttttcctcacgtctttagagttatttttgcttctagagaggttaacatgtaattttctacggtttattttaatagtgccataatagcatgggggcagtgacaatttgacaatagtcccacataattcctctgtagtgatcttgaggacaccggaattattatttagatatgtgagggatctaaaattcttaagagggtataatacactacttctacttatttatcttaattaattgggcaattctatgtcgaaaaaattgttggagggtcgttcccgcttgtctctgctatcagctgcacgtagccttacatatgttgggttctctctctttctcctcggtttctcttcatgggagtgagtgttgcatcgtcggcagcagcggcttacgtgtgccgaagcagcggcggccggcgcctcctccaacctcatcccagctgacgttcacccgacgccgcccgtcgcagggccggatatcgatagatcgacaagtgctcgaacggtggcggcagcaagaggggtccgccctctgcggcgctggcaagcactgtcaactgcgccgccgggagtcgccctcgccgccctcctcctcgctcgctcatctccttcggcgtctctccctcccggtctccgcccccaacgcctccaccaccggggctaccgatgacaacgatccactgtcatttgaagaaggaagaaacaggggagaaagagaaataagaaagagagagagggaggaggaagaaggaaggaaagaggatgccatgtgggtccccatattatttttgtgtgaatgataaatgggtcacgcgtatatttttttaattaatacacataagcaccacatcgaacgaaaaccaagtcaacaccgtcacgttagcgaaaccgccctacaaaacctttgagagagccaaattgtaccggttttaatagttgtggggccgaaatatccggcaatacgaattagattcggttaatactcaaggaagtcaaagtgaacttatttccgtggcgtatatcccttatttcgatgggtgggcttgggctgacaaacaatcacgctctcggcccaaaacttgtatctttt

SEQ ID NO: 61314 - DNA, 36261 bp, Oryza sativa
ttcctgccggaacagcaagctgccctcctcctgcaactctcgcaagtaaaaacaggttgctcccccttttctttctttatctgcatgcacctactacagatttcattcacttgcatttcgtaataattttgcttcatcccaaacggcactactaccttgttgtgcaaattgacttatgggacaaagacactgcaatcttctagtggtggggtctggggtggttcgtgccttggatcactctcttgttttagcctgaaaatcagctacattaaactgaatgtggaagtaatccagacttttgttctttctcaatgcattgcagttggaaatggtacaataagagtaaaaggtccatgacaatcactgtcaccactttagcatgatgctgtatggctgtactttgactcaagtagaaggataactgttatgttcctacccagataattgcaaatcttgtcaaggaaattgtgggcatcctatctgcattactgtgaagaatctgtatatttcccgtaaaaaaaaatctgtatgttgagattgtaaggctcattatagtccctgagaaagggttgtgctgttagttcattcacagccaacaaatagttacagtgggtgcactttaatatctgaaatactaaattgcacttttctttgttgtttttctgaattctgactagcaaaacctctgaggctcagggtactcggcctatttcatcctcggctccttgtcatcgatctaaaaaggtcagttgcatttcctagaaccataatacatgttttgttattaggtattgaatcattgtgctattgcctcttggagtgatctacatgatgcactgtccattacatttttgcccacctttgccatgtaataattactaaaagctaaatgtgctatgtatttgatttctcttgcacttccctgaccatatttatatatattctgcaattcaactgtgatactgcatatccagatgttatcctatgaatattttgacacacactgcattggtgtgctttatggatatatgctatgatgctaagtataatatgctcttgcccggcaaagtataatatgctcttggccattttaggaatcacctagcttaggtacacaagtagagtgcactgttcttgttttgtttttgagtttcggtcctagacatttcatcgggtgagccggtgaaggtaatgaaaccagctgcaccagtgtcttcataaacagcttttgcagaaacgcctctcaaagaaaaataaacagttgtcatgatgtttcaccttttttattgcttgaaactttgaacagacgaagagcacgaggatggagaatacatcttcaggtaaacatatgctaccagaagattttgtcaagaagcagagagcctactttgaggaggttgatgcctttgagctgccagaggaggaggcctcagagacggacctggagtgaagactcagttaaatcagtgtatcggtgcagctagcttgtaagaaattactagaatatgtgactaccctacctgtacagaagcacgctcgcatagttttacgacaatgtaactgcgagttagtataacccgtgtaccgtaatcatcaccagtcaaagccctactgacgttggctttgtcttctgcttgtagttgtacaatatcaagtacttagatattaagatgagaccggtgctttcccccgtttgacctaaacaatggctatgatctttgttttttctggaagtaactgctggcttggagtactaatttttcttcaaagttacgtctgatgaattttcttcagtttttttctaagttacctgtgttatactcctacataaatttccttcaatctatgactggcattttactcgacaccctcagcctaattatgctagaagctatagatggagcttcatgtgcctagcaccaacacagaagtcatataacatgtcgccgttcaacatgtgcttttgcagcatgcagtataaggtgtggactgatgacttatcaaatcaaccaaaaccaaacatttgtttctttgtaataatcaattaaacagtgatactgattgcgatactgccattattagaccacgcagatcgaacccccccaagtcatgaagaagattattcttcatacaaggtaccgttttatccacaaacaggccgtctggcacaatcagcttcgtcaaaatcttgtttctttgcagaatccaagataattaaaataagtagtgagtggctttgatgctgcaaatacaatacaaggcaaggcactgaatattctttgaaagagatggctgccatttcctttgctttgctttcgtttctgcttgtgctcaccactcaccaccagcccaactgctcccactctgcatcttacttctgtgtatgcatgcagtcgagtcaacatacatcaattggctggcaagcaccatccatgcaaggattgagcacaattttctgagtcactagtctttggatgcggcttgtgaaagataccaccatattctgcagttgtatgcaaatgcaaatatcaattcgaatgaacggataggtaacagaagcagttgaaaacaccattgacatccggaggaaaagctcctccaaattgaacaacgaaaatattcgacaatcaagagaaacttccaaagtttggggggtttgcatacatggaatgtaggattggttaatgatactcctctatcttcctaatagttaattattttcatgttttaaaataaaagaaaggagatcacactgctaaaagtgacttaaggtgcacaatttgttgacaaagtatctccggctaatgaattagttcacacctaaagttatgacccaactgatcatgcctaaagtacatatattatctcaatgcagccactctaatttgtggactactacagctatttgttgatatcatagttcgagttttcaataaccattagcaaacattttacccaatagtttaaaccacaacagttttggctaggttgtactacaaactacaacaacgatattgtagaagaacaagtcaacctgaacaataagaaataacaagttcagtgataactgataagatcattcacctaccatccagcagaaattcattttttttgtcactcgagtcagaacaccacaaattcaattttctccactacaaaacacctccattatacgattacactattaattttgtcaccataaaataggttaacattcttttgtacagaaagaggtacaaaaccacacaatcttgtttatactaaaagggagcaaacatatgtgcattcatggataatatttacctcgagtctccagagctatccatttggtttttcagtaattcttctagatggttacatcttagtggagggatcaaaagaccaaaccacaaagggtatcttgtcatgttggcatgcccccatctgatcctctccacttgcatgcactttctgactgtagagttttccattaattagcctgatacaaaaaaaaggaagatcaactaacaaaatgcaaagaattacaaagccacaataatatacatatgacaaattgagcacgtgcacagaattctgcctataaatattcgtgtacatttgactggcaaccagcaacagcactcaagcctccaaaccaaatggcttcccctaaaccctttgcttgcagtgccattgccttgttatttgctgcaaacttggtgtcagctcagcttagcgcaaatttctatgacaaatcatgccctaatgcactgcccaccatccgaatagccgtgagatctgccatcgcaagggagaaccgcatgggtgcatcattgctccgcctccacttccacgactgctttgtcaatgaaagtgtcctgaacctgcagagatattcaaaattttctcacttctaagtattacgtaataaccttcagtattctgacaatgcagggttgtgatggctcggtgctgctagatgacactccaacattcactggagagaagaccgctgctccaaacaacaactctctgcgtggatttgatgttatagacaacatcaaggcacatattgaggggatctgtccgcaggtggtctcatgtgctgacatccttgctgtggcggcacgcgaatctgttgttgcggtaaggggagaaaatacaaaggatatcaaactaaaagttagttatttgtctgtcttaaaaagttaacaggaactcctgacgtcagaagatgagcaactgaaatgaacaaaacataactctttatgtatagctatgaaattctataccaaaacaagccttacaaagtattaaaagtcaagttgccaaagatagtaaaataaattaattgatatttataaaatacaatcagtagtgacatatgaaaaccgacaatttatttttcagctaggaggtcctacttgggttgtccagctgggacggcgcgactcaacaacagcaagcctggatactgcaaacaatgacattccagctccaacctttgaccttggtgatctcacgaagtctttttcaaacaaaggactaagcgcaactgacatgattgcactctcaggtactgtgtatgtaaatggaactttttggtatataataccatctataataaaaccataaaataaaacagctatccttgctgaagcttgattgtcaaaacaaactgtacaagtggtgttacatttatgtaggagtatcaatatatcatggtgcaaccccaacaggttgtttagtatcaagatgctactgatcaattgatcactaacatcaaataaaaatatatgccaggggctcacaccataggccaggcaaggtgcgtcaattttcgcaaccgcatctacagtgagaccaacatcgacacttccctggcaacatctctgaaatcaaattgtccaaacacgactggcgacaacaacatatccccccttgatgcatcgacgccctacgcctttgacaatttttactacaagaacctgctgaacaagaagggtgtcctgcattctgaccagcaactattcaatggtggttcagcagattcccagacgaccacctactcatcaaacatggcaacattcttcactgatttcagcgcagcaatggtgaagatgggcaacatcaaccccattactggatctagtggacagatcaggaagaactgcaggaaggtaaactaggtcataaatttttacagtctaagcctgtgtgtgcctgtgcggaagagtgtaatgttcagagaagggagaagtgtccctttcctgatgctgtagtcgttttgaaaggtgtctgtattgctattaaagaacacatatgtgaaagaataaaatggcataaaaaggcaactggtgtaacagttgatatggcctttcatcttttcatccacaattcttgcacttgaaagatcattgataacaaaactcggctccaagcctcttactatggttgatgaatttcatgactaaaacaaacttgtaataataatggttaagaacaactgttcagaatgacttgtcatgctggcagtgatcattacttggcttaattccaatattcagttcattgactatagtttcttaactagtacaactcataaccgtagtatatcaaagttgacaaattacatatcaattgtgtagggttcaggtatatgatcacaggatgattaaaatcaccattaagaaatgtggcaatcatgcttatttgaaaaggaaaatttgaacattagatattttcctaccgtctgcacttgatatgcagatatgcaagtgcctatatcagcaacaaggaaaagctaataatatatcatatcatgattttgttttagataatatcatatagtcatattcaataacaaagtgaaaacattgacaatttgtcatatagtagatggagatttctccttagaaccaatatttattttctgaggtagacaaatatttgcaacaaaatatattgtttcccacggaaggtttcccagtaaaatgattgggaaggttttgtttttcaattgtgtagagcaagccagtcctatacaacagagttgacaactcaaaggggaaaagaaaaagaacaacagtgccaactgagtagataaaatcttcctaacaccatagtcgaaagcaaagtcaggagtggtgaatgttacggatagctgcatttatacttttacagtcgaaatccatgatcttcatccagttctcataatctccaatttcctgtaacaaaataaaacaacagatgtttcagcaacaagaaatggaatatgatcgactaaggaaactacgcaaattgcccagcattgtactatagaatttatcatgttattccaaacgcagtgctgcacatggatacttttggggaaaatgaactgcaccaaaagaaagcaatccaagcaatgtcatctcattttttattatttgacgataaaagagcatgcgattggtgctctagtaagagtagtatccatgaaccggagaaaagcatctaaaaaaaggagatgaaaggaagatgagtagaccttcaagacagagttgattgcgttggtggcggcaagccactggtcagtctgcttcttgtaccgtgcgattgtagcaagcagcgcgcgggcttcaatctctatgcgcctctcgttgatgtagagctcctgcgctccgccatcaaccgtggccacgagaagatctgcaacccgcgccgcgctcctcactgcatcgatcttttctctgtctgtatgtattgacggggaacaaaaaaggtcacttggcacttgaaaaatcaaaggtggaaaggaaatttcatcaaaattttggtattttggcgaaatcaataggggatcggatcgaagggggttagggttaccggttatcttgcgctgatgaagggaatggtggtggtggcgttgcataatgaggagcagcgccgcttccagctgcccgcccgccgcctccatctcctcttcaatccgtggatggaatggaagcgaaggggatttgcaattatgacactgcaagcattaatattttctataataacactgaacccacatttcatagacacaaataggtccatttgtcatccacacggagtgtcaaaacagcgaagccaccatatttgcagttctaatattgcaattttcttcgcgaggggaaggaagggaacacgagaggcgatctccagtgagggccggcgcggcgacgacagattggcggtgcttttaactatttgccacttttagatttggcaaataactatttgccacccctatctcaatgacatgtgggtccacatgtgtctatgacatgtgggtccagtggcaaaaagttaattgccacatctaaatgtggcaaatggttaaatatctccagattggcgggtgttttcaacggacaacctcgggttaagatgtatttttcttcatacccctcgcacttcacaaattttatgatgagttttttgtaaggggaaaaacaatcattgtgaagcgtttgatcgaatatgcatcagatatgtgctacaagggagttcaacataaatttgaggataaaattttgtaaatttgtgaccttccaatttactcctcgattttatgtgcctatgatggttaagtttcgcaattggacatgtgagtgggatggagactttgcgagggtttcctcatttagagggacatcaaggtggtggtacaaaatactactattgtgtgacgagatggtgaggcagcggcttcagcgttgagttggcgttgagaagtaagaaaagtagtggatgctctaaaaagacagtgagagaaaacaatcatgttatgatagtggatccaatataatagcaaaatatgttgaaggcggaggaggccaataacacgagagaaatgaagtagagatgaaaatagagatgcaattacgaggggataggttatgggtaggtagcaccaacgaggtgtgctaacgagtgatggagcacgtggtagatggcatgatatcgttgcatacattggttaagcttctcgagttgatctaccaacttaccaagaaacaatgaaagagcgtgagaagaagaatgcagacatatctagaggttagtagaccaagatttataatctttgtacttcaattctcacaaatcaaggtccatatgtgacttataacaaggtaggtaaattatactccctccgtctcataatataagggattttaaaaaaaaattatgacacatcctagtactactagttagacatagatagcctatctagatttatagtactagaatgtgtcacgtccttttaaaatctcttacattttttttatctcatctaagcaatagccggttttagttgtctttaaaaccagcttagaaactgaatttattgcttgattgcatttgcatagtgtataattaacctccatatgtataagaacatctgaaacttcagtatattaaaatccgttttcacgattttgatgaacgcctagtctgtaaggatataaatgttcctgatcgtgtatgatgaaatttataacaaatatggttgtgggttaccggaccaaagtttataatctttgcgcttaaaaaaccgataggtttgcatgtagtgggatgtgcatctgtacgccttacctctagtagccaaatcttttcagatgcaactccttatcatgtgtcttttatcttgacaagaatgcatgatggaacttagtattagccttgttgcccaatctccatcttttgattgttgaccagtctctttacatcttaacagctctttaacttttgttaatgatgtcttgtcaagctaagtagcttaactagctagcacactgtaggccattgacttgttaatatactgtagatgcatggtctctgttttccttctgcagtatactagagtactagacatgcatgcagatttggtcttgtttgatcagccaaaacctccattgattgcggtccaaaagcagataaacccactacctgcatgatcgaatgcattcggcagccatgtagcactgaattcggttgactaagattgtgtttagttcacgagaagaaaattttttgaatgtcacatcggatgtttaatcggatatcggaaaagatttttggacacgaatgaaaaaattaatttcataactcgtctgaaaaccgcgagacgaatttttgagcctaattaagccgtcattagcatatatgggttactatagcacttataactaatcatgaactaattagactcaaaaattcgtctcgtgatttccatgtaaactgtgcaattagttttaatttttatctataatatattatatactacaagaaacaagctagacgtcttgtcatggttaattagctaggtaggtagttccagaaaaggtttcttgccaaagtgcagccttctcataaaaacatctccccagaaaacaaaatgagacatttgagctaccggaaggacattttgacttatctacattttgtattggttaaatcaagacctgaaatgccattgtccatgtcactacttcaattgataacatgcacgtatggcaatatgatgtttttcatgctcaatgcatgattgatcatcctaaaggtcctaaaggtaaataggtgattaaggatggattatttgcagtttaatctgcgatgacggagtacacgtacgacgttgagttttaggtttgctgagtacgatccaaatcgaatctttgtactgcatcagctgcttgctttgcctaattgattcttaattccgacactccatctaacaatcctgtactgctagttaatttcataatgtacttcctatatcgaccggccttatatatcttgctcgtcctttccgtagtaaggatatttactactagtcacttataagcaagcgattatagtcgatgccattaaggcgttaactgctaccacgataacagataggttcgatgatgcgtccatcttaaggttggagctgctgtgtcaattagacggcaagttcaacaatgatgacacgtatatatcctctgggaagtctgttttttaagtacgccacacccctacatatcctcgccagttaaaaaaaagagcaaaataacattaattatatcctttagtaaaaaaatagaaaaaatagcgtaaataatactttatatttaagtttaggtttccgttgttacgcacgagcatccaactagctagtatactaagcaactgagtatcatcatgagtaatattctaatcttcttcatgtgtgttgggcctggtctctctacggctacgtatacggcatgcagaattgttggggttaattagcgcgctcctacatgtacgtgttattctagctgatagcagagctactagtaactaggaagaaataaagcagacgaaagataggtgaactcaccgtgctagcttttctaatgtttcccccctgtcattcgtttagcttaaatcaagttgctcttacactagctagctgatcgagccgtgtaaactatatatttatcttggattttggttggtgatatgctatagctcctgcctcgttctccataaaagaattaaactggccaatgatcaaatatggtgtgtgcacttgtgcgtgatggttattgatcaactatataggccatccagacagaatctcagcaaatcagtgactgacatttcatctgcatatgcttctattgcagttgctagttaattagctactagacttttcgtaagatcagaggaacatgcatgtacgtagtgcaatatactaagctgatctttttctcatgcatgtttgcgtgtgtcaagtttaatttatagtatgtatatatatatatatatatatatgaaaaacaacaacattagctttaggaaacttctccatcctctgctcatcaggtcccttggactaaaagcaagatcatggagatcgatcagtacgcatgcacttgtcaaaggcctcaaattaaccaataaaaaataacctctctaaagtgggaggttaattagggttgtgtgaactgcactaaaactaagtaccacagtagtactatactttgacccaaaacaacacctacaaaatcttacaacagcattacataacaaacaaaaataatgatatatgagcagatacatctggtacatggatgttattataacaaaatggagaagcgacatctggtacatggatgttgttataacaaaatggagaagcaaacctaaccggaatggacgtatgcaggtcaaattcgtcagctaaacggcttggactcctgcctaagctagcacccatgctccggcaggtagaaatgcatcatgtcggaagtaaaactaattgcattatattgcaatatactgtactattttaagttatctgagttgttagtaaaagctaaagaatttttgctgactgcatatgatagtagtaacttggaaggtgagtaatctatagtgtattaaccaacgaccagcatgatcttctttgactagtatatactaaacgactgaattgtcgatcctcgtagacatattttgcccatgaacgtccatgtagctactttcgagtttcaatggcgctttccaaggccatgtactttgattaccatgatcgatcatttgataatgagcagcttgctaactgcatgtgttagcctagctcccttaggaaaaaggggaaaaaaaaagaaaggaacaactacaaaagacacacatatatacatagtacaaaaaaccagaccggaccgacggttgaaccggaaccagaggtctggatggctcggtttgctgtaaagaccgcccctgcatttgaaccggaataaaccgcttgaaccggatggttttcatgtgaaccggtgaaccagagagaaccgagccggccggtttgtcatgccaagagaggatgggccagtcaatgccttgtgcgcgcaaagatctcaaggcccacggtgaatgtgtactattgaaaatagcaagaaaaatgtggggaatggggttcgaaccctggttggctggctgttttcaacggaggatatgcaacaatataacacttccggttcaacattcgaaccgtgtgaaccggcggttgaaccgctggaccggtgacccagggacttgagcggttcgatcaccgattcggttttttcaactatgcatatatactccctctatcctaaaatgtttgacgccgttgacttttttaaacatgtttaaccgttcgtcttattaaaaaacttttgtgaaatgtgtaaaactatatgtatacataaaagtatatttaacaataaattaaatgataaaaaaagaattaataattacttaaattttttgaataagacgaacggtcaaacatttttaaaaaagtcaacggtcaaatatttagagaacgagggagtactatgcattatgcatatatatgtaggcatgcatgatgatgctttagctttacttaagcgtgtataactgttggacgcggtccaagtgttctcacgtaccaaatcctagctaaaagtacgtgtacattcttttctcttttttttctgaaactgcaaaaaagaaaagagaagaagaaaagaaaagaatggtgcactagtatacgtggctactccacaatgcctaacaatataaggaaaaggcacagcaaaaggaccgacacggcaagaaagatggtatagacagtgcagctagctgaaggtgcaggctttgcatagtgtgaagcgtctgattctctgacggccagcagcatattcagcatggacggtttgattgatgatcaactcaaagtccaacagagtaggtgaacattaagacacagagatgaccatgacgcaatctaatcatgaagacaccatgtattttaattcatactctaattagctacatactcttgtgcctctgtgaagctctaactcagctataaatacatgcaccaccacagctctgctatctccaggcactggtgcactcaccaaatcaacaagctagctaactaagcttaccacactcacatactcctatatattttggcacgcattgattacctgctagctccttgagcaatatcaatatggctcagccgacttggtcagcaaggcgcgtcactgccgccctggtcgtgatggtggtggtggtgctcgcggtcgccggcgggtcgtgggcgcagctgtcgccgagcttctactcgtactcgtgcccgggagtgttcaacgcggtgaagcgggggatgcagtcggccatcgccagggagaagcgcatcggcgcctccatcgtccgcctcttcttccacgactgcttcgtccaagtaaccatcctctacctagtacaagtatacgcacgcacacattgatcatgctatataattaatctgtgcatgtatgaatgccagggttgcgacgcatcgctgctgctggacgacacggcgagcttcaccggcgagaagacggcgaaccccaacaacggctccgtcagagggtttgaggtgatcgacgccatcaagtcggcggtggagaccatctgccccggcgtcgtctcctgcgccgacatcctcgccatcgctgccagggacagcgtcgccatcgtacgtactccacttcgatcgatcgatctctatatactgaaactgaaactgaaaatggtacatatatgcagctgggtgggccgagctgggacgtgaaggttggtcggagagactcgcgcacggcgagcctcagcggcgcaaacaacaacatcccgccgccgacgtcgggactcgccaacctcacctccctcttcgccgcgcaggccctctcccagaaggacatggtcgccctctccggtaaccactgctagctgttactagtatttttgtttccactgagcattcaattaagtctagcttgttaactaacaaaaataaaaatttataaatgcaagcatcaattcattcacataactaaacgaacaagcatcgtcaactgttccatttttcaatcccttctagaagggaaaaggaaaaagggttcggaacaacttcatttcacactctgtttctgaatagtatcagtagcttttgtgtcgatctgcacacagctgggtaccacgcaaacggaacagatagctacgttttcaatttgcagcatacttggcattctccaagcctatactactttgacaagatgattaatttacgaaagtctgcataaacatctcagattcaactagcagtataacctctgactctgagtccccacttgtctcccctgtttattttttttaagaaaaagaaagattcagtgtcatctgtttaacatgcaatttgttaacttacttgttaaccaaacaaaacgtagtagcaaagtcggtaagcatggttgtcgatgggatggcataaagttactttgaggtaatgacgtactcctaaccgtgtctgcgttgtcggtatgggttaatttgcttctgaagaaatagtacaggcttttctttttaaggttcagtaatcagtacagactgctgccgatcgaaaagatcagtctgccatcacatgccgtgaattggctaaatcacaaaagcaaaaattaatttgtttcctaaaaaaccaaaagcaagaataaagttgataaaccctggctacccatcaagttattaattacaaccacagataatgttccttttgttctgtttgttaataaatgtgatcgaataatgttgattttttttctgtattccaattaatattagggaatgatgaagaacctatactttctttctaaaataaaaatattcacaatactatacaaaagcaaagacctaaaagctcagctcttaaatattctaaattattcttacacatatgctcagctcttaagtatagcatgatttcatattgtacctgcaggatctcacaccattgggcaagcacgatgcacaaacttcagagctcatatatacaacgaaaccaacatcgacagtggctttgcgatgaggaggcaatcaggttgccctcgtaactcaggatcaggtgacaataacctggcacctctggatcttcagacgccaaccgtgttcgagaacaactactacaagaacctcgtcgtcaagaaggggctcctgcattctgatcaggagctcttcaatggcggagccactgatgctcttgttcagtcttacataagtagccagagcacattctttgcggattttgtgacgggcatgatcaagatgggggacatcacaccgttgacgggatcaaacggggagatcaggaagaactgcagaaggattaattaagaaatgattaagaggcaagctgtgttcatgtccagtagtgcaaacgcacattgtgtcgtgtttcttgcggatatgtttgcaacatctcccttaatttctttcatgtgtttatgtatcattatgttcgtttgaaataatgaaagtactatgtgatttgttttaatgtaacatatgcttagtttatgtggtggtaaatgatcggttaggtttggactatagcacgatggaacttgactgaaagactgaaaaggagtttataactaaaaaatgaattggatgagtaaaacgaaaggcaaaatacattcaaaagaaaaaaaaagaaaagaaaggcaaagtcaatatcgactcttgtacgtggaagtatagtgtgtgtttaacttgagtaggaattgatgtgacaagctaacaaaatttatggacctttctatcatcatcatatacgcggttgatctttttgttgatggtgtagttggttcagctagttaaatagtaatcacaaaactcgaaacaagagcgtcgatatgtccgagtggttaaggagacagacttgaaatctgttgggcttcgcccgcgcaggttcgaaccctgctgtcgacgaccatttttttttaggctttttaatctttggaaaaggtacaccgaaggtcccccaacagcccaacttatcatcgaattaaaaaatagtccccctaccgcaaaatcggatacaacgccaacaacccaacttatcatcgaataaaaaaaatagtcccccaaccgtaaaaccggatacaaagcatcccttaatttacaaaacaactgcaaactaggtctctcgacggcctagaccgacgtggcagctgacttagcgtgtgacccgcgtgggccccacatgtcagcctctacttcccctcctcccctttcaacgggcgataaggctgggtacggtgggcgcggcggacggccaacgcggaggagctgggcggcaccgacggcgggggaggaactggacggcgtcggcgatgggggaggagctgggtggcggcggcgcggaagaactgagcggcgggggaggagctgtgagccggcgggcgtgtgggggaggagctgcgcgcgtgggccgccatcgtcgtcgtcgtcgtcgtccgccaccgccaccgcctcgccggccttctccgcccgccgcaacttcgccggcttcacgcgccgtcaccccactccgctcgccgtcgtgcttgagctcgtcttcttctatctcccccgtgctcccgccgcccgacgccgccgaggtgctcgcctcgcgcctcggcatccacccctccctccgcaccctcaacttcgcgatgcgctccgcgccgcgcaccccgacctcgtcttccgcctcttcttccccgacttcctaggcgacgccgccaccgtagccttcctcgtgcgtgcttgctcctccgaaggctgcccgctcgacggcctccgcctccagcgggtgaggagctgggcggcgttggggaggacgagagagcagtcgagcgacaggaacgcgtcgatggcggcggcggcggcgcggatgtgccactcgatggccttgcttggttggtcgacgccgaggcggtcctggatgtcgtagaacgcgatggccatcggcaccgatagcctgacgcagcggtcgcggagcccccgcgacgtcaccaccttgctgtgcttgtccttctcgcccgccaccacgcacgccacccggctcgtccgccatgctgctgccatggccgccgacgccgacgagcgtgcagcacgggcgctagcgctccttgccgacgacgacctcctccatggccgacgcttgcgctagctcatgcgaaatccgcctcggcttcgtctgctcgattttaatggaggctgctttagcacctcgtgcttctgccgtcgcctccctccccttctcccgtgtcgccgccgccgagttgctgtcgccgcatcgctggccggctgtccgacctccttgtcccggtgacctcctccccaccgccggccggcttgcccagaggagatgagtgagagagagagaggaggaggaagggagaggaggggaaagaaagagatgatgacgtggcgtcctgacatatggggccaatgtgggtctcacgctgactcacccgccggttttgtaagttaagggacgttatatatctagttttgtggttgtgggacgattttgtaattcgatgacaagttgagggaccttcggtgtactttttccttaatctttttattccttcagtatcaatgggcctttgttttttactcactccttgagtgggccggccttaatttctattgggccgcatctcatttcatacagctgaagcccacagttgtgtcgaaatccaacttccaaccgcatgagctaatccaatcactgttcggcgttctaatctgttttttttctccttttcctccacgaattcataccctccacgcaacggaaaccacaccacaccccgatacgactaggatttcctctctgcttcttcgatccccttgttattacaatcgatcctgcaagagaagcactctataattgcagcggcaagatcgattttttacaaaccaacaaagcagaaaggattcacgcgccgccgcttgcgatttgtgagttgtctttcccctttcgattccccctcctctcttccttcccctatcgtcaactagctcgagttgcttgcttgttccctctgctgcttcctctcttgtgtggattggattcccggcctggccctttctttttcctcttctctcctagattagaatcgtcgcgatttgattcctcaatctctcgatttggccgccctatctgttattaatccccaattgttcttcacacacatactcaattgcaggtcaattgcagccagaaagaggcgatggatttcaaagtcgcttcctttctcctactcctgttaatcgtcacctgcggagctgctcaaggtcaaggcaatgattttggtacgccctaatccaacaccttcccttcctcccttacctatgctcctcctggctcctgcatgcagtttggaaccaacatgtcaaacattctcaagggaaaattggacaagttttttattgtgcgtagtaaagtatcattctaaaatttatatatatgggcagctgctgtgggtattttatttggttgaaattcaacttgaggataacctgctactgatcctcttagcttggttattcattgcctgcaaaatgcatccattatttttgttcaagctttgccatgcactcgttacaaagtcccatgttcatctcacaatggtacacaatgataaacattgtggtcacaataaattattgatagagaaaaaggaaaaagaggatagcctaatctaattgttggcatctctgatttctctcgtatgttaaacctaggctagttattatttatttatgctagttatggtatgttttaacagtgttacttttttaaaaatttctgcaacaccaattattggttatgggtacatacttctcataaaaaggattatggatacatacaacaaggctagagatgcaatatcacataatgtgacaggaattaactggttccagcttcacagaaatgagaatgtgcttcccaattattggcaatggtttacttttacttcttaatatgtaatagaaattattattttttgctgacgaccttcatgatattttattcaggcaaaattagttatgtagcaccgaaatttcacgatcttattttcattctatttatttgtttgcaccgaaattaccttttgtttattattcattccttctcagttgtccttgatctaaaaacaactgaggtcggggaagatgctagcccaatgtacaaggagcaaattgcgttgaccaagatacctgtaactcttctgaggagcaagcacagctcactgtgctcggcttgtgaaaacatcacaagcgaagcagtcaactttcttagtgagaaacaaatacaagataagataatgactatccttcatgacacttgttctcagacattctcctttgagcaaaaggtaattgttcccttttgatttggtttgttagatcttatatattgtgtctgtatattagaaatacaaccaatttgatcaaaagatatgacacatgtaggaatttgattcccttactaaagtaccaagaaggaaagatattccatgaacaatagtagtttaacatgatcactttgtatgtctgcagtgtcttgagactatggactcctatgcaactctcgtctttgcaaaaattgctgagattaagccagatgagttctgcaaacagtatggcctctgcagggacatggctcttttatcagctatgaaaagtgaaagcacatgcgtattctgccaccacatcatcgatgaaattatgtccaaactgaaagatcctgatgcagaggtgattgattttccctcgattacacaattacatcgataaataatgagcatacatttggaccctaacatcttgtgtgtgatgtttgcagtttgagatcattcaattactactcaaggaatgcaacaagattgaaggtcatcagcagcaggtaaaacatttgaagtagtttgtaaaaattctctctctgacccaataatgcttgtttggttaatgtacatgtctacatgagtgatatgggttgatgaaatcgtacgttttcttgttgacagtgcaagaggatggttctgcagtacgtccctctggttctagtgaacggtgagaagttcctggagaagaacgatgtgtgcgcaatgatccaagcctgtgatgcaggcaagaggaaggcattcaacttgttctctgcacggaaattggtgcgtgacgcatgaagtagtaggaagcgtgcatacacgaatcaagttgtggtaggcatggagaagacgaagaagtgatggcagcttgtacatatggttgttattaatgatataggcaatactactctgtgaaggggataatccgataattgtatgcacacatttgaactgtttgtctgatagtaatggctatacttacttttgtgtgcttgcttctggggagtatggagcagtatactccactatttaagtagtactacctcagtttcatattataaaactttctagcattacacacattcatatatatgttaatgaatctaaacacatatatacctagattcattaacatatatatgcatatgggcaatgctagaaagtcttataatatgaaactatatatgtctagattcattaacatatatatgaatgtgtgtaatgctagaaagttttataatatgaaacggagggagtactgaattgagcgagaatttgtacacgaccagaagaaactaaatttacatagcacatacccagagatgttgatctgcactggctaggagcaaattaactaaactgtgcaaagcttggatccggccacgaacataacagactattgatctctctttacgagaaaatctatcgtgtaccactgactttgctctagatccacaatctgccactgactttgttcagttctatagtacgccatcgccttttgtttaacttctacaatttaccatcgccgtctagttagtctccgttagtaccatacaattgtgttctaatgacgaaaatacccctaagatgaaaactttcagaatttggccgaaaattcacaaataccatactgtaacatgtcacagaggttgcccggctcatattcttctatgataatacatgattatctaagcatacatatgattgttttagcaacttgtttgacggcatgttgcacttacaaaaataaatctaatcacacgcttattttatattatgtattgactaatatattacttcctccgtttcacaatgtaagtcattctagcatttcctatatttatatagttgttaattaacaactatataaatatgagaaatgctagaatgacttacatttgaaacggagggagtagaattctagcaatacatacgtatgtatgcggccgccacgggcttgtggaccacggacacagcctgcaatattgcacgtgtacttgtggccgtaacagaggcggacatgaaaatatattgggttaatttttttattctagaggtattttggtcattagtacgaaattgtaccgtgctaacggagacttaactgacggcgatggtaaattatataagttaaacaaaagacgctggtatattataaaattaaactaagtcagtggcagattattgaactagactaaagtcaatggtatataagtagattctctcatttatttatacatttacactgttcaaaatcatcgtcattgtcgttgttttgttgttgccagtttagtcaattacactctactgatactgataccagaatgctttttttttttttttgatttgacaatacgaacgaacagctcctctctcgtcaaaatgaaaagaaagaaagaaaaaaacatatatataagacgtcaaacctcggaatcgggggattgtgtttgtgagtgacttgtttgattagatttgccgggacgggaggacaagcagagtagacgacggagtttggattggaaatttggaatgacgacgacgacgacgactcggcaccgcctccgggatgcggcggtggcgtcagtggtggccgtcctcccccacgagatctccccgctcatcagcgccgcctccaccttcttcttcgtacgtatcgtatcgtatgcttccctctctctcttgcttcttgcttcttctcatttcatttccttgattcatctatggctttatggctgtgcagatcctcagcgcctactttgccgtgctgccgctgcgggacgagggggccatctccctgggcctctcctccctcccgggtctcttcgccggctccctcctcctcacccttgtcgccgcccccgtcgcctccctcgccttctccctcccatccatccccaaacccagggtccgtattcttcctcacttacattatctatttttattagcttgctttttatgccacaagccaaccggttagatttcttagatgcaaacttcggtaatgctttgtacctttacggacgcaatttttacacacttattgtagtcaatcacgcaaaaacaactgcattacattctcacaatcatgaaaactctttttaacgaatatgaaaacttgaattggttcagatgaaaacttgctatttgctctaagttcagatgtaggcacacttcttaaacctgaaggaatgcaattcttaactcaactcaattatttcaatgattgtattgttcttgctttagtgtttcactagttaaaagtagtatacctttattttgtttcatttgatcaagatgctagctttgccttctgtatgactggaacagttgatgaattactttagagtaccatgttaatcattgaatttgtgttcttttgtctgttgagaagaaaaaaataattctggtctgtgttgtgcgagcttctgtatatttaccacaggaatgcaataatttgggtatttcttcagtaaacccctttaatttaagatggttcagctagcttttccttgactaaataccagattcttgtcctcagctttcttccgtttgtttatcgatgatgaggtctacattttaagaatttgaaatattctgaagaacaatacaggctacaaatatccttgcagttatttcttattcactgacatcagctaattttatcatctatattcaggctttggttttcatacacagattcttcagtttatcccttcttgtcttttttgttctttggtttgcctctacccctgggcattccccttctatctcccaggtaatatacattgctattaatcttggtttttgcaattatgtacaatatagttattaaatttcaatgaaattgtgaagggaaaaaattaccgtaccatgaattttcactcagctgcttcgtctgtccccctgaatttcctaatctaagaatcattcctcacacaaaaaaaaacttatttttctctgtttcttggtgtacaaatcaagtcaagcgaagatgcttcaaataaacctcctggatggggaaaccacagttggttctacatattagtgagaataagcttgtttctttgggtacgacttttcatgctacatgggcatgttcatttattctaattctcaaactgattattgatttgagtaattatgtctatttgaaggtttccttgcttaatctcattgcaatatcatcaacatgggcaagagtaattgatatcatggatagtgaggtatcatttacagctgctctaaaacttattggcaaattacctacaactgattacttttgcttctgatattcttattactcttttaattcagtcaggttcaagattgtttggttttattggggccggtgctacgctcgggcaactttttggttcattatttgctgcaactatggcattgctagggccctgtacgtatgattttctgaacaagaaaacaaattcctgatttaaaatttctagaatgcattttcacatctccgaaatgtgcctcagttctgctcctgttttcatccctattgatggaacttgctgcattgtcatcgaaaggaatctgcactgatgatctacacggctcaacggaattgtcttcaacaatgtatgtatccttctgacaatggtttgcaatatcctgacttatctatgactgttacgttgaccggggcaaaacatatcattgatacggactaatgtccagttttactttcatttttaattcttaaacttaagtcacattatagtttgtaaattctttcttttataatcaacctcaaaacccttgaatggattttgttagtttgaacgtctcatagcaaaacagatagattgcctgctgattatttgatttgatattttggtgattccttgttttgcttatgattgcatcccaatctattaccaactgcagagccgaacaaagccaaaatacagaggctgatgatgaaatgtcttcactggtcacttcacaaggattaccgtcccaagtctccgaatctcagaaaaccaaacctgagatttttgtgatgtttgaaggtttctggctgattgcacgctctccctatctgatgtatatatctctatttttgtggctgagcgctgttgtgtcgtccttcttttacttccaggtatggttcttctatatatgtctattgacatgaataagttccacatcactgtgaccatgttgtttccttagttacatcgttggaaggatccaccatttaccatccatttgaattctacctgatttccagaaagtgacgatagttgctacaacaatatcaagcccaactgccagaagaagaacctttgcactcataaacagctttattgccgtctttattcttgcagggcaactcactttgacggtatttatccatctccagattgtccttggttttattattaatagtacccctttttgcagtatgaataaatcttaacctgacaaattgtcctgcacaggaccactatgacatgcgtcatggtgaagtagctttatatgttgcaaactgaacattttgactcattaggctctccctcctttttgttttggtggggaaggctcaattagaaagctcagcttcatttctaacatctatttgatcatgcatgcgtatccccaaagtgcttatttttctcatacaacattgaacttattatttagtgatatcttcctttgttcttttgaagacaagaatgtgtcaaaatttcaatagattttccttctgaattctgatgtaattctgatacacgcatatgttcctcagtttgacaattaagagataattcgcatctcatatcgtcaaaagaagggaagagttcattacgatgtagtcaaaatgatgtattgcatgtctacatcactacattccaagtactgagcaacttattagcattggcaaaaacaatataatttaaaaatgtcctaaccaacaagttgttagaaaactgcaatgactgaggaagttttgctaattttgtttcttctttcatttcgaaaaaaaaaatctcgaaatttcgttactgattcctgttatgaattaaacaactatttcagggtcgtatccttaccatagctggtgtaacagttgctatctgtgcatccccattcattgccacattgaatatggttgcccttgctctatggccaacttgggttgctgttgctgtcactgaaacaattcgaaaggtacatatagaacagggagctatgattgaacttttggtgtaataaccgttttttaccattaaatgatactttccaaaagtcacatacaaataaatatgcatatctagatgtgagcattcattaccacctggatattcatatttgagagctgagacacattaatttgaatttaatctggaattttcgcatgtcaaggatatctaatcactcataatccatttttgtgcaatttagggttttcgatgttagctctaaattgctgctttcccaatctcatcttttattctctgtaggtaactacttatgttttgacaagacctggaagggaattgctattcacagttgtctcacaggatgagaagtacaaagccaaggtaaaagatatgtcattacctgtttgagtttagtgaccaataagaaacgaaataatacatttgcttgaatgcaatagatgagttgtgtcagtagtacacattatcatgcaccacagagaactaacaaaatttctaatccctggattgctcatcaattttcatcaatttgcattgtgttatagatgtctccggtagatatcaagcatatacacatcaacatatgtgatgtgtttttgttctcaaccctggttcaaggtggtcgtaggcatggcgcaagaggccgccctttggcatcttgcccatcctctgtcgccaacgcttccttcttagcgtgctaggtcatttggtcgtcccattgtaatcgcgagaataggattaagtccttgttttcctctccccccccccccttttcttcccaaaccccccttcttttctttgttttgccttttgtgtaaattttattcctcttaatacagaagtccgcaatccttttgcgtattccccaaaaaataaaatggctctgttttgaattcacctaggcacatcagagttagccttgtctcttaaaatggagagtgggtgattagcagcgaaatttgaagttgaatttccagattaagtaggctattgtagaaaaatagtcagtttttcagttgccttcttagtcttatatttaaaatcatcttaaatacgtgttcacaaatgtatgacccatttcagttttgactatttaactaatgaatatgattctaataggtttgatagatgttgttgttcaaaggcttggtgatgcaacagctgccggaatatacagtttgttgttcagcagccttgagaagaaggcatccatggtcaccctctacgcgttgccggtatgtgtcatggtttcagtcattgtatttgtaccccatcaccacataagattgcatatatcactgaaaaactaattttctcccttctgataacagctctgcttcgtgtggcttctaacggcatttcatttgggccggctccagacaaaccttgtcaaggttcaggttgcttcttttgcatcttcgattcctagataggtacttggttacctatagtaaggtgattgtagcttacttaattcacttgtagtgttcttaacacaaatgcttgatacggggaactgctgcacgtacccacagaaatgcatactgtaagtaaccagagtgcagaaagaaatatggcacaacgacaagtcaggttgccagtggcgttgatactccttttgccttgtaagactaatagaagatttatcgagaaacatttttgttttcaatatagcattaggattactacaggaaggatacaacatgcatagaggaagaaggaatactgtatgactagatgaataacagatgagtatgtgatctctgcgtctattgttagaaacaatactgtcttgcagacggcagtgtatgtgacttgttacattgctatttgctaatgagaaaacaaggctgaatttgttgggcatttttgcttcttttgggaactcaatatgatcttcaggcatgtacaatttactgttaaattgatactatagaagtgctctcatggcaccttctgataacttattgatcatgttcttcgattttcatactgcctgattaatttctggaacacacacacagatacacgcatgtaaagacaagctgcatttcttattactgtattttctttgcaaagcgagagcccaagattgaatggtggagagtagaatgaatattgccttgcgtgatctttgtgctaatcctttttaaaattgcgcgggaagaatccccgcgtgagttataaaacgatacgcgcgccacgccggatcatcaagctgcgagcctctcgtgcttaatactagtcactaattaagtgcttaagctagtgcttaacactagctagctaattgctcatcattgatcaagcgaagaagaagatgatggcgtcaccggcatccaagcgcgccgccgtcgtcttgctcgtcgtggttgcttctgtgatgatggcgacgccgtcggaagcgatgagaccgaggaggaaggcagccgccgccttggtctcgtcggaggcccgcgtcctccgcttccccggcttcccgggaagccgccagcgcttcccggggttccccggagccaggccgtcgccgcgcgcggcgccgccgaagccatcaccgccgccgtcgtcgtcgtcagtccccgccctgccactgtctccacccgccggcggctcgctgccgccgccgtgcgggaggtcgtcgcagacgacgccgccgggcaccttgatcccgggcatgccgggcagcggcggcggcggttcgtcgccgacggactgcgtgacgtcgctggcggggctgacgacgtgcgcgtcgttcctgacgggggcggaggcggagaccccgacgccggcgagcgagtgctgcggcgggctggggatgttcctgaacagcacggcggcggcggcggagggtgaccggacgttgaggtgcctgtgcccggtgatcctcggcgacgtcaaccggatgctgcccaagccggtggatcccgtgcggatgatgtacctccccatcgcctgcggcctcgtcctcccgcctcaagtcctcttcatctgcttcagtcagttcttaccttcacttgcactcattgattcatcattctcaaattctatcagattaattcctttctgacgaaaaactgatatattattgattctttgattgattatggcagccgggcagcctaacccaccggtgctctcgcgtgttcctgtctcctggtcgacgctctcttcaggttcttgctgaatttgctctcttggtttcctgttaattcacacattgttcaatctggatttttttgcattctaatgtttttgttgttgttgttttcttaatatgcagcaatgtcgccttgatggttcacgataagatcgattcaaaggttactgatgattcagtgtctcactttaagcttacaaagctgttgttggtcttgagtgttgtgttttcagaaacagctgagcctgtacttcagtaaaccacagagttagctaccatactgctatataaccacataagattggttggtacatcatgcgtggtgtaagagcttatttcttatttatagggaaaaaatatgtaagtcatttcatcaaatattctttctccacaactaaagagtgtgaaatttgggacaataaggaaactgaaaatacaggtcaactgcacagcaaaattccagtaggaatggaatgctttgtctacaacattacttgttataataatcaaattgacaggaaaacataaatatcagtaaacttaaacatccgcagtcaacctctgaacatgcatacatcacatttggcgatgatatgatgaattttcactttcagcaatagtatgtgtttcactttcaacagcaatagccgtacacatgagcaaagtgacagtctcaagacggccttattcgatactctgaatttacaaggcactatgtgcgtgtgggtttcccaattacacaactggtcgccattaagactacgcaattgcaaccaagaaccaagatcatccagaccagcaatgccatcttctggcacctccttattttgtcattcttattattatcagatacctactaaattagatcttgtctgagctttattctgaggataggtgaatcaaaaccttttcatctgcaccagctagcaatctggcagcaaagaagaatactactagaggagctaaggttctgctgttgtctgttccataatgaattcaatttgcgcagatttgtttatttagttctatcatatgtttactgcatttcctgacctgtaggcttgaatagaaggatatggagaagttttcatttacttctcaagcctcccgaagagcacggacccgttcttgaattaacctcctctcgagtcagcaatgccctcaaaagcatgctctggcagactgtcaaaagactctttatgtggatcattcttagcaagatcataagttgcagcacggatcgctctcttattgggtccacagggccttttagaagttagtttctcataagctgtcttaagctgcaagcaaaagataaatgctaagaatgtggcctggcttataaccctgacaagttaagaattcaagaagatgaaacctacattcatattctcgaaccaaaacatgtaagcaattgcaactgcaggtgctctcccaagtccagcagtgcaatggacatagacacgccctttgccttccgatatagcccattctagtgatgcgactgctttgggcaattgagtcctcaacgaatctggatcgaagtccactggctgaaaccaaataaatgcaagcttttaactcactttcataatcaaacttgcactaacttcattggaattaattatttcctagacttttatagtttacttttggcactcaaagatagcagcttactgttacttttacgctcttctgatgtacagtgttggaggtcaatattttatacttttcacctatcttgtcatatagtggaaatatgaaagcttgctaggtggatatgaattgtgattatctcaaatgaattataaagtccaatgcaaaggacaaggccagctgtgctcattgcagtaaaagaacaattaccatattttctcattaaacaacttcttagttcatctgtcatgtttatatgaataaaaaaaatgcaccggtgcaaaagaccagacactataaaagttaatcaagcttgaaagtaggaatgtaaagtgctcattttttgtttgaagcagaatttcataagcaaattaagcatgatactagctcagtacataaataagcgtctcaccggtcttctgatgtgttttatgccaagttctttgcacctattgacaacagtttggaaatcaatgccccaatattcaatgtccttgtcctgctgtaagcaaagaataaaggctactttctcctcatcttttaagtgatcaatatcttctggtttttgaggttgcgagccaacaatcaagctatcactaatgatagcataattcatacctacattccaggagtaacagagtgagaattgcataaacacaaagtagggattttgttttgctcctgttaattgctgtatctatttcagtgacttataaaaataattaaagcaagctgtgcaattcaattaagtcatgacaaagtatgacaccaatgtttatctccacatcaaattgctatatcttcagcaagaactttcacagaacttatcaaagaatggatatttcacaaacatttaatgtacaaaagataagggcctctaccatcttaaaaagatacatttttcacatcatggtgtaactttcattataatgtaagtgattctcaaatagttatgtttagggtaacacagtgaaactgccatatgaagataataaaatactaaaccaccaaagccctcaagcccaccaaaaatgcagaagtaatttccatgcagatcaacaatgcagatttgatcactatttgaggggtggtagatataagaatgcaagccctgtggagccctgttcccccaaaacaaaaacacttcatgtggcaggctattagagataggattcaatcagctgcaaaactgaagaacataagttgggtaggatcagagttttgtcaactgtgtggtgaaattgagacctctgtgcacatttgctttagatgcccaaagaatacctcgagatttttaggatttctttaccatggtcattgtgaatgatagctccaaagaaaaactagagttgaatacatgttactggcggctgagagtttgttgctgtggtctgtcagaattgatatgatttttagaagcaaactcatcttgacagcactaacaattcctgttcgcattatttgtatgttgttacagtggaagccacttctgaaacctgaagaacttccaaccttggagacattggtgggtgctcggtaacaggatgtttagcttctttttacataccatggtttttgacaatcatcacaaaccattaccgactactaacatttgtagcaaacttagtactgaacatgaaccatgatgcatcataagcaacagaacaccaaatctagacttgacctacctcccacaatcttctttttcttttctttttctaatagaaatagaaaacctcccacagtgttctcactgatttgacatttccccaggcctgactcaggaaagaacccaaatctcctcggacaaggttgaatctttaccaaaatgttgattgagtccagtgtagggctcaacatccacacaagaaaaccttcatgagtcatgacacagatacgcattgatccagcagttatagtatctcaggctcatggatgggacaatcgaacatcaactgatataaacgcactaatgtagtaatgctataacaagacaacgcgtgcacggaccaaatcaatcatttcggcgggacgaaattaacaatccccatcccaaaaatagaatcattatctaggtaggatcaaaagcgcgtagacgaggaaaaaaatgattggtacggacctaaatcatggtggtattcgtagggattgcgcatcattctcttcatggcggtgttgtagtcctccatcctagtgctccccgtcgtggaggagcggcacaggaaaaccccagaggaactccgccgccgttggctcctgcttcctccggcggccatcctgctcctagcagcgacggcgccgcgcgctgggagtcccggggtggccggaaaacacggggcggtggccatggcggccatgtttgcaggatgtggatgtggcaatgcgacgatgcgagcgaggcaagcagaaaggagaccggccggtggtggtggtggtggtggtgggattcccggcggatttggcgcggcttctggatcccggcgacttgggacgatgcacactcgtcttattaatcacgtaggtatctgaaaagcaagaaatcaaagagcgtttgagcaccaggagaagagaaccttgttgtctagcctttttgcaaaaatcaaagagaatgtgacaatgttgatgtttgccaaagagaagcacttgctatagtttaaccttatgtagtcactcttttttttctcttttttttattccaggatgtaatccttttttagatatattcgatgagatgagcattgtctcatacggttcattggaaaaacgtttaatcttaaccatccatttattttaccttattttatcttaaccctccattcgttttcatgtcaagaccataaatgggaagaggtaagatggagttgcgtctagatgctctatcccatgctttgcaagaagagaagacaaaaaatagaaaggcaaataagacaagaaaaacaaaaagagggggcaaggcaacccgaaggctaagctagggtttttgccatggctacatccggactcctgagctcccccttctccattccgatctttactaatcctgcctgaaggataatatctctgatacgcaccaaaaagttgtctttaaataggttccctctcataactagtttaggtttgattatatcgttagtgcatactatgtgtatctaagtaatcaaaagagtataatcttcttatgtatacatttataatcgattatatcgttgatatatgtttttagtgtgcagccacacgatttcacaacatcactacctaaattttatttcattttggtttgcttttgcttattgatagtgctaattgtaagcataagctttctctatagaaaacacataccacaataaaaaaagagacactttcatgagcatgagaaaacttcatgttgaagaaactatgagtgtgtgataggcaaggtggcaattctaatataacaaatggttccatttcaaaacctaggacaatatactggacaataaaactaaatactagactctctttcttgaaagcaacccatagtatttgacaaacactttgatttaacaatggaaagtgaacattttgtgtacacttttagaaagcatgtgcttaattactcaataggtgttataatacattaatactatggatgttaatataattaaaataatatttaggaccatggtagtatgatacacttaaaaatatgatgatatccaaatattgcatttataaacaagatcttaactggcagccttatttctttcttggtgtaggagatgaatcctatttttatatattcttttcaccgacttgtaatacactactatgtaaatactatactcttaaattaagagaagaacaaacatgtactcacttttagttatacacatagggagaactacaatacttcaccattcttttcttgatctcttaaaaaaggaagctctataaagaaagtaaagctaaggataagggtaaaaagaaagtactatgatgaatagcttggaataacctagtatatgctaatattagttgaattgaaaacaactactaaaacaagaataaaatgttgcattaatagtcaaaggctgagacaaagcacataagcatactctagaatatacaaaacttttaggaaatctgaaaaattttcaatacaatttctatgttaaaaaaattatatattgtgttttctttaattgtgtagtactagtagtcggagtaaggagaagcaaaacatgaggagggagcgacacaaaattaactagaggaaagaaagcaaaaatggcaaagaaggaagaaaaaagaaaagggaagaagaagaagagacgctggcagcagctgcgtcgagacgctttatcccttgcctcgcgagaacagaaaaaagaaaaaaaaagaagaggaagaggggaaggcaatccgaaaggaaattaggctagggttttcgccatggctaccacccaccacctcgagctccccctctccattcccaatctctccgactcctcctaattaatcccgtattcccaccccccaagccaaggacagcatctcgcatccgcgtccttcaattgatttgattgggttccccccctccatttcagggtttcgtttcgcatcgcagcaatcttcccgacccagcaagcttcttcttcccttgggtccgttagggtttgagattgagaggggcggcgctggcgatcgagattggtacggcggcggaggcggaggtgggcggataatgtgtatactgtgcgccgtgcaacggtggtcgcggcgcgtcgcaccatgctgccatggctggtgctcccgctcatcctcctctgggcgctctcccagctcctccccgccgcctaccgcttcgaggtcacctcccctcgcctcgcctgcgtctccgtcctcctcctcaccctcttctggtacgagatcctcctcccccgcctctccctctggcgcgcccgccgctccgcccgcctccgcgaggagcgccgcgcccacgccctccagctccacaagctccgcaagaccgccacccgccgctgccgcaactgcaacaacccctaccgcgaccagaaccccggcggcggcaagttcatgtgctcctactgcggccatgtctccaagcgccccgtcctcgacctcggccctgccgggaccctccccaccggctggccctgcacccaggattggccaaatgctgccggtgaccctgcctactggctcgacctccgctgctcctccgataacctgtactcggggttctcgtggcgcttgttctcttccttctgcgtcagcatgaggtggttctggagggaagtgctcagatttggctcctcgggggacggcgatggcttgggccgagatggtaaaagattagcaaaagaaggggagaacggagcaaaggctgaggagagcagagtcgagaaggcgaaaaggaaggcggaggagaagaggttggcgaggctggagaaggaaatgctagaggaggaggaacgcaagcaacgggaggagatggcaaagctcgtggaggagcggaggaggctaagggatgagaaagcagaggctgaagagagatccaaaggcgccacacctgttggggagaaggatcctcggaaggaagtggaacgtagacggcaggagaggaggaggaaggacgagaaggataagggatcaagcaagagcaattcagattgcgaggatatcgagagaagagtaaccagggaaggggagagaaagcgggattctgatagaagaaatgagccagagaagcgggatgcaacaagagttggcgctgagggtcataagccctataattttgatgctaacaaccagggtagtaagacagtacagagcaaggcaaagtactttggccgtatgacaggcggtctgttatcttcttcaagaggttttggtggcggttccttttttggtagaagtgctcagacctctgctcctcaagttaacaaggtgactaaaccgcttg

SEQ ID NO: 61315 - DNA, 1473 bp, Oryza sativa
cccgtgagtaacaaaggcattattaattgctgcagcagtctatctgttacgattacgacatgtgccattaattgttttcaccctgactatcgtcttacaaataccgtttgcatttttgttatgcttttatgcaggttagtccaaatgtgcagtcacagcctactggacttaaaaagtcatggcaccagctgtttagtcgctcagcatctgtgtcaccttgtcctgatgttcctgctacagcccgtgaaatgaacgggcaaccagaaccatatggagcacaaattagcaatgctcaaatcttcctatcgcagtatccccctctggacagtaaccctagttcaagccgctgtatgcaatttccaggtttcccaccagtgaatggagcacctgccaacatgtcactctctcattttccagctggacatatgccctactattgtgagccagaaccaacagtgtttgaagaaccagaacaatttgaggacccatgctatgatcctgatgcaattgcgttgcttgggccagtttcagagtccctagataactttcctctcgacttggatagcgggttcatctctagtgacatcaccaaggaaacacatgcgaagccttcaccaatcgaatctcctctttcaagatcacgtacattcgaggataatcctattaggcactcaactggaaaagggcctaatggttctattttgcctgaagctagcaatgaacatgggggcacatggcaaatgtggggcacgccattagttcaagaaagtttaggtctacgaggtcctcagactgagtggctcctaccaaacacaaatcaatttaaccatggtgccagtcatttgaatggtggaacaagaagctcagtgggttctggtttggatgacaatgatttatggctgcagaaagcgcctttccagcaaatgcctcttgatacaaggagtctgttcctttcacatgatgtctcagagaatgctatacacaacgatttggattttggatcaccaaacaaatcagcccgtttgcaccccattgggccacctggtcattcttggtccaagtaagtatgttgtgacattcttgtaccgctttcagtattttctgcggcgatgaagcatttgattccattatagacaacaatttgataaccttggtttgagctagaaacatggtcataacttacaacagaattaccctaccccatactttgattatgtgagcataattttcatttaggtcataaaaaatcattactaatgtagcttcatgtatcaatacacataaggaccaaatgagatcaaattcacatagtattcttacaaggaataatcatatgccataggggactcctaaatttcttttgtcataatgactaggatgggtgctaccactttatctataaaaatggggcaagagtgataccagttaagagcaaacaatacactctgaatctccaatttagaaggaatcaaa

SEQ ID NO: 61316 - DNA, 1977 bp, Oryza sativa
ttgttgtatgaaacacttgaatatttctttgttctttcttttaaagaatgtattcttatatatttctatatttaatatggaactatggattgatgatgatatcatattaaaataagggattatgtctagtggttcttggtaacgctccactggcattccgaagtagtattattagctagaaagaatgatgacgctgtagaaattaaatgtactgccaatctggaacctgtttcaacagtccttgtctggctctcattctttgggatgtttcgcggtcagcatgaggatgtgggactgtatattactcaatggttgagagtgcagttcaattgactgtctgtccaaactaaataactgataagaaccacgcctgaatccatggatggatgagtgttgtttatgtgaaatttgttaactggttgtttcaccatagaaaaatcaatattgtttttaggatatatatatatatatatttacactgtagatgtctgacacatttgtttagaaaatgtgttcagttcataatgttgattggtttgcctgcatctcttttgactttttttgtgaatgacagaatgatgcatgctattggcttgttggaaaaactgttttatagttcaaacaaaccaagtttcatgtttgacggagccattgtttcgcttattcacggaataagcgaaacggcatatttgcaaacgaaaagtaatttgtgaataaaacttttatatatgtgttcttagcaatctaaaagcaaaggctgaaaaataaacttcgatgaaaaaatctcaaaatcagctccaagttcaaggttggaaattcaaattttggctgataagcataagcataagcgaaaagatgaggccgtgaggcataagaccaagcatcaggtccaagataatgaaaacttaacagggtttgcttttatacttcggtgtttttttgtggagttggtctgacatacagaactgttgccatgtaaatagagcaggcatgatagattgatgtaatgttggcaacttggcagagaaatcagttatgggctcactgttcagtttctctagcaatttgtagctatctttatcaatacacaagcttttgtgattagactgccatttgtttttcttttaaaagcaaaaaaaatgcttgttttctaaccgggttgattttcgggggtttaaggtaccctgttgaactgtaaacaaataattgaaagccactaaggacgttcctttggaaaccaggtgcaaagattttctcactagttatatttgcaatgaaaggtttagtcatttagtttgctgctttatctgctggattcaacttgtggccattgggctgcattatgtgatgatagttagctgcattatctaagcagtaagcaccagtaaatgcagttactagatcatgtgtgggttatgcactggccaggtgatatacaggggtttccaatgtgctaacgtggatgttgttttgaattgtttattgttgtcatcacttgaaactgccgataaattcatcattcgttttttcccttgcctgtactgctctggtgggttgaacagatatgggatttagtttttttttttttgacatatatgccttgggcctaactattaactaagaaattgaatgtacatggtctgagctaaacaatgaatatatcctcgaatagttgggttggacgagttgctagcttggaactaagtacagggccctatacaaatggaatacatgatgtgtaatccttgttcttttaccctttcctccccaccttggtttgtggccgttggggttttatggttggctcttggctgtactgcattttcagaagttacatggtgaactgtgtatacctgaacttttctggtattctttgacattgtttggtgttgaaaatattgttctaggctactaataataatttgtatgctgcaactgatggttcaatttttattacatctgttgactagtcatgca

SEQ ID NO: 61317 - DNA, 4459 bp, Oryza sativa
gattccctagtttgccctgtggttgaactggttagttccagtgtgacctttgctttcagtctgctgagaggtgtggagagaagataatgaaggaatggtcgtggagcaagtgctgttcccattaattgactgcattttttgtgcttgttatctatccagcgcgccgatccttgatttccataataaaagtttagtattgggtttgttaatctgcatggttaccttttgcatcagtcggtccacaaaagtcaaacaaagctgtgtgggcaagtgggtcactagctagctgcctgcctaactattttgttgtgctcatggacatgattgcgccatgatgaaagctcactagctcactcactgcctctgcctgtgcagaaaaggccgcattcgatttaaaggatttttgtatgaactgaaaccttaggaattttttttaccatcattcatttcataggaataaaacctatccaattcctaaggattctattcttacagcctaattctataagattttttttatattatgagagacctcttggaaaaatttctatgaattggagtgcatgagtcattctaatccttaatttttttttctacctatgatttggaaactctatgaaccgaataagtgctcagagttgttggatgtatcccagtcaaaagaaaaggaattgcagatgtgagattagactatcattatccccttgtgaaaaatgagcagatgatatatccgggtagccggcggatttgcctggagtgatgcatgtgtatcttatctatctggttgggcggcccttgtctgaatctcttgcaactgtgcaagtgggctggtgtgtgtactgtaaaacccacacaagcttgagagcgatggaccgactgctcgtggaaatacatagaaactgagaattgagagatggagcaacaagaaaagtcattacgaattctcgaaaaagaaaaagaaaagtcaatacgaacgaggagtacaaacaaattaatgcttagaagaaacgaagcaagcttacaattaacttgatgctacgatcgatacagcatgcttacaaaagacaagcattatggctgtgttcttctcccattttcccaacctatctatctctcgttatccgcgcgcacgcttttcaaactgttaaacggtgtgatttataaaaaaagaactttttatataaaagttgtttaaaaaaatcatattaatcctttttttaaaaaaataggtaatacttaattaatcatgcaataaaacaaacttcattttacgtgcggggaggggttcccaaccccctcctccgaacacagcctatatatccttgatgctgatcgctagagtatgtttcactttctttcctccaaaaaaacgacacatgctcgatagtaagtacagttggatcgatgcttgtctcccgtattttctcaactgcagggaaaaaaaaatgccatcggtctgtccaaagcaggtcacgtactcttctgtccaggttactctagtttggtagttagcacatggcttacactcaatcttgcattgcaaccgatcgagtaccgattcaatattgcatcatgcggctggctctttctttcttgaacaattcagctacacaaccaacatcaatatacgtactcctagtagtatataaacaaggagtacctcattacaacaaatctacttgcctgtatccctgtgtgccttcaagaattaacagcagctatatctagctggctaatggtgagctccccattatgatgaaaaaaaaaggtaaaatttgctacagaacacttaaagattgtggtctttgctgtgagacatccgaagatcgtgtatttgctcttggacaccgaaaaattatggaatttggttggcggcacctcttcccgtattttattatttccagctgaaaccgtgagacaaactttcataaaagacaattttacccatgggccatttgtataagccgaccaggtccggctgcaaccatatgtgagagaagtagtagtagtcagagcagccatggccccctgcccgtgctctgccatggcggcagtgcggtggtgtttgtcagtgacagcgcatggctgccaccacgagcgtcggcgtcaggcaagaggagatggaggcgaacccggtggcgcggcacggggctctgggatggtgtgcaggtggtgctgcggcaacggacggtgttggccggaattgtggaaaagacagagagaggcagtggcgcgaggggaagaaggcttcggccttggagctcaccggcgacggcggcgcaggaaggagacggcgatgtccacggcgcagcacccggccgtgatggcctccacgacgcggcggctcgccacggccgcgccctcatcgtcgccggtcggccacaggcagaaccgcgctctgcccatgagctcgccgtggtccacccctgccgggaggagaccgtacaccagcaactggtcgtcccgcccctcccactgcgtgagcagcacctcccgcacggcgccgccacgcgcgacgcctcctgcagcgaaggacgcgacccgtgtcaggggcaggaaagagagaagaaaagagagaagaaagaaaatagaaagaagaacagtgtcaagggaattttggtactttcaacactctttctctctctgttttcaccgaaaataataaaataatgcctcgagtgtccacagggccggccctagggagggtcaggccgtgcggccgcctgaggcccccaaaatctaggggccccctattgcacatataagtatatatactacgtacttaataattttagtcaatgggctataggcctatattaagttagacagctaaatagctcaatacagaaaatgaattttagtccatcgccagacctgtttcagtgaagccgaagcgattttcatcttactcccgtcgcttcgcctcgatcacatcacgccactcacgtcgcgccacctcgatcacatcacgccactcgctgctcctgcgctcttggtgactcgcaaacggaaacggcaaatcggggctcgctagtagtcagccacgctcgtgtcgatcgtccgccggttgccttctctgctcgctaccactcgctgcccctgctgcctgctgcttgcactgctctcctccaattcatttattcatttgatttcaaggtcctacactcctccaattcatctcatctggtaaatttctctatcacatcgaatattaaatgttgtgtatttataagactatataaatatatatatattagtttatgtataggggcctccatataagtttttgtcctggggccccaaaaccacaggaccggccctgagtgtccagcagctaattaccatatttttacagtgtccataagcaaatacacgatttttaggtatctcacagcaaatgccacaatatttgagtatcatgtagcaaattttgccaaaaaaaacagacatatagtagtagttatttttaagatggaatttaagaattaatactccgtagttggtaaccactaatccagtgcacatgttgactttccaaaccaacaataggataatatatgcacggatagactaatgaatgaatactaatttcattttttgcggtatcttccagaagaaaatcttgcttgtaaaaggctcattaaattacttgcttgctacccgtcatggaagaaaacgtggagaccactgtgacatatatagtgataaaaaaacaaggacaattaattgcatttgtaaattcgccatcgatttttttaatattgcaaggatgccactcgaatgatagttccagtggtatttttataattttctagtgtcagttttgcaataataatttaaagtagtggtaaatttgtaattgcccctaattaaaatgactaaagggatgacaatcatatactccctccgtcccataatataagggattttgagttttttcttgcaatgtttgatcactcgtcttattcaatttttttttgcaaatataaaaaacgaaagattgtgcttaaagtaatgtagataataaagtaagtcacaaataaaataaataataatttcaaaaatttttgaataaaacgagtggtcaaacgttataagcaaaaacataaaattccttatattatgggacagagggagtactaggaaagataagctaaggttcccctaactatgaatgacacatggtcacatgtttactttagcccaggcacttgagatatattaattattaaattgttttcaccatctactactttctccctcctaaaatgttgtatctagattcattgtcataagatgtgtcaaattccatcctactccctctgtttcaccatgtaagactcatatatatgtagatgttaatgaatctaaacacatatatatgtctagattccttcacatccaaataaatatgggcaatactagaaagtcctatatggtaaaacaaaggaaaacatgg

SEQ ID NO: 61318 - DNA, 990 bp, Oryza sativa
gccgatgccgacgcctccgaatcccacagggaaagggcccccgtgcccctccattccaaggtaataaaggaaaaaaacaaacaatctttccttgctcgctccacgctattcttgggttaggttacctgacgcacacgtttcatgatatccccttgctagaggactaacgctttaatcctactgcttaattcctgctacgagccccatttacccccctcatatggcaaataacaacattgtcttgtctttgacttctagtttgctgttgctggatatgaaagctagcgattctaggaatgctttcttcttacggctgaaagaaaaaggaaaattaagtgctttggaaatgtttctggcatgcctaattttcagataaatcacaaccatgtttctttttagtgcacacaacatgttctcttgtttttctttttacacagctgtacttcacttcactacacataattgactcatgaacagcaacaacaaaaaaaatccaatggctttcatgctaatttttagattcatggcttcattttcggtcatttttttcaggcttataacaattagaacaaaatgtttcagtacaatattgttgattcctgctgattgtctagagcttggaggttgaaaaggaactaacacccgtcattccaaacttatatactgcaaccactgttataatgcgataagcaaagatattgcctgttcttattccaaagaaaaaaaaactgcatgcaaattatcaggaatcatactaaaacatgagctaatttgaagtatttctatagttgcagtatgcttgataacaaatcttacttaaacagcgaaatgtagttggctagttggcagtgcttcttacattgtgttaaaccatggtatcatggttttacattgtgaacctgtccttatggattatgtaagcataatagtttatacactggagatgctggattgttgaaagaagtactagggaaaagattgggttgttgt

SEQ ID NO: 61319 - DNA, 1186 bp, Oryza sativa
aaccggcatttggtgaggcatttccaacacccgatacacacgaaatcgtggtatttgctcatttcttctacggcggattttctcttccaaccttaagatttttccggggaattctgaacttctacgggattagcttgcatcatctgaatccaaactccatagtgcatattgccaactttattcatgcctgcgaagcttttctgggcattaggcctcatttcgccttgttccgccgcatcttcttcctcaagccccaaccaaacaagagtaaaccatgcgtcgttgggggtgctggtttccaactcaggggaacactaagccaaaaatacttctccatgcccttcaagacctcaaataaaggctggcacgcaaattggttttatgttcaaaaccccgagcctgttcttcccgagtactcctgtcttcctccagtttatcgggatacttggaattcactgccaatgggagacgaagctgcacaagcagtagaactgatcgagaggatgattaagctgaaagatcagggccttcaaggaaaacagatcacccggcactttatcaagtgtcggttagctctaatcaaagaaagatctcgcacagccttcgaatttgacggcaagcatgatccaaaccgtgaagatccagattctcttgacttcaaggtcatgaaggaaaggatgtataagatcttctcaaacgccatcgttgttagctactctcacttgctgccagtcataccgttcaatgcattcaatcctcctccactggtacgtattcatacacttcaacctttctcaaaatatgatcttgctttcttgttgaatcagttaacaatgaaggatattacacccaggaatttgctttgatgaagtcggatcccccaatcgctcaacgccgatcgccccgccatcaaactgggcaagggagcggaggaccaagaattcggtctgaaactcaaccaagtgcttctgatccaatcggccagtcagattctcgaaagaagaagctggttctaagtgacgacgaagccgatgataccgccaggaggcctggagaccgagagacaaccaagaaactaccaaaacaggctactccaaggaagaaaacatccagtcgccctgtgccaaagatcaggaagtcttctaggtgcaactcatataacgacctctcttgcattgatgcgcac

SEQ ID NO: 61320 - DNA, 7367 bp, Oryza sativa
  unsure (1)..(7367): unsure at all n locations
accattcatgtacaattaacatcattctttttaatggatcaagtgttttcatcggaatgagttgcatcgggatgaagctctctgcacagcagacatattctgcagaccaagattatggacctaaatcctaaggagtggtttaaataacagtgagctgaaacagtagtgaagatcgatgcagaagttgagaagcatgtgacaaagaagatgccaaagcttaattagttggggtattgtgatgatctatcttatgcggttcctagtagaaatggactgcataaggattatctgtttcctgtttcttgagcacaaggggatcaatcgaccctccataattcttctcgtgtgtgaaaaactaaaggattgcagtcctcccataaatctgagttcatttcttgaggttcccaacgtcaactccttaatttcctagctaggcatacgcttcctggactactaagcgattcattttttataaaaaagaaatatatgaaagttattgtaaaaatttatattaatctactttttaagtttttttactaatacttgattaatcatgtgctaataaataatattgttttcaatgcatggaagaatattttcaatctctcctcccaaacatagcaagtactactctagtccgaaaaattaaggggcggagtcaagacccagccaccacgggcgagtgccagagctccgcccactgcattattacgtaccctgtttgattaacaaggaaattagtaaagttgtggagattatggataccccatatctatatgacggttgtaatttagtcggatatacggtaccaaatatagatggaatatctctatgaagactcgggttaggttctaaacttgtatgtcaaggaaatacccgggatcttagtcggttacgattgtattttatctataatcccatattccgttaggatatggactgtattttgtaaagcggactccttcccctatataaggagggtccgtgtgcctcttggggggcgattctttttccaatttatacaatcaataacacactaggcggaatcatccccagacaggagtagggtattacttcttgaataagaaggcctgaacctgtataaaattccttgtctccaaacccatccactttcctagcttgatagccacccccttttattattgccgaaatcttgcttcgacagttggcgcgccaggtaggggtagcgtcaagttctcgccgactaagtgcgatgggtttcgtttctggcatcgacgacttcgccttccctcccgggcaggtgttccggtttggcagcctcaacttcatcaccaacgacttcggcaagatctctctccttgactcggattcaaaccagtcggggagagaccaggtccccgtgccgttcggtattccgaactcggccgaggcctactccaagatcatctctcccgactcggcttcaaaccactcggacgagatccaatctactcttccgcgaccagatcaagacgacgggtcctatccctcaatcctgacgaaacttcctgatgatttggccgctgtcttcacagtcaagacatctcccactcgaagatctaagcgagctccggcttcggccccgatccgatctagatccaggaaggttggcgttatactccaacctctcgggacagtctcgacggaagagttggatggctacctcagctcctccggcgtcagttctcgaccaaccgagatcctcgactacgatgatttcggctaccactacgaccacggcgacctcgacaacttcgacgacagctatgaggataactacacgcccctcttcttcggcgtattcaaggctaacaatgaaatggaggaacagcaccaagcccgagaagcggaccaagatcgcgcacgacaagaagctgaacgtcatcgactagaggaagagcgacagcgataggagcgagaacgactacagtgtgagcaacaagatcacgaacggattgcaaaggaggctgaagatcgacgacaacgcgccttggaatctgggcggcgagcgagagagctcattgggcaacaagacgttgatgggacagcggtctttcgcaccccccagcagaacgcggttgcagcaatcactctcctcgacaccctcctcaaggaagacgcactcaaccaagcttatcatgtagtcaacatcttgaaccagacgaagaccatgatcgctgcctcggttccagccaactccgcaagcacccgcaccccaactggtagccgagtccctcatcttcgatctcaagactatcaccagccaagcctcagcattgccggcgtcaaatctagtcgcaggagcaggggacatgatgaacggtccgttcgctcgcctcccgagcgatatagggagcgccaagtcgaacgaccacagtccccacatcgaagatgccccatcgatcttcgcgacaccatcaaccagcgccgcgcacaagaggccatcattcaccggatcgctacgacgacgacgtggacggagttgctgccttcacaagcgatctgtgtcgagtggattggccagccagctttaagccgactggaatcgagaaatatgacggcaccaccaaccctgagtcttggcttaccgtctatagtctcgcaatctgcgcagcaggaggagacagcaaagccatggcgaactatctacctgtggccctagcggattctgcccggtcatggcttcatgggctaccccgcggcacgatcggatcatgggcagagctacgcgaccacttcatcgccaacttccaaggtacttttgaacggcccggtacacacttcgatctctacaacatcgttcagaagtctggagaatctcttcgagattacattcgacgcttctctgagcaacgtaacaagatctccgacatcaccgacgatgttatcatcgccgcctttactaaaggcattcgccacgaggacctagtcggcaagttcggacgcaaacctcccaagacggtcaaacatatgtttgaaaaagccaatgagtatgccaaagccgaagatgctatcacagcgtccaagcagtcgggcaccacttggaagccaaagaaggacacgccgactgcaggagggagcggaagtaacaaccacaaggatcgcaagcgtaagcccgaagaacttgtggccacaacctctccatcttcccgacaacgtccccgcgtcaacaccttcgacaagataatgaactcccaatgtccgcatcaccccaactccaaccacgtggccaaggattgcttcgtctacaaacaatttgcggagcaatacgtgaagaacgcacgtaagccctcagacggagatcaaggcacatcaaagaagaaagatgatgaagacgatgccccgactggttttcaagatcatcgcaaagaacttaatcacatcttcggcggacccctggcttatgaatataagagaaagcagaagctaacagaacgggagatcaatgcagttcagcctaacacgccccaatacctccggtggtcagagatagcaattaaattcgaccgctcagatcatcccgaccgagtggtccacccggggcggtatcctctggtactagacccagtggttcgcaacgtcaagctccgacgaactctcatcgatggtggcagcgcactcaacatccttttcgctaagaccctggacgatatgcagattcctcgcacagaattaaagccgagtaatgcacccttccacggtgttatcccaggattgtcagctacaccacttggccatatcactcttccagttaccttcggcactcgggagaattttcgcacagaaaatgtttgtttcgaagttgctgatttcgagacagcatatcatgctatactcggacgactggctctagccaaattcgtggccgtcccacactacacctacatgatgatcaagatgcctggtcctcgaggggtcatatcactacggaacgacatcaagcaagccgtcacatgtgacaaagaaagttgcgagatggcccaaactcacgagactactctcgcccgcgaagagatccgactggctgcgaccacggcaagcgagggagaagtgcctgcaaccaagctgacgaagaccgaagaaagtgatgccaagacgaaaaagattcccttagatccctccgatcctgataagactgctgtaataggcgctgagttagattgtaaataggaaagcgcgctcatcacctttcttcagaataataaagatatttttgcgtggaaaccatccgatatgcctggtatccccagagaggtgattgagcactctttacatgttaaggaagacgccaaacccatcaagcaacgactccaccgttttgcacaggacaggaaggatgcgatcaaggaggaattaaccaagctgttagcagcaggcttcattaaggaagtccttcatcccgactggctggctaacccagtcctggttcggaaaaagacggggcaatggcgcatgtgtgtcgattataccgacctctacaaatcttgtcccaaagacccttttgggttacctcgcattgaccaggtggttgactcaacggccggctacgagttactcagcttcttggactgttactcgggatatcatcaaatccgactaanagaatccgactgcttgaagacctcgtttattacgccctttggggcctactgctacatcaccatgccctttggattgaagaatgcaggagcgacctatcaacgcatgattcaaagatgtttttcaactcagatcggtcgtaatgttgaagcttatgttgatgatatagtcgtcaagaccaagcagaaggatgatctgattgcggatttagaagaaacctttcaagcatacgtgctttcaagatgaaactaaacccggaaaagtgcatcttcggagtaccatcagggaagttgctcggatttatggtatctcaaagaggcatacaggccaacccagagaaaatcaacgccatcctcaacatgaaaccgccaagctcccaaaaagacgtccaaaagctgactggttgcatggcggcgctcagccggttcgtctcacgactcggcgaatgggggatgcccttcttcaagctgctgaagaagactaacaatttccagtggggacccgaagcacaaaaagcctttgaagacttcaagaaacttcttaccactccaccagttttggcctcaccacatccaccagagccgctactgttatatgtgtcggcgacctcccaggttgtgagtacggtcctggttgtcgagcgtgaagaggaaggccatattcaaaaagtccaacgaccaatttattttgtcagcgaggttttagccgactccaagacaaggtatcctcaggttcaaaagttattatatggtgtcttaattaccatcaggaaattatctcactactttcaaagtcactcggtcacggtggtcacatcgtttccactcggggatatacttcataatcgcgaagcaaacagacggattgcgaagtgggccttagaattgatgtctttggacatatcgttcaaaccacgaacttcgatcaagtcacaagctttagctgatttccttgccgagtggaccgagtgccaagaagacatgccagaggaaaagatggaatattggactatgcattttgatgggtcgaagaggcttacaggcactggagctggggttgttttaatctccccgactggagaaagattgagctacgtattgtggatacatttttctgcgtcccataatgtggcggaatacgaggcgctactccatggactaaggattgcaatatctctaagtattcgccgactaatcgtccgtggatactctcagttggttgtcaatcaagtcatgaaagagtggtcatgtctagatgataatatgaccgcttatcgacaagaggtacgcaagttggaaaataaattcgatggactcgagctcacccatgtcctccgacataacaatgaggcagccgacagactggccaattttggttcaaaacgggaagcagctccttcagatgtgtttgtcgaacacctttacgaaccgaccgtgcccagaaaagagacagtcgaagccatggatattcaaggcgtaagcatgatcgaagccgactggagagaaccgtttataaaatttttgagcaaacaagaactacctcaagacgaaaatgaagccgagcggatttccaggcgcagtagactttacattattcatgagactgagctgtacaagaaaagtccgtcaggaatactgcagcgctgtgtgtctttggaagaagggagacagttgttgaaggatatacattctggtatttgtggtaaccatgccgctgcacggaccattatcggcaaagcttaccggcaaggttttttctagcctacagcggtgtccgacgctgacaagattgtgcgaacatgcgaaggttgtcaattttttgccagacaaattcatttgccagcccaagagttgcaaaccatcccgttgttctggccatttgcggtctgggggcttgacatggtcggcccgtttaaaagggtagtcggtggttacacgcatctctttgtggctatcgacaaattctccaagtggattgaggctaaaccggtcatcacgatcacaacagataaagttagagattttttcatcaacattgtgcatcggtttggggtacctaatcggatcatcactgacaatggcactcaattcactggcggagcatttaaagacttttgtgaagacttcggcattaaaattttttacgcctccgtggcgcaccctatgaataacggacaagtcgagcgcgctaacggcatgatattgcaagggatcaaagcacgagtttttgaccgactacgtccctatgctggcaagtgggtagatcagctgccgtccgtactttggtctttacgcactactcctagtcgggctaccggccagtcgccgttctttttggtttatggcgcagaagcaatgttgccgagtgaagtggaatttgaatcactacgatttcggaacttcaacgaggagggctatgaagagggccgagtagatgacatcaaccgactagaagaagcccgagaagcagctttaattcagtcgactcgatatttgcaagggttacgccgttatcataatcggaatgttcgatcgcgagcctttttagtcggtgacctggttctgaggaaaattcaaacaacacaggatcggcataaattatctcccttatgggaaggacagttcataattgctgaagtcactcggccaggttcttatcgactcaagcgcgaagacggtactctcatcaacaattcttggaatattgaacaccttcgtcgattttatgttaggcatttcgcttgtatc

SEQ ID NO: 61321 - DNA, 1555 bp, Oryza sativa
aggactgaaggtttttaatagcttttgcgggttttaggctcaataaggcttgacaaaggcttttaagaaatcagaagctaagtatggaacaccaagcatagcataaattcatcagtattgtacaaattgagcctccaccgtcattgatcatcaaaatcattgttatatcaatcagtatcagttttttcatcatcagacttattagacccagtcggccgaaggtcgacatattggaatctctcaactacatcagcagcaatcttgtcagccgctttctgcgcatcattgatgaggtcaagagcagcttctttgctcgtcccgtctgcaaagccatcaatggcatcaatgtcaactcttggataaagggatttggtcatcgccaatgccagacttgctcccatacttccagcttctttgatgttcttgaagtaagtatctggagcgactctcagcttgtcgaagatttcggcagcatcaagtgtactcgaaccggcgttattgaagaacatggcctggataagtggagtagcggcattagcgactttatccctggctccttcaagcttgttgatcttgtcaactaagacatcaaattgtgcttgagacttgatcttgcggtctgcgtcaacagattcacattaatgaatcagcatgtagaagataatggcttttgaagtattgattattggtaccttcaacctcctttaaagccgaatccctctgtcttgccagctctgccttgtcattttccagagtttggatatgcttctctagttgagatatcttggcagcttgcactacattaacttcggttaatcaaggttacaaagataacagcacaaattagttgggcagagtttgcgcgaaccttttgatgagccactcagttcgaaattggactcctggagctcagcaatccgatccctcagatcgtgttcattcttcttggcaagttctctggcctcgtgcagttgactcctggtggcttcgagggttccaagatgaggaactagtctctctagggttgcggttttcgcctcgttcctaagatgaatcctctgcggagcagtttaatcagcgctcgagctagacagtaaacaagatggctgaggtcaggcatcaaagaaacttacatttacaatgcgagtcgcttggttgagtccctttttcagcaggcatacctcttcgtcttctttttgccggtttattacaattccttgaggttgcaagttgtcatcccaccacttgaccagaataggagggcacgaatcttcggttgcttatatacggggaatttcttcttcatcatcgatcattggtcctaatgcatccaatgacaaaggttagacaatcgatcagagttatttgggtcaacatggtttcggacaaagtgtttacctgtaatgatttcaggacgaggacgagtggattcggatacttttaaaggggatccagatctccggtcattgctggcgtcttgtccgcgagggttgtttgcttgggtttcgacttctggaatctcttggcttggccctgcgtccgactggtttccagt

SEQ ID NO: 61322 - DNA, 19747 bp, Oryza sativa
  unsure (1)..(19747): unsure at all n locations
attcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcacaactaacgtggcgccatgcggcatccaatttggttgctagtgctgcttatcgatcaaaaagtgtgaatacagtggtccacgtgtgaatacagtggaccacgtgtgaatacaatggactgtcacgcaattgtgcatctatctgtgtacatttgatcgtttcttccaatcccgtgcatcacgactctaggtgtttctctcctagggatgaaattaaatggtcgaaactatattatcatttttattgttttatgtaaatagtagcgatagcgatactactgtatatcaagatacctctatacttttataaccaatttaaatgaatacccacttgtataaattacataagaggccagatccagtcgccggggtgccagaactggccaaatgagcacaagatttggtggttcctcccaaggcacgacctgcctcccactatccatcattggtcgcttccctagcactgtcgcctcctcctctacctcaccatctgaattttccgatggcgactcggacggtggtgaggcagaggcggtggtggttgtttcgcatcctagtcgcccctgaggtgggagcgatgcggacggagctcaccttctagagttacggttctatcaatcttatttcaagagaattgaaacacataagaaagaagtggcttattatgaaagctgcgtcctcacggcacctctcctaaaaacacacctaaaaacatgaaaaatggaactatagactatggcgtcgttagtccacttagtgatccaattacaaaactatatgttatttgtccctcgactcacaaaaagaaactcaagttttatacctaggtccgacccacggttcactatttatgatgtggcatcatttttttttggttatattttatttgaagaaaatccgagctagaataataaatccctcaactactgtgaaaattctattatttggtcatattatatttgaagctttcgtcaatttggaaaaagcctggcacctgttgagtcagctagacttgtatccggtgttttggtttagtagacacacattaatggttgtgttatgatgattatgatatggaattttcctttagtgttgatttgcatcaaacaaaaatgaataatcactactggagaaaccatctttaatgggttgtccaaaaaccataatagtctcggttgcttaaaaaaaccagggctaaaaaaatttttagtcgcagttaaaaagggtagcggtattttttctatctcctccctagcgcgtagatcaacaaaaatcaaacagagcaagcgtgtcgatcaattctcaaaaaaaataaagaacaaaaaaaatcagaggcgcccagctcccttatctgttctcctcctccactcctccccatccatctcttcttttcttcctctcctccttctcaactcctcctccagatgcacttctcatttagttttctccttcttctccttctccactcctcccctccccttatctttgacctagctggcaggcgggagggccgcggcggctgcgtcgggggcggccggcgccgggcgggaggccgcggccggcgccggttgggaggcggcggccgacggacaacatgtttttttttcttctcttctctgttctctgtgatgaatgctgacgatgttgtagatgtgaactttttttttctctgttgtctatgatgaatgcttgttgtcctggagatattgtagatgtgaataaatgcaaagaatattgatgctttgatgttgattttattcatttgatttgtgatgatttgggcttttttttattttattcattcgatctatgatgatttgggcgatatgcaaagagtaaaagaacaatgaaaaagaaaaaagaccaaccggataaaaggaaaagaaaaaaaattttttaatcctggttggtaacaccaccggtacagactgttgcacctcccaggatcagcctgatgccgcgcattccaaataaaaacgcaaaataaaagatcatcgggcgcaaccaataaaaaatcgccgcttcattgatttcaatataccaggtactaaatattttcacatatcaaagaacgttgtagttatgttagaactgaaaaaaaatatcggaagaatgggagcataaattaagtgggtcacgttgtatatggagtgtatggtccgatgaacgtgctttgctggatgatggtcttttatattgaatttttacggtataatttattggtagtataaacaatccaatgacgaattagtttcctaccctactgcataaatggttttttcagggcgagaccctctcctctcctttctcactctctcacctcttcttctcactcttctctcctctgcgcagctctcctatctcactctcctcttgcagccagcggtgggcggcgcggccggtagtgggcagcgtggcaagcggcaggcaaggggcactgctggtggcaggtggagggctcgaccggtggcatcaggcggctctgcctccgccggcctcgtgacgggcggcaggcggtgctatcaacggtgggcttccccgcgcatcgacggaggcttcgatagctgatctggcaactgcggcgaatgcaggcgccggcaacggaaaaggcggcaactccctcggcccttccacgcgcggatcgagcgacgggctcgagcgggaggccgggagcggctctcccctgcccttccccatgcggatccggcggtgggctcaagcgggagggtaaatttgtctttccatgttacacatgacgggcagttccgtaaaaacccattcttcactccggtcgaaaggaaaataatcgttagctgtttcgcgatgcccagagaaaagcaggaaagtagcttgtattataccgttttcctctccctgttttgcggttgcaatcttgtggatttatcaccacgtagtatgtacctatgccgaatgtcgatgatcaggaacaagattaattatgcatagctagattaaagtgtgtttaattagagaaaataatcgccaatttgtttattactagtatttattaatgtattagatcgtcgttattctttggttgcgatctatagtgggactaaaaattaaatagtcctgttgtaaccaccaaccgagactaaaaatccatttttagtctcggtttttagtgtaaccgggactattatgattttcgccagactgatcaaatatggtttcttcactagttaataaagaacgtctgcacctggacatacgcactcgcgcactgtgcggagtgaggataaccggctcgatgaaacagagcaaagcaaatagataggggaaaatagaggaagtagagaagggcaaatctgtatatggtaactcaataaaattcagcagaccaagcatgatttcacgttatcaacaaaccatatatgatttctccaggaatttcacaacaaaaccatcgtgaccttctctataattatcattgatggtttttatgcacaaagcaatcatcaacgcaaattatacagaaggtcacatagatgtagtggtggatctagagtcctaacgtgtctatcgttatcatagcatgctaattatatttagaatatagtgttataatatatagacaagcaatttaaacatagcttttgtcgaatgtcatcgctgtcttctgacaccagtggtaacactgtagatccgcctgatagatggtaagcgctaacaaaatattatgttcatgttatcggatattatgataaaatagtaaccaaatttatcccataccttttagtaagttttaactctccaacaaagccatgatagtaatttcatcaaataacaattatcccttgtatatctaatctttatctttatttactacgtagtaaaaaatacatagtagtggtggtgagtcctggataatctaagggccgatattacccttaggatcctcgtgcagatcaaaaggctcagatacccctcatgctgtcccgcaccgcccccacctccgtatcacaccgtccgcccgcatcacaccgcctgcccttggacgcccccgttacctcctccttcatgccacttggcgctgcctccgtggcgcccccggtggctccttcgttgtgctgctgccacctcctccgccgcaatgctactccatcgcttcatagcccctctcctcctccagccctatgctccctgctccgtccggtgcaccgccacttcctatccccatcatgtattccaactttatatctccctactgctgtcatcctccaacttcatatctccctactgctgtcatcctccaggtaattgattctatattggtttggtttatcggatagtccgtggaagatcgagctgctgctaagtcaggatacatacatgtcacagcttaatttttgtttcaggatttataaattatttaataaattattaatagaatttatattaaatgttcattaatttataagtgaagttaaatgtgggaaataaaatttcctaaatataaagcatggatggatttaatttgtattaaattctccatgattaattatactctggaattttcttggatttttcagagctcaattattaattttaataatacaaagaatatttcagtaattattcacatattaaattaatcattaaatgagctggtttcaattttgttaaatactttgagtgttcaagtatattcaagatttttcttggaattacaattgaaagatcatttcagtgattaatttaattgggaaaagtaattaaaatccccttttcctttttgggccgaaacaggaaagttcacctttagtcctcggcccattcttctttctattcggccggccttatcccttccaatagtctagtttgcatccctgcttctatcgggctgtgcaatagaagcccagacaaaagtctgttttgcctccctgacactgttcatcttccagctcggacagagtccgagccagccatgcccgtgtcctgttgccgccgcctcctccttccaaaatccggcctcctcgttgctcctttttccaaattagttgagggaatggaatcctctcaatctcctctacaatttcccaagaaatcccaaaaagtttctatggaaatcctttccaatttcgcggatcaatctttccttttccggcgaagatccttaacattcccgcagtttttcccgtcgatatgggcttggacccgagctcccggtcctatataaaggaccccctagtcgtcctctacctatcccctcaaatcccgtcttccgccgtcgccggaaacgctctccccgcgctcgccttctctctccacctccggccgctgctccagccgccgtgcgccgtcgctgtggtcgtcgccttcggtcgccactgccgccattgggttcacgaggaggagaagaagatcgtcctccacttccccgaagccgaaatccacctgatgaggacataattagctcggatataaccatgactaccttatgtattaatcaaataaaggtgcatatgttctacattagatatatttgttatatatttgaacaaacgctgccacacaatgagtttcgtgtgtttttgtttgcagaggtacttgcttgggcgaaagaaaagagaccgagcgtaaggaatgcatggatgattgaagaagttgattggggaccaaaccaagaccttctgcaagtcttcttttttttttgaaggttttctttcatcttaacacgtcacttttggtccataaaagaaaagagataaagttctacacgttttgatttcggattcaggcctcctgacagcatcaactttaaatggacctagcctctgatctagaaggaattttgaggcctatgagtacttgttggaaagcttatgggtctactttcagatggttttgtccccatgtcaaaattcctaccgagctgccggaaatctgcaaaacaagccacatatctcatccagtccgaatctgatttgggttttgggccttgtaattgtgtcgtgggcttagcccaagggatgtgcgccatagggaaaccctaggacatccctaatcatattaattcagtagccgtcatcgtttagagttgggttttgcttagattatcctgtcaagaacagtttcgccgctagatcggtttgtggaaccccaaattcgagtgcttaattattcatatgcaatttggttacaatctatcttgttcttgcttgtgttctttaattcgcatgcagggattagccttctcggcgaggtaaaccgggtttcggcacttttgataaccagaggagacgtggtgctgcgattacggggctcagtagcgtgttcgttcagaagccggatcgagttgtgtcacgactccacccaaatctttgtttatcaataccaatcggaagatcgggacctaacatccctcatcaccaccggagctccatcagcgccgtcaacccgaagttcaccgtcgcgttttgatatccagcgaggccctgcagcacctcccattgtcgccaagttttgtcaccgcctcctttgggttcgcagctgcgaggtgaaggccgtccactcctccattgtcgctgctcatcgccggaaagtcgtcgctgccgtggaccagtacatcgccaccattcggatctcgtcaccgccatcttccgtcgctctccgtcatcacgtaagtgttggtaaggaccgtcgtctcgtgctctttctcccggtgtgctccctttttgccgctgctccgtagttcaccggtgatcgtcgctcccgtgtctgccgtccagtgatcccgcgtggttgtattatctttgccacgtcgttgcatctctgctgtcacttcaccgccacctagccacttcgttgtctctgctgtgccatgtctaactaaaccctagaatggattcaatctaatccgttggatctcagtcaactctcggttaagattaatctcagccatccaaaatcaatataaatccgttctctcttttcaatggcatattattcatttttaatatatgtcaactaccaaatataatctaattttttccagagattgttttaatcttttatctcagttataaatcatttgtatattgtttaattaatttggaatagtcttttctctaataggattaactggaattaaatcttgtaaaattcataactaattcatataaaatcggaatgaggtcgttctagtctcataattcatctacaatcatgatctacatgtttgtttactttatatgttctgtttatttggtttttattagtctttttcctcgttttgcatgttagcttgtcgttttcgtcgtttcgaaggttcgcgtgtgtgtcgtaagagttcaagaagataattgaagaccaattattgcaaggcaagccacacagatcctaatatacaattcctttgagcatgttgatcctatatttaaagtctctatttatttcaactgtgcatttattttcgaatgtcaccgggtggtgtgaacttattcctttgttatggccaatttgcgttcattactctattccttgataccttgtgttattataattttactagttgagctttgtatatttgttcagctagatgttagacataattgcttagccatgcttagaaacattagcacacaattgggataactaatgttttactattacttaatgatggatatttaattgtagctcacaatggttaatcgtgattggttaattaattaatatgccattaaaacttgataatggtgggttgtgagcacatggttttgatggttgtgctcatgacaattaaggactggttcacgagtttcggttgtgaaacattaaccgtgccaaccacaagccagcatgcgcaacgcctttaccttttgtatagcatggttcattgcggggcaccagattgagaagtggtggagataagcccacgggggtcgctggggagtccatgccttgtttataagggggtgattatgatccaggaacggtgtgctgtggtggattgtattatgcgaggggtactgtcacagctcctttccgaggtaccgtggtggtattgaggcgcatggtaacatgttgtggggctgtgtcttgtgggtacagtggtacacctctggctagagtaaaactattcgaatagccgtgcccgcggtcatgagcggctctaacaatgtctgtcgtgattagtctcacacttttcaccataataaataatgctataactggtaataatttgattagctcctggtttggaatgatacattcctggtttggagatagatctgtacagccgggtatggttgtttagtatggttgggtctgtgtagtatgggtgtgctgttcagtgttgattaatattgatgattaattactctactattttacaattctcgaatgtttgttaaatgctgcttttgtaaatgagccctatattatgccattctttggtatccttgtgcatttgcatatttgctgtgtggcttacggagtattccatgtactcaccttgcaataaacaatcaaacctcagttcaagaaaagttgcgaaggagaagacgtttggcttataccccaattgagctgcctgtgggagtgttgccggagcttcgctagaccgtaattccgctgctattttctcttttcttttgtaagtatgtaatgctgtattattgatgaatctgtatattaaattgtcagtttgtgtaccttgtctgattcctggacgaggatttgacacacaaattagttcagaaattactagtgaatttatgggcgtgacaagttagtatcagagccatctcaactgtaggataagccaaatggtcaaactttaaggactaattttcaaaaaacatgattttgtgaaaatgtttcctttcttccttctccagaattctttgcaaattgctttatcatcctttcctcttcctctttcagcttgagtagttctgaaactagttgttgaaacttgaagaagccaatgtggtctacttatcaagtggatcgaggaatatgaaggtgatgatcgatctgaagtgtccagttgtcaagaaggaatgaagtttggatcctaccttagaacttaaaccgccaaagtgactttgaagtatagttagtagggtagaacgcttttgtttgcttgtgtgtaggtatggttgcattctcatcattgaggaagttcattgatgagtgtgtaattgtactaggttgctcgtttaatcaacttgaacaatataatggtctacacacaccagatcagtgataacctagttaaggtctttatctttagtgtaacccctctccttctatcttctccaaatctgcaacgaatggtgaacactcatgctagtggaagtggaaacaataacaatgaagagaacccaacccttgctcaagttctggctcaacagactcagttaataaacatgatgatgcagcagatgcagaaccatctcaaccaagggaacaacaatgctccaccgccccagaacaagttagctgatttcctttgtgtgaagccgcctaccttttctagcactatcaacctagtggaagcaggtgattggctacacactattgagaagaagttggaattgctccagtgcacagatcaagagaaagttgtgttcgcttcacatcagttgcatggatatgcttcagaatggtgggatcacttccggatgaacagagcagaaggacaaccaatcacttgggaagagtttaccgaaggattgaagaagacacacatacctgcaggagttgttgctttgaagaagcgtgagttcaggacattgaagcaaaaggatcgtaccgtgactaagtttctttatgagttcaaccgtctagcacgttatgctccagaagatgtctgtactgacgaggaaaggcaggagaagatcttggaaggcctgaaggatgaactgtcagttacgttgatctctcatgactatgctgattttcatgagctggttgacaaagcaattcaactggaagataagaagaacaggatggacaaccgtaagagaagaatgactgttttccaggaggcacagggcagtagccagaggcagcatatcaagccatcccaagttggtgaatcaagtctaacatctcaagaacaatcgcaacagttgaacatcggtggtgagatcaattcagagactaatgcaagcaatgaagttaacatcaagcaagctactctatcggagccagttcagcaggatcagtctcaagaaaataacagtagtggaagggagcagcaagtatgtttcaactgttatgagccaggtcacttcgcaagaaagtgtccgaagccgaagcatcagcagccgcaaggtcaagtcaacaacattgtcgtcacaggagccaatgcagtgccagttgcgtcctcaagtgttacagctcagccaccagtttcaaagcagcagtagtcttctttaaagccttagaataattatcggagttatggaataagatagactgcagttgacctatgcccttttctttctagccgttccgaatctcgggacgagattctttgtaaggggggtagatttgtcacagcctgatttttgtttcaggatttataaattttttaataaatttttaatagaatttatattaaatgttcattaatttataagtgaagttaaatgtgggaaataaaatttcctaaatataaagcatggatggatttaatttgtattaaattctccatgattaattatactctggaattttcttggatgtttcagagctcaattattaattttaataatacaaagaatatttcagtaattattcacatattaaattaatcattaaatgagctggtttcaattttgttaaattctttgagtgttcaagtatgttcaagatttttcttggaattatttgagcattggaagtatttttaacaattgaaagatcatttcagtgattaatttaattgggaaaagttggcaatacaccgacgtataattgtattgacgtggatttccttacaaaaaccctaggtatacatatttaattataccctaaggttgatacaagtcctgattcgacacaatatagggccccatcatttggctttttcccaaataagccaaaacggcttattagggaataaaaaaatgaatttgtaggtaaaaattttatatatgtgttcttggtgacttaaaagccaatgcagaaaaaaaaactacgttgaaaatatctcaaaatcaatctcaaaattaattttaaaaatttaaaatttagctttttctttggctgattaggccatccgatgggagccataatatttcctaacaagaaaagaaataactaatcatgtctatttaagagatatactaaggaaaatataaagcagtattgtcgtagttttcaggattcctcattgaactcggcttaatctggataaatttccatctaccaatcagtttctttcattaaccaattccacaaaataatcgtaacaaattttggtgttaacaagaagtcaatgtgatttggaggatatatgaagatcttgtttcgtcgatcaccttaatggatggttcattccaccggtgctcatcgtctagttccatgaacaggcataatgacaatggtttcattgtctaatcagatctctttggttcccatttcttgattctccctttttgctaggaaccatttagttccaagaaaaactatcttagccaaagcaatgtactccctttgtcccgaattataagatctatatatttttttcacgatcttcaatgacttaagttaaccaataatttatttcatattgtatcatcaacaaatatacaattagcattacatggaagtattttataatacgaatgtaatgacataacatatataatacttggtgtagatattgttagtgtaattattaatcaaaagttatcgagtttgattttacttaaaaattaaggctccctataattcaggacagagggagtaagatgaagatgggctattatattgtattgcaaagttccaaaaaaaatctagtttattataacatgagtgatgtcagctatgaaacatgcgaaagtgaataaagccaaaatttaccgcagaagaaaataaaaatgccattttgtaacaacacaagcaagagagaaaaagaaaacctttcatgggtttgtggatcactggtttgcatgctagaaaataggcactgctgatgacaatgcaggaagttgatatctctggtacaggtcattgaactcatgaaaatttcagaacacataaaaaaactaaggggcaattgcttatttgaccctgttttgaactgtaactaccaatttaaccctgctttttaaaatgtgcttatttgaccctccttttaaaaaacgaagcactggtctgaccatattccgtttggatgagttaacggtgttaatttaggcgtaaatagtccattttacccatacttatttaacccagttgcttgtttgacctgcttcttatcctctctctctaatctctctctatctccctcgagcgctgcggcgacggtggcggcagttgcggcggaggaaagagcgacggcggcggcagctgcggagggccgacggctgcggaggagcagcggcgctgggagcgaaggggcggtggcggctcagcgacaccagcggtggtggtagaggggtgttgacgtaaaacacgaggcctgggagatctgctgaactccagtgcaggtccaaaactcgcgttcgggtatgctagcgtggcagttgatttgatcctgcaatcaacaagaaataaagacaaagaaaccgcagttaaacctataaatgatagctgatcggctagatgccgatgacatatcatttatctctgagccgatgtcatatgtaaatcaatcggcagttggaactagataataaaggactaaatctattcgatcggctatacatattaacaatatataattcttatatcgatatatatttaaatcaagtgattgggatagatcagtccctatgccgagacagtataaatcacttagatcgaaatatatattaataatagaactatatatgtttacagcaaatccgatcagatagatctagcatgtatcggctaatactccgatacagctctatgttaagatattaaaacaagcagaatataccaaaccgaagcttaatatacgtagatgcaataatatcttgacataaagagcagatttaacatgtcaacgaagcatatagagcaaatatagttaaaccagataagatcggctgaaactccgattctaccctaatcggcaaccagaaggcaggctagagactaatattctaagcacgacttaatagatcaaactcaactgatgcagcattaagtatgaaaagaagaacaatatgtagacaatcaagctgctggaagtttcatagagtggtggagatcttatataatctaaatcaacgtcaaaatctaacctaattggctgccctctattaacagatgttagccgattgtaggttagatagtgatattgccagagattatgtaagatatatcataactcgatgaattacataaacaagattagagtatcataaagatggaagcactaatcccgagaatgcaagccatcataacaagttttacctcttgttgaagatcgaaaccgatgcagctcaacccaaaagcaagaattcgtcgaaataaaacaaaagcaaaagggtggcgatgcgccgaaattgtattgaacgtgtgtgttaattgattacatggggttcggggtttatttatacacaaaaattacaaactatgtccatatcaaacatgactcgtatctctaacaaactctaagatacaataagtctttatggcagacttttgccctaaacatatctctaagaaaattacataaaatatcctaattaatagatacaattgccttctcaggactctatccaagtgcggcaaccatcttgaagcaccttaattcaacctgatatcgtatacgaagttgtattgtcagaatcggctatatcaacttactcagtccgattcggatccagccgatcctaatcgtagctgatttggactcctgccgattcttgctctgttctcgaatcgatctccgccttcgactccacttcaatctaatcctcttttccgatgctgatattaccaaatttggtcgttaacatatgccccccaagtctggaatatttggtaatgttccggatttgctgtatatcaactccgagcaagtttcgcactttgccgttttccgactgttacagttgtgctttaaatactaaccgtcaccctcgaaaaatttcacaccgtcctcctccgttttcaccgctaaaaccaactttgttctctctctctccagcgatctctccaacacacaaggcgatcccaggcgatttcatttccgatcagatctccgcctatggtgatgtcgtcttccgctagcccgtctaccgcgccatcggcagagtacgctgaggtaagttctcatcggatagatcccttttcctcgcatgaaatcgatttcctcttttctcatcgtgctttctgcttcccgattcctttggatttgcagcacctttccaacctagtcgcgattcccagccggtcgcacgaaaaccactattttcttggcccaatcggcaatattgaccccattgatttcatcattggtgaaaccaacagaatcccctttagactagtgtcacgaccggaaataacccaacgggcgttccttacgtgcgtgtattattccttgttccaggaggcaaggtacaccgaaagttgatacatttcagagtttatcaagcggaagcataaatagttacattattacatgggcggcgaaggcccagcacacaagaagacaaacgggaaacagcggaagacaagggcgacgaccacaggcgcttgactgcaggcacgagctaaacaccaaagccttcatcatcaaggggctccttttctgggtttggcaaaattgagcaagactgagtacaaccaccgtactcaacaagacacacccataagtgcagaataaatgcaagggagtacaagggggttataatataaagggttagggtttgcagtaaacagcattaaaagacacttagttgctcaaagctattttgtaaatacgatcctagagctatacaagattattaatcaaggccgtgaacccacacgaacctgccttaacccaaggcctacgatgattcagaccgaactggcaacccgaccctgggtcccaactcgtcccaagccaacccaggccaaccatttccacattttagttgttaagcaggttttaaaattaaaacactaacttggatacattgctcggcttgcccataaccaagggcgcggctattcgaataggttatactctgatcagaggtgtacatctttacccacaagacagatcttcctcacatgtaaccacgtgccacataccaccatggtatacggacggaagacgtgacatagtttccaacccatcctagccatagacaagagtaccgacccaaccccacctacggccggaacccccgggacaggtaggcaggactgagcccctatcagcaggacaccggccctatgccatgacatctcgactaccgggccgcagctcgtgtagccttcatttgtcctagagatgtccattgacccccgactttgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccaacctaaaaccattttgaggattttgaatagagggggaggtgtgaatccaattccacaataatccaaccattccatagtgtccaggtgatatgaatatcccaaagtctagagttgtaaaaccacctaatgttacctaattaagcggcgaagcatctacctaaattcatactagtggtaccatgagtagagtgtccactagttggggttttgtttattctagggtgaacaaggtaataataacaataacaataataaggtcataacaaaggtaaataggcatggctagataaaacagtgataacgcgggaatttaagtaaagcgataatgcaataatttaaatcaaaataattttataaactgggattcaatattctcaaggatgatgtgacttgccttgctcactttcccaaacgtcggcttcaacctccacgaagagcggatcttccgaagctgcagcgtctacacgaccaacggaaaagaaaaggcttttactctaacaaactccacataacaagcaggaacaaagcacaaaaatgggttcttgacttcttaaggaaaaattagagacttgaacggtccaattccgagttcaaatggccaagttatggccatttgaagtttatatgctatttaaatgaatatttgcgaatttcttcatttaaattttaatttaaaaaggggtttattgcatcagccgagggggaggggcgcgcggaccgggtccacgggagtggggcccacgtggcagcctcacggtccacggtggaccgggtgcacccgggctcacaccggccggcgccgtgggccccacgcgtcagccgcacccgagggcgcgggcggctgacggccgggccccacgcggcagccactcggcgcgcacgagggcggccacgccggcgcggtcggcgggaggcggcgcgcccgcgccccgatggtcgccggcggcggccatagacgcggcggagcggcggccgagagaggggagggaagggggaaaggaggcgacggtccacggctcaccccggggcgacggcggcgacggaggaggcggccggagcagagggaggcggtggcgcggctcgggttgtcggggacggcggagctccggtggtcggcgaccgaaacggagaggtggacgaggtcggcgaggatgcggcgaagccgaaggaggcagcgctgaggcgggagacggtcccggcgagcggagaaagccggccggaggtcgtcagcgacggaggagagagagagcgacggcgcgagctcgattccggcgaggaggaagggcggtgagaggcggaaacggacggaggaggtgcggggagggtttaaatagggttggaagggggagagagcggccggaggggaaggaaaccagcgcggcgttctcgggttccatcaatggcgtcggcgggattaggggaggatttccaaacgaatccaagggagagagggagggaaaattgaggggaaagggagagggaatcacggggaataattcccccctattgattgcacgcggggacgacgggatgcggcggattcggcggcggcggcggcaggagcggcgggaggaaggggatgacgggtgggccccacccgtcagcgagggtggcgggtgggcccgcccgtcagcggcgcgcgcgcgaggagggaggccgaatgggccgcgggaagaggagaaagagggggagggagatgggccgaattcggcccattagagagaaggagggattttagggtttttctttttataaaatcattttaactttgtttatttcttcttaattattatttgtgctctgaaaattccactaaaatttatttacacattttaggcttttaggaaatatacaaaaatcctctaagccttatttgacttttaactttgcacattttaattgttggaggctttcacacagattttaattattctaggcataatttagaggatgtattttagagtcgttttgggacgtgacaaacctaccccccttaaacggaatctcgacgccgtgattcggaagaactggcgaagagatcgggatgggctgccttcagctcgtcttcacgctcccaagtagcttcttcctcggcgtggttgctccattggaccttgcaaaaacggattacccggttcctggtcctgcgctccatgttgtccaggattttcactagtctctctacgtaggtcaagtcttcgcgaacttcaatctgctctgagtcggcctgctcggacggcactcgaaggcatttcttgagttgcgacacatggaacacatcatgcacgttgcccaaggaggcgggcagctccaactggtaagcgacttctccgcgtcgagcaatgatacggaaaggacccacaaaccgaggtgcgagcttccctttcgtctgaaaccagcgtacgcctcgcagcggcgtgacccggagatacacaaagtcatccactgcgaattccaggttacggcgtcggttatctgcataactcttctgccgagactgggccacctttagattctcccgaatggttctgactttcgcttcagcttctctcaagatatcggtcccgaacacttggctttccccaacttggtcccacaatagcggtgtccggcatttgcgtccatacaacgcttcatagggtgccatttgtatgctggcttggtagctgttattgtaggagaactcggcataggggagactcttatcccaggtcttcccaaaatctagaacacaggcacggagcatatcttctaggatctgatttagacgctcggtctgtccatctgtctgtgggtgatacgcggtgctgaaatttaagcgggtacccaactcttcttggagcttcttccagaagtgagaggtgaattggcttcctctatcagatacaattttcttaggaacgccatggagactcacgatcctagcgaagtagagttcggctagtttgctccctccataggtggtcttcacaggaataaaccgtgctaccttggttagtcgatccacgactacccatatagagtcataaccgccttgggtttttggaagtccggtgatgaaatccatcccaatttcatcccatttccattctggtacttgtagaggttggagaagtccggccggtcgctggtgctccgccttgacacgctggcacacatcacaaagggccacgaactctgcaatttcccgcttcatactaacccaccaatatttttctttcaagtccaagcacatcttagtgctgccaggatggatggaatagggactttcgtgagcttcctgaagtatcaactgtttaagttccctgtcgtctggaacgcatacacgatttccgttccatagggctccatgttcatcttctgtgaaaccagcggctttaccttgtttcatattcttgaggatcccatgcatatctggatcattcttctgagcctcgcggatttgatcgagcaaggtaggcttggcttccagcgtagccaagaatccatggctaacgatgtttaggttcagggcttccatctgttgattaagttccgatggaatgtcacggacgccaagagtgttgcaatggctttttcgacttagagcgtcggcgaccacgt

SEQ ID NO: 61323 - DNA, 3545 bp, Oryza sativa
tgataggcggaaacggacggaggaggtgcggggagggtttaagtagggttggaagggggagagagcggccggaggggaaggaaaccggcgcggcgttctcgggttccatcaatggcgtcggcgggattagcggagggtttccaaacgaatccaagggagagggaatcacggggaataattcccccctattgattgcacgcggggacgacgggatgcggcggattcggcggcggcggcggcgggagcggcgggaggaaggggatgacgggtgggccccacccgtcagcgagggtggcgggtgggcccgcccgtcagcggcgcgcgcgcggggagggaggccgaatgggccgcgggaagaggagagagagagggagggagatgggccgaattcagcccattagagagaaggagggattttatggtttttctttttataaaatcattttaactttctttatttcttcttaatttttatttgtgctctgaaaattccactaaaatttatgtacacattttaggcttttaggaaatatacaaaaatcctctaagccttatttgacttttaactttgcacattttaattgttggaggctttcacacggattttaattattctaggcttaatttagaggatgtattttagagtcgttttgggacgtgacaactaaccaaccctaatctgggtcactggaagaatactttcaaatcttggccatctcttgagaaaaccacccctgagaagagttggaccacctggtaccagcacgtatcggctagtaagaaagttcactgggatgagattgggatcggccaagcgcttgctctcaccatagccaattctgctaaggatgaacctctgatggctgccgccacctatttttggtccaacaccctcaatgccttcttgttcaaccaagggccgatgactccaactttgatcgatatcaccatgatcactggtttggatgtgacttcatcggctaatcccatgagcatgaacaccaagaatcaattcgacttcaggacaaaaagcataggtggttggtctggctatgtagcagcatatatgggtcaagggtctgttactcctcgagagcatgtagccttcttgctaatgtgcctcgaaaaatttctcttttgtggatccagttgtggccctacaaccaactgacaatttgtagccgaagccttagaatcaaagaaagaatttcccttagcaagatcctcctcggctacttataacaaacattgaacaatgcatcggccaagatagccgtcagctcagtagtcggtgcaggtggaccatggtggctgctgcaaacctggttgaacctaatggtcatgaaagtcgtcaatcggccatctgtgacagaagctgagttcccattgccagagccgattgtaggagatgatggacaagaacacactcatcgcagatgcacatcatatggggaatatgcgtccacaccaaccgatgctggagcaaagctatcggccgagctgctcaaggattggttctgcagcttctatgaaggctttaagaaagacgcccgagtttggtttccttatgaagactcagtagatcttgaacttccatcagactttagatttgaagatatcaatcatgaaaagtatcaaaaatccagagaaattcttacagctgcaatcagcccatgcatccttcctgtcggcattcatcaagaagaaatatccaagtttcctatgagttttatcacccaatgagctcggctagacaacttggattaggccaactcccaatcggcttattctttgccgacaagatccagtgccgaggagaaatcacatcaacgctgatgatggatcggctgcttaacctcccaggaccccctctaggcagcattgacaacattgagttggcgggattcaagagcagaaacttcgacagatggtggggtgaatggaagctgcacctgttttcatcaatcgacttcgatgtatatgacagacctattccctgatgtcataccccaggtaaaccttgtcattattaacttgaatgatggttagccgattcgtcacttgactaatcttttgttcttgttttgcagaccatcgactcttcccctccgcaccaaagcaacagtggcagtgacattgaatatgctccaggtctgattcctaatggaggtggaccatcccccctgttattgactaccatgccccaaagacttcaactctccatcacggcctattcagggaaccagccgatgcaggcaagaaaagaaaaactagatcatcggctatgggtactttggccttagctccaaagaaaaaggccaagtccaagaaaactaacccgactgataagccgactgatgatctgcctgccttagatccatccatcgaacaagctctagatgaagaggaaattggtgaagatgttgatcaggctgcagttgaagtgagtgacatagaaagaacaccatcaacttcacccaagcagacatcaccaactccttctgctcgcactcatttcacaagagtaagcaactcttcttgatcccttttgtaatcattttactttatggccgattactcacaaattttgtaattacagaaaacaagattgctatgaagaagaaatcggctgcagcaacatctaaaccagctccaccaataagatagtctcgattttaattagttgatcccagccgattttatataacactcgtttattttacagcctcctcctcctccttctccttccgtccagcaatcgtcaagtgaccgaactccatcggctgtgggaagtcaacacattgaggaagaacaaccagctgctcctgctatcccagtatttttccttcgatacaagaaattagatcggctatattttacctagctcttattctctccgaaattgtctctgcaggctttagccgatcttttctcctttgatatcagagattatcttgatgagacagaagaagatacttcaagcaaagctctagctcccttatccgatgatgtgaagaagacacttgaagatatctgtcatcggctggaagcatcatcattagataacttggtggtaaactgtgggccaattaggactcggctacttgagatccaagctctaatcctagatgagctagccgacatccttactccaggggtctatcttgagcaacatcaattcaagctggaaaaggccaagttaagactagccgaacgtcgggagcgcaaggatattgaggccacaattcaagccaatcgtcagcttgtgcatgaggagaaatccaaacttgatcagctttcggagggtccgatcaaatccaacattgatcggctcgaggctcgcaagattgagctactggcacaacttcaggaatgcaacgccaagttagatctggagcacaagaaactagccgatctcccgcggtccgtcgaagagcaaaaagcaagacttaaataggctatcaagaatgttgctgatctgaccaagtctttgaagatcattcctggaactgatgctcaagatgcccaagccattgaagaagtcg

SEQ ID NO: 61324 - DNA, 6880 bp, Oryza sativa
aaacaactaagggtgatataacaatatcggccattgtatatcggcaaaccataaccgattacaatttgaaaaaccgactaagggcgatataacaatatcggccatctcaagacgatgaaaatacatcggctatcatgtatcggcaacacagccgatcatgcattaacccaaacacttgggtaatatttcttcaaatatttgccatttagtgctctgccataaacttctccatcgagtccttgcaacatgtaagctcctttagacacaactttataaatttgaaacggtccttcccaattcgccgactacttactgaatttgttatcccgagttccaatcggcaaaatcaacttccatacaagttccccctccgaaaaatctttgggtactactttcttattgtaatgccgagcaacacgcttcttatccttggtaacttttgcaagagctcgcaatcgcgactagactagatcctccctctcatcggccataaggttgtaatattcatctgctgttaaagtattttgcaattccgttcttctagagccgattctaacttcccatggcaaaacagcctcatgtccataaacaagtttataaggagggacttggatcgatccatgacacgcctaccgataagaccacaatgcttcggcaaccgagtatgccattgccgaggataatcagaaattttcttcttaatcaatttgatcaggctcttgttagatgcctcagcttgcccattagcttgtgcataatatggggaagaattcaacaatttgatacccatgctatcagcaaactgaacaaactcatcggacacgaaaattaagcctcgatcggttgtaatagtttgaggaatacaaaactggtagattatatgctcttgaacaaactgaattgcatccccagaatcaactttctttaaaggaatcgcctctacccacttggtgaaataatcggtcgccaccaatataaacttatgtcctttactcgatggtggacttatcatatcgatcatatcaattcctcaacctttgaatggccatggcttaataataggattcatagccgacgccggcactcgctgaattgctccaaacttctgacaatcttgacaccctttgtaatatctgaaacaatcttccagcattgtcagccaaaaataccctgcacgccgaagtaaccacttcatcttatgagccgattgatgagtaccacaaattccttcatgaacttcgccgattgcaactttagcctgatcggtactcaaacacttaagcaacaccccatcaatcgtccgatagtaaagctcatcatccaatagactgtacttcaacgccttatatctcaatttcctagaagccgattgagatggattatgtaaatattgatgcacatcatacctccaatcatcggctgttattgctgcaatttcaaccttagcatctttgatcatcggcttatacctcgatgccccctgggccaaatcattaggttcaatattttgttctcgagacacatgctttaaagtaaccagccgaaattccttcatcagttcttggcacttctcattataaaccattaatgtatcattcttgcattcatattctcctgccaattgactgattacaagcaaagaatcccccatgatttcaatagcatcggcttcaactaccttgagtaattacaaccctttgagcaccgcctcatactcagcttgattattagtcgcataaggtttaatagtataagcaaactcgaaacatgcccctcgaggggaaattataaccaagccaatgccacaaccattagtacataccgacctatcaaagaataaagtccatggcacaatctcgaccgagccgattgaatcatcaggatgttccacaataaaatcggctatagcttgtcccttaattgccttcggcgactcataccgaagatcaaactcagttaaagagaatatctactttccaacccttcctttcaaaattggagccgataacatctatttgacaacaccagccttgcatatgacagtacactcattggatagtagataatgcctcaatcttgtacatgaaaaatataggcacaagcataacttctcgacagggaaatatctagtttcagcatccaagagccgacgactaagatagaatacaactcattcctttcaatatagctcctgaatcaagactgagccgattgacttctcaccggcagatagatacaatctaaaaggtattcctttctatggaggaattaaaacgggaggagaactaagatattccttaatattatccaaagctttctgctgctctgccccccaagtaaactgctgatcggctttcaacctgaacaatggtgtgaaaggctctaacctaccggataaattagtaataaatcttctaacaaaatttatcttgccgatcatctcttgcagctctgtcttgttctctggaggctgaatcttcttgatcgcattaacactcctctgagtcacctcgatccccctctcgtgaacaagaaatcccaaaaactggccagccgatacgccaaaagcacattttgtcggattcatcttcaggccatattttctggttctctcgaaaaccttcctcaaatcggctatgtggtcctctatttctttagacttaataaccacatcatcaatgtaaacctcaaccaaccagccgattagatcatggtatatgtaattcatggctctttgatatgtagctccagcactcttcaagccgaaagtcatcacaacccatatgaacaagccgattgcaccaggacacctgaaagttgtcttatgaatatcttcttcagccataaagatttgatcataatactcccaagcgaagcaatctctgaattcttttaacagctctatcaacttggttctaaattctgcagataaatttttactaataaacgtcggccttggtcggtcacctagacctatatcaatttcttccaaatcatcagccgacataaaaccctacccttgtttgtcatcgagatcatctaccgtgtccttgttgtagacatgtgaatcctccacggcgccctcaaaataatagcttgggctctccatcttcaattggctgtatatcagaatcggacacttttagaaaatctccatcccaaacttttccagataaacaatcaagaccatccatctcccaaagagctaaatcggcacgtgtaacattgactgacctgtcggctggcacaatttcaatcttgtcgccttgccactgaatcaagcattgatgcatagttgaaggaatgcaacaattagcatgaatcccatcccttccaaacaacaagctataagaacccttcccatcaatgacaaaaaatgttgtggggatggttttgttgccgactgtcagttccacgttcaaaactccttcggtttctgatggattgccgccaaagtctttaagcaccatgtttgtcttgatgagatcttcagcgtttctgcccaactttctgaatgtagcgtaaggcatcaagttcattgtagccccaccgtcgaccatcatcttggacatcggcttcccattgacataaccatttatatacaatggctgaagatgtcaattctctgtcccctctggcttctcaaaaactacctgccctggcgacaaaatcaatttagccgattcttcttcaacttcatcgatatcggcttacttgatcccaaactcggcaggcaaagtgaaaaccatgttgaccgaagcagttacgacgctttccctttagctaacctttttgcttcatcagctgtggcttcatcggctacaggaacctgattcttaacacgccacacccgcctcggcttcgttttcttcagcaaatggttaatttcctgctcgacctcctgaaagcgctccctgttcctcaatctttgaacccttctcttttgattcttcgtaaagataccagaaggacaccattgatttttcttgttttcattgtcctcttagccacgatcttgattcactggacccaatctttgatgaacaggaactcttgtctgccttagccgattgcccctactatatgatcggcttgagctctcggcaatatcaccgcacctaggacagtcttcaatagattgcaacctcataccttcattccaacaacatctaaagaactcacaacccaatgaggatcaaagccatcgtcgtcttcttcatgatgcttctcctgctgcttgtcatacttcctctgatatttgttgataatcttagccgaattcacctgaaaaccccttgcacgaccccgatcggctgttcggccagctgtatgcaccatattaacaggaaaaggattgccatcaaccttcatcggcctcttagagtcatcaaacttgattttgcctccttcgatagccgcttggatctgctgcctgaagaccttgcaatcattagtcatatgagacccagaattatgccacttgcaataccttttcttacctaattcttcagccgatggaattgtgtgactggcaggaagttgaatctgcttctctcggagtagcaagtcgaaaattttgtcagccttagtgatatcaaagtcatacctctccttttttcctgagctctttacccattggcatggtataacctttttactccttacccactcagctgcagctatctcataatcatcatcctcatcgtccgatccatatatataagggcaaacatgattaacctttctagaatttttcctagcctctgcatacctttgttcatgcaaggctaccttctgtgtaaggtgtgacaagctttcaaagtcttcatatgagaacttctccttaattagagcaatcataccctaaaaagccaaatcggctaactgggcatcagtcaaactcaagctgtaacacttatttcccatctccctgaatctctgaatatactcatgcactggttcatcatgcttttgcttgatcgatgttagatcagacaatttcatctcatgaatcccactatagaaatagctatgaaactgcttttctaaattagcccaactattaattgatccatacggtaaagaagaaaaccaagtaaaggccgatccagccaaagacaaccggaataaccgaaccctcaaggcatctacagccgatgcttcaccgcattgagctaaaaatcggctaatgtgctcataagttgatgtactatcttgccctgagaactttgaaaaatctgaaactttaaatcggttaggcagaggaactctctcaaactattcaggatatggctgtcgatataggtttccagcgtctttcggcctaagcccgaactgctccttcatgacatctacaatcaaatcggcccatggccgctgttgaggtgttccttgaagttgttgtggcataggctcaaattgattgtattgaggaacaaattggggctgagccgatcctgcttgctggtactgaacatgaggtgatggtgggtgatattgataattcaagttgcccccctggtaattttgaaggtctggctgaatattgcacaccaaatgttcaggaataacttgaggaacaaccgtgccatctggctgcacatgatgaaccaagtgttctgggacaacctgatttgcggcatgctgcatgggttgaccaccaggtgttgcaaacccagccgatgcattcatcggaccttgctgctgaatcggctggacaacctgttgcctcaacagtgtctgctgaatcagctgcaagacctgtcgtcttggtggcgtctgctgaactggttgcacaacctgttggattggaggtgtttggctgaactagttgcacaacatgttggattggaggtgtttgctgaactggttgcacaacctgctgccttggtagtgtctgctgaatcggctgctgctgggctggatcaatggtgtgttgaggacgtaagaacatagatgcaacctggtcttgcgttagccgattcacattctgtccagtgtgctgtggctgttctctcaccaacaatcggggattaattaattggcctggggctgaaggtggtgcagtaggtgcgggagccgatgctggtatcgtcggctgagctgatggtgcattaagagggactgactggcgactggtagattatcggtgattaacggccgataattcgggaacacccctccttgtaggtaaactggtcctgtaacctgatactcggccattgaaccatcaatcattgacttcaccatatttctcagattgattgatcaaagcatggtgtacagtgtcacatcctgatttttgtttcaggatttataaattatttaataaattattattagaatttatattaaatgttctttaatttacaagtgaagttaaatgtggaaaataaaatttcctaaatataaagcatggatggatttaatttttattaaattctccatgattaagtatactctctgaaattttctcggatttttcggagctcaattcctaaatgatacaaagaacagttcagtaattatttgatcattaatgatctaattataattgttaagagcttttcttgtttaaaaatccttaaattataaattgttgtttaaaaggaattattagaaatgatcttaaaagcctaaaagagaagatctaattttaattaataaattccaatataaaatggggccagataaaatttcattaaatactttacttgattctatagttcctagatttttctaggatttatttgagccaaggaagtatttttaatcaatggaatatcatttcatgaataatttaaattgaaaaaggtttttaaaagtctcttttggctttgggccgaaagccggcccaaaaccgctctctctctcctccccg

SEQ ID NO: 61325 - DNA, 4465 bp, Oryza sativa
gcccctttataagcacccccgagctctcctctatccgccgccacctttgccttagcccgccgtcgcgtctagcaccgcctccgcgtagccctagccgtcgccgtcgttgccatcggttcagccgcgccgcgccgccgttgcagccgccgtcgtcggtcgccgtcgccaccatcgggatcgcgaggtcgtcgccatccccgtccaccgcttcgccgccgccgaagaccgccggagcgccgccgtcaccgtcgacccgaagaccgtcgccgcttcttcctcgtcgccggcgccgtctgttgctcttccgccgttgttttggtcaccggtgagttcgccgcgtcaccctctacccgttggtgtcctccgtttgcgtcgtcgcgccatcgttcgccggcgagcatgcgccgcccgagccgtcgccggtgatgacgtcatcgctgacgtcatcgttgccgtccgccatagaccggtcgtagaccgtttagatcttggccgttcgttgtggatagggtagatctcggccgttcgtttccgtgagccgccgccgtgcacccggtccaccgtgaacccgagcccgttgacgcaataatcctcttttccttttcaaaaataattcattattgcgtcataattcaattaaaatctatataaatgttttaatccgatttaatctttaaaaattcataactaattctttgtaactcagtttaatgtggttcaagttgcaaaggttgtgtaaaataaagatctacatattaaaattatccataaatagaattaaatttatttaattctttttaaatgggctttaattagatttaatcttgtaaaattcgtaataaattcatttgaagtcagaatgaggccgttcaagtctcataattcatctaaaatcatgatctacatgtttgtttactttatattactgtttatttggtttttattagtctttttcttcgttttgcgtgttagcttgtcgtttccgtcgttgcgaaggttcgcgagtgtgctggaggtattcaagaagattaattgaagaccgattattgcaaggcaagccacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctttatatattggttcagctagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtataatatgattcattgcggagcaccagactgagaagtggcggagataagcccacgggggtcgctggggaggccatgccttgttttataagggggtgattatgatccaggaatggtgcattgtggtgagttgtgttgtgcagagggtattgtcacagcctctattcgggcactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatactatatctggtaataatttgtttagctcctggtttggagttagatctgtacagccgggtatggttgttcaggatggttgggcctgtgcagcatgggtgtgctattcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggattggagctgaagccatcgctagaccgttattccgctgctattttcttttcttttgtaagcgtgtaacattattattaagatggatttgtatattaaattgtcagtttgtgtacctcggctgattcctggacgaggattttatgcacaaataagtttggaaattactagtgaatttccgggcgtgacttacagcatagtcaacctgatcttgaatgttgttgaactgcaactgcgttgcattgtcgtcttgattaacacctccaccttgaactccctgtgaaccatcaccttgaaccccctaaaaccatcaccttgaaccccatgtaccccttgagagttgtcaccttgatttggtggaaaaccatctgtagcacctttgtcattcagttgagccgagccatcttgagtttgttttccttctccatccttagaggaaccagtctcgggatcgtcaagaaccacctttattttatacttctgaacaagtgtccccttgcgagtctgcatgaatgagttcaagaattgatcacgtgctgcctgcatcatcgcttcaaaatctttcttttgatcaggtgtgaatttttctggatcgatgggtacgacgttcccttcattgacgtcggtcaaacctaacttctggatcttctccttgacagtgcctgaactagccgaagatggtgatagcggtggtttctcggccatgagaaggaattgcttgtctgacttcttatcggtcccatcgggcatgccaaaagagtgttgacgtaaaacacgaggcctgggagatctgtttaactccagtgcaggtccaaaactcgccttcgggtatgctagcgtaccagtcgatttgatcggcagctggaaatagataataaaggactaaatctattcgatcggctgtagatattaacaatatataatttttacatcgatatatatttaaatcaagtgattgggatagatcggtcgctatgccgagacaatataaatcacttagatcgaaatatatattaataaccgaactatatatgtttacagcatagctgatcagatagatctagcatgtatcggctaatactctgatacagttctatgttaagatattaaaacaagcagaatataccaaaccaaagtttaatatacgtagatgcaataatatcttgacataaagggcagatttaacatgtcaacgaagcatatagagcaaatgtagttaaaccagataagatcggctgaaactccaatactaccctaatcggcaactagaaggcaggctagagactgatattctaagcacgacttaatagatcaaactcaagtgatgcagcattaagtatgaaaagaagaacaatatctagacaatcaagccgctggaagtttcatagagtggtggagatcttatataatctaaatcaacatcaaaatctaacctaatcggctgccctctactgacagatgttagtcgattgtaggttagataatgatattgccagagattatgtaagatatatgataactcgatgaattacataaacatgattagagtatcataaagatggaagcactaatcccgagaacgcaagccatcataacaagttttacctcttgttgaagatcgaaaccgatgcagctcaacccgaaagcaaggactcgtcgaaataaaacaaaagcaaaagggtggtgatgcaccgaaattgtattgaacgagtgtgttaactgattacatggggttcgtgtcacaccctgaagtttctttcccaagcctaaatgaaaattataaatcacctagagaaaataccggtgtcaaagcaagacaaaccctaataaattaatgcaaataataatcggaattggcatgtgggatttttcttgagttctatatgtcgaaatatgctaacaagatttttagtggaatttttagagctctagaaataattttaaccaattaaaaatgagcaccagcattatttaatccttggaaattcttttctttttttcttcttcctttgtcccctcctttttcccaaatgggccgccggcccatttcctccacctcccgcgccgttgctgggccgaccgaaggccacagcccatccgctcgcccgagcctcccctctccctcgggcgctgacaggtagggcccacctgttaggcccatccctaacctttggccgcccaccgtctgcagacgccgcctcgcaaccgtccgcgcccgcct

SEQ ID NO: 61326 - DNA, 4661 bp, Oryza sativa
ccacgtgtgcaccacgtggtgcgccgctcctccccggtccatggacacggtccaccgtggaccgccctccccgagtcactgccatgtggggcccgcatgtcggcgccaccctctctctccccgggattttatttattacgcaataaatcaattaaggatttttctgtttatagtaaaagcacattgaatcttctaaaattcatatctaattcatccgagctccgtttaagcccattcaagtctcagtaaatcaagaagaatgtgaagaatccattaaaaatggttttgttctttgtttcagtagtcttatagcctgtttgtattgtttgctttgtatgtcgcttagattccggctctccggatgctccggtgtactttgaaatagtcgccgaggttcctccagcagtagagcaaagcaagtcatgcttgtcacttgaacatgttgatcctatattacaaatgctctaccgttttactttaaatgctgcatcgttttataatgtcaccatgggatgtttacctactgttacagccatactagttttgtatcatgctccgttgttagcttggggatataacatgacttgatattagactagggattgcttagccatgcttagttcaactagcacacagtggggaaaatacattaaagcatagatatctgattctagtaatgatgttggttaataccaccgctccggtgctggttaattaaaatatattaaacgatgggctgtgggtgcttggcttcgatggtcgcgcccatggcacttaaggatcggttcgcgggaaacccctggaagaattccacgtacttatcacaagctagcgtgggcaacggctgggcttgtagtgtagctttcctctagctgacgcatccaggcaagggtgggcgtgatggagccgggcgggccctgcgacggcctctgttgcttccggattctcctaggcacgagaggggactgcccgttgcccgctggggacgggggtgaaacctgaggtgtggtgtgcttggctagatggggttatgcgaagagtcctgtcacggcctctttccggtatgtcgtggtggcatgtcggcgtatggaaacatgtcgtggggctgtgtcttgtgggtacagttgtacacctctgatcagagtaaaactattcgaatagccgtgtccgcagttatgggcggtcaacgagattcaccgtgattagtctcaccctagtttagtctgatggaactgattagttcaggtggttggttgggcctgttgcaacgtggtatagcgttggacagtggatggttaatattgattaattattacacctgattttcctgctttcaactactgtttataaatgctcgctttatacaaaagaacctctctagctatcctttggtaatatcctgcatcataccccctgttccggtatgacttgctgagtacggtggttgtacttagtcttgctttattttccccaaacccccagagtttgagtatgcatcagatggtggtttctctgaggagtaggcttcgtccgtgccggcgagaatgcctgtggagtggtgttcccgctgcagtccaagtcaaggcttagctccagttatcttttaattttccgctgcatttatgtaagacttttataatatttgtaagacgtggatctatatgttaactttgtcgtttgtgtaccccggccggtaatggacggggattttaatgcacattctacttagaattctattcgggaatttctgggcgtgatagttcggggtctatttatacccgaaaattacaaactatgtccatatcggacacgactcttatctctaacaaactctaagataccataagtctttgcggcagactttttccctaaacatatctctaaggaaattacataaaatgtcctaattaatagatacaattgccttctcaagactctatccatgtgcggcaaccatcttgaagcatcttaattcaacctgatatcgtataccaagtcgtattatcagaatcggctatatcaacttactcagtccgactcggatccagccgatcctaatcgtagccgatctggactccagccgattcttgctctattctcgaatcgatctccgccttcgactccacttcgatctaatcctcttttccgatgctgatattaccaaatttggtcgttaacaaggggaagcgttgggtcggcgatgaggagggccctcgcgccaccgtcgccactccctccctctgctccgagcccggcagccaccggcgccgccgctccctctgtccgcttcaagcacggcagctgccgccgacaccgctccttcctcctgcgcgccgatgccaccgcttcctccgtcggccgcagcactcgccatcgccggcgactaaaaactgaagatgtggggattgggaatttgggatggagaggtggggatagggttaattagtaatatgggggtatttttgtcactttggggtagtatgttttttttttcttttttctaaatgttgttccaacggtgaagtctaaacagagtcaaacggaaacttcaatttcaaaaaagagggtcaaataagcaaacctgaaaaagtaaggtcaaattggtagttgggctttaaaatagggtcaaataagcaattgtcccaaaaactaatcaagaatctattagaaatgaacaaatatcaatcgtgttgggataatttgaggactgcacgacttttcttctcgtcggagaagacgaaagaaaggttacagattaatttttatttgtaaatatgccgtttcttattcacttaataagccaaatgatgggggcctcgacctttattagaactcaagtgtacagcacctccactcttcatcatgctatagtttataagagctcatatgttggtgaaatatgaagagtggcagtactggagacgatcataatgttttccagacccccagttctctaagctagctagcatgtatttatatttttcaggtagtgcgatatcttttgtaccaactagcaaccaaaatattgatgaaagaattagcaacagcaagtgtgatagccaccagcagcctcaggttttcttgcatcaacgaacatctcctcacagcagacagcactgttgttcgttcattagccacatctgcttgtcttccgtcttcagcttcagcttgccatgaatcaaattcccagccggtttgtccccagcagccagcccgccatccatggttggagctagacatcatttgcttcctgctttaacgggtggataccgatgcttctcttctctatgcctctcattccttagtcatgcccagatgcaggccaagctaacgagattgtctaacaaagagcatcaatgtcctttgggatgtttctgcgcagttcttatgtacagtagaaaagatgaatatgaataggatgattggttgaagcaatttaatggtactactgcgtgatcacggggatttactggacaatgactgccactgcaacccttatactacatctatcttccacgcaacaatgactgcaactgtaggggtgaacgatgaatgcaatatgaaagtttattaatgtaattttagtgctacaattgtactcgctccatttcatattataaatcgtttgaattttttcttagtcaaacttatttaaattcgatcaaatttgtagaaaaacatattaatattttcaataccaaacaaatatattatcaaaatatattcaatattaaatttaatgaagctaatttgatgttatagatgctactaaattttccaataaacttagtcaaacctaaagaaatttgtctaatgaaaaagtcaaacggattataatatgaaacggagggagtacaaaactgtagggatactcggtttgagtacggtatcttgaaatcacccatgatcgtccaggattttgatcgtgtacagattgataaacaaaatatctttcggtacatatatttgagattttacataaaaacattacatatgagtatattagagtaggttttaggggccgatagaccaaacttacaacgacacactccctacaaatagaaaaaccatacacaacataagataaaataacaaaacaacacaggtgttgcctgagagcggatcgacctagaacgtgaactcgtcagcaccgaagaaatcttccccttcccgcgcctcctctaggaagagccgatcatttgaaatatgtagttttgtcatatttcaccttaaatgtatatgttttttttataaatttgatgttaaatttatagttttgtgatgcatcatcttaaatctagttatatgataatgtggtcaatatatatgtcttacttaaaaaaaaaaccttggtatctgcttggaaggcgtcttggacctaaattcaacgtacatgacagccccagttgggctaaagaacgttttttagatggtaatttctataattacaaccccagttgatcctagcctacctaaaaagtaaatatctcctaatgccacaaagaaaagacaggagttgtcaagggcaaatccaccctgtgtcgtgaaccataagcttcatggaggccatcacaatcctttcgtaggatccatcagtccatggcaaggttctgaattgctgatgccactcattccaaagccggggctgtttgtgttgtcct

SEQ ID NO: 61327 - DNA, 1584 bp, Oryza sativa
ttatagtatgtagaaaactaccaatccacttgcaagctagtggatgtgattttcctattcattcgtttgaacgggtctgtccacttcatgggagtacgagttatcggtgttatatggagattaaccggtaattcatacattaccataatcctacggggatcaacttattcttccggaagtcattttctctactatgagaaatattctcgcttctaggagaaaaactcttcgtgagtcatcgtaaactcttctacgagtcttgcaattctcttcatgaaaatatagtgtgcttcatgatactaattagtatgagatttacatatatgttgcggaattgttttctttctagtgaaaacttcatatggattttcataacccataaactgcatatcatttattcattcatgacttttgccagcgatatatatagtggaatttaatacattcatagtaggagaatatcggtcttttccatgaccaaatgagccgtcgcttttcaccacttcatttcctattaagtctgaacttccatgttcacatagacttatttagcgactatggttcaacctcattgctttcttcaatagacctgatatgagtgctactatgcaactctgccatggactttggttccggatccggattctcattagagaaatattagtaatcatagaggcgatgttgtcgacaactattattttctccacatactcattccgtgaagttaattcattataaacaatatcttagtcatttccaaacataagatgtatggttgttccgcaccccagaattagatagatgtgcgttctgggttttcatcttcatgatgaacctcttcatgaggcaattcaccttcatggtgattactctacaagagttgtaaggagttattaatgggtacattgaaaatagtcattagatcttagaatccgcacgtgttcccgtagattttagaacattgactaacatgtcactctgcatttgtggatatactattcaaaacccggggtataccactgttagcagaaagtttactacaagtaaacataacttctgattactcctttaattcataattatctagcaagcttccgcttctggcttacacgagaataaactaaaccttctagtttagtttggcttgtacgttattcttacttataaagatctttttcttcttgaaaatataaggcatctttaacacatgggcttttctccccctgatgctgatattcgatctttatctaatagcatatcacaaaaatcccctatcataggcactggattaatggaattcggtccatttgtatccccaacttcatgtggaggcccatatatgtatgctatggtggtgatatatgagggaaatgttcattcattgaacatgcacttatacaaaataaagggggtaaagatattatatgcagtgagctaacataaaaattaatgcaatggcatgaaaaattgcacatccctaatattgtaggttatcccaagtcatagagggttattattctgcgacaatgaagcccaaacaaatatccactagtcgacaaaattcctctattttctagctttttt

SEQ ID NO: 61328 - DNA, 8805 bp, Oryza sativa
acactatggaatggttggattattgtggaatggaattcacacctccccctctattcaaaatcctcaaaatggttttaggttgggctcggggtgcatggttttgatagtagcacctcggccatataaggactggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcatagggccggtgtcctgctgataggggctcagtcctgcctacctgtcccaggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttataggcaagccgagcaatgtacccaagttagtgttttaattcttaaaacctgcttaacaactgaaatgtggaaatagttggcctgggttagcttgggacgagctgggaaccagggtcgagttgccagttcggtctgaatcatcgtaggccttgggttaaggcaggttcgtgtgggttcacggccttgattaataatcttgtatagctctaggatcgtatttacaaaatagctttgagcaactaagtgtcttttaatgctgtttactgcaaaccctaaccctttatattataacccccttgtactcccttgcatttattctgcacttatgggtgtgtcttgttgagtacgttggttgtactcagtcttgctcaatttttcccaaacccagaaaaggagcccctggatgatgaaggctttggtgtttagctcgtgcctgccatcaagcgcctgtggtcatcgccctagtcttccgctgtttcccgtttgtcttcttgtgtgctgggccttcgccgcccatgtaataaagtaactatttatgcttccgcttgataaactctgaattgtatcaactttcagtgtaccttgcctcctgggacaaggaataatacacgcacgtaaggaacgcccgttgggttatttccggtcgtgacaagttggtatcagagcccccttgaccctaggacgagccttagatcccaagccttagcaatattttcgaaataaaaatcctttcttatttgtgaaaatcctctagtctctctctgtcctgctgcttcatttatcgccaaaatctaatctttaaaatgttgcttttctcttttgtctttttgtttgtagatggccggcagcatcaaccgtcgtggtctggacctgactagcttcgttttggagctgcggggcatgtgcgttgtcctggggtatccgcatggagtggattaccagggcaagcagctcccggagcaggagggtgacgatgtagagccccatgctgcttgggaggtcactgcagtgatcctcactggctcacctgagaggacttcgttggcagtcaccgcgggaggagattctttctctgccgcttgccagaacgccgcactcctcgccatcggcactcttcaccagcgctacccggacgagttgcagcactcgccctaccgctaccaccctcgtcgcggaggagcccgcgactacgccaccttcagggatgctagctcggaggatgacgctaccatcatgcacctggcacgcatggtggaggcgtacgacgcggctcgtatcgacttccatcagatggtgcgccgcgggttggtcgagaacaacatgaagatcctggagctgcgacaggagaatctgcagctgaagaaggacctagacgcagtggaggcgcagctgtgtcagctcaagatcgcccagggagaggtctgtcgccccaagcgccgccgcgtctgccgcagcctgaagatcaccgcccgcaagagtacctccaggcctgagcttgttcgtcagtccctagcgtggacctgctttgtcgagacccctcgtgccgagcccgcgcccttggttcctcaggaggagggagcctctggcgtgggtagcacgaaagatgcgctactgctcaccttccgccctggcccgtcgcagaagtagacgagcagttagtaggcttgcacgtgtgttcttctcgttggtctttctgcttgagtcgtgtggggcatggttataccggtgtggggtataactgtatcggagcctgtctttattttatttgcttaagcaacttgaaccttaatgaaccaatttaatagcagtaataaattcaagaattatggtagtcgtggctagttagttttaatagtcagctctctctgtttgccggttctgtgtgggattttgagattgtgacaaccaggagaagtgctgctaccggtgaaggcagtcaccccgaaggcagcaaccacaacaaccatggcagcccacctccacctcctcccctgcctccaccaccaccaccagacaccaactccatcctcacccaaatcctcgcccagctggccaacatgacgactgctttcctccaccacatccaaaatccgccacagcatcatgctccacctccaccaccacccccacaacactctaaactcgctgagttcctccgcatccgtccgcctaccttctctaactccaataaccccgtggatgctttggattggttgcatgccatggggaaaaagttagacaccgtgcagtgcaacgatgaggagaaagtcatctttgccgctcaccaactgcaggggcccgcatctctatggtgggaccactaccaggctacgcagccagaaggacagcctattacttgggcccgtttcaccgccgctttccggaggacccatgtgcccgccggagtcatggcccttaagaaaagggaattccgagagttgaagcaaggcaaccgctctgtgatggagtatttgcatgagtttaacaacctggccaggtacgccccggaggatgttcgtgaagatgaggagaagcaagagaagttcttggcaggaatggaccctgagctgtccgtgcgtctggtctccggggactatctggatttccagcgtttggtggacaagagcatccgcttggaagccaagcacaaggaactggagtcgcacaagcgtcgcctgacgaatttccgcaaccaacagggggctaaccaaaggatccgctacaccaatccctatccagggggatcctcctcgcagcagcagcaacagcagcagcaacctcgctccgtgccccaacctcaattcgtggtgcgcgtcccacagccgcagcagcagcagagtgtcacatcctgatttttgtttcaggatttataaattatttaataaattaataatagaatttatattaaatgatctttaatttacaagtgaagttaaatgtgggaaataaaattttctaaatataaagcgtcgatggatttaatttttaaattctccatgattaagtcaactctctgaaattttctcggatttttcagagctcaattcctaaatgatacaaagaacagttcagtaattatttgatcattaatgatctaattatatttgttaagagcttttcttgtttaaaaatccttaaattataaattgttgtttaaaaggaattattagaaatgatcttaaaagcctaaaagagaagatctaattttaatttgctaaatctcaatataaaattgggctagataaaattttgttaaataatttgcttaattctataattcctagatttttctgggatttatttgagctaaggaagtatttttaataaatggaattgcatttcatgaataatttaaattgaaaaaggtttttaaaagtctgttttggctttgggccgaaagccggcccaaaaccctctctctctctttccctcggcccagtccgccgcgccccttcctcctctctctctcagccgctgacagatgggccccatctgtcggagccgtcttcctcctcgcgccgccgccgccgcccgaaccctagccgagccgtgcgccgccgctttccaattcggccgcgtctttccttctccggccgaatcttttgaggggaaatgatcttcgagatctcctcttccttttctcttatagaaactccggtcaatttcgtttggaaatcgacggattcgaggtcgattcggatcgacttttctccctccaaccccgacctttccttctcgccgccggtcgccgtgggccttcgccgccgcctccttgcccctttataaggatccccgagctctcctctacccgccacctccctcgccttcgtctctcgccgtcggaagcgccctagcgtcgtgtgacctagcgccgccgtcgtcgccgctccagctgtgcgccgccgccgttccggtcgtcgtcgtcgctcgggaagatcgccattgtgatcgccaagtcgccgccgtcctcgtccaccgcttcgccaccgccggagaccgccggagcaccgtcgccgccgtcgacccgatctccgccgccgcttcttcctcgtcgccggcgccgtccgttgcttttctgccgccgttttggtcaccggtaagttcgccgcaccgcgctctacgtcctggtgccctccgttctcgtcgtcgcgccgtcgttcgccggcgagcttgcgctcccgagctgccgccggtgctgacgtcatcgctgccgtcatcgctgacgtcatcgttgccgttccccgtgagccggtcgtggaccgtttgatctcggccgtccgttttggatagggttgatctcggccgtccgttcccgtgaaccgctgccgtgcgcccagtccaccgcaaaccctagccgctgacgcaataaatccctttttccttttcaaaaataattcattattgcgtcataattcaattaaaatccatataagtgttttaatccgatttaatctttaaaaattcataactaattcatttgaactcagtttaatgtggttcaagttgcaaaaattttataaaataaagatctacatattaaaattgtccataaattgaattaaatttatttaattctttttaaatgggctttaattagatttatcttgtaaaattcataataaattcatatgaagtcagaatgaggccgttcaagtctcataattcatctaaaattataatctacatgtttgtttactttttatgtattgtttatttggtgtttattagtctttttcttggttttgcgtgttagcttgtcgtttccatcgttgcgaaggttcgcgagtgcaccggaagtgttcaagaagattaattgaagaccgattattgcaaggcaagtcacacagatcccaaacacaattcctttgagcatgttgatcctatattcaaattctctatttatttcaactgtgcatttatttttgaatgtcactgggtggtgtgaacctattctttgttatggcccttttgtacttgattactttattccttgataccttgggtgattataacttgactagttgggctatatatatattggttcaactagatattagatataattgcttagccatgcttagaaacattagcacactattgggataacttattattcactattatttaatggtggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcatgggcaacggctttacctttcgtatagcatggttcattgcagagcaccagactgagaagtggcggagataagcccacgggggtcgctggggagtccatgcctctggtttttgaggggggtgattatgatccaggaatggtgcactgtggtggattgtgttgtgcgaggggtaatgtcacagctcctttccgaggtaccgtggtggtactgaggcacatggtgacatgatgtggggctgtgtcttctgggtacagtggtacacctctggccagagtaaaactattcgaatagccgtgcccgcggttatgggcgggttgagcaatgtttttcgtgattagtctcacacctctcacaataattatggatgctataactggtaataatttgtttagctcctggtttggagttagatctgtacagccgggtatggttgttcagaatggttgggcctgtgcagcatgggtgtgctgttcagtgttgataaaatttctgattaattactccactgttttacttctcttaaatgttttgctaaatgctgcttttgcaaatgagcctatattatgccatcctttggtatcctcgtgcacttgcatatttgctgtgtggcttgctgagtatgtcatatgctcattcttgcaataatcaatcaacctcagttgaagaaaaagaatccagaaggagaagacgtttggcttataccccagttgagctgcctgtgggagtggagccagagcttcgctagattttattttccgctgcagttttcttcatggtgaggactaagtgcctcttaagtaagtatttatcgttttagttaatttgatgaatctgtatattaaattgtcaatttgtgtacctcggctgattcctggacgatgttttcatgcacaaataagttcggaaattactagtgaatttccgggcgtgacacagagtcagcaagggacccgtgcgccccatcctcctacgccagccgtgcagcctggacaaggccgcagagacgttcaatgtcagcagcgtctgtgcttcaactgcttcgagcccgggcacttgcggataaatgcccaaagccgaggcgccagcaaggccaagcgcctccccgccccaacaacggtggtaaggatgtcattcggggtcgtgtgaaccacgtgaccgccgaggatgtgctgacaactccagacgtcatcgtgggtacgttcctcattcattctatccctgctaccattttgttggactctggagcttcccactcgtttatatctgtgccattcatggggagaaatcaattgggggtagaaaggcttagaaaccctctgctcatcaccacccctggaggggttatgacagcaaagtattatagccctgccgttcctatagaaatccagggaattccttttccctcagatctgattcttctagacaccaagaacttggatgtgatccttgggatgaattggttggctcaattccaaggagtagtggattgcgcaagacgcactgtcactctgtaccgagggccggaacaaccggttgttttctttgcacccccaacctctgtcggcagttccgaacttcatcagataggactgtcggaaaccctcatcgtcagtgagttcggagatgtgtttccggaagaactacctggtatgccgcccaagcgagagattgagttccggatagatcttgctcgaggaaccactcctctgtacaagcgaccctaccgcatggcagcaaatgaactagtcgaagtcaagaaacagttggaagagttgaaagaaaaggggtatatacggccgagcacttccccctagggtgctcccgtgttttttgtggaaaagaaggacaagacaaagaggatgtgtgttgactacagagctctcaatgaagttactatcaaaaataagtaccctcttccccggatcgatgatctgttcgatcagcttaaaggtgccactgtcttttcaaaaatcgatcttcgctccggatatcaccagttgcgtattcgtgaagaagatatcccgaagaccgcgttcaccacgcgatacgggctgtatgaattcacggtgatgtcgttcggtctgactaatgctcctgccttcttcatgaacttaatgaacaaagtgttcatggaatacttggataagtttgttgtggtcttcatcgacgacatcctggtgtactcacaatcagaggaagaccatcagcagcatctccgtctggtgttgggaaagttgcggaaacatcaactgtatgccaagcttagcaagtgtgagttctagttgtccgaagtcaagttcttagggcacgtgatctctgctaaaggagttgccgtggatcctgaaacagtgaccgccgtcactgattggaagcaacccaagacagtcactcaggttcgcagctttttgggtttggccgggtactaccgaagattcatcgagaatttctccaaaattgccagacccatgacgcagttgctgaagaaggaagaaaaaattgtgtggagcccgcaatgcgagaaggcgttccaaactctcaaagagaagctggtttcctcgctagtgttaatcttaccggatactcgcaaggacttcctggtgtactgtgacgcttcgcgccaaggattggggtgcgtgctcatgcaggaaggtcatgtggtagcctatgcctcccggcagcttcggcctcatgaaggcaactaccctaccaatgatttggtgttggccgctgtggttcatgctctaaaaatctggcggcattatctcattgggaatcgctgcgaaatatataccgatcataagagtttgaaatacatctttatccaatcggatctgaatcttcggcagagaatatggttagagctcatcaaggattatgatgtgggaatccactatcaccctggtaaggccaacgtggtcgccgacgctc

SEQ ID NO: 61329 - DNA, 3814 bp, Oryza sativa
caataccctactcctgtttggctattgtatccaccggatgtatattaatctgatgacctaattatgttatgtccttggagggcttcgtgctctccttatataggttgggggcaaagttacaaagggaaacccaatcggacataacatggatttccttatatagttacatacactactacacaaatgattttcctataagagcaccctaatatattgtaaacgggtcataagtgtccacgtctggaaaaatcgacctttatttttatttttacacacaactcgttaagtggcctacatggaaaagactattttcacatacaaacatcttaaggagccgtatgcaaaaatggggatattttttagacgggcctatcaaagaaccacatgtgaaaatcattttcgcatgcgggcaactcggagataagtgggccacacgtgtccccgcatccctttttctcctcctcgtctctaccacacatttcactcctttttattttctctcttcccgttcaactctcactccacatctcctctcacccttcctttcccactccacctcatatcttttcctttcctctcctcgttctcttctccaccaccggtggctaaggcggagatgacggcctcgcaggcgggctctggcggcatgcagagacgaaggtctctttggcaggcggcggaggcagcctcaggggcgggtggtgacagcacgcggattcggccggtcccatccacgagagcgacaacggtgcgcggatctgtcgacagcgattgtgggacgggtggctccgtcgccggcaaccgcagggagggccgatctgtcgccggagaccgcaggacagacggattcatcgtcggcgaccgcggggagggcggatcagccgctgacaaaatcggggaaccccctccccctcccgcacatggatccgccgacgacgggaggggtgatgacggcagtagtggcggtgggaggggcgacgacatggtggttgtggcgacggtttctaggttactgttctgtggctagggttttgatttctggaattttttttttgcgattttctattagcacgtgcagacggcttaagcgctcgcagtcgaataagccgtctgtgtggatatatgaaacccgtaatctccacatgtagtttctacaatgcgaacgtagcaatgtctggactgggcgatctccgtgggagatcatccggactggtataccaaaacctttaagtttaatggatcaatgaattaatggagatgagggattgcttgtgagacggaaaggctgaacgaaatgacaggcagctcacatggcagaccatctgggctggtaaaccaaaaccttaggtttaattgataggatagggtcaattaaaccctagattgttcagtcccgcacattgtacttccatgcagatacctgcaatgttggttaatctagcagttatttctatcctgaagtacttactacagaatttaacaaatatagtaactaatatcttggaaacaaaacaaccctcaggaccttcttggaacacaagttttggaacgaaaatcagtgtaaattacagggctgaaaagttataagttgggctgaaaaactttgttgttcaggtggggttgcttgtcgcattataatctccgattgagcccaatccacccataaaagaaatatctcctcctggtaattaacacaaagaaagaacggggtaggagtactaatctgatctggttgcaggcgagcctgcggcctcatggtgaaccagcagctgcatcagcaagaaacggagtgtacacgacgtcactcgagaggacatggcggaccatcgcctatggcgacacgggctccttgttgtcgccatgtgtattccagaggacactcaacgtggcaggttacttgaagctccctcttgcaggattcaccaggcaatggcaagattctgaattcctgatgccacccattccaaagcaggaatagtttatgctgtcctatggggatgatcagcaaaagattgcgattaaaaaaaatagcgtctcaagacttttgtgttctccaacccctgtgtctttttttttgtgccaatttaagggaagtgaataatgatcgggaggggttcatatatatagctgagacagtgagacaagagataattgatcagcatgacagggatgagagagtaatgacccacctacaacattgcaggatcgatgaagtggatgaattttttagataatggaaatggattatatctccggcttctgtcataagacacacagccataagtttaatagtaataaaaaggtaagataaaagtaaatcaaaatgagaaataaggtgatgggacaaatccccaactcccctttattattgactagcgttcaaccatatagaatattttagctagcaatttttatggaacaacgccacccatagtggaataagagacccttggctaccgattccaagagtgtagcaccattgcgcatagtatcctgctcctcctgtggtagcattgtagaccaaaagtggagccagtaggaagacatgaagataacctacatagggttagataattgtttaccattaaaaactttatcattgtgacaacgccaaattgaccaacatacagcactagctctaattagaatcatcttcttaatggacctagatacccctctaagctaattaccgaaaatgtttttggacctacatacagcactagctccgattagaatcaacttcttaatggacttagatacccctctaagctaattaccgaaaatgtttttggcgttacggggtgcggggatattaaaagcaaaaaacacgcatctctaaacaaactaagcaacacgatactcaaagaaaaaatattggattgtctcttgtacatagcagaaagaataatgtttgtctccccccattttcttttaggagtaaattgcactggcggtccttaaacttgtgaggaggtttcatccaggtccatgaacttacaaacacggggtcaaggtcactaatcttgttttattgtatcaatccggtctagagaacgctttgacccgtttcgtgcatacgtggacagcaacgtgttgcgacacgtgtgatgccacaccgcaccgccccgcaccgtgcactttttaaatctaagcccctcagttccctcgaattctccaaaccttagccctctcttctctactctcttctcccctggacagcgaagcagaggcgatcgccggagaaattgcgggctgtgatcactggtgagatagggattgagaggttgcggggagggtgcagagacactggcctcccggaggtgttgaagccggcgaggaggcatgttgttccggctaacaggagagccgccgccggtgtacggtatgtacaatggacccaaaatttgagcttttttttggttgattgcagatgggtggtagttatgctagctgtggtctatttatttgatgatttcgagtgtggaagctgtggtcgaattttgttgattatttagggttttggtgacagccatcatagcagtaatctttgctaattaggaagacaaattttgtaatgcagctaaggattcgggtacattcactgctgagatacaccatgggggtttctttgttggctatggtagcaacagggcatacatagatgagaacatggattggtttgataatgttgaggcaaaaacttggtgtgctgttagtttagatggtttcttagaaatgcttgggtatgataagagtctaggcttcaaggcatattggttgctaccaggcaaaactcttgaagatggtcttaggg

SEQ ID NO: 61330 - DNA, 5045 bp, Oryza sativa
ttacctggcgatcgagcctgcggcttcatggtgaacgggacaaacgaagccatcgcccgcactagcaacacgcgaagtgaggcaccccacagcttacacttgaggcaggatcagcaggtgcaccagcatgaaataaaccgagtgtccacgacctaactggggaggacattccccgcaaaaaaaaaaaaaaaaaaaaaaaaactggagaggacattgcggcccatcggtatggcggcacggctccttattctccccatgtgtattccacacgacattcaacatggcaggttacttgcagctcctttttgcaggatttaccatgtaaatgcaggatcgtacaacaaaaactaagccaattagaggggtcaaatggttggagtaaccaaaaatcaaaatttttaacggaattaaaagttagcctccatttctctttatagctgaggtaggttgcctaaaaccatgaaccaaactcatacaagaagtcctaatcctctaggaaaccatgctggacgagaaacaaactttataaactccaattcacaactacagaaatgtagattggtactggttgggaactacacaaaggtgctggatttcccaaccgacaccacgaaaacggcactgatgagaagactccaagatgccggtttaggaaccaacacctttgatgtatacgatttgtaaagaaaagagtaaatttcactttgggcctgatttattggccaaagtttcaccataccaggtataactctaccttttcagttaacaccaggtatgattaccttcttttgcagtttggactgggtttcaatacttttgggccaccatgttggcttgagcctggtgaactcagttcagcgcagagagttatcaagggagactagcgcacgggaaaggaggaagatagtgtcgtggaggtgggggtggaggtggacttgctcaacgcctcgatctccaccctcgccaccggcggctcccggccaagtctccggagcagcacggcgtggcggcggcgtgaccttctccggctccgaattggcatggcggcgtgctcttcagcttcgtgtggtgttggtggaatgaatctgtgttgtttctaaatgtgtatgcaagtaagatagagctgtcaattttgccactaaaaacatggaaagaggttccaagttccatatgtacatgtacctgatcatgaggtacttgtgataatttccctttccagtgccttctctttagtggtacttatttacaatacaattagctaataattcctactctaacttggtgaggcttttggaatcctcccattctgccgtgagctgaaggagcagtgcgtgcaccccgttgccggcaccgcggtcgagcagaagaagagcatgccgccgtcctgccgcgccggagccgaagaagagcatgcacggccgctgcgccatgcctcgccagaaccggagatgtgcacacggccaccgcatcgtgccgctccgcaggcgtagaagccaccggtggcgagggtggagaccgaggcgttgagcatgtccgcctccgcctccacgacactatcttccttctctcccatacactagttttcctcgataatttctcttccccgaactgagttcactaggctcagatcaagccagcgtggtggcccaaagtcttaaaacccggtccaaactgcaaaagaaggtaatcatacctagtgttaactgaaaaggtcgagttaggcctggtttcatggtgaaactttggttaataaatcacgcccaaagtgaaatttactcaaaaagaaaaaaccaggagccgagccgatgcttgaaagccaccaaacataaattaaaaatctaaaaaaaggaacaagtacacatcacacaatcaacaagttcatagatcacaataaacaagttcatcaatacatcaagaacacggtctaaaaaaacaacatcaagaacacagatcaagaagtactctacccctgccgccgtcgccagatagaaaggaggatagggggaggggcgagcctccttctccccttccactacagccgccgctgcctctgctttggcgaaggtgtgggtgctaccattgccgtcgtggaaggccgctttttcccctcccaccggatctggcgaaggggagggtgccacccctgccgcatctcctccatccatcagagaatgcagatgcctctcctcccgccgtatctggcgaagggaagggcgctgccccttctgccgtcggaggcagtcgacgcctctcctcccactagatctagcgaaggggcggcggggtgtgaccgctaccgctaccgcctccgccgggccactccggccgccgcgagagatgagagagagaagagagagagagagagagagagacgcgtgagatagataagatcaaggggattggagagaaagagataatgccgagggctgggctcgctggcttggctcggtttgttataaaacaaaggcacttatagtataagtataggttttttctatttttagtcagtggaggtgggaaaaacactatatgtgctggttttagctattctagcccctatagtgccgacttgtatgtgccttttttagtagtgattgtaccaaatttggactccttccaaattcaactccacatcccatacgcacaccatatctccgtcgtatgtcatatggaatctataccaaccacgtgcattgatgtttagcttaaacatcccacatgatatcctaattatccggacatcatcttctcccaggttgactcccgatccatcactgacaacgctctcccgaggcatcaagacttacctacacatgaacctacaaagaagccatgcatattggagcataaaatctcttcaactagactcaacattagcacaacaatattacatacgcttgttaacgaccaaatttggtaatattagcatcggagatgaagattagatcgaagcggaatcgaatataaggattgtcgcggaaacagagtaagaatcggctggagtccggatcggctacaactaggatcggctaagtccgagtcagactgggttaagtgatacagccgattctgacaatacgacttgtgtacgacatcgggtttgagttgataagcttcaatatgattgccgcgcatggatagagttctgagaaggcaattgtatctattaattaggatattttatgtaaattctttagagataaatgtgggtaaaagtctgtcgtaaagacttatggtatcttagagattgttagagataatagtcgtgtccgatttggacatatcttgtaattcttgggtataaatagaccccgagccctatgtaattattaacacacactatcaatacaatctcggcgcatcgccacccttttacttttgttttgtttcgatgagttcttgcttttgggttgagctgcatcggtttcgatcttcaacaagaggtaagacttgttatggcggcttgcgttctcgggattagtgcttgcatctttattatactctaatcttgtttatgtaattcatcgagttatcatatatcttatataatctttgataatatcgtcatctaacctacaatcggctaacatctgttaacacaaggcggccgattaggttaaatagcgacgttggcttagattatatcgatctaagtgatttatactgtctcggcatggcgaccgatctatcccaatcacttgatttaagtatatatcgacataaggattatatattgttaatatctacagccgattgagtagatttagttcctttttattcatttatggctatcgatcgatgtacatatgacatcggcccaaaggtaaatgatatgtcatcggcacttagccgatcgactatcatttatggatttaaccacggtttctttgtctttatttcttgttgattgtaggatcaaatcaactggcatgctcatacatccgaaggcgagttttggacctgcactggagttaagcagatctcccaggcctcgtgttttctgtcaatacgcttttggcatgcctgataggactgattagaagtcagagtcacaacagcagttttcctcatggccgagaaaccgccaccgtcaccgtcctcggctagagaacctgattctgtcaaagctaagatccttaagttgggtctgtctgaggttgatgagagcaacattatgcccatcactctggataaattgacacctgaacagcataaggatcttgaagcaatgatgcagcaagcaaagaaccaatttttgagttcatttacacagacccgcaagggaacgttggttcagaagtataaattaatggtggttgcggatgttcctgggacaggttcttccaaagatggtgaactaaaacaggctccagatggtatggctcagccaggtgatcaaggtgttgcaaatggttctcaaggaaatcaaggcgatggttttcaagaagttcaaggtcttggttctcaaggtgataattcccaaggattacaaggtggaaatcttagtcagaatggcaatgcagcacatgagcttttcaataacttccaagatcgggttgactatgccgtgcacaatgctttgatcaatcagtctggggtgttagtcaataccttgtcaaacatgatgaaatcaatggttgatggttcaatggctgaatatcaggctacaggcccagtttatttgcaaggaggtgtctttccagattatcggcctctgatcaccaatactcagccatctgttcaaacagttcctcccaatgcgccatcagctcagccgacggcaccggtatcggctcccgcacttgctgcgtctacgtcggcaccaggccaactagttagtcctcggttgttgatgagagaacaaccacagcatagggggcaggatgtgaatcggctacgcaagatcaggttgcggccatgttcttaccacctcaacctattgttgttctagtccagcagcagccgattcagcaaacaccgccaaggcagcagtttgtgcaaccagcttagcaaacacccccaatccaacaggttgtgcaaccaat

SEQ ID NO: 61331 - DNA, 2475 bp, Oryza sativa
cccaagcaacaacagtcgcaaggagcaactcagcaacgaccgtgggctgatgtgattaccgatgtgatgagggaacagttcgggcttaagccgaaagatgctggaaacttgtatcggcaaccttaccctgagtggtttgagagagttcctcttcctaataggttcaaagttctagatttttcaaaattctcagggcaagatggtgtgtcaacttatgagcacattagccgatttttagctcaatgtggtgaagcatcggctgtggatgccttgagagttaggttgttccggttgtccttgtctggatcggcttttacttggttttcttctgtgccatatggatcaatcaacacttgggccgatttggagaagcaatttcacagctatttctacagtggggttcatgagatgaaattgtccgatttaacagcaatcaagcaaaggcatgatgaacctatgcatgagtatatccaaaggttcagagagatgaggaataagtgctatagtttgaatttgactgatgcccagttagccgttttggcttttcagggtatgattgctccgatcagggaaatattctcatctgaggactttgatagcttgtcacatcttatacaaaaggtaaccctgcacgagcagaggtctgcagaagccaggaagaaccctaaaagggttaatcatgtttgtccttacatatatggatcggataatgatgatgatgactgtgaaatagctgcagctgaatgggtaagaagtaaaaaggttataccatgctagggggtaaagaattctagaaaagaggagaggtatgactttgatataaccaaggctaacaagatttttgatctgttgctctgagagaagcagattcaactccccgctggtcatacgattccatcggccgaggaattaggcaaaagaaggtattgcaagtggcataactctgggtctcattctactaatgattacaagtcttcaggcaacaaattctagtagccattgaaggaggcaagatcaaatttgatgattccaagaggccgatgaaggttgatggtaatccttttcctgtaaacatggtgcacacagctggccgaacagctaatggaggacgtacaagaggttttcaggtgaattcggctaagattataaacaagtatcaaaggaagtacgacaagcaacaggagaggcgttatgaagaagataatggtggttttgatcctcattggggttgtgagttatttaggttctgctataatgagggtatgaggctgccatctatcgaggattgtcctgggtgcagtaatgttgcagggagatcaagccgatcgtatgatggaggcaatcggctgaagcaaacaagagttcctattcatcaaaggttgggcccggtgaaccaagactatagccaaaaggatgatggagacaggaagattcagtggtgtccttctggtatttttacaaaaaatcaaaagagaagggttcaaaggttgaggaatagagaatgcttttaggaggttgagcaggaaatcagtcatcggctgaagacaaagccgaggcaggagtggcgcgttaagaatcaagctcctgaagccgatgacgccacagccgacggggcgaagaattggcaaaagggaatagtgttgtaacggcatcagttaacatggtttttaccttgccagccgaattcgagatcaaacaaaccgatgttgacaaagtagaagaagaatcggctaagttggttctatcaccagaacaagcaatctttgagaagcctgaggggacagaaaatcggcatgctaaaccattgtatataaatggctatgtcaatgggaagccgatgtctaagatgatgatcgatggtggggctgcagtaaatttgatgccttaagctacgttctagaagttgggcagaaacgctgaagatctcatcaagacaaacatggtgctcaaagactttggtggcaatccatcggaaaccaagggtgttctaaatgttgagctgacagtcggcagcacaaccatccctactaccttttttgtcatcgatcggaagggttcttacaacttgttgcttggtagggattggattcatgccaattgttgtactccttcaaccatgcatcaatgcttgattcaatggtaaggcaacaagatttagatcgtgccaaccgacaggtcagtcaatgttgccagtgccaatttagctctttgggagatggatggtcttgattgcttatctggaaaagtttgggatggagattttctaaaatagtccgattctgatatacagccaattgaagatggagaacccaattgaagatggagaacccaggctattattttgaaggcgttgtggagggttcaaacgtctacaccaaggatacagtagatgatctcgatgacaaacaaggtcaaggtttaatgtcggccgatgatttcgaagaaatagatataggtccaagcgatcggccaagg

SEQ ID NO: 61332 - DNA, 1482 bp, Oryza sativa
cgaacctgtgaaggcggagattaagcgtttatatgatgctggttttattcgtccttgccgatatgctgagtgggtttctagcatagttcatgttatcaagaagaacggcaatgtgagggtgtgcattgattttagagatttgaataaagctaccccaaaggacgagtatccaatgccagtagccgatcagttggttgatgctgcttcaggacataagatattgagttttatggatggaaatgtgggatataatcagatctttatggctaaggaagatatttataagacggcttttagatgtcctggtgcaatcggcttatttgaatgggtagtaatgacttttggattaaaaagtgctggagccacatatcaaagggccatgaactatatttatcatgatctgatcggctggttggtcgaagtctatattgatgatgtggttattaagtctaaggaaatagcgaaccacatagccaatttgagaaaagtttttgagagaactaggaaaaatatggctggaagatgaatccgataaagtgtgctcttggcgtatcggctggccagttcttgggatttcttgttcatgagaggggaattgaaataactcaaagaagtgtcaatgcgatcaagaagattaagcctacagagaacaagacaaaattgcaggagatgatcggcaagattaattttgttagaaggtttatttctaatttgtccggaaggttagagccttttacaccgttgttgagattgaaggccgatcaacagtttacttgggggacagagcagcagaaagctttagataatattaaggaatatctaatgatttagcccaaggggcatcgggatataagccgatgatcaaagatgttaagattgaagttgctgccataacagccgatgattggagatatgatgtccatcagtatttacagaatctgtctcaatcggcttcttggaagttaagatataaagcgttgaagtatactttgttagataatgagctttattatcggacgattgatggggtgttgctcaaatgttttagtgccgatcaggctaaacttgcaatcggtgaagttcatgaagggatatgtgccactcatcaatcggctcataaaatgaagtggttgcttcgacgtgctggatatttttggccgacgatgctggaggattgtttcagatattacaagggatgtcaagattgtcagaaatttggggcgatctagagagcaccggcgtcggctatgaatcctattattaaaccatggccatttcgaggttggggaattgatatgatcggcatgattaatccaccgtcaagtaaagggcataagtttatattggtggcgaccgattattttaccaagtggatagaggcgattcctttgaagaaggttgattctggggatgctatacaatttgttcaagaacatataatctatcgatttggtattcctcaaaccattacaaccgatcaag

SEQ ID NO: 61333 - DNA, 2742 bp, Oryza sativa
attcctgcagcccgtcagtggctgagaaggcaaaagggaaggtgtttgaggtagtacgagagagtgatagtgatgatagggccagtgattctgattatgttgatagtgactatgatttgtctgattctgatgatgacttgtatgtggacaatattgatgtggaggtagaagacttaagctggaaagaagaaaacgaatagtaagaaagctagaggcagtgaactgaagggcaaagaaatagtagtttgtacaaattcagagggagatgatgaggactatgacactgatgaaggcttggaggcagctgattctgatggggataaaagtggagttaagtttaagtttaggtcatttagtaaggaggatgtcaataatccagtgtttaaggtgggcatggttttttcttgtgtagagttgcttacgaaggcaatcactgaatacagtatgaagaatagagtttatataaagcttcctaggaatgatcagcaaagacttagggctcactgtgcagagggttgcccttggaatttatatgcttcaaaggacagcagagctaatgctttcatggtgaagacctacaatggagagcacaaatgctagaaggaatggatcttgaaaaggtgcactgccaaatggttggctggagagtacattgatgcatttagagcaaatgagaagatgacacttggtggttttgccaagacagtgcagctggaatggaatctgacaccatctaggagcaaacttcagagagctaggaggttggctttcaaggccatatatggtgatgagatcaagcagtacaaccagctttaggattatggtgttgagctaaggaggtctaatccaggcagttgtttattcctgaacattagtgatggctgctttagcacattgtatatgtcacttgacgcatgcaaaagagggttcttaaagtgctgcagacctcttatttgtttggatgggtgccacataaagacaaaatttggtggttagattttgacagctgttggaattgatccaaatgattgcgtatatcctataccattagctgttgttgagactgaatctctaagctcttggaggtggtttctacagaccctgaaggaagatctaggcattgataatacttatccttggacaataatgatagacaagcagaaggtagttctctaagctcttgatttatttcttctaaatgtcaccaaactgttttgtgttaattgttgttcttggtttgtgcttgattgcagggtttgattccagctgtgcagcaaatttttctagactcagaacacaggttttgtgttagacacctctactccaactttcaagttcacttcaaaggtgaaaatctgaaaaaccagctctgggcatgtgctaggtctagttcagttatagagtgggtggcaaatatggaggaaatggctactctcaatcaggatgcacatgattggttgaaaaaaatggaacctagtacatgggttagagcatattttagtgacttcccaaagtgtgatatactcttgaacaatagttgtgaggtttttaacaaatacatcttggaggctagggaattaccaatgttaagtatgttggaaaagattaagcaacagttaatgactaggcactttaacaagcagaaggaggctgcagaacagtggaaaggtcctatatgccctaagattaggaaaaaagtgctaaagaatacagacctagctaacacatgctatgctcttccagctggcaaaggaatctttgaggtccaggatagaaactttaagtacattgttgatatcaatgcaaaacattgtgattgtaggaggtgggatctcacagggataccttgcagccatgcaatttctagcctcaggtaccagagaatcaatgctgagtcagtattgccagtttgttatagtgtacaagcattttcaaatgcatatgagttcaatatttggccctgtcaagacacagctaaatgggaaaagacaaatgggccacatgtgaagcctgctgtctatgaaaagaaagttggcaagccaacaaagtccaggaggaaagcaccacatgaggtccagggaaggcatgggccaaaaattagcaagcatggtgtggagatgcattgcaagtactgcaatgaggcaggccacaaccaaaggggttgcaagttgaaaaaagctggactcaggcccaatcagcaaccaaagaagtctattcaaaaccctgaagtcatcacaacagaggtaatgccatcttttattcaatgatttccttctaaaatcaaaacttccatttaccatgacttctctgtaggtgcaatctcaatctcaggtgcaaactcagtctcatgttgaatctcagtcccagcagttgctgacacaggttaacaatgcaatggtatctcagatgtttgaggagtcctcccaagttactcaaatgaacttggcacctaggcctctgcctgacaaccaatttgtcatggcaaacaaaccaacagccaggccaatgcctctaaccacaacagcaaaggaaggaaagctgagagcaacaaaaagaaaggctgcaggtgatggtcctgaaaagagagctaccaagaagaagtagaattgctgatagaactgcataagagctaggctagagagctatcagtactttcttttgtaatgacaaatgatagtgtcaatctgattatggctaccatgtctccttttataattatcgaagaaatggctggcatctttt

SEQ ID NO: 61334 - DNA, 3708 bp, Oryza sativa
agctccttgaaatgtccaacatcgggttccttcttgaattcctgagcactgctcttcttcagctcatctccatccttcattttggcctctttcagcaactctgcacaggcagcttcataaatgaagccactcctcttcaggaatttgatgtaggcttcctcccaataccagaaattacaaccacttccatccttctatacatttcacagattgcaacatgtaaatttcaagcaaaatgacaaaaatccacaaagggcactttatcagaggcaagagatttatcacgtggtctggacatgtgaagaaaatgcgacctcgattagcttccgtggtcgcggttagctccaagatctgcttcaccccgcatgaagggcacttaatcagcgggattgagggcctcctcctcttgcgactcgagtggcttgagctgcttgcagaagccatgccgacgacgatgaacacacctcggccgagtgccctccctcgccgttgactctcagccggaagccctccctcgccgtcgactctcagccgccctcccacgccctcactcaccgtcgactctcagccgccctcccactccctcactcgccgtccaggggaaaagagagcagaaaagagagggctagggtttggagaattcgagggaactgaggggcttagatgaaaaagtgcacggtgcgggacggtgcagtgtggcatcacacgtgtcgcgacacgttgctgtccacgtatgcacgaaacgagtcaaagcgttctctggaccggattgatacaataaaacaagattagtgaccttgaccctgtgtttgtatgttcatggacctggatgaaacctcctcacaagtttaaggaccgccagtgcaatttactcttcttttagccaggttatctttcgttagaattactttcttgtgaagaaaccacataaagaccattgaattactttttttcgttagaattactttctttagatgaagtggatgaatgaagctaatatgtcaacaaacgattcatgaaaacataattaagacttttggccccaatagctatacatagctaggtatgtacgtactccctccggttccactgcacccctgctcagcttcactgttttctcgtgtaatagaaatcaccggacgttatgaccctgaaggcctgaacctggcatttctgggaagatggcaatcagcttccctcttttcttgagtccatcctctgttttttttccccctgtggtttcaatctgtacactaattaagaacagaggaagtatgcaagtctgtaaaatgcaaatttggaatggtgcatattatgtactacttgacaattagattacttaaatatctgcttggatgttttcataataaatgcttatcataaacactaaccaaagagtacaaatcagaaccaccttgctagatcaaatccctctcatgagtcatgagaatatattatgttggaagatcttatggtcatgaacccttgacatgttaattagcgcgcgcgtactacgaaataatacatgaatataatccgggttttgtggataatagtaaaatgttgcaacaaagccaaataatactgatgagattcggttgtatcactggtgaccttttatttcgtgattgaatcatcgctgtatgaaaaaaaaattcatacaactgaaattagtttgcgccaataaattatcatgggtagggagctacacaccaatgtgataaaccatgacatatgggtcttttccatgccaactaccatcagcacatctggcggatcagtaatcctcggttgagcaggcagacatctgactgttctgagatatcattttcctgatcccgcgcattccaatcagacattcatatttcaattgaaatggaattaaatgtgaaaaatacccccctacaaatcacttgtgtttcttctttgcctactactacttgatttcgtacattaaacctccacacaagacaatttctcctaacaattgtggttggtctctcgcaacctccttcctcccttctagtatctgccttcccaaatccctgtatgagctaagatgatggcagaacacgatggcacaacttgtgcgctagctgtaatttctataataccaacctatcgaggtggcatgagtttctattgtcccatgacgctggaggcccatgcagcactagaaattgaaataactaggtgaaataattgacaatgggactttggggaagttaggacataaattaacttgttgggaggattttctgtataaaattgagttgtagggggaaatagaaaaactagtgagttgtagggggttatttggaatttcactggaattatattatgagcaaaataaggcggatttcttttttgaatatttaaatgtcatgattcagctcctgttgtttttgcgtgctctagggcgcataattcctctggaaactcaggatgtatcctggcagaataagagagagaatgtggggatacgtgttacggctactgtaccaaatatgacaacgatgaacccgatcaaagtgaggcgtgttccacacatgccaggcttgccaatgttcgccttggtggatccggatgggaagatgtgctaattgtaaaggatgcgactatataagcaccctggagtggactggaagcttgaaaattaccgttggatcaaaaatagatgtccgagattcgtcaatgtcacggttaaaattttactcatagcaaaatttttactcgtgatgacatagacaaatatcagacgtctatttttcgatccaacggtagttttcaggtttccactacatatgtactttgcaccatatatttttccgggttagacacagatggattgggttagtgatcatattagtataggatgctgctagccaacagatggggaattgaggtttaaggaattactaagctaccattattaatattatttgttgtttctagattatcctttcgaaatcaaaggtgcatattaattcatttaggaggtacctgggtacctctcaagcacagtaaaatcctctcagaaatgtatgttgatatgagattgatcaggtagtgaccaacgcagtgtttaattagctttcttttgtgcttacgttttgcaaaaaataaatgaatgaataaataattagctcagatttgtcattttggtcttatacaatggtcatgatatatagagtcagaacttttgaaactttaactatcattagtttttctaatgctcattttaaaaaggaaaaaaatagtatatatgcttagttttgccttgaaaaagtattatcatggtataaaaacttattagatattctaatacaaaattgatagtcaaagtttgtaagtgagagattttacggtctggaggtaccacattttacctctcgttgtgtttggtactaggagctacgggtacctcttagtaactcttgagtgctagctgtaaaatttcaagtcaaattttgttctaaatattaagtatttatgaccggatggtgtatatgatacggatccgtatcctcaatacttcatgcagtttgtccttgatataaagttctgaaaaaaaaaaccttttttttggttggggcgggggggggggggggtgggacattgacctgctgtcttctctgctctgaacattcactacccacagatacacaccttctgctcttcttgcccgatcacctatcccttattatt

SEQ ID NO: 61335 - DNA, 3726 bp, Oryza sativa
caacctatcgaggtggcatgagtttctattgtcccatgacgctggaggcccatgcagcactagaaattgaaataactaggtgaaataattgacaatgggactttggggaagttaggacataaattaacttgttgggaggattttctgtataaaattgagttgtagggggaaatagaaaaactagtgagttgtagggggttatttggaatttcactggaattaaattatgagcaaagaatggcggatttcttttttgaatatttaaatgtcatgattcagctcctgttgtttttgcgtgctctagggcgcataattcctctggaaactcaggatgtatcctggcagaataagagagagaatgtggggatacgtgttacggctactgtacaaaatacaacaacgatgaacccgatcaaagtgaggcgtgctccacgcatgccaggcgtgccaatgttcaccttgctggatccgaatgggcagatgtgctagctgtaaagggtgcgactatataagcactcgagaggaggctagggccgcatagaatttgtaaacagcaaactgaatccccaaactaatcctctgtctcctcaatctatctctgatttatttctgcagttaagggtaaatacaacaagacctagatccgggatttcaaaaaattcaccggttatagatatatattttggtccaaagttgtcaacgctggttcatttggtgcaaattaggagtaacatgcatccgaatggtgcttaactagtttctcttttgttcccgatctgcttaattaaatgcttagcgattaacaagcccaatatcttcttcaatcatgcaagaaattaagcgcatcgattttgcaagaattcaattacttcaaacttttcaattccatttaacagcctctgagccaatcaatgcttaacaaaaatgaatcaatgctattctgtaaccatcatgagcaggcatcatccatcaacaggattcaacaacaatcacattagccatggtacgtgtcagccggttgccacagatgtgcacgctggcgctcagctgccccagctcctcacttctttctcttagggttagatacagatggagtgggttactgatcatatcgatatagaacgctactagccacaacagataaggaattactaagctacctttattaatattatttcttgttcctaaattatcctttagaaatcaacggtgcatattatttcgttgaggtacctgtatatgttgatatgctgatatgagattgatcaggtagtgaccaacgcagtgcttaattagctttctcttgtgcttacgtttttcaaaaaataaataaatgaataaataattagctcagatttgtcattttggtcatatacaacggtcatgctatatagagtcagaacttttgaaactttaactatcattagtttttcaaatgctctatttaaaaagggaaaacaatagtatgcttagttttgccatgaaaaagtattatcatagtataaaaacttattagatattctaatacaaaattgatagtcaaagtttgaaaattgagagattttacggtctcgaggtaccacattttatctctcggtgtgtttggtacgtactaggagctacgggtacctctagtaactcttgaggactgtaaaatttctcattaaaatttcaactcaaattttgctctaaatattaatacttatgagttatgaccggatggagtatatgatacggatctgtatcctcaataaaaattttaactcaaattttgttctaaatattaagcacttatgaccggatggagtatatgatacggatccgtatcctcaataaaaatttcaactcaaattttgttctaaatattaagtacttatgaccggatggagtatatgatacggatccgtatcctcaatactagtgtatacacatcgttcttcatgcagtttgtccttgatatgaagttctgaaaaaaaaaaacttgcggcggttttttaacccattgacctgctctcttgtctgctctggactttcactacccacagatacacaccttcttctcttcttgcccgatcacctatcccttattgttacaagtctcattttatttttcttattaccccatcactgcatgctacaagtgataagctactgcttagctgtgaattctgttaagagtattatgtgtttaggggtatattagtaatttctcatatctattgtactcatatatgtcctttgggctaactcaatggcaattgttaatctccaaatcttatctcaaagtgacatggtatcagagccctaatccaaaatcgccactaaatccgtcatcaccggcgagccatcgtcgtcgtcctccgccgttaatcgttgaagcatcaagcaccagtttttggcctcaaccagcagcagtgaccggtcgttatatccagtactccgagactgccgcccgttgccgttcatcgcagccgctcgtcacggcgccttcttcatcgctgcaggtcgcggcactcgtccctgctgctcctccaccagtcgcatggtcgtcccgcgccatcctctcggccccaaccacgcggcgcttgtctcgctgcccgtcgcgtggatcgaagcaacctctgcgatctgtagcagcaacagcagcggcataccatcgtccagttcgccttcaacacttcaagcagtaaacaagtagcagcagcaaatcaaaatccccttttcatcatcattctctccaaatctggtgatgttctctggcaccgatcgaatctatgatccttgtcctcgagctcctcttttcttcaaacagtagcagcagtgaagttccaagatgcagcaacaagtctcattcccattgtgaatattctgttcttcacccagtggttatcctctccttctccatgttcattcactctctacactaattttgcatatttctgttgtggctctgtgctgctacagcctactatttgattagtagaggagtacatgccatatcatgacataattagtttcattgctcgtcataatcatcttgtgcagctgcctgttccctcaattaattcctactttcagtggtagaatttgttaaaatcgtccccttaatttatattgatccctactgtcaccatcagtggcttatgcatctatcaagggcagggcacttctttcgttgctcatttccatagcagtcaccaagctcatcgcctgtatatatcctcagcattgtgcttgcttgtacactgctgctgtcaaccatctagtagtatatatcctgtgtccttttgctagtatatcaatgtcttctacaaatcaatttcccatgtttcctataaaatctgtcaaagtccattgtattgttcagtccgtcgaagtcatgctagtcaatcttttcccagctccaagtcggagttggtcttcatcataatcatcataccatcgtcaactccatgtcggagttagtattcgtcttcagtttaccagctccatgcaccaccaccctcatcaatcagtgaaggactgaagaacagtctgtgaagttccttcaccatcattgtcaccgtctttgaatcaatgaaaagccaaagaacagtttgtgaaggcttctggtaccaagggctgaataacagtttgtgaaggctcgaggtccacttcattgaggaggggatggttttctcttgttcttcatccaagagcaatgcttcgacaacatctttaaatagg

SEQ ID NO: 61336 - DNA, 3348 bp, Oryza sativa
gaggattcactcaatccggtggtttgcttcccattggggatttaatctccaagaatcgaacatgccctaagggtgtctgccacagaaacacatggtaagcaagccagggtcctaagaagcagaggagcataaccaggacaagctgcagtatagatggccaaaaggcccgcccggcacggccaggcccaggcacggcccaccagccatcgagccggcacggcccggcggccgtgccggcccatgggctgcgcctcctgcccaggcacggcccaccagacgtcgggccggcccgaaggagcgggtggcccatcgtgctttttttaaataagtctattttctgtccctcctctatgggctgtgacatctatataacgaaaataagtctattttccatccctcctctttgggctgtgacatatatatatagtgaaaataagtctattttccgtccctcctctttgggctgacatatatatagctaaataagtctattttacgtccctattctttcaattgtggcatataatatgtctatttttactccctattgtttatgtgtcgggcctggcctgcggcccatcgtgccgtgccggtggagaggcccaggcacggcccggtgattgggccgggccggcacgagcccgacccttgacgggccgtgccatgcttgggccgggccaaaacgccatgccatgggccgggccgtcgggcctcgggccttttagccatgtataggctgcaacactaagttgatagttaggttaaacaaagaaactgggaattggtttgtgagcacgttcatggatgggcacaaccatgacctgatatctagctccgacctgacatgtgttatccggtgtcaacgtattgtcacctacgtgcctccttgcaaggtgggtatcaatgaagcactgagctgactttataaaaaaaaccaataggtgataaatatgcgaagggatatctggtctggtggtaatagattttcccagcaacaatcttacttttccggaatcccatatagtcatttttctcgtgtattagtggatctaggacatgatcctcacttatgttactattaaacactagaagaccaattgacagtggcgactcatagcgacgtgagaagcaggccacggcggccagtcgtcaacgcgtgcaaatgttggtcaagcctcctatttcttcagtcttccagatgctattgattctctttttctttcgaacagactttcttgtgtgtacatcttgattaatcttaagaacaaacaaactataatattgatgtatttgattttcatttattttaattaatcttaagaacaaacaaacaaacaaacaaactaaaatagtaaaaatctgaccattgattttcatttaaattggtgggtctattaattttgattgttagatttattttacaagaaaaaaaaatctccgcccggagtccggacgtcagccttcatgcgcacgtatgtacgatccctccaatgttccaaccaccgttcctctcttttttttaatccccataacaattaaaattaaatatttttatgggcctaaaaagcccattagcctattatatctagccaactctttatatattcaaaagtccattaaacttcgatcaaacgctcctatgctaccatgtggcatactataaacgctctcgagtcgccatgtgtcactctaataaaatagtaaaaatctgaccattaattttcatttaaattggtgggactattaattttgattgttagatttattttacaagaaaaaaaaatctccgcccggagtccggacgtcagccttcatgcgcacgtatgtacgatccctccaatgttccaaccaccgttcctctcttttttttaatccccataacaattaaaattaaatatttttatgggcctaaaaagcccattagcctattatatctagccaactctttatatattctctcctaataaatagtccattcaatatcaaataaatatttctaaacaatgtccagatttgttgttattggatatatcccatcatattctaatttgaatttttataggacggaggaagtatatagcactcttaaattagaggaaatcttaaagaaaaataataaaacattcgacaatcgaaattttaggttattagttctatctttttttttaaaaaaaaacatcccaaatctccctccgcactcccatgcggccttaaagcaaattaaccatcttataaatatttttaaaccacccagtgacacttctaaattagaaaaaatcataaaaatttaagaacaaaacatcaaactatggtttcgacgtaaatcgatggacatatcatttaggttgttattagatttttattttaaaaaactcccaaacctcatttcctccctccctgcccctacaatgttaatgacttaaaactacattaaatatcttataaatatttctaaaccactagcgttaaatgatattgttttttgtcataatgtgtaccacatctagtgttaattttttatagacaacataatgaaaataaaaacatgctcagttgaacatcatattgatcgtacaagcatgtaggttggaacaaagaatcttagaagtgaaacaatgatgaggtggccttaccaatataatgagtcaattccatataggaattaaaaatcatgttcatttatttctttttggtagaacttgctacgctccgttgtaaattcctaacatgtagtgtagaacaacttagaaatgtgtatttattacatgacctctatttttaatatttcttactctattgaagtgagataatttagaagagatgactttacctcatgtttgtaggctcgacccacttatgttttcaacccaaattacagagatcaaataatttcaaagatgcttcatagaatggaattctccaaatttctttaaaaaatggacatgaaaacaaacaaaatttatctatttttttaaaacaaattggttttaaaaaccattctaaatagaaatatttaaaatttttgctgcgctaatggaatgaaaatatgtaaaacatcaaatagcacctaacaaaaaaattggacattttgagcaaatgttggggggggtaagatatctacgtaggaagtcaaaattccaaaaatttactcatagaaactacacatattttcgacataatattttctcataaattgagaagtgtgcagtctcgagtaattttagtttagtatttatgtgctgaaggggtaatcagaagaaaattataaccagcattcaaaacacattaaataagttcaatttttattttatgtgcattacaaaggatatttgtaataaaattttacgt

SEQ ID NO: 61337 - DNA, 3438 bp, Oryza sativa
atggccgatattgttatatcgtccttagttgtttttatgttgtaatcggttgtggtttgccgatatacaatggcggatattgctatatcgccctaagttttaaactataattaaatcaatgcttttgacattgtaaaattaggggggcacatatatacaccagttacaaattttgacaatttttgagcaaatttggaagttatattaatcggcacaaaggattatcaagataaacatcagtagtatcttagccgattacaaaaatttctaaggtctattacacagaaagttaccgagacaaatagcgctggatagccgatatagctctttgcctaatttgttctacttcttcgatggcttgggcatcttgagcatcggttccagggatgacttttaaagacttggttagatcagcaacattttttatagccgattttagtcttgctttctgcttttcaacagattttgggagatcggctagctttttatgttccatgtccagattggcactgcattcttgaagttgtgccaggagctcaatctttcgagcttcaagccgatcaatattagacttgatcggaccttcagataactgatcaagcttggccttctcttcatgaacaagctgccgattggcctaaattgtggcctcgatgtctttgcgctcccgacgctcgactagtctcagcttggccttctccagcttgaattgatgctgctcgagatagacagctggagttaggacatcggctagctcatctgggatcagagcttgaatctcatgtagccgagtcctaattgagccacaatcaaccactaagctgtctaacgatgatgcctctagccgatgagagatatcttcaagaattttcttcacatcatcggataagggggctaaagctttgcttgtggtatcctcttctccttcatcaagatagtctctaatgtcaaaagagaaaagatcggctaagacatgcaataatgatttaaagagaagttagaggtcaaatagacatagccgatctgggtattttgtgtcaaagaaaagcttaccaggatagcaggagcagtcggttggacttcttcttcaacatggtgaatccctacagctgatggagtctggtcacttgatgactgttgtacaggagaaggaggaggagactgtaaaagagacaagtgttagacaaaatcggctgagatcaactaatgaaagaattaagatgtcattatagccgatttcttcttcacagcagtcttctttttctacaactacaaaatctgtgagtaatcggccataaagtaaaatgattgcaaaaaggatcaaagagagctgcttactcttgaaaagtgagctggagcagaaggagttggaggggtctgcttgggtgaagccgatggtgttctttctgtgtcgcttactttggctgcggcttggtcaacgtcttcttcaatttcctcttcatccagagcttgttcaatggatggatctagggcaggcagatcatcagatggcttagttatctttgtcttggttttcttctttggagctggggctgaagtatctacagccgatgatctggtttttcttttcttgccggcatcggctggttctctgatgagcccttgaagaagagctgaagtcttgggggcatcatagccgatgacaggaggagatggtccacctccatttggaattaatcccgaggcatattcaatgttcctgccactgttactttggcgaggaggagagaactctgttgtctgcaggtcgaaaggaaagttagtcaaggttagtcggctaagcaactattcaaatgaaattgagtaaattaagacatacctgagggacaacatctggaaagagatctgtcatatacatagaggccgattgatggaatagatgcatgcaccattcactccaccatctgtcgaatgctctgctcctgaatgttaccagctctatattatcaatgctgcctatagggggtccttggaggttaagcagccgatccatcattaaggctgacgaaatttcccctcagcactggatcttatcttcaaagaataagccgattgggagttggcccattccagactgcctggcagaacttattggatgataaaattcataggagacttagatgtttcttccttgatgaatgccgacaggaaggatacatggactgattgcagctgaagaaatttctctgggtttctgatatctttcattgttgatgtcttcgaatatgaagtccaatggattttctagaagtgttgaatcttcatagaggaaccaaacttgagtatgtttttggaaaccctcataaaaattgcagaaccagtctttaagcagctcggccgatagctttgcttctgcatcggttggtatggaggcatattctccgtaagatgtgcatctccgatgagtacgttcttctccatcattgtctacaatcggctccagtcttggaaattcagcttctgttacagatggccaattgacaaacttcatgactaccaaattcagccaggactgcaatagccatcatggtccacctgctccgactactgagccgacagctaacttagccgatgcattgtttagcatttggtacaagtagccgagaagtatttttcttaaaggaaattgtttctttgcttctaaggcttcggctacaaactgccaattggttgtagggccacagcttgatccacaaaagaggaatttctctagccacattagcaagaaagccacatgttctcgaggggtgacggaaccctggcccatgtatgctgctacatagcctgaccagccgcctatgctcttggtcttgaagtcgtattggttcttcgtgttcaagctcatagagttagccgataaggtgacatccagacccgtgatcatgatgatatctatgagagttggggtcatcggcccttggttgaacaagaaggcgttgatggtgttggaccagaaataagaggcagttgccattaggggctcatccttagctgagttggctatggtgagatcgagtgcttggccgattccaatctcgtcccaatgaactcttttgctagccgacatgctcttgaaccatgtgatccaacttttctcgggtcgagttttctcgagggatggccaggatttgaaggtgtttttccagtgacctagatctgggttggccaatctaaaaggaatcctattggtttcaccaataaagaactctgtgggatcagggttgccgactgggccgagaaagtagtagttttcatgcgataggctgggaattgcaactaggttggagagatgctacaaatccaaagtaatcgagaaagggaaagcaatataaggcgagagaaaatcgatctgatgctaagaaaggggatctagccgaccgggacttacctcagtgtactcgccgacggcgtggcaga

SEQ ID NO: 61338 - DNA, 2247 bp, Oryza sativa
ttaacgaccaaatttggtaatatcaatatcggatatgaagattaaatcgaagcggaaccgaagataaggattgtcgcggaaacagagtaagaatcggctggagtccggatcggctacgactgggatcggctaagtccgagtctgactgggttaagtgatacagccgattccgacaatacgacttgtgtacgacatcgggtttgagttgataagcttcaagatgattgccgcgcatggatagagtcctaagaaggcaattgtatctattaattaggatattttatgtaaattctttagagataaatgtgggcaaaagtctgccgcaaagacttatggtatcttagagtttgttagagataatagtcgtgtccgatatggacatatcttgtaattcttgggtataaatagaccccgagccctatgtaattattaacacacacgttcaatacaatctcggcgcatcgccacccttttacttttgttttgtttcgacgagttcttgctttcgggttgagctgcatcggtttcgatcttcaacaacaggtaagacttgttatggcggttttatgatactctaatcttgtttatgtaattcgtcgagttatcatatatcttatataatctttgataatatcgtcatctaacctacaatcggctaacatctgttaacacaaggcggccgattagattaaatagcgacgttggcttagattatataagatatctatcactttatgaaacatccagtggcttgattgtctagatattgttcttcttttcatactcaatgctgcatcagttgagtttgatctattaagtcgtgcttagaatttcaatctctagcctgccttctggttgccgattagggtagtatcggagtttcagtcgaccttacctgatttaactaccttatcttatatgcttgattgatatgttgaatctgccctttatattaagatcttgctgcatttaagtatattaggcttctgtttggtatatcctatttgctttaatatcttaatacagagtggtatcggagtattagccgatacatgctagatctatctgatcggctatgctatgaacatatataatcttgttgttaatatatatttcgatctaagtgatttatactgtctcggcatggcgaccgatctatcccaatcacttgatttaagtatatatcgacataaggattatatattattaatatctacagccgatcgagtagatttagttcctttttattcatttatggttgtcgatcgatgtatatatgacatcggcccaaaggtaaatgatatgtcatcggcacttagccgatcggctatcatttatggatttaaccacggtttctttgtctttgtttcttgttgattgcaggatcaaatcaactggcacgctcatacatctgaaggcgagttttggacctgcactggagttaaccagatctcccaggcctcgtgttttctgtcaacaacgcttagtattcatctagaaatcataaacatgatttatccacaaatatctacagaaaacaacctgaaaccgaaatcgacacatattcggccgatcagaccgcgggctgaccggtctgaccgcgcaacacacgccggtctgatcggcaaccacagttcgctctaactggtccaaactgacagcagtccctatttatcatctgaaaatcaaccttctccaaaaccacttcaccaataatctaaaaatatcaaaacaataatctcaaatgataattgttcatcacaaaataataagagtaaagtccatcaccggtccctaaacttgtaccgctgtgtcatcccggtcccgaaactcgcaaatcgactgttcaggtcctcaaacttgttcaactgtgtcatcccgatccttaaacttttagatcactcgtttaggtcctccaacctgttcagttgtgtcaccccggtccctaaacttggatttgaatatcatctgggttaaataggacggtctaaagactttatatttaaaaatagttcataactttttcatgtgaactctaataaagacaaactttatatcaaacttgtagtcctcgacgcgatctacaactttttagttgaatttttttttattttaagtcattttttgtcccaaaatgtaattttaaaattaaaatttcaaaatctataaacatgcaacaatattttgggaccttaaacaattttagttcaaaaacttttcaactacaaagttataggtcgcgtcgag

SEQ ID NO: 61339 - DNA, 4520 bp, Oryza sativa
  unsure (1)..(4520): unsure at all n locations
cagataagtcaatattgtactgaagtttcaagtttcgaatattttggagacgattctgcacttctttgagttctgctgctattctgcgcaatggcatcacactttcagattttctgaagaagttcttcaacaattccacagatggggtttcttttctgccaaaataatagacaaattcatccaggatgtcttcaacttcaaatgctatctgctgaacttcctgcagaaaggtttcagcctgcctgctggagctttctttttcttggccatcttgcaggaaagattgcatcaacctaaactcacttctaatttgctttacaatgctttcaacctcaattaaaactgatacctccttccccagatgtgaaactaatgcctgcgtcagatgtgaccccaatattgatccaattttgcataggattccaaacaccacagactctgccattcagtgctcgatctctcagttcagatattttcaaatgcaagacctgaaacaaaatgaacaagcatccaataataaattttcatcctacaaattactttgtaccagagttcttgaaaaattgcattaagttaaaaaataacagaacggttgtcatttcagacttatttcacaaattttttggtgccagatgtatccatgtaacaattcaaataagaaaccggtgaagtttaagtggcatataaggaattttctcttcaaataaacagatgctacacaatctaatttctggtccaatcgaaggcaatatactctttctttttcagccttttttatgtaaaaaacatggaacccaaaccacaaaaccacctataagcctatacataagggagagaaacagactaaataaggcaagatagaacggagaaggtacatgaattacctgtgtttgctcgccgaagcttttctcgcagatgggaattgcaatggcaaagtagacgccctggaggcatttgatcgaacagttggcgggtggttgaactgacgaccggccagagtgtgcgccgtggtttgcacactatcaatgggaacctggtaaacccatagacacaccaataatagtgatgtcggtagtttatttagtgtttagcatctaataaaaagtggcaacttgcaccttcgaagaaattgagagcaagaaagctgcatgtttcctaccgaaatccccattcgagggacaaccgatcaagatgtcaattgcagcttggaaaggggaaatggtttaaatggagagagtgggactggcgtgtcagcctaggacaagcatataatatactccctccgtcccataatacaagagattttgactttttacttgcactgtttgtcccctcgccttattcaaataaaatgtgcaaatataaaaaatgaaaagttgtgcttaaagtactttggataataaagtaagtcacaaataaaataaataataatttcaaaattttttgaataagatgaatggtcaaacagtgcaagcaaaatgtcaaaatcccatatattacaagacggatggagtattttattaagagtgtatttttttaagttcattttgtcttaatatttatgttggccactttccattgagtaaatttcacggaacactacaattttcagggaatctgtatcactaccaaaccacattcaactatcggttacctgataagaaaggctcaccggtcagtgactagccgtatacccccccttgtgcgtctgatacgcaggcattcgctggagccgaagttagcgaatcagaaacgacaaaaaaaaaaaaaaaaccacgctaagcttttttcaggagtagcgtcaccagacccatgtgcacaacacgaagacaaccaactctttttgaagctcacgtttgcttgcctgcctacttcggtagttcggtcttttggttttcggcccaactcgagtttacgacgtatataagaagttccaaacctagtatttgcaatgatgctctgattttctgcatacatatacatgaatatattttttttatctaaagtgtgatttcaaatcttttattaaagaaattagttactataaattctattactagatataaattttatcttagggatgccaagtcttttataatattttcttattatggatgaaaacccacaatattttttaaaaattatttctatatgtattttatgtatgttaactttacatgtataaactttttatatgtaaactttatatgtacaaattttatgtatataaactttacatacacaaattattggtagaaaatagtttgcatacaaatcacaaagctgcatccgcccatgaacattttgcacttttgaaagatcatgggaaaaaaagaaaaacaaaaggtgcaaacaacgggagagggccaatgcaggaaaatgtccatccatttagccctaagaaaacttcaacgcatgcagaccatatgctgaaatccagaatgggagacggcccatgtgcttaaatgcagaaaatagaaatagcatgtttgcttgttagacttttcggaatcaaaccaagagaggaaacagaacgctatagttgaaagagaaagtgggacgttcgcgcgtgtgactaatcaggaatgcgcattagtcgttccgccgcttccttcctatatgccattcacccgttcgccccgaaaaattatgtagttgcaaacctaaaaactagtctatagtaagataaaaaaaatggggcaattacgcatctgagcttgttttgaagcctaactactaatttgaccctctttaatcaattttgtttattttacccttcttttcaaaattgaagatccaatcttaccctattctgttcagggtatataacggtgttaatttgagcaaaaaatgtctcttctacctttggtcatttgaccctatttaatgtctcttctacctttggtcatttgaccctattttatcagaattataaataaaatatatcaaaattttggatagcaaccaaaaaaaatataatctctttgccacggcggcggcgtcgccgacccggcggcggcgcacccacggaggaagacggaggcctccgcgcgcggggagggagggagtgagcggcgccctatgctcttcgccacggcatcgtcatcgtcattgctgaccatcggcggcgcgcgcatggaggaagatggagaacgacgcgcgcggggatggagggagcggtgccctgatctttgccacggtgtcgtcatcggtgtgcgtggaggaagacagaggctggcgcgctcggggagggagggagcggctccctgtgatcttcgccgcagcgtcgtcgtcgttgccgacccgggggcagtacgtgtgtggaggaaccgaggaagacagaggccggcacgcacggcgacagagggagcagtgccctgtgaggcgctggagctcgccggcgtgcggagggcgggcggcggcatcacgcgcacggagaaaggaggaggccggcgcaccgaggacgagcagtgacagcttggcgccgaaactcgccagctcacgggagaggggcgccgctagatctgcggcttgtacgcccagcctccgccggatccaccgccacaacttgagctccgccaccgttgctcctcctcgtcgtcatcaagctgccgccgctccttccgctcgtcgttgctgctggtccttctgctcgccgtagctgtcacctgtcctttctccgcgcgcaccgcctcctccgcgcacgggctgccacaggtctgctacctccgcgtgcgccaccacaggtccacgcccctccatcaccgctcgtctcaatcgtgtgccgccgccgccgccgatagacaagatagagacgggagtgaatggatagggttagatgtggatggggtttcttcagaatagtttggtcaatacgaataataattaaatttctttttttttcaaaaaaatgaaactttaacggtgtagtggaaacagggtcagacggagtattcatttttgaaaagcagggtcaaataagcaaactaaaaaagtaggatcagtttagtactccctccgtattttaatgtatgacgccgangctnncctatctcccaaaatctgttgaaaagcataaagcaagactaaaatccgctataaaaaatgttgctgatctaaccaagtctttaaaagtcattcctggaaccgatgctcaagatgcccaagccatcgaagaagtagaacaaattaggcaaagagctatatcggctatccagcgctatttgtctcggtaactttctgcgtaatagaccttagaaatttttgtaatcggctaagatactactgatgtttatcttgataatcctttgtgccgattaatataacttccaaatttgctcaaaaattgtcaaaatttgtaactggtgtatatatgtgcccccctaattttacaatgtcaaaagcattgatttaattatagcttacaacttacggcgaattagcaatatccgccattgtatatctgcaaaccacaaccgattacaacataaaaccaactaacgacgatataacaatatcgg

SEQ ID NO: 61340 - DNA, 3688 bp, Oryza sativa
ggcgtcatacattaaaatatggaggtagtatttatgcttccaaacggagccaaataagtaattgtgcctaaaaaaatagacttttaagatttgcactatatatttttccataagtaaaaaattttactactttcaagtatttgcactatatatttttccctgtttgcccttgccgaaattcttctactgttacaagttgaacttgttagtgtgctacggctgtatattttccaagtttgtcctttctgaattttgaaggcaaagtattatccttccggaaacctcattgatatagttttcatcccaacgtcttccgtgacttagaaaagtactgagtacagctttattgaaaaaaggcgtaatttggagaataggggatggtgacaaggtgtatatttggagagatcaatggatcccaaaggctgctgggttaaaggcaacaggcaagaaagagaaatcgagattaaagtgggtatctccactaatctttttctaggatcgaacagcaagaactaagccaaccagggagggtcaatggttgtagtatccaaaaccaaaacttttagcgaaattaaaagttaccctcgaatcgatgacacgtggtctgactagggtaaatgcgctggtctaaccgcctggacaccattggtctaaccgtagtagtcactccagctgtctgaccgctgtaatcagccgccatcgcctatagccgccgccggtctgaccgccgttaacctgccggtctaaccagtccgacgccatcggtcttgccagttggaccgctgagcctgagcaaacacaaatcgaagaactctcaaagtagatcacaactttattacttctatctgtgtttacaaagtgcaacaacagtactcctcacgaaatctcggctaaactcgaaaccctagctatcctctcaactcaatgctctcttaaacgataccaggaggccacaccctccctctctatatatacacgaggtaggcagcctaaagccacgaaccaaacttgtacaagatgttctaatcctctaggaaaccttctcgtacaagaaactaactttacaaactccaattgtaccaaatttagacaccctccaattcgaccagtcagatcgtgggctggccggtctgaccggtagcacctgcccagtttgaccggacccgacaatctagcagtatctgttcatcacctgcaaatcactttgccaataatctccaaatattaaaaccaataatcttatatgccaattgttcatcacagaataagaatcaaacacactttgattttacacttctacaatcatgatgctgattaaatcctaaaagtcaagccttcaccgagaatatctgaagattttgttacctggcattacgagaaaaatggtatcttttcaatatgcagtgcttataaattggtgctagcagaaagagaactaaaagatggaagttcttgtagcaatgctactgatgggagtagacattgctggtacatggtttggacagcaaacgtgccctagaaagttagagtgttcgcctaccgcatcgcacgagacaatctccctacttaggccaataagtttcaaaggcaattagtgacataagaaaagtgcacgatttgtggatttgaaattgagaattttcacacaatggttagatgtacaaaaagcgaaagctctgcgacatgctctgtgcaggatttgggctctcctaggggaaagctcttttaatttttttggcgtgattgctggaaaggttgtctatccttcttatccttcttagctctgtaccaactaactcttgtcatatccttgtgctgttttggggagcttatagtatttacgtaatgatattgtccatggcaaaggtgaggagatggtggcaagatctgcaatgttcttacagagttaccatgactcttttgcacaagccgtggtacaagaacctggtaaaaaggtaaggcagttttgagtgcagtataaattaattccccaaacccgaagataaatagaactttgggcgtgggttgcagctcatgggaattgccagaactggttgggccaagattaatgttgatggtgcttttttgcaggctcatgcaatgtggtatagttctggttcagtcttgttatcatatttgaagtacattcgccacggggcagcggtggaaaaattagaattgttagcttgcagagatcaaggctggcctcaccaacgagcacagatcgcggctggcgagcaagccgaggatggctttccgtccctctcccagctgccaccaccttcacctccccttccggtgacgacctcgaggctggccatcgagcttcgacggggactagatcggggcgtcagcgcgctgcggccgtcctgtccacgtcgcgagcgtcctctgccgacagcctccagatcaaggcgacggtcgtcgagctcgatcaaggcgacggttgtcgagctctccggaggatcgagagatggcgacgaggtcggtggtgggcagcgggggatggcgacgagccccgcggaaacgcagagccgagggtcgtgaccttcttggcagtgtggagaaggggatgacagcaagctcctcggtgcggcgcggagctgggaagacgggggatgatgggctcccttttcggtcatcgagacgggctccatttcctcatcacccttctccctttccctacccaggcggtttctccctttcccttcctaggcggcacaggcaatggcaagccatgccctccacaacgcctctcctgccttctctccccatgccaccaaccctcgaacaggctgaagaacgagtgaccatctttggttccgcattcttcgtgggaccgcacgaggatgatgtggcagcgaatctttgatgtggatggccaaggccgaacgccaactatatgcattatgcattatgaatggacttaatagatggcaggcagtaccgcggtagaggcggccatgcgtaggtacctagatgagctaccgcgcgcgccgactgcatcgacgacctaccgtacgatcgagttcattgccctggaagtcgcacgtactcggactctcgaagcagcatgttagctcgttccttgacacactgcaggtggctctgtatatttatctgaagagctgccgttgatatttgcactgctctagcatttgtgagttagtagctcttatatactagcacatcatgtcgcgcattcaccacactcgttctaaaatcatgttattcgttctaaaatcatgttatgtggtagagtggcaatctatatatctcttttaggtttctggttgctcgtaaaaaaacatgtatcggataagtgatattgtatatgctgaaataataaatgatttaaactttaaatatatgcaaacttttacatctgtatgagttatagtcctatagttgttttcgtcattacataattaacccccttatcctctccttattttttttgtgtgcacctttatatccgccacgcatatattttgtaagtttttaaggaatattttagttttgttttaaattagtgtggaagtcattaaacttatatttgggagaccacgacctcctcgttcgaaagaatatgtaggtccatatagcaatttttatctcaaacacattaataattgatttttagaaacataattaattatatgaatatacattttgaatatgctcttaa

SEQ ID NO: 61341 - DNA, 1124 bp, Oryza sativa
tttccacacatccaatggtgagtgctacagattagatgttgatgaacctgaagagatcccgccagcagttcggcatctgtccatactggctgaaagaattgacctactttgcacctgtaagttgcaaaggctgcgcacactaataatctggaataaagacaggtgtttttgcccacgagtttgtgtggaagcaaattttttcaaagagttcaagagcttgagattattggatttgacaggttgctgcttaagacattcacctgacttaaatcatatgatacaccttaggtgcttaattctcccatacactaaccatcctctacctgaatcactctgcagtctttatcatttgcaaatgttatccgtacacccacattcatgttttatggatacaggacctgtcatcttcccaaaaaatctggataacctcagcagcatattttatattgatattcatacggaccttcttgttgatttggcttctgcggggaatataccatttcttcgggcagtcggagaattttgtgttgaaaaagcgaaagtgcagggattagagattctaaaggacatgaatgaactccaggaatttcttgtaatttcgtctcttgagaatgtgaataacaaggatgaggcagctaatgctcagttagccaacaagagtcaaatatctagattgaagctgcaatgggattcttctaatgcagatagcaagtcagataaagagtatgatgtgttcaatgctttaagacctcaccctggccttaaggaactgactgttgatggatacccaggttataaatctccgtcttggctagagttcaactggctatctagattggaacacattaacatccatgattgcacatgttggaagttgcttccacctttaggtcagctaccatgtctcaaggagcttcatattgatacaatgaacgcattggagtgtatagacacatctttctatggggatgttggttttccctccctggaaacactacaattaacacaattgccagaactggcagattggtgttcagtcgattatgcttttcctgttcttcaggttgtattcatcaggaggtgcccaaagctgaaagagctgccaccagtcttccctccacctg

SEQ ID NO: 61342 - DNA, 1963 bp, Oryza sativa
tgcgtatacttgtaatcttattccacctatctatgaatttcaagtttagactcatactgcaaaagttggaatgactttggtactttggttctagatattccttattcatatctaatacattgatgcaggtacatgttcagtcagatcctgctggccgtttgatagttactggagagcctgagcaactagacaatccttggggtgttactccattcaagaaggtctgtcaagtgttaaccttttgaatttatttgatgtttcattttataattgtattctttggcattgaaaacggtacacttacttcaggttattagtttgccctcccgcattgatcctcatcaaacttcggcagttgtcactctccatggacagctatttgtccgtgcaccattcgagcagtcaaagtaaatggtgctctacaagatgaagcgcaacatgcaagtatgcccttgttccctaaagatgcgctgcaaacttacgtgttctgaagttgtcgtctgtatgaaagtaatgaaaatgaaagcatgttagtgaactggtaaaattttaagatgggcgcagaggatgttagtgaactgtaaatcttgtgtagtcgtttagatagtttcttgtggttgaatgccattgaactgttgtaatctgtttgtttcctgagtcataaatggtagaactcaacattgttgttgctggacagtagtaagtcgcaatgggtttatgatttgcattctttagtgttattttcgagttaaattaagcacatgttttgagactaggacacacctgaactaatccacttcctttcttgcagggttgcttttgtaggtgggggtttatgtgattgacttgggcctgttcatcctgatcttcgttgcaaactagttactttctgcttcattactcctgccatgttgtctattctgtattgattaattctagttaactagatggtctagttatgtatcttgtagttcgttaattgtgatatgtagcttaagttcagctctattagtttagaatgttaatagcctgatgctaaacatgttcatggtttctttcttccttttttttttctcaactaaagaaaaggtgataatttgtagcatgtagcttgtgaggttattcctaatactcagttctcatactactcagaacatgaagacaagatagattcttggatgtaactgttgccttgtgcattgctgttgtatctgtataactgaattgacaactgtgcctgaccatcccttgaaactattactgatggtgtatcaattgtttttagtgttatcttgaaacgagtcttagttctaattggctaactacgtgaagtgaaatatcacagcgttgtcaagtcagttaaaagatgagaacaatgctgttctctcttttcttggggattggccttggtgcttgcagaggattcagaacctcgttgctttactagtactacattgcttataatatatcttcaaaattattgcagaaattttgtttcattattgtgttattcatgccagtgatagcaaatgaaattaccctttcagggctcttcttgtcctatcagtctatcacaatacaagagctactatttaactacaaggtgctgaatgtactagcaaacgacaaacacaaaaccatggtacaaatatatgatgttgaaaacaatcttaagaaattctgcaattgcaacgtagaacacgaggtacacggttcgttattcacccatgatacgctgataggcactacgtactgacagagacagacaccaccagaatcacacacaaactttaaacttgttacgtggagcaactttgtttagccactatgcttacgtacggcttgattagatttagatcacgtgacaatttcgcataattacgagatggatattattttggtcatcctcatggctccccttttggttttgtgacgccgctgctgccgtggttgccaccggttg

SEQ ID NO: 61343 - DNA, 1107 bp, Oryza sativa
ttatgtcagcttaaaagcatttccactaaagatctgtaattgtctccttgcttcatccagatgttttgcacagcatcaggactaagacaaagttatcatggactaacaaaatcaatcaagtagatgtgttgctttaacatctattaattactttcagtaaagcacatttgcagagttccattttggcatttggtccaaaatatcattcacttgctgggcataaaaagacgaaccatgcttggggagatagtcgatcaatagaaacaagatcttgagcaaggtaacttagccgcatttcctcattcaaatgctgcaaaagagaaacaaagctggtgaaatttgaggcaaaaggtgggaataaagtactctcaagtacaagagcagttagtccacttacataaagaacagtggagtaaatgtccattccctccaacgtgcatggtgatagtcgatgcgctaactcaaaaaaatgatcggcttctaaataattgacgagttcaaaatatgtcttcccaacctgcaccgttgaccaaaatgaaaacaatttttaattgtgaaaaggaacaaaattacagggtactgttaatatctgtacagtgaaaaaaatattatggcgtgactttttattattaagttgagtatatagaagtggaaatgaaataccagatgtagagtggctcatgtgcaagtaaacatggttatgctgagtgactggaaattccaacaatcagcattcagggccaatgttcaactacagttcaagttatcattttactaatgtcaattctccagattgacccaactaacatatatacaattaccataatgaattcatcacattatcacgtatcagattaatttaaataaactcgtagtttcttttagaaaacgaaggaaacaaatatgctatacattacgatacagaccctgaatcattactatacagtccctatgcctcatgccctcatgaataacgtagatacactcatacaaaaccagttttccaaaagttagccctaggagcagagtaaccaccccaattaggcattagattgtcaattaggcggcaaactatccatgaaggttctggtgtagctattttagtgt

SEQ ID NO: 61344 - DNA, 959 bp, Oryza sativa
  unsure (1)..(959): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacggaaatctagaaggttgtagtttggatcttaaggctaatgccctgtttagatgagattaactaattttagtctagtccctcccatccaatgatccaaacagcccctaaacttgaaccaaattcaaatctcacacagcctgccccacatcacacatcacagtggcgcaattcaaaacaaccaaccccgggtcccacatgtcacagacgcaccagacaaatcccccgtgtccgcgtagccgcggttcccccgcgccgctctaatcgccagcaccaccgcaccagccagtcagcccaccatttcaaacgccacactcactcacaccaacgcgcacaggcgcaagcccaaactccgatccgttcgtccgaatccccaatccaaaaaaatcaaaaatcccaacacaacaccaaaaaaaaaaaaatccccctcgaatctaacccaacccctcccctctcctcctcctcgattcaaacggtgcccaccctcgccgccggccgccgcgcgccgccgcagtagcccgacacgcatcgccgccgccgccgccgctggagcgttggcggcgatggaaaccctaatggtggaccgcgtccacggcagcctccgcctcttcatgcaccgcaacgccgtcttcctctgcgagcgcctctgcgcccagttccccgccgaggtatgcatgtgtttccctggagtaagcgcggttcagtcgggtgcttggtcggggggtgggggcggcgatttggggtgcgggcgctcgcctgcgccgggggggtcgatttattggcattgtttaggttttagtgtttaggcgtgcg

SEQ ID NO: 61345 - DNA, 784 bp, Oryza sativa
ctcagtaacttggtgcatgttgatatagagaagtcatatgctctcatgctaacaggcatgcatcaacttccatgtgttgaaggttcaggagaatttcatgttggcaagaaggggcaaagtattgttgggctgaaggatctgaatgaacttcgtggagagcttgcaattagattgctggagaatgtgaaaacaaaagaggaagctgctaaggccaatcttgagctaaagaagcacataagaaagctggagctagaatggggatcgggtgaccatgatggtcacactagcaatggttgtgatgtgcttaatgtgctaaagccgcaccctaatcttgtcgagctaactataagtggatatccaggtgctacttctcccacctggttgaattctggttggctgagcagtttgcaattgatttgcttacgtgattgtaaaaaatgggaggtacttccacctttaggggatctaccattgcttaaagctcttgaagttcggagaatggatgaattaaaaatactagatcaggagttcttgggccgtaaaggattcccctcattggagagactgctgctggaacgcttgcccaaactagaatggagtattgtagagaacgaccagttgtttcctgctctcagagatctctcattttctggatgcccaaggttaagagaatacccgacctatgtgcgtaccctcagacatattgctatacttgataaggaacaaatccacttcaaggtttttatggacaactttgaactcacaagatcattttgctgcctgt

SEQ ID NO: 61346 - DNA, 1465 bp, Oryza sativa
acatgccatccctccaaattttacttttacgaagttgcccccaagtgacacgactatatcaatctggttgccacacagctttggaggaattgagaattgaatcctgtgatgggctagcatcactagaagatttgaatgaacttgtttcccttagaaagatgaaggttatagaatgctctgctctcatatcgctgcctgatatgagcaccttttattcactaaagattcttgtaattggtcgatgcactcaacttagggcactgccgaggaatggtctccctgtatcacttaaagctttcttcttgatagaaggccatccattattaggcaagcagtttgagctgaaaaatggtcctgactacaacaaggttgctgccctttctggatgcatgcgtcatacaaatcagagtaatattactttttattcactgttctgaatttagtattggaatttggaaattgaatatgtcatttatttattctggaatgtcaaatttctcgttgatacatagtacatagatctaattctagtgccatgacccgttccttgtagggaaagtttgggagtactggtcgaaattctgaactggcaaccaagcgaaactgttgtggacaagttctgatctggcaaccaagctaaactactgtgagtataatagttccgagttcgtaagaagtgatactccgtattacacataccgacacacctacacgcaccaattacatgaccattttgaaacgcaagttagcgcttacattttatatatttttgtatgcagatcgcttcttagcgtttacattgactgtttatggggatcggagaatttgaagatcaccagagtggtcagcacttgttaagttgcatgttttcatgaggattatgatgggttgcactggcttgaggagcgatctagttacccagataaatttgggtgtcagggtggcaaatggcatgcgtcccctgcgttgtgctgctgttcctgtgcaaattccaattgcatgctgcaatttgggttttccatgtgccaatgttactgaaatggtgcaccgttcggtttctgattatgcaaatgtgctcatgattcaatcggcaaaatccaatgcccacgttgttctcttcgctctatattgttcctgtttaaaatgtagaaaagctcagttgttgctaaagtggaattactggatttcaattcaatggctataatgattattctaggggtatgcaactaacaaatgttgatatttagaaataatgggtagaaatccgaactctatatccacaaatggatactccctccgtactcgtaaaggaagttgtttaggacaatgtttaagtcaaaccttgggaatataaatcatgaataactcttaagttgttgagtttgaaaatataaaaattatgtgaatatatttgtcttgaaaaaagtatacatatattactttcaataaatatttttatagaaac

SEQ ID NO: 61347 - DNA, 6676 bp, Oryza sativa
gcgccgccgcgaaatcgtgcttaggtactccagtggcgcaggattcagtccttataatatcctctatttttttttaaatttttcggaggaaatacagatacttcgggttttcgggatagtacttcatacatgaagcaacgaagtttttgagaacttagtttatctggggcagcatgggccatggagagatactccagttgatgcttatttggatttcggagagggatctgctctaattaggaatggaactcctaccagtttggaggcaaataattttggatgcgtgtatgacaaattatcaacccccccccaccccccccacccaaagaacttaagtttcttctctgtttggatatttgtcttttagcctctttaaccgggaaaaaaacgagatagttacatcatttgtactcctacccttattttgcctaggggcctaatgatctgataaaacaaagcagcagaatcagagcataatgggaaatttatgtacttatagttctagtatctctggcagtaatcttacatgcatttgagtaatgcgaaggttatttctgaattgtgctatcaactatatgaaccagcaccaatatgttccacttctacatgttcacgttatgtttttctctttggataattgatctgaccaatacatgataggtagatcagttgaaagctacacggagaaactgaagagccttaaacactatattgagcaacatggccactataccactagccactggagttggatgggtggtttctcctgtcatcaagcttatgtttgagaaggtccaatcatatatatcaacccagtacagatggcagtccaacttggatgatggccttaaaaagctcgagactattttaactgaaactttattggtggtgggcactgcagaaaggcggagaacacttgatttcaatcagcaagctttgctccaccagctgaaagatgctgtctatgatgctgaggacatcttggatgaatttgactacatgcttctgaaagaaaatgctgaaaagcgaaatcttagaagcttaggctccagttctatttccattgctaagcgtttggttggccatgataagtttagatccaagttaagaaagatgcttaaaagcttgagtagggtaaaagaatgtgctgacatgcttgtcagagtgattggaccagaaaactgtagttcacacatgttgcctgagccgctccaatggcgtattaccagctcattttcaattgatgagtttgtggtcggtcgtcagaaggagcgagatgaactagtgaaccaattgttagaacaggtaggcatacctaagtcaagaagcgaaggagcaataccaacatcatcagaggtaataaccatagtcggtactggtggaattggaaaaactactttagctcaacttatttacaatgataaacgaatagaggataattatgatttgagggcatggatatgtgtctcacatgtctttgataaggtcagaatcaccaaagaaattctaacatctattgataagaccattgacctaacaaatttcaattttagcatgctccaagaagaactcaagaacaaagtaaaaatgaagaagtttttacttgtgttggatgacgtttggtatgatgaaaaggttggagggtctataaatgctgatagatggagagaattatttgctcctttatggcatggggtgaaaggagtcaagattttagttacaactcgaatggatattgttgcaaatacattaggctgtaccactccgttccctttgagtggtctagagagtgaagatagctgggaacttttcagaagatgtgcatttaacactagagatccaaaagaacatctggaattaaagtctataggtgaacacattgtgcaaaggttgaatggctcagcattagctataaaagcagttggtggtcatcttagttcaaacttcaacaatcaagaatggaatcgagttctaaataagggtctatcaaatgagaaagatatcatgacaattttacgcctaagctatgaatgcttgccagagcaccttcaacaatgtttttctttctgtggtttgttcccaaaaggttattatttcgagcctgatgtattggtgaacatgtggatagctcatgaatttattcaggatggtaggcacacctatggaagtcttaaaagcactggaagaagttattttgatgagttgttatctagatcatttttccaggcgcttcagtatggaggtacagtacattacgttatgcatgacctcatgaacgatcttgctgtccacacatccaatggtgagtgctacagattagatgttgatgaacctgaagagatcccgccagcagttcgacatctgtccatactggctgaaagagttgacctactttgcgtctgtaagttgcaaaggctccgcacactaataatctggaataaagtcaggtgtttttgcccacgagtttgtgtggatgcagatcttttcaaggagttgaagggcttgagactattggatttgactggttgctgcttaagacattcacctgacttaaatcacatgatacaccttcgatgcttaactctcccaaatactaaccatccactatctgattcactctgtagtcttcatcatttacgaatgttatctgtacacccacattcatgctttatggatacaagacctattatcttcccaaaaaatctggataacctcagctgtatttttcatattgatgttcataaggacctttttgttgatttagcttctgtggggaatatgccatatctttgggcagctggaaaattctgtgttggaaacacaaaaatgcagggactagaggtgctaaaggacatgaatgaactccaggggttccttacaattacatctctcgagaatgtgaaaaacaaggatgaagcaactaatgctcagctagtcaacaagagtcaaatatctaggttgaagctgcaatggggctcttgtaatgcagatagcaagtcagatgaacagaatgtgcttaattctttaatacctcaccctggccttgaggaattgactgttgatggatacccaggttgttcatctccgtcttggctggagtccgagtggctatctagattgcgacacatcagcattcacaactgcacatgttggaagttccttcctcctttaggccagataccatctctcaagaaacttcatattgatagaatggatgcattagaatgtatagacacatctttctatgggattgctggttttccctccctggaaacactagaattgacacagttgccagaactagtatattggtcttctgtcgattatgcttttcctgttcttcgtgatgtattcatcagttgcccaaagctgaaagaacttccactagtctttcctccacctgtagaaatgaaagtgctttcatccaacattgtttgcacacagcatactgatcatcgcttggacacatgcattattcaaaaggttagtttaactagccttgtgggtattttccatctttggcacttggattctgaggaaatcgcagacaccagctttgacagagcaaacatgttgaacaatgggcttagagattcaagccccaatcttccatcccttgaaggaccatttattggctggtgttctgattttcaccatgcatttgtgaggttaaatgaaatggaaattgtagattgccccaatgtaacatcattggtggactttgggtgttttcctgccctccagaatttgatcataagggattgccccaaattgaaggaactacctgataatggcaacctgacaacattaacaaaggtgcttatagagtcctgctacggactagtatcactgaggagcctgagaaacctttctttcctctccaaactggagataaaacattgcctgaagttagtggctttgccagaaatggttaacttcttctccctcagagtcatgatcatacaagattgccctgaacttgtttgtttaccagaagacggtcttcctatgacccttaactttttgtatttgagcggatgccatccattgctagaggagcagtttgaatggcaacatggtgttgagtgggagaagtatgccgtgctgccgtcatgcttctatgctggtaaatcgatggaagatactgaaggtaacccatcacgacttgaattttgatgaggataagtttagaaattgatttgttgcaataatattaccgcaacatactaactcatgtccttttgcagatatagctgacgaaatacttcttgaaaatgatatgattgagtggtcaacccagaccagtctactgcatccaactgattctgcagcaagctcttccagttttcttcagtgaattatctgcattgatcaagacttcggcatggccattgggcacaccgcgcaccgacgctgttggccagctggccacggctggccattcatgcctgtgcagctcagccaccctggcatgaaattcatttgcatattccattttaatcgggccaacttatcatgaggtctgtgcattttcgcatctaaacctactcttagagcactacagaacattcaccggtcattgcttacagtttgtacccttgccgtaggatgcaatgtagccatgtgctcctttgaacatcaggagcatggttcttgtggagtttttttttttctgaaacaatcgggtatgtattttttctagaaatcagatcgataatcgggtaaatacccataaacaggacatggcctttttaaccatactgtctgtacgtgtacaatattagtgtatgctactagattgctagagtgatggctagttctcgactgcctactgtttgtcatttacagaagatacgttaggctcattagatgtaattttgtagactgtacattctttgggatgttattagctttgtatctggggttctacaaatacaatggacaggttgatcccatgattcctgtgtaaggtcgtgctatgtgctcagtttctgtgtttagcatcttcttctcaatgtctttgcttaatttttttattctctgcgcaatttcagggacaaaaagaaggaaattttgtgctcgtgaaaacatgggccaattcagcaattctgtttgctgaatgtttccatattgggagagttcagctagagttgacgacgagaagatacccttgaacggaaaattggaagctgcttcccagttgaattctcttgtatgtattctgatttctgagttgaagtctatgctactagttaaaaagatctgaaatagtataatgcgtactctctccgttatatattaattataagtcattttgatgaagcttataaaaaaatttagcaacaatgtttcattaaaactaacattttatatattatttaatatgttttggtagtaagtttgttttgtgttgaaaatattattatatttttctgtaaacttgattaaatttaaaaagtttgactaggaaaaaaaacaaaactacttataatatgataaataatgaaaaggaggtagtaatatgttgcagtgctctcatgttttggggagtgatctgctcacccttgcttttgattcccagctgatggctgatttttttaaatataattctttcatgtataagaaattgagaacattttgtattttgtgcaggctcaggcagtgcaggtattggcataattattcgtgataacttcggctcagtcttgttatcatcctggaagtacattcgacatggagcatcagcagaagaattgaaactattggcttgtcgtggaggtttagctctggccactgaatgggttcatatgccagtagtgctagaaacagattgtttatccgtagttatgcactaaattctcataaagagaatcgatctaaatgatgtcatattatcattgatgtgcaatgtacaaaggagttgctttcagaggtgaagatttgtcatgttgtaagatgaggtaagatgaggcaacagggtagctcatgagttagcaccactggctagcaaaacgaagtattgtgcagtttggcgggaacatgttcctacttgcgtacaaggctttgttctcaacgattgtaataactttgttacctatcaatgaagctctctcttccttgaaaaaaaaaagaaaataaaaagaaactgagaacattattttcatgttcggatatagtatgaaattgtatccgagatatattaatatcgttatgatttgatacgatttggtcttcccttatctatagagagttgattttagaccggacaatttaggaatcaatttggaacaagtgaattttattttacagaaaaaaatgtagagattttatgaccatatcctttgaaattaactactccaaaagatgctttgtcaatgaaatggaaatatctgatgatttacgtcagcgaaattgttgtgagagagagagagagagagagagagaacagttggtttgggctctacttgggccgtgactgggctaggcacacttccacggcgaagcagttcgtctggccggcggggaagccagaaggaaaaagtacaccgaaggtccctgaacttgtcatcgagttacaaaaacgtcctgcaaataagatatccgacgtctcttaactaatcaaaatcagtcacaataaattcggttttgatcccggtttgaccctacgtggcggctg

SEQ ID NO: 61348 - DNA, 2328 bp, Oryza sativa
tttggacggccggcggtggggacgaggtcgccggggcatggaggtccgacgtccggccggcaatgaggcggcggcgacccagaagggaagggcggcggcggcgggagcacgaaggagaaacaccagcgtcttgtgccgcgtccacaacggcgtgccagcgctggcggccggcaagaaacaccagcgtcttgtgccgcgtccaccgcggcagccgcgaccgcggcgtgccagcgccggcggccaacgaggtcgcgttggcggcgccggacattgctgctgctgcctcccggaactcgatcgagacacatcaagggatccaccagctgggatttatctacggccatcgcagccattaaatcgggaatcaaagcttgcaattttggcatccagcagaaacaggcaagaaattaatctcgtgctacaaatgccatctcatcatactcatctcttcttatctcatccaactaagaggccatagaaaatcagtgtcattctactggcaaatcacaattaggcaaaaaaaaaagcaagaagttaatctgtacagctaccgcagctcgcataagggcaccggcgaggagctcgccggagcgccactgccgccgctttgcctcagggcccttatcaagggcttggtcgccgaccacgacgaggctgcgtcggccgtgcacgcacacgcggccaagctcggcctcgaccaccgcctcgccgtccgcgatgggctcgtcgagctctacctcgcgcgcgtcgagctcgcctccgcgtgggcgctcttcgacggattccccgccggctggccgggacgtcgtttcttgtacggtcatggcggatgatagcggcgtgtgcatcgacaccgtcgccgccgctgcggcgttctcggcgtgcgcgcaaatcgggggccttgcgctgggtcgggagctttgggggatgcccgtgaagaagaacgtcctcgtcccggccgccgccgccaagtcccggccggccgtcggacctcctcgccccggcaacgacctccccaccgccggccggcctgcccaatccagagagaagagtgggagagagagaagggaggaaaggagaggaagggagaggctggtcgctgacgtggcatcctgacgtatggggcccacgtgggtcctacgctgactcagccgccacgtcagacaaaccggggtcaaaaccgctgagggatcttcggtggatgcgttatatcctgttttgcggtaaggggacgattttgtaactcgaggacaagttgagggaccttcggtgtactttttccaagccagaatgggggaggcggcggcgctggatgctcgctgtcgctggtgacactcgccggccgggagtcccggaagcgcgcgggaagtagaatcggggcgctccagttcaccccacctggcacctggccggcggtgaagcgagcggccttatccgctgcatacggcggcatgttatcctccccggcgacggcgatggcctgtttgtcgtcgtccctccgccgtagtctagttcaacaaggtaagttttagtacttcgttccaattactcgagggcttcacaatggcaaattttccttttttttctaatattagtgaaaaaaatttgctgatctcactggcttccgctcttctgttttatacgggctagcttggtctgaccttaccaaaattctactccctccgtccgtccgaccttaccaaaattctactccctccatcccataatataccatcccataatataagggattttaactttttcttacactgtttgatcatttgttttattcaaacaattattatttattttatctgtgacttactttattatccaaagtactttaaggataacttttgttttttgtacaaattttttaaataagacgagttgtcaaacagtgtaaaaaaaagttaaaattcttttaagtagtttgtggccaactaaacacaccataaacaacaaaaaaaacaataccatttcataaattcttttagtattacccatatatttatatatcttgtaggagtacatcaaatttgtttttttttatcaaatcacacatgtcaacttgaccctgtcaaattttggtaggcaatatcataccacaaaccagcactatatgtctccggttcttcaagatttggaagagtcgaaagccagaaccttccgtgttctgttcgtcccctttgatccagctctgtttccggtttctcctccgggctctggtctcacgacaaaggcagcttgataaacaagaagatattttgggagcgtcttcttcttggaggagattggagtactgatcctaccaataaggtaggtgtt

SEQ ID NO: 61349 - DNA, 3259 bp, Oryza sativa
ctttagcttttaggtgctgaaatgtgtacagtagcctgtcggcaagctaggcgcgacagtttcgatagcatgattgttgtgtgatgatcatcaccagtatgactagaaaacttcttcactgcactagcgtgtgctttactgctactctcttcgtagtttttcgtcactgtgcctgtggtgagtgtgaaacccagtgccatttgcatgttcacccaatgattcattcactccaggcctcgcgaattgattcaagaatactatgccacatgacatgtcctaccacaaagcagtgttttccctgttatttattgtgtactctacatgcacttttttatgtagtttatgcacctctattatgtcaccaaccaaaaaaatggtactccgtactcaattgttttttcttcagatgatgctactccaacactggaccactgatagcacataactgctctgattagccaaacattttttttgtcaatccttcattaactgattaactctataataatttcgtttgccatgctgagcagatcaaacaacaacatccaaaccaaaaccaaaccaaaacagttgtttttcacctgtataatataattataaccataataattacaatcattccaagaatgacacccacatcgtcgacacctactcgacgaactgcttgccttcgaaggtctgcgcgaacatccagtccggcggcgcgacgctgtaggcgacgaccgtgcggcccctcccgccggtgacctcgaacgacagcggctggccgcggaggtcggcgtctcactgtcagttctgggcccccttccttctcctttggagtcacccggggttttaaactttttactttaccggcggcaactttccgttcgccgccacgttttttaataaccaccttcaggaaactggggccgccggggatagtgaaactcatcccccctggcctgtcacagttcaccctgcaccaccaccactcattttgttcattcattagatggaacccgatatgagcaatgtgccgatgtgttctggggcggagctagagtattaaggtggcatgcccaggaacctggtcaaaaaaaaattatagctatacctaacctattttcaccgtgtgcaccattctcaatacaaatttagacatccgcattagcttaaacttaatataagacagagtaaattaaacaagtagcacccccctcaatctcactctagctccgccgcccatggatgtgtttgatgctttgattcacgcagagctgatcagtagttgcagctaaatttttggttctcttattggagttgtagtactatctagagttcatccatcaatggctaatgtcatgaaaacccaaattgcggtagtttgttataaaacttcatactgtttaatacgagtcgttaaaaaaagtgatgctttgactcatgcggaattcagcagattggcagtaagatttaaccttatcttgttagagttgtagtactactacagttctagaaaaatggaatacttggagtgtactcctgcatcagcagttggggcaatgggacacactcatggcaattgtctgaaactgtggaggtgctcataattaacaaagcacaagtcagatttaaaaagggggaagctagcagcagtgattaaagatttaaagctgctctttgctccatgcaaagcagcaggaaacacgcactgtccgcatattctgtgttccatctccaatgatcaaacatcattctgaactttcgcaaaagcagcactggttcagcctagagaaacacactccaaatgcactactcaagaatgatagcgccatgccctttttgcatggtcagaattcacacatcagctagttgcagaatgatacgctacaagtgatcaatgaccagcgagcaaatcatgaacatgatgtgtgcagtactaagagcaagtttaatagtagctcactactaactccaaattatttatagccaatgtaatagctaattcatacaatagttgcttactatactattaatacttggtcccatctgtcatacacatattacgtcttgaagtccgtgttgcagctagctacagatctatagcccactgctcttctctctcttcctttatctctttaaaatatgtttatagctggcttatagcctgctattgtacctgctctaagagcaagtttaatagtatagcccactactagctccaattcatctatagtcaatctaatagcagttgcttactatactattaatatatggtcccacatgtcatacacacactgcgtcttggagtccgtgttgcagctggctacagatctatagcccgctgctcttctctctcatcttttatctcattaaaatatatttatagctggctaatagtctgctattgtacctgctctaatactccctctgatagatgaagttccagaatacgggcaatcaaacttaaaactgcttggactactcaatcgtactaagatagtactctctccgtcctaaaatacagtaatctagtagtattagattagacacaacctagtactacaaatctgaacacaactaattgagtccaatctagtacttttttttgccgcgccggcttttccgaccaaacattgtaccaagaaggagaacattcagaacagtacagggaaaaaaaacaagagtcaaaactctcacaccaataggatcgataaacaacccatactagcagagccgaagctaacacacactagatctaatctagtattagcttgctatattttgagacgaagcaagtagtgaatttgtcctaaaaatgtatatctccatgtcgctctactcgtttcacttcactaacatataactataagtaacaaaaacatgtattggagactatggtgatgtaaaagaaaagtgtgggagaagcttattgttttacctccggaactgcaccggcacaatgtcggccttggccttggcgacgcggaggaacgcggcctccgacatctcgaagtgctccttggggaagttgcaccagccgccgtagtcgtcggagagtccgaggttgggcgcgcagaagtcggtggccgtcaccaccaccgtcgggctgccgcggaggcaccacagcacgtggttcacgcaccgcacctcgtagcagccgccgcagcgctgccgcgcccgaacagcgcgccgctcacgccggcggtgtacctcccgtacctgaagatgtccaggtcgccgtacccacaggctccaccaccttgcatttgcaggt

SEQ ID NO: 61350 - DNA, 3421 bp, Oryza sativa
ggtactactaggacagcattagtccaataatttaaggcccacttagtccaataatgtagtattatcgtttgtttttttcgtccgactaggaaagcattagtgcactaatgcacataaaaggttttatctaatgatattagacaaaatatttgattggaatgatagctttattagcattggcaccaacattcttttataaccctgaaagaaacctttttactaaccttttttacaaattaaaacaaaatggacctgccaacaacaggacacacattggaagttcagttcgaagagtcacaatctatctgaagaaagagaaagggaagaacaagtttcagcagtgaatcttcactcctgtttcctacttctaacttgaacttcacttcccactatgccggatctgcacaatactacaccatctgcccaccattcatccttgcaaactacattcaccatctccatgatgaatccatccaaagaaaaatgcagaaaaagggcatatgttcttgatcctaccaactgacaaagattcagaagcttaatctgttaaaaaacacacacacagattgcacataccatcattcagcgggtgccccagggactccttgatgtaggtcgccgagcccatcctccactcctcatacccgccattgccaagccttatgcagccactcaagctcactccagaaagcagcagcagaagcaagaacagcagcactgagctcatcacacacacacacgccctggctctactctctgatgatcaatgcctctcttggagggaagaaaaatgtctgtgatggattggaggagagttcttggtgctgttctttttggtattcttgtgttcttggtctgaactcactgtgaactgtgaagtctgaaatgttgcagtgttttggcctgtggtgggagactggaatcgtgggtagtcaaagatgagaggagcacaggcacaacacagggggagagtggtggaaggggtccttcctttctgctctcgctttattgggatttgcagcagctgcagacgcggcggcttcccttttaaggacgagtagcgaagcaattagcaaaggttgccttcttttgctattgcaccctcggcaacttgtgattttgcaaaagcagtagcacctctcgctgatccgtgtttctgcaagctccaagatccccagcttgcagtcagagcgattgtgagacttgagagttctgcttatcttgtcacctcaccaaaacgaaggttggtttttaccctgtcttttgacattatcgatattttgatagtaatatttacttgttgctgtaggaaaccaaacatagccaaaatactattcaaaatgccggcattttggtaacggaagttttagcttcaaacctagacggcaaaaatcactactcagaacttgagagtgatttttggttggaagaaaaaagaactgtggtgagtgagagtgactcgagtgtgtgaccggatgaccggagagagcaactgttttttaccatcgagatgacacggtatagagaatatactctataatattgagtttatcatagtttaatgatttataattggcattaatactccctccgtactcgtaaatgaagtcattttagacagcagcacggtctccaaaacacaactttgagttcttgtttccataaaaatatttattgaaaagttatatatatatatatatatatatatatatatatatatatatatatatatatatatatatatatatatatatatattcttttatgaaagtatttttcaagacaaatctattcatataattttacattttcaaactcaacaacttgagagttattcatcacttatattctcaagatttaacttaaacattgtactcaacgactttctttactaatatgaagggagtatatcattaggttggccttacatgtaagattaactattgatttatcctattaaaagtttttaaaaaaaattatgaatttttttagcctctatacacaatgtgaaagtttgtgtataagtttaaagatttttgtatttcattttttataaaatattataatttatccatttatgctatataaaatattttgtctttgtttttaatataaatcatatttcatatcctacccaacataattttatgctattatattttacgtaagcaatttctctatcagttatcacataaaattatttcttttaaaaaaataaaaatgccccaataacttgaaaatctatatgcaaactttcatattgtgtaaggatgctatatagacaattttatatcttatttaaatattgatgaaaaacacgaggcctgagagatctgcttaattccagtgcaggtccaaaaatcgtcttcgggtatgctagcgtaccagttgatttgatcctgtaatcaacaagaaataaagacaactataaattaaacctataaattaatgctaacttcgatgtctttaagggtattctgcgtatttttcataaaaatgatctagccgaatggcatattggagaagaattaataaactcatcggcatattgcagaaataaacaacatcaatagtatattgtcgaactggaacaaactctgtgacatataatacattctattggatgtaaaataaatttatctaaaatactttctttgtccaaacaacgaattttttttgagcttaaagagggaaactttattaatcacggagaaaaggattacattcctggtctattaggtctatgattcctgcaggagcacacaacaacgaatttggataggtttttattcatatttgttatatttggatatattacattcaattctaaatttaatttttatgggatagaggaaggagtatagcacatcaacagtttcgattgatctacattcgtgctaggccttttcaggcctacgggctacggactcggggttgggggcagcatgagcatgagcatgagccagtaacagtgattgtgaactgagcagcgcagttacacttacaccaggattagctgcgatcttgatccgagctttagggaatgtttagttcccaaacgaaatttttctcgctgtcacgtagctgcaatttttcacgcggtttggacacatgtatggagtattaaatatagaaaaaaaccaattacacagttcgccaggaaattacgagacgaattttttaagtctaatcgtgtcatgatttgacaatgtggtgctacagtaaatatttgctaataacggattaattaggcttaataaattcgtctcgcacctagcggaatctgtaatttgctttgttattagactacgtttaatactttaaatgtgtgtgagtgtgttcatatatctgatatatgcgggggcaattttttttttggactattaaacaggcccttagctcgtagtactagtagctctag

SEQ ID NO: 61351 - DNA, 6237 bp, Oryza sativa
  unsure (1)..(6237): unsure at all n locations
taggatatggttaaatcaggcaacaaataaagaaacagttgaacacatcaaccgagcacaaacttgtggaaacatttgattgcattgatcttctggttcaacttctgaatattttggtgattggcatacagagattatttttacagtctagtctaccaccttaatttccttattcttaagtatggagaatacaggctggttatccaccagtaaggtttgtttggattcctcggtgtcagtagatctcagcattgccatattccacgttgctacacgctccatgcgaccatgccctgttcctgcctcctgctctactgttgtatccatccttctcggaagaacaaccattttttttttcgaaaataggaagaacagcctttgttcccatgaggccatgacagccatgccgacatctctacgaagttgctagcacatccgtttcataacaactgatactaaacggtgaatgcttcactatagccaatgtaatagctaattcatacaatagtatagcccactactagctctatatcttctatagctaatgtaatagccaattcatacaatagttacttactgtactagtaatacctggtcctacatgtcatacacacattatgtcttgaagtccgtgcgtccgatttcgattattatttgcatttattaatttgaggaattagctctagattaaattgaacaatttcttcggacgatttattttacaaattttaaagctggaaaggggaacttcagggcgtgacacccgctgctcttctctctcttcctttatctctttaaaatatgtttatagctggcttatagcctgctattgtacctgctcttaaactttaaccactcatctttcttcttaaataattatgaacgctagaaatgatgttatggtattaaaatgggttatttcctaaatatacacataaaaaaaagtccatttcgatccaacaatatataggtaattaattgatggttaaagtttaaatgagaaagtcgaaattatcagttgctaaaacttggaagggggagtatgttttggacgtctaaaacttgctggcggtcatgaatgaattcagcccactattttctcgtcaatgaattcggtccactgactgattccaatgaattcggcttggttagttcatgtcagcaatttgggcccagaagtgaattcagcccacaaacatcccatcaacaaagtcagcccaataaaggctaaaatgaattcggcccacttaaattcccataacaaattcagcctacaaaagaaattggcccagctactgcgtatgaacgaattaggcccatgaatattattggcccaactttaattccaatctacgaactgggccaagaataaatatggcccacctaattgcagtcgacaatttggcccaccaatgaatttggtccactgaattctcgtcagcaaatgcagcccacgagggaatttggaccacaaaattcccgtcaccaaattcagcccactggaaaatttggtccacctgtctcgtcaacagatttcatcgcccgcggccaccggcggccggcgaacgcctccgtcgcggccggcgcaggctggggaattccaccggcgggttcgcccatggcctcccctcgcgaaccgagatccgggagcgctgcaccgccgaaagggaagaaggcggcggcggcgatggcggcgcctcccaattcaccgattgggtggtggcgcgaggtgagagcgcgcttgtggctgcacacggtgnaagtatgtcccccagaccaatggcttgtttggcgccgctcggctccgccgtgccgccgccaccgccctcgttttgcagagccggctggcccgccctggtaacgctttttcttaatcttagggtanagtctccgtagagtttttaaatgtcgcacatcggtgaagtcaatcatgtgttgtcctaagggaatgattagtggattagtggattattgagagggaatgaactaataggagttgagcgggtttgatgttattattaacatttttttttcttgtcagtggatggatgtaggaatttaacagggatggaaaatataagggattgatacaccatcatttcaataccattttttttcttgtctgttgatggatgtaggaattcaacagggatggaaatataagggatcaacaccatcatttcaatacaggagagaaatcctttttttttaaagcagagagatgagtagatcttagctccttatgatactacatccaagctaatttttttataaccaaccagatattttatattgtagttgcttggtaaaacgcaatcagcattacacacagagctaggattggtaatagaagatagactttaatcccacaccaacactttcatctaaactcctccccttcctcaagactctaagtggcaaaacagtctgtatattattttcttggcatctcatacggaacaatttgttagtaaaactttctccacagaccgactgccactgcctgctttgatgcatcggaagccaaaccgctggaatttcacggtgattccacctattctgctaggtggagtgtacctacctccgctctccagctgttataagatttggttggtcgtctctttggtcaacccggctaataaagccctccagctgttgtttgtgtgagaacgtgggatgcatacaagatacggagtaattctttactcaaagttgaaaaaacctctccttttttctttgtttgaagaggtggaagtcaactttcttgcacatccatttgtggtttactcccatttccctctgtttgaatctggctctcctcctagtttctctctgaaagcagccttgcatttgatcagcaagaagaaagatcaagggcctcttcttctaggagtgagctgcagttctgatcttactactagtcaggtaaacaatatttcaataatcactagctggcagttgtcctattctgttttctgactgcatcattgaagaatgaagacaatatttactcttactcgtgtatccaatttttgccgttaaagttgcaaatttgtgtttgaggcccatatttcggtcttcttatacatggcctgatagagtttaagagtagagtagcccatattgactgcatctttgagcaataatttcttattttggttagttctaattattttcaatgtttattaggtgaatggattattgagtttcaagctgtatggtcatttgaagaaaacagtatattttgaaaaaaagggaaataggtttgtacattgaccaacatggctacactaccaatagccaccggcattgggtgggtagtttgtcctatcatcaagcttatctttgagaaggtccaatcttatacatcaacccagtacaagtggcaatctgacttggaggatgatctaaaaaagatcgaatccactttgataaaaatccaattggtgctgggtgctgctgaaaggtcgcaaatgctagattgcaaccaagaagctctactttgccaaaatgaaagattctgcctatgatgccgacgacgtcatggatgaatttgattacctgattctgaaggcaaatgctcagcagaagagcaagctaagtagcttggcctccagttctcttgccataggaaagcgtttggttggccaagacaagttcagatccaagttaaggagggtcctcaatagcctgattagagtaaaagaatgtgctgacatgctcatcaaagtgattggggctgaaaactctaattcatatatgcctcctcagccacttcaatggcgtgtcaccagctcaatttctcctggccaaattatcattggccgacaaaatgagcaggatgatctagtgcaccgacttctgagagaagctgatggaccagagccaagcagaggactaacaatatcaccaacaccatctataattaccatagttggcagtggtggcattgggaaaactgcattagctcagcttatttacaatgacagaagaatagtcagtggttttgatctgaggacatggatatatgtttcaaatatcttcaataaggtcaaaatcaccaaagagattttgaaatcaattgatagaaacagtgatataacaaatttcagttttaacatgctccaggaagatcttaagaacaagttaacagcaaagaagtttctacttgtgctagatgatgtgtggtatgatgaaaagattggtgagcttacaaatgctgatagatggagagaattgtttgctcctctatgctatggagctaaaggaagcaaaattcttgttactgctcgaacaaatattgtttcaaggattttgggttgcccagcaccattccatttggagggtctgaagggtgaagatagttggaacctcttcaggatctgcgcatttggcgctgaagatccaggaaattatccagaactagagtctatcggtgaatgtattgtccaaaagttgaatggctcagcattagtcataaaggttgttggtgcacatttgaatgctaacctcaacgttgaagagtggacacgagttatgaaaagtagttcatcaaacaaggaagacattatgcaaattttgcgtctgagctatgaatgcttgccaggtcacctccagcaatgttttactttttgcagcctgttccccaaaggctattctcttgagcctgacttgttggtgaatatgtggatagcccataaatttgttcatggtcatataggcacatatgaaagtatgagagaaactggtagaagttatttcaatgaactattatctagatcattttttcaggaacttcagtatggccatacaatacgttatgttatgcatgacctcatgaatgaccttgcttctcacatttccagaggtgagtactccagaatagaaagagatggtaatcttgcagaaatttcaggaacaactcggcatctgtctatacctgtcgaaagagtaaatgaactccatggattccataacttgcaaaggctgcgcacgctaatagtttctgaacgaaggcaggtctctttgctcaaaactttgtctgcaggcggatgtttttaaggaattcaagtgcataagagtattggatttaagtggctgttgcttagaatttctgcctacatatattgatcatttgatacatctcagatttctttatctccaacatgttggataagtctttgtgatccttggttgtgattcttctttttgcttttggatagtttcacctttttcaggacagcatctaccctttagcatatttttcaggtgctaggacagctgcggttagtaggacagcaacagttagcatcttctttatgcctcctttatgctttattcagtttggatgccctctaggacagcatcccattcaaatttcgaattttagactaggagggtgtagcaataggctagcagccagctctggctatatatatgtatccaacctccctcgggtaggtatggcttttgtgtttttgtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcactggttgctcctccttcccctttcccttccccctctccacgcagcagccccccggaggtgcgccatgtccgacgctcggtctcggcgtttggtcgcctcgagcacttggcgtcagcaggacgccgagctcgccgcagcagaagagcgcaggcgagcaacggctcagaccgctgcagcagcagcagcgagggtggccaaactggcggcagtggagttggcagcagccagggcggaggcggaggcggaggcggcggaagatgcggcacgtgcggcggaggtagaggttgagaccttgcgcagcagcatcaacggctccatcgccggcgacatcaccgccgacagggagcttgaggagttggcaagaggaagggcatgggagcgggcagagcggtgggcagcagcccacctccacggcggcggcggcggcccaagggaccgcgcgcccgccgacgggaacccagacgggcgctggcgtgccggcggcagcccggagcccgcacgcggccctcgcaggcagcgcggctctctctcccctgactggcgccatggtcaccacggcgtccagacggtggtcagggactttgg

SEQ ID NO: 61352 - DNA, 2249 bp, Oryza sativa
cctcgacaccggcgccacccatcacatgaccggctgacgggagttcttcaccgagttcgactccagcgtccaaggctccgtcaagttcggggacgcctccggcgtggagatcaagggtgttggctccgtcaccttcactgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggcactaatcaactctacatcctcagcgcgcaggtcgcacaaccagtttgcctcgccgctcgtcgggacgacgaggcgtggcagtggcacgagcgcttcgggcacctccacttcgaggccctgaagcagctcagtgctaaggagatggtgcgaggcatgccgtgcctggaccacgtggagcagctctgcgacgtttgcgtggtgacgaagcagcggcggctcccctttccccagcagacgagcttccgagccaaggagcggctcgagctcgtgcacggggacttgtgtggcccagtgacagcggccacaccaggaggacgacgttacttcctgctgctcgtcgacgacctctcccgttacatgtgggtgatggtcctcggcagcaagggagaggctgcggacgccatcaggcatgcgcaagctactgcagaggcggagtgcgaccgcaagctgcgcgtgctgcgcaccgacaacggcggcaaattcagttcgcgtcgtactgcgctgatgagggcattcagcgccactacaccacgccgtacagcccgcagtagaacggcgtcgtcgagcggcgcaaccagacggttgtggggatggctcgggccctcctcaagcagagggggatgccggccatcttttggggggaggcggtggtgacggccgcctacatcctcaaccgctcgcctaccaaggccctcgatggcaggacaccgtacgaggcttggcatgggcgcaagccggcggtctcccacctatgggtcttcggctgcctcgcgttcgccaaggagcttggccacatcggcaagctcgacgacaggagcaccccaggggtgttcatcggctacgcggagggctcgaaggcctaccgcatcctcgacctggagacacagcgtgtgcgcactgcgcgcgacgttgtgttcgacgaagggcgagggtgggtatgggacaaggcggtggacgatggttcgactccgatgtacgacgacttcaccgtcgagtacgtccacttcgagggagctgggggagtaggcagctcttcttcatcgagcgtgtctaccccagcccccgaatctccaccgactccgacaccaacacaccctcgggccacgacttcgactacgacgagctcttcgtcgacaccaccccagccagtgactccacatgctccagcaccaacagtcactcctccaagcacgtctacttcgacgccagctcgtgttgagcgcagcccggtggagttcgctactccgctctcccacgacggggagcgcatcgcataccacgacggtgagcagctacggtaccgtacgatggaggatcttctcggcgaccagccggtgccgggactggtgcctcgcgacctagaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactccttcatgcgctggctgctcaggaaggctggggcgtccatcacatggacgtcaagtcggcgtttctgaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatgggcttcgagcaaagcccacacgaggcggccatcta

SEQ ID NO: 61353 - DNA, 5727 bp, Oryza sativa
agtcggttcatgcagcgaccgacgacggagcaccagaaggctgtgaagaggatcatccgctacgttgcggggactctcgaccacggtctctactacccaaggtgtcctggcaaggcacacttcgtcgggtacagcgacagcgaccacgccggcgacatcgacaccagcaagagcacgagcgggattctcttcttcctcggcaagtgctcgttagctggcagtcggtcaagcagcaggtggtggccctgtccagctgcgaggccgagtacatggcggcctccgccgcttcgacccaggcgctctggcttgctcgactgcttagtgatctcctcggcagagacactggaacggtggagctcagggtggatagcaagtccgctctggccctgacaaagaaccccgtttttcacgaacggagcaagcacatccgggtgaggtaccacttcatccgaagctacttggaagaagggagcatcaaggcgagctacatcaacaccaaggaccagcttgcggacttgctcaccaagcctcttgggaggatcaagttcctcgagctctgctccaggatcgggatggcccaacttccccacaagacgacgcacaagacttagggggagaatgttggataagtctttgtgatccttggtcgtgattcttctttttgcttttgggtagtttcacctttttcaggacagcatctaccctttagcatatttttcagttgctaggacagctgcggttagtaggacagcagcagttagcatctcctttatgcctcctttatgctttattcagtttggatgccttctaggacaacatcccattcaaattttgaattttagactaggagggtgcagcaataggctagcagccagctatggctatatatatgtatccaacctccctcgggtaggtatggcttttgtgtttttgtgaatgaagaaaaccagaaaattgccccatctcgagtgccatcctcttctcaatgagagtaaccattgaaattctaacacaacatacgcaaaactcgcttccaaattcactctgtaaacttcaccatttacttgtgttgtccatacgctggcattcatgtttcatggacaggcgacttgttacttttcctaagtgcttgggcaccttgagcagcattttgtgtattgatgttcatcgtatgtgcactgttgatttagctgccagcagccatatgccatgtcttcgagcggctggggaattctgtgttgataagagtaaagtgcagggactagaggtgctgaagcagatgaatgaacttcaggggtcgcttgctattacatctcttgagaatgtgaaaagcagggatgaggcaactgatgctcaactattcagaaagagtcaaatctttaaactgaaactgcaatggggttcttctaatgcttctagcaagtctgacaaagcgaatgatgtgttcgatgctttaagacctcactcgggccttgaggaattgattgttcagggatatccagggtgtgtgtccccatcttggttggagtcagagtggctctctagactgagacacattagcatttctgattgcaagtgttggaagttgcttccatctttaggccaaatacaatctctcaggacacttcgtattgctagactgaatgcagtggtttgtataggccccgagttttatgggactgctggctttccctcactggagattctggaaatgatagagttgccagaattggcagaatggtcttctgtggactgtttttttcctgctcttcttgaggtgtgcatcagaggatgccccaagctgaaacaattgccaccagttgttctcccacctgtaagaatgagtatatatgtatctaccgaagtttgcaggctgcgaaatcataatcgcctggagacatgttttactcaggaggtgagcttaagcacactcttggatatgttgcatcttcgtcgtctggaacctgtgaaatgtgtaaatatcatctttgaaggagcaaacactctggaagatggacttaaagatgtaacaacaaatctgccatcccttgaagagttggttatcaggggatgttctgatctgcagcatgcttttgcagctagtaaacagcgggaagaggatgggaatgtcttttcttcggcatctattcaatgtctcaaaatgattggctgcaacctgacagtggacatttttcttagtgtgtttcagaacattagtttcctttcattgtggataaacgattgcaacatcacttattcaactcctgaacgtgtgttggccatgccaaagtcagtgactggagtacttgagaagctgtgtattttaagctgtgatgggttgacagctttcatgggcctagaaacattcttaaggttaagcacaatagaaattgcaagttgccccaagttaacgtcagtgccagactttaggtgtcttccagccctccagaacttgatcataaagaattgccctgagctcaaggaactacctgaaaatggtaacctaacaacattaactgcactggttgtggaacactgcaacgcgctaatatcactgaggaacctgcgagacctttctttcctctcaaaactggtggtcagaaattgtatgaagttaatggctttgcctcagatgattagtttctcttccctcagagtcttgatcataaaaaactggcctgaagtagtttctttaccaaaagaagggcttcctgtgtcccttaattggttgtatttggctggatgccatccagtgcttgaggaacagtttgaccagaaaaatggtagtgaatgggagaagtatgaagtgttgccgttttgtttttttgctgataaatcaatagaagatatcgaaggtaaacatcttccatcctcggattgctgtctgtgaaattcaggcacataatatttgaattttgatgatgatgaatctacaatttctttgttgcaaaaataaaacgtcaattgactgactcctattgattccaatctactgcagagatagccaaagaagtacttatggcggatgatcttaccaggatttccattcagggcaatcgagttcatgcaactgattttgcagcaagctcgtccagtttcccttagtaagctctccgagggtaatatgagctgttgtgatatgttgatcattttgcatcatggccctacctgcgcaactgtgcaactgctgaaattcatgtgcttgtatatttgttccattttaaaccggactcgtttttcctaaaagacaggaaatcgaacatcgtattaccaatttatcatgctggtgcatttacggatgttaacacattggatgcaccacacactgttcaaccgaataatgattgtgcaactcattaaagttagtcacggttattcctcatcaaggaaattattttttattcttgaaggataacttgattgtgattctggaagaacacattggatgcaccacacacgttgcaacttatgctttattagtatcagttgatgtaacagccctatagaaccgcgtagcctagcccaaccgacgggtgggcccaattacacataccatttcacacttacattttcgtcctcgcttcgtgtaaaagggttaacccgagagtggcatggttgaagagacaaggcttataagttggtttcacctttactaaattagcaatgtgttaataaacatacgcacacagctctcatgggccacacatgccgcatcttaattggaccagaatgtcacgtacacctccctcaaaggacttatgtcctgtcggtccaactcaccacatagccacacaagcatataggcaaatgtacaggaacacgctccctcttagcattggaccaactcacccacataaccaccaagaagataggcaaatgtccagaaacatgccccctcttagcactggaccaactcacccacataaccacacatgcaaatgtccagaaacatgccccctcttagcactggaccaactcaccacatagccacacatgcataatgtccagaaacatgccccctcttaggaacacatgcatacatctcacccacatagccacacatgcatataaactcacccacatagccacacatgcatataaactcacccacgtagccacacatgcatataggcaaatatccagcaacacgccccctcttagcacacgtccaatgctggtgctatatgtcatgccatgtgtctcacatagaagccacatgcgccatgcaccataacacactaacccgcgcaaccgcgagggtcggctctgataccatttgtaatagccctatctccagaaccgcatagcccagcccaaccgacaggctggtctacttacacataccactccacttacacattcgtcctcacttcgtgtaaaagggttaacctggaagtggcatagttagagggacaaggccttataagttgtttcaccttgctaaactagtaaggtggtaataaacatgcgtacacagcttttatgggccacgccgcatctaattgggttaggatgtcacggttgattggttggtctcctagcggttgtatcataatttctccataaattggtcatgtgctgtcattttttttctgtacgattgatttaagtttttgtgcatgtagttactcaaagtcataatgaacgtctgatccatctcttgcaaattacaagggcgttatgatcaacgcgataagttttcccccctgcagatatgcagaattcttatggtttaattgcacggtgatactgagataaataccatagcagacgtagttttgcacttttgctcatgtttatccatatagcttatcaaaaacttaataatactgaatttctgagtaaaacttttatatatatgccatgattaaaaattcaaaagttaatgtagtaaaataaactatgattaaaaatcataaaattaactcatgagatttaaaatttggcttataggtataggcacaattaaaatgatgctcattaaacccagtgtaacagtgcaatatggcaggatcagttatccatgaaggcttaatagttctttgagcactcttgccccagaaacaggagaccatctgttcgtggcatgtcattttactaagcaagtaaaacgagaatctgctaacaacttttcctctagcgtcgtctcctctcgggcggcacgggaggtgcccaggccgccgtcgcccgccctccctccctcctcctctgcctccgccgcccgaccggccgccagtaaagccgcgcagcggcaaggacagcggcggcggggcttcgcttcgtctcgccgcacaagggcagggggaggtctgccggcatcgggaggcagaaaccgcccagatctgcgtcggccagccggagttcgcggggagttaagccggcggtggggcagtgtgctcgggcgcggcctttggcggggatggcggcggagctttggaggcgctggcggcggtggaagaggccgccagatccggcgcggatctggcggggaggtttccggcggcccccggtgggggtccggcgccgccggaggaggtcggcgtcctcagggcgatagcgacgacggtgccggtgccacggcggccggaactggcggcggtggagccggacgacgactgccgaggaggcggccggatccggcggcaacgggcgtgacggcgcggagacgctggagaagaaggtgcggtggctgcgacgacggtcgaggggtggccgggtttggtggtc

SEQ ID NO: 61354 - DNA, 1816 bp, Oryza sativa
aatgagacgcatcctagtaccagtggcaaagccagaacaaattgaagggggtgcaccactcaactgtacatgtagtggcacgtagaattttcaagccatgatatataaaacgtacgatgaaatgtgattaaaaattcctacttaaaaatgtaaaatcaagggagccataataaaagagatactcagtattgcatcgaaccattaaataagggtgtgtttttgtgaggagaggaaagtagaagaaagcgtatgattaattaaatattaattattttaaacttggaaaatgaattaatatgatttttaaagtaacttttctatagaagatctttgcaaaaacacacggttggggaagtatgtgcgcaaaaaacaagggatttttctccatgcttcaaaccaacgcactctaaaactggtggagtatgaatactagatattagaatgtgataaaattcaaaagtcagggagctagtgccataacttctcaaattgaaattttagtacttaattaggatcaatatacaattactccactttcctaaatcccaacgtaaatcctaaactagtatgtagaaccattaaaataataactgaaattgaactctatatttaaactttaactctttaaggtttgaagtgaagaattcagataaattgaggaaatacgatgaggaagatctatgcccttgcctctatgtcattaacataagcacatacgggagatacacatgatcaataaaacgataaaacaaatgaacaaagcagtacgctgatgcagcaaattgggcaccaactgaacgcgtgcggccaagtgacctcgcggccgtgcgtccgtcgtcctgccgcgctttggccagccgtcggggggtgcacgtaagggagctgaggggggtgcacatgtggcaaaaacaggatatcaagcactgtacagccaatataacttcgcccctgcctagtacaacgaatttagacgtagagtatatctagatttattgtatgaggttggtttttttttttgggatagggagtatgcccccatctctgcactattcaattcgagtctattctcacttattaaattgttcacactccacactgcaaactaatcatgcgccattgtgaggattctccacctaacctcaacttggtctggttccgagttgcttagtgctattgctactagctagaaccagaacacgctctgcctttctcctgctggctgctgctctttggcctgcttcagccttcagcttctccatggttttctttttgtttgctccagcttctccatggttttttttgtttttgttctgagaggaaaaagggattttatatattgataaggtattattcttggtttctttcacttgatagcatgagttcagcatttgtaggctgtcaaatttttaaggatttctcaccatagtaaaacgattatattgaatttacttggtggatcttgatccgtatgtagctcctctttgcttcccaggcatatgagttatctatgtttcccttttgctgaaatacatatggagttaattttgcaaaaccatagatatttttgtcaaaactatagatttatgccgctgtattgcaaaaccacgtactccctccattctaaaatataatggatttttggagggatgtgacgcatcatagtattacaaatatagaacatagtattaccacgaatccggacagcctctctatccagattctagaactagaactaggatgtgtcacatccctccaaaatcgcttatatgggacatagggagtatttagcatatggagttccataattcttgacgtt

SEQ ID NO: 61355 - DNA, 835 bp, Oryza sativa
ttatgtttgagaaggtccaatcatatatatcaactcagtacaagtggcagtccaatttggtggatgaccttaaaaagctggagactattttaactgaaattctcttggtagtaggcactgcagaaaggcggagaacacttgattgcaatcagcaagctttactccgccagctgaaagatgctgtctacgatgccgaggacatcatggatgaatttgattacatgtttctgaaagcgaatgctcaaaagagaaagctaagaagcttaggctccagttctatctctattgccaagcgtttggttggccatgacaagtttcggtccaaattgggaaagatgctcaaaagcttgagtacagtaaaggaatgtgcccatatgctcgtcagggtgatgggagtagaaaactttagttcacacatgttacctgagccccttcaatggcgtatctccagctcgatttcaattggtgagtttgtagttggtcgtcagaaggaacgggaagaactagtgcaccaattgctggaacaatctgacaaacctgaatctagaagcaaaggagcaaggtcaacatcattagaggtaattactatagtcggcaatggcggaattggaaaaactactttagctcaacttatttacaatgataaaagaatcgaggataattttgatatgagggcatgggtatgtgtatcacatgtctttgataaggtcagaatcaccaaagaaatcctaacaactattgataaaagcattgacctaacgaattttaattttagcatgctgcaagaagaactcaagaacaaaataaccatgaagaagtttctacttgtattgga

SEQ ID NO: 61356 - DNA, 3913 bp, Oryza sativa
actagagatccaaatgaacatctcgaattgaagtctataggtgaacacattgtgcaaaaattgaatggatcggcattagctataaaggctgttggtgggcatcttagttcaaacttcaactatgaagaatggaatcgagttctaaaaagtggtctatcgaatgagaaagatattatgacaattttacgcctaagctatgaatgcttgccagagcaccttcagcaatgcttttcgttctgtggtttgttcccaaaaggttattatttcgagcctgacatgttggttaacatgtggatagctcatgaatttattcaggatcgtggacgcacctatggaagcttgacaagcactgggaaaagttattttgatgagttgttatcaagatcatttttccaggcacttcgatatggaggtacagtgcattatgttatgcatgacctcatgaatgatcttgctgtccacgtgtccaatggtaagtgttacagagtaaaagccaatgaacctcaagagattttttcagaagttcaacatctgtctatactggctgaaagagttgaccttcttcgtgcctgtaagttgcaaaggctgcgcaccctaataatttggaataaagaaagatgttattgctaacgagtttgtgtgggagtagattttttcaaagagttcaagagcttgagattattggatttgactggttgctgcttaagatatttgccggacttaaatcacatgatacaccttaggtgcttaattctcccaaatactaaccgtcctctacctgattcactctgcagtctttaccatttacaaatgttgtttctacaccggcattcatgttttatatgtgcaaaacatgtcatcttccccaaaaacctggataacctgagcaatattttgactattgatgttcatagggatcttactgttgatttggcttctgtggggcatatgccatacctccgggctgcaggggaattctgtgttgagaagaggaaagcgcaggggctagaggtgctgcatgacatgaatgaaaaaaaaaactagaatattagggaaggacctaatatcaaataattaggaggggtgaggctttgaacccaggtcgtctagcccaccaccttgtggagctagccggaagacccctgggcatttctcctgcatgacatgaatgaactccgagggtttcttatatttacatctctcgagaatgtgaaaaacaaggatgaagcaattgatgctcagttagtcaacaagagtcaaatatctaggttggacctacaatggagtttttctaatgcagatagccaatctgacaaagaatatgatgtgctcaatgctttaacacctcatccttgccttgaggaattgaatgttgaaggatactcaggctgtacatctccatgttggctggagtccaagtggctatctagattgcaacacatcagcattcatgattgcacatgttggaagttgcttccacctttaggtcagttaccatctctcagggaacttcatattgatggaatgaaatcattagagtgcatcggcacatctttctatggagatgctggctttccctccctgaaaacactagaattgacagaattgccagaattggcagattggtcttcaatcgattatgcttttcctgttcttcacgatgtactcatcagtaggtgtccaaagctgaaagaactgccaccagtctttcctccacctgtaaaaatggaagtgctcccatccaccatcgtttacacacagcatactgatcatcgcctggacacatgtattactcaaaaggaggttagcttaactagcctttcgggtatttttcacgtatgtcaccaggaatctgtggaaattgcagaaattagctttgacggagcagacatggtgaatgatgggcttagagatctaggccccaatcttccatcccaccaaggacgatttatctgctggtatgctgatttacaccgtgcgtttgcgagtttaacagaaatgaaaattgttggttgccccaacataacatcgttgttggacttcagatattttcctgtcctcaagaacttgatcatacaagattgccccgaattgaatgaactacaagaggatggacacctaacaaccttgacagaggttcttatagagcactgcaacaaactggtatcactgaggagcttgagaaacctttctttcctttccaaactggagatcagaaattgcctgaagttagtggctttgcctgagatgtttgacttcttctccctcagagtcatgatcatacacaaatgccctgaaattgtttctttaccggaagatggtcttcctctgacccttaaatttttgtatttgaatggatgccatccattgctagaggagcagtttgaatggcaacatggtgttgagtgggagaagtatgccatgttgccgtcatgtttgtttgctggtgaatcgataggatatggtcaaggtaattcacagcagcttgaattttgaaaaggataggtctagcaattatttgttgcaaaaatattaccacaatccactgatttgtgttagtgccaacctattgcagatatagctgaggaaatacttcgcgagaatgatataatccagcggtcaattcaatccagtctactgcatccaactgattcttcagcaagttcttccagttttcttcagtaaactatctgggctgtcctccgaagctgtaggcctgccggtgatcacctacagcttcatcacatctacctgtgtggctgtgctgacctggccaaaaaaaaaaaaattccacctgtgggttctattttaatcaagccaacttattatgaggcttgtgcattttcacatctaaacctattatttatgcattacagaacattcaccattcattgcttgcgttttatactttttctacaagatgcaatgttgccatctgctcaccaggagtatctttcttgtggagttattttttcccttttctttggaataatcagatatgtatcacacaatatgtatgctggcttttgagataaataccggagattgaaatgacattttgagatttgagcatatcacattaagttgagaaaactcggcagcctttttgcctgcatcatggtctttctaaccatactttctatgctactaatgtattatatatgatatactgctagtatgtgatcatgagggatccaagctgcatttatagaagtcgtagctagttcgcaacatcttactgtttgtcattcacagaagtcatttatatcatttacagaagttatactaggcttgtccgtgtagttgtagcctgtttattttgctgccatgttattagtagctttcagtatgaggatcagcaaaaagatgatggtccccccttgcaaaatacagtgatcactgatcaggttgatctcctgaatcctgggtaaggtcaattttgttgtctgcccggctttttttttttggttgtctgctcaattttcagggaaaatacctctcggctcgttaaaacacttgccaattctgatggtttttattgcacggcgtgatatatagctagatatatagcttttgctcgttaaacccgttataatggcagatcagtcaacaggcaacccaatcctccatccgttaacatatacgagtatatgattcaagaaataggtaaggcagaagaaaatttaagaaacagctgagcaaatcaaccaagcagcaaccttttcgaactatatttgacgaagcgaatactttgccattttgccaactgacctatttctgccacctctttagtcgtaactacggtatggtcttctatgtttacataggggagatttgctctgaaccagtaaaaatatcttacggtaccaaatattcctctcaatatattcggcccacaaatgaacttggccca

SEQ ID NO: 61357 - DNA, 1699 bp, Oryza sativa
tattttaatgaattgcataatgtgcataggctttttcagggcccagctaagcaaaatcatacagctgcctttgaagactagatcggcgtcttcccgtgtggctggctgctggcgcgcttccgaccaaaccgcccagggattccgtgcatttgttatgtagaaaaatatatgtgagaggaagattgagattaatgggacaattgtggcttggtgatttagtgaccaatccaattctctaaagataagtaaagaccaaatcccatcaaattagaatcgatcataatctggtataatttatttattgaattagtgttcacatgacaaactaatcatgtgctgggggaagaaaatgacaactgtatggctcaccatttaaccccatcttgctttggccaatgcccaccactttgtcaatccccattgcttgcagtatcgctacagcttctttatggtttcttgttctggaagggaaaaaagaatttatgccataatactgatcaggtattattcttggtctctttcgcttgatagcaggagtttatgccataatattgatcaggtattcttcagagtttaaaggcttctaaatttcgaaggatttgttttttgaagcaggagcagtgctattcattagcttgacggaagtttatttacaaggaaaaacaaatcaactaagacatgtacttagaattgaagttcaacattgctacgctattgcttcctagaaggtttcaatttcttccttgatcatgaagcgctcatctaccatcttcagttgatgttcaacaattttcctatttgtctccttccattattccaaactgtgtatgttcctattgttattatcctccttctcctgctttatttttcctaccgtcagtgcattcccatgatgccagagtataaccataatttgttggatagagattaatgtccagccaaacagagatcttgggccaaagttgtttggagaatggccattgatgaagcaagtgttttgctttttcctgtacttgatcacataattgaaaaatatcatcattcagaaatcatcttgcttgtagtttgtgagctgttaatattttctcctgcaatagtagccacatgaagaacataaggttttgttatgtttccaacctccagatactagctaggcatgtttgctgaacagcgcaacaaattgtactctataatctgatctagcactgtggattccagaatggcagaatgatgtccatttccaggttatggagtttggatggtcattagaacttatattttgcaattttatccacaagtagaagattgccaggaagttaacatttttacttctatgcaatcctctcatccttttgttgcctgtaaaatttcgaaggatttctcagcataataaaactcacaaaatcgaaattttcgaaggatttttcaggacatatgaattatctatgagtgtgctggattgaagttggtatccccagcagttcatgttgtgcccatgcttttgttttgtttgggctgtataagactctctatttgttccttttggctttctccaaaaaaccgggtaattaaaattacctgttatctaaaataagtatgatttatctatgctttacttggtcgaagtatatatgttgaacctaattctgtcttttgattactcaaatagattttgggaactataagaacttgtgaacct

SEQ ID NO: 61358 - DNA, 1271 bp, Oryza sativa
ttggcaagcgtttagttagcattgataagctcagatcaaaattacaagaagttataaaaacactgggcagagttagagcttccgcagagatgtttgctcaagttatggcaggggaggtctctagcttcagtcagtctcctgagtatgctccagcaagagccacaggatctcttttgcgtgaagatacaatttttggacggaagaatgagattgatgaactagtaagtatattggtgaaggattgtgatgaacatttgtcttatgattgtcagttatttaatacagtggtgcattctattgttggtgttgggggcatcggcaagactacactagcacaagctatttacaatgatgagcggattactgagatttttgatctgaagatatgggtttgtgtctcccataattttgacaaaactagactaactaaggagatcatagcatgcacagctggcacagaacatattgaattggccagtttcaatttcagtatgctccaagaaaagcttcgagatagactgatgtgcaaaaggtttcttctagtgctggatgatgtgtgtatgatgaaagagttggagagcacatgaacagagaaacgtggaaggagttgatagctcccataagaaatatatatataagttctgaggctttagagagaaagagaacaggaagcaaaatactagtgacaacccgggcagaattggtagcaaaaatgctagattcgagaagcttatttttcttgcagggccttggaaaagatgacagcagaatgctcttccggaaatgtgcatttggaaacaggaatccagaagattacccagagttgaagataattgaggaccaaattgttgaaaacctaaaaggctcagctctagccattaaggtgactggaggccatttaagtggcaaatacaacgctctggaatggaacaaaattcttcagaaaagtgtactcaaccctaatgacattatgacaatcttacgctcaagttatgaaagcttaccaaattatcttcagcagtgttttacgtactgcagttattccctaaaggttaccgcattgatccaaacaggctgatccatatgtgggcagctcagggttttgttcattcagacagaaatatcaatactagtctggaggatattggcagaggctatttcaatgatttgctacagcgctcatttttccaagtgttccgatgtggagaccaaatttactatattatgcatgatgtattgaatgatctggcacttcatggggctgcaggaat

SEQ ID NO: 61359 - DNA, 4355 bp, Oryza sativa
atgccaaatcagccctaaaaattatctcaagaaaaaacagcacccaatctctggctacacaaccttgaagaaatgggcataccttgatgcatctgcatctctagagttgtcaatgagctctgctattgctccaaagacccagccagcatgtgtctgactgagtgttcgcagataactaggatccgtgctgacaaaattttttgcaagagtggtggttctctttttcactattggatctaaaattctagggccatcttcaacagactcacatggtgatgattctggaactgatttgtgcagctctgtgacacgcgaggcattcatctccttaggatttgggccactatcacaaatctcctctctcaaatatgactttggattcatcgagccagattggaaatcacttctgtatgacctttttaaagcatctgtcatagcaatattcatgtgtcattctggtggcataatagacaagtgaataaagttaaataccacaaagaaacgaatcagcaaatagctcatagctgactacacgcatattatggtgtatatctttgatgttaactatagagagagcttcctccaacaccatggacaagtgagaatacaaatgaagtaataaaaaaaaagaagggactccaattgcaactcttggggattaatagaccaatattgatgaaacaaagattactggaatgtattgccaattgttaaatttcaagtttttttttatataaaattagcatagggtcagccaaaataaaaggagaagtaaaccatccaagcatagcattcctgttcaacaatcagcataggaaaactctcaccagatactccagccatcggtttgcagtctccaggatctttttgctcatacatgaccaccgcatgtgagaagttagggcgttcatgagattcatgagattgaggagggaaaatatgtaaggcaaaggagctgaatctaactacagcaaccttcaaaaaagcaccgaaaaagaacaaggaccccacattacaggcaagaaaagaacagagaacattgctaatgatgttaataataaaatacaaaatggcaagtagagaacagaacaatgctaatagtgctaataataaaatacaacatgcctactgacttgcaggggaacaaaaccctgacaaaagttgattaattggaagataaaaggtactacagtgcatggcctcccccctatcagcctatatgtccctgttatttgtcccatgtccgacacctaccccacctagtgcgggttctcagtaagaagtacgatagtatccaaatggtcaatcctttgccccattttacttgaacaaataagtaacaaaaaaagataaaatatcttgtatatatttttttagagcacctatcttgtatatttttattagcaattatgacatgcaatagaaacaataattaccctctgattgtcccagaggaaaacatgaactttccccattcaatattctgacgatcatcttcaggttcaggaagcagtgaaaatttcaggaaatcacactgctggtacaccttagttggcacaaacctaacaattgaccaaaccgagggcctgtaaatgtgaaaagcacagacataagatacctccatgaaattaagaaacaaatcaccccaccccccacaacaacacacccaaaaaaaagtcatggtttttttaccgacatgttgattaaatgtttgtagatttgagtaaattaacagtatagctgcagcaattcactttagtagtatatatttttacaaaagctctaccactattttgatgatagcatatgagattgggtagttgtagcatggcatttaacagggggtatgtatggttgaaatcattgctggtgactatttattttgactgagagcaatggagggctcagggtctctgacaagtactgtgaaacagcgggagcagtcagatgatgctagtatgaaaacatgaacacaccagcattgaactttataacagaagaggaaaacccactaatacacactgtagattgtagatttaaccaatcgatgacagtatgcgatagagaacatcaacaatatttatctgacaatagttttggccaatggatgatgatgtaaaacttgtaaagtattcacagatcaggaaaagaaaaagagatcaacttacactttaactggaatatcacagactttggtgcggcatatgttcttagaatctttttgtaataatacatagttcaagccaccacctaccacaaaaaaatatatccttcaggcaaaaattcacacagtatgtattctaccaaaaaggataattctaacaacaatataaaagaagcaagcatcattcataattgatgtgaataaatgttaacatattggcattactaccatttttaagttataaaaaaaggctggacaggtttgccacttcatcacatgttaaagtgaggtactaggaccctatccacatctatcaacactgttgatcagttaaaagtacaaaactagagctgttaatataaacttaggagtataggtgatagagtttccacagattttgcaatatgtgaagtttcaggggtacaagtggacttggtgcagtttcctcttaattttgcagtggaacctggtctacagaaaggatatggccaattggccatcctttatggcaacgcatctcatataatcataccttgattttcatgtggcggctcattcaaatcaagtgtttcatccgccatctccttctcttcaccccctatgaacagcaacaaccatcaaatgataactatattttctaaaagcaaaagatcatcatgcatgtaaactgaaactgaaaccaagcatgagtattaactaagcaggtcaattgtcattctggagtaacatatgaccattaaacaagccagtagatccagaaatgtggtatagtagactcacagtatcgtacatcattaattgttcaaactagaggaagcaaacttatcaaatcccaagttacatgactattcatctataagttattaaataatgccaaaagaaaaaaaaatcagctgggcaaacaggccaatccgaccaaaactcatcacaaaggtcaaacacgacaagaatttgctggtgaataatatatcccagaatgctaaatacatgccagataacatgcttaaaactatccagatgaatcgaactaagcaatgctacaaattataaaaacatcagattcagccctacataactacataagtcaggtacaagcaagcagcaacgaggctcaactctccagtatattaaaatgttaaatgcagctccaaggcttcaatgaaggccatgactcatcaaatgccctccttacagcctcgcataactcaacatattaatgtgattccactatagaagaaagaaagcaacaaaaagtacttgagatcacggtccaaagtggtgatttatgtcacttaacacctccaatcataaatatttggcatttaggacaagatttgattaaacttttaaaacattcaccattagaataagcttatgatgctatgatagaacttttcaaggcaaatctacacaaaactaagcatttgagaagttactcatggtcaaagtttcaaaagtttaaccaaatcttgtccgaaacattaagcatttattgcaggagtgaatactttggttacacaccgagctcggtaaaagacaccaccttcaacccccacaaaaatcccaaaagactccgtcttctataaagaccatgagcacccaaaaaaaaaatctcagaaaacaagttcttaatgcgcatcaaaggcatcaataggattgcaaagtaaattaccaaaaaaaacagagagagaaataaaactgaaagcggagagagaatggaccacctccacacatttctaaccaagagaaaattttgggcacccgaatctcccgatcacgcaccaaccactacgcgagcaaccgcaaagcacgtcacgaacaccaccactacccacttcacctcaaaacccaaacgtcaaaggccacgcacagtaacttttacccccaaaaaaaagaacaggagaaaaaaatcagagcggtgaggggtttgaactagacacatttttctcaagggagaaaatgaaaaaaaaaatcgagcctccgatcgcgtaccaaaccactgcacgcaagcgagtagtgaaaccaccaccaaaaaccccacttcgcctcaaaaccccaaacccccccaagccccggttctcgcaaaaaacaaccaccacgagcactccggcgccggccgcggagcgcatgcacacacgcacacacgaaccaccggaatccacggcggtggtagcgaaccaacccccccacc

SEQ ID NO: 61360 - DNA, 3287 bp, Oryza sativa
ttggccatccattccacacgaaaacaaacaatccactccaacctctttttatttttcctgtgcatgggaacgaggcaatcaacaaactaatcttcacaagcttcactcctctgacacatgatgattttagttagtgggtaggttctttaaaaattcctatgtttttcctacgctctatccgaacgcatgtttatatagtattcctatgtttttcaattctctgttttacacgtgcattcctatcatattcctatgattttcctattcctgtgttttttcaatcctccattccgaataagccctaagcctatatagcctcgccacgtgggattgttctttttgtttctttttcttttttttttaccgttgcagtaattgtgaccgtccgccaacctcacacatcaaaacaagtcttttctttttcaccgttacagtaatttttgaccgtccgccaacgtcacacatcaaaacaagtcttttctttttcaccgttgcagtaattttgaccgtccgccaacgtcacacgtcaaaacaagtcacaaggttatctcttctaccataacggcagtagtattagagcaagtttaatagtacagccaacaacggacttcaaattatttatagctaatctaatagcttattcatataatagttaactataaaaatatactccctccgtcttataatataagggactttgagtttttgtttgcactgtttgaccacttgtcttattcaaaaaaaatttagaattattattttttttgacttactttgttatccaaagtactttaagcgtagcttttcgttttttatatttgcacaattttttttaataagacaagtggtcaaacaatgcaaataaaaactcaaaatctcttatattatagaacggagagagtactacactattaatatttggtcacacctctcatacacatataatgtcttggagtccatgttgacatataatgtcttggagtccatgttgcagctggctacaaatctgtagcccgcttttttctctctcttctggatatgtggttatagctcaatatgtggttatagcttgtttatattctgctattgtacctgctcttaaagattgacacgagggaacccacattggaagatatacggtccccacatattaatggctataatggtagtgtcgttatgatagagaataattaatcatccagtcatgaaacaatttatattagagtaaatttcataaaactacagatactttgcacgatctatcacaaaactatatatttaaaaaattgtttcacaaaactacagatttagtgtcttcatttagcacaaaactacaggtactttgcacagtatatcacaaaactatatatttaagaatttgtttcacaaatctatagatttaatatcttcatttatcacgaaactacaggtttagtgtctccattatcacaaagctatatgttttacactaaatctatagttttgtaaaacaagttcttaaatatatagttttgtaataaattatacaaagtatatgtagttttgtaatagattgtacactaaatctatagttttatgaaacaagttcttaaatatataatttgtgataaattatgcaaaatacctgtagttttgtgaaatttactctttatattaaaataataaatacatttttaatttatttaaaatttaattgggttattgggtttgccatctacacttttattatctcaccgcgtgaaatcaccgtgcataccttgtgtattgtctaactaaccgccatgagtgcctcacaaccaccaaaattaagtgtgttgtgtgcatgggcatgatcaggtgaaatttaggtgcttgtttccgtagtttggttttaattgaaattacgttgttttgcaggagaagatgggtaaacttcggtatcattatcttcctctaataatcacattagttgacaattatgactaaccaagcacacttaatgctctaatgttttgtggcaaggtttagaaataatacaacattataaataatacacttttaatggaaaattgtcaaaaaaaaagatgttgattgttcaaatcacaaatttagcaccctatataataaccgtagtttgataaggtacctgtgttcgacaggtacgcctgtcgaataacaacagttcgataaattagttggcttgattaaaaaaggaaaagagcaaccatggatcccaaggtatgatacatcccactgctagggatgaaaacgagccaagccaagtcaggcttgcggtgactcgtaacaaattaggcttggcttggctcaactcgattaggaaaccaagctaaaacttgatctcggctcggctcgtttcctgactcgagccaactcaagctggcttgcaagatttcctattgaaacacctcttcatatatattttgtaatcattaaaaaaatcaagaacaaatcatcaacatataaaatttaaataagtttatatattcaattcttaatatcttaatgaaaaatttcaaattgacaaataataactctataaaaaataaaataatccatataagcacatgatggcctagactcacgagccaaacaaagcagctcacgagtcagctcgggctcggctcattttagcaacgagctgaaaaagaggcttaggtttggctcatttgacttacgagctgagctaagccaaccaagcccgagctgatgagttcatgcgcccgagctttttttccacctctacccacagcccactcacattcactcatcactgtccagattcatagtattataatgcgtcacatccggtattagattcgttttttttaaacggtggagtatagaccaaacggcatatcttagccttagtaaaatactataaatttaaagttatgtatccatgacttcactactatatcaccagatattatttgtggcttcttctactatatttgttgggcatttatttatgagaagttcaacatattattatagtcccaaaaataatggttaaaaattgtagtgcgagaattaaggccgtgttcttttcaactgtaacatcgaattgttaaaatggattatttactccacacttcgatatgtacattttaaaaaaatctacctcatttcttaaattacttgttataaactatctataaagtttatttcttacaatatttcatttatacctataatatattaataattcatagtataataatctaaatcacgacctaataagatcatactagtagtatgtagagctatcattctaactaccctagcag

SEQ ID NO: 61361 - DNA, 2246 bp, Oryza sativa
agagaggagagcagtgggctactacagcacgaacttcaaaacataatgtatatataacaagtgagatcatatattaatattaatagtatagtaaacaactattatatgaattgactattatattggttataaatgaattgaaactagtagtgggttatactactcctccatcccatattagttgttgttccaggtaatttagcatcgattaaggtttgagaaaaaaagactatagtatctctaattaaatattgtatggttggatataggagggtggttaggggtagaaaagagataaatttgaattagaagtgattgatgggacaaatactatttcattgtgataactattttaggataaagtttaaatgctgaagagacaagtaatttgggacagaggggtattaaacttgctcttatactccagtaaggctgccacagttttttgttggtcacaattaagataaagttagctaagcgtttaataagtctaacatgtgagctaagatgctaagaaaatactatggcaatagtaactgagacaataaatccaatatataactaatgaggaataagtaaggtatagcgtaatgtacgtgataagttgggattttcaacgaacctgctctcgctatgcacgatccgtgctaacccagacagagatggaatagccgagtagtagccagacaattcaacatcctctcacgcgttcctggaacgctagttgtttatatatatcgagcatagaatatgtataatcactttctagtgatactaatactactagtatcataccctatattttattgtgaatcacacgaataaatgtatgttaactatataaaaattatataaagaatatgaagatgatgatttgatatacttgtataggttgaactctataatgaaatgttaatgatgtgtgttatgtttgcacgatatttaagggcatgttcggctgcccgttaacgcggctgggctgtagcagcttaaacaatgctactattgatgattcagttgttgcagacgtgagatgcaacgctgcggctgcacagcaatggctgccaaacacagtcttgggtgataatcaatctttgtgataatcaattaagatgttttaaaatagtaatactattgggtgatgatgtacatctttgtgataatcaatctggaaatataggaagaaccgaaggattggtgcagattccgagaaggcacattagatacagaaaatatcaaaagaatccacaatgcatacgtgatgacctttggctattgtctgcatatttgtagctaagagctcgtttgcgtcaagccaatgtgaaacttaaagtagggccaaagcgaaaaaggatattactataaaaattagagaaggttatatatattgaccctgttttgaaaaagagaatagaaatatcatagtaagtctcaaataaatttcacactaaaaaaagaggagttctttgattccccccctccccccaacaccttgatggcacgagagggcgaggagatcatcgcccagaaacatagtacgtggtcctcccgccaagggagctacaaactaggcttcgcgtgcaaactcacaataatttcattagaaactatgttttttaaattgacgtgagaaactatgctaggaaaatgtctaattttcctatctcaaccgtaaatctaggcataatacctccctcaaatatcaaatcatatcagtttaccttggttttgaaggtggcttcatctgacatggtgtctacatgactacgtggcatcacaattggaaaaaaaagaatttaaccagtaagaaccgaactctaattctttctcccctacctcctctctctagcatcgctcaatgactgtcccaaagctcgctgacctccccactactccctccctcggcaccagccttcactgttgtcggtgatatgggcccgggggtatcaggtttagagggaggaggctgccccccgatgccacgtggccctcccccgaggggagtcaggcccgaggtggggtggcggccactccttccccaaagactagtcggaggaggctgccccccgatgccacgtggccctcccccgaagggagtcaggcccgaggtagggccgcggccactccttcccagagactggatggagaagactaccctccaatgccacgtgtcgggcccgagtagggcagcggccactccctggccgatactaaagggagaaggccgccccaggcgccacgtggct

SEQ ID NO: 61362 - DNA, 3552 bp, Oryza sativa
taggtcaccacatatggtgggttaggtgtccgcctccaggtgcccacttacccacatttatggcgtcctgagcggtcgcgccacgccgcatttaatgcggtgtgcagtgcactcaaccggtctgtgaccggtcgaatgactgatgggacccaagatgtcaggcgcaccatcgcgtgtgtcaggcgatgtgcagcccgacatatcccatcaaataatgatggtgagaggttctcatcctcttatcccagccggagtcggtcctcccgctctggtcaaagcaaggctcccgtttcccggtgtaataagagcccagaagtcttcacccattaaatggtgactgacaggggcaccccccgtgtcaggcgacaagatttgacaggccccatcatcaagacgacgtgtgcttggcttcccaagtcaagagacaagacatgcatttaatgcaaagattataatacttctccaccggagctaggttaggttgttgggcccatgtggtaacccctttaggtataaaaggaggttcaggcctagtggtggaggggggacttccgagcgaactggcgcttgggtctcgcaagcccaagcaccggtgttctacattcaatcaatcatgcacaggagtaaggtattacgcttcatagtggcccgaacctgtataaacctcttttgtctcatcgtcttggaggggcctaaccccctcaagatcacacagctccgctcactaagccctcgaatctcacccgctgcccccagccgaactcacaaaggggggcctcatggttccctggtggaggagttcattctccgacaactgtcatcatccctcaacctaaagcatactaccttcctcaccggcgtagctcgacctctcccttcctctccttttccgacctagacatcgagcttggttaagggagagctatgtgacaaaggaggtgtcatcggctcgagctcacccaaggccaagatctccactgaaagccatgactgcaactcccattcgccacaatgccatgcttgactacgggtggtggagtcctctatgtcccttcattccccattaattcctgtgatccctcctcctatacagcacaaccactgccgagttcaagcccctcgcgcgagtggctacggcaagctcccccttcctcaatgctcagggaggcgatgcattgaggttgtcttgatggagaggtattagtcagggatgagatcgatgcgtgccgtttctcaccatggagatggtatctcttccctctctcgccactgccatcaccgaatagcagctcaagcttttgaactcaccacttgccacttcctcgcttttgtatataccgagttgacgaggtctcaatgaggaatagatgaagaggttaggttaatggttggtgaaactccgacaaggatgcagtggtggtgaagtgttgacggaaaaatcaaacacactggcctgggagatctgcttagctccagttcaggtccaaagattgatgagatgtgggcgtgccagttagtttgatcctgcaactgacaagatatgcaaatagcagataaaatagccgatcggctaaacaaccgatgtagtgattccagccgaaaaccgataatagccgatgccgataccagccaatagcgatagggtttaagcaatcggctatatgtccaatgtagataatgctataaaggcaattggctgatgatgatgtaataaaataataatataatccaatataaaccaatcggcaaataatgatatgataaataagcatcgatccgaatattaaagcacacatcggctggaggtccgatgtcatgaaatccacaagattagattaaacagtgaaacctttgttgtcatcggctaaatccaacttatatgtatatgcaatccttacgagccgatgcaacgtccagataactcaccagctgaaaccccgatgaaacccttattggcaatcaataagcaggctagagattatggttctaagcacgacttagtagatcaaacttaactgatgcaacactaagtatgaaaagaaacacaatatctagacaataaagccgttgactgattttcagggtgatagatgcctaggctaatctaatctagcaatgcgatttagccgatactggcagaaaccctaaagcgagagacagccgatagagctaaattgatatgctaagactagattaacagagacatgataaataggtaggcaaatatatcatccaaaccagagcaatccaagaggtcgaatgtactgatgtagccttgaacgacgccgacgtaaacgatacaattgcctgggccgacggaacattggacttaccccttcgccggagatcgaacaccgatgcagccccgcgtcaggtgccaagtcccgccggacgataaaataaagtaaaaaggtaaaaggtggcgatgcaccgaattgtattgatcgtgaggatagattacatagaccccgggtgtacatatttatacccatgggttgatacaagtccttgtcagacaagaaagaaactttcctaaagataaaagaaaaacatagagtccttatcggacactaaacacactttcctaaagataaaaggaaactaacaaactattcctaattaataggtaacttgccatgccgcattctctttgagctcggtctcttctcgatagcttcctttagtagatcaatttccttaaccgaatatagcaagaatctaacaactgacgacttgataactctcatcggctaatcttagtacttcgaagccgacactgactttaagccgatgatgactttgggcttaccaaatttcactgttaatatgaagataactcaattgtgggttgaaggtgaggacgagagagtggaggatagcctagagatggaggaggatggtcggacagtgttgtgagttacaccaaggcagatgatgccacgagcaccttcccctcggcaccgtgagcctcccgcctcccgcctccctctctaggcgcctattcccagccatcatcgcctaccttctccaccttctagtcccggtctccttgctctccttcgctaacaatggaggtgctaggcttgagtggaagagagaagagaggtggctagtgacatatatataggttccacctttgttttattattttctccttgactgtactgcacgtatacaccacctcgaatgaaaccaccgttaaatatctcggagaggcaaaattaacctttttttgatattttagggagaattcatatattgttttgttgagagagagagagagatatcggacttgggacaaaatatatttcttccaatgttggtgtgattgggaataagttggggcctattaaataagtaagcgcttaatgtcctgatgggctattctcaaccggcccaatcccatcatggctgatctttttaggaaaaagtccactatgactcccttaaaagtaagccgaatctaattcgtacccctcaaccacagaaccggatagaacgactccctaaactattgaaaccagtgcaatttgactccctcagcggttttgg

SEQ ID NO: 61363 - DNA, 3908 bp, Oryza sativa
  unsure (1)..(3908): unsure at all n locations
atgcagggattagggatttgggtagccaagtaagaggaggggaatcggcggacgccccgctatggccctcgccagttagcagccgccgccactccagtacacgtcgctgccatagccaaggggataagaaaagagagataaggaaggagagggaggaggaagaagggttggagagaaagagaggatgatatggctgtgggtcccacaagtatttttcctatgtgaacgacaaatgggtcccacatatatatttttaattctaatgtcacgtaagcgccatgtaggacgaagaccaggtcaacatcaccacatcagcgccacgtcagcaaaaccattctccaaaaccgctgagggagtcaaattgcactggtttcaataggtgggggagtcgttttatccggttttctggttgaggggtatgaatcagattcggtctatttttaagggagtcaaagtggactttttccatctttttaagttgctttttccaagcgaaggctagggccgtgtttagttcccctattcccaacttttcatcacatcatatcacatctaaaatttttctacacacataaacttccgactttttttcaaactcccaactttcttcaaactttcaacttttttttcaggaattaaacacaccctaggaggggaacccctatggtctagaattttttttggtttatttcttcaagctccagtaccactatcttcttcacaattgtttcaagtgtgaagaattaattaaagcctgtttcctgtaagtgcaggtacaatagctggctataagccagctgcaaacaaattttaaggagataaatgaggagagagaatagcagcgggctataaattgatgcagtgtacggactccaagacacagtgtgtgtatggcatgtgggaccagttattgatagtgtagtatgtaactattgtatgaatgagctattagattggttatagatgaattggagctggtaattagataagtttaatagnaacgccaaccggccagctccgattcatctatagccaatctaatagtcaattcatataatagttgtttaatatactattaatatatggtcccatctatcatacacaccgcgtcttatagtccgtgctgtagttggctacatatttgtagcccgctgctcttctctcttatcttttatctcactaaaatatgtttatagctggctaatagtctactattatacctgctctaagcgaagttacacgtaagcacatttcagttggtcctctgcatgcattcacaaataggagtatataatatatcgaatcttcagtcgagcttatgaattccggtcctttggtgcattctcggcagagcattgcaaacgagattgtgattaagaaactatgcattccggtcctttggtgcattctcggcagagcattgcaaacgagtaagaaaatatgctgacataaaatatgctgacataaaaatcttatagagagcctataaatctctacaagagatccatgtcaacatattttctacttggaagatattaaatgaagagagagagcaaaactatctactaacctggagatagtctatagagaaaaacgaggcaatgcattagagagctatagataccgatgtagacatactattgaggtgatttactattaatctagtctattgctgagatgtacatgttttatagagagcaacttactttaccattgcgggtgctcttaggcagtaccagtttttattaacggatgcagatggaacggtccagatcagccaggcgcactgttcatcgtactgtagcagaaaacactgtagcacagaatactgttggtgtggtcactgtatcgctagatgactagatctgagccgttgatcacagaaatggatggctgaaattgcatgcagttcttaagttgcagtcatagctataactgcacctgatctgaatcggagttagcattggtcgctggactggacgaccaagggggttcggaatttgtttctctatccgaaccccgcgggtcagaaatttctttccctatttctcctagttattgcagcctgtattgtcaccttcttcgacgacgtttctatgtcccaggtcttttattgagggtttccttttctatttactattataaaaattaaagatgttttttccggtattttagtatgtcatatgtgtttgagtcagtttttaagtttgttcaccttggaaatacatattcgtgtttgagttggattttcagctcgtttacttttagaaatataaaaggagtcgtataataaatctcttttaaaaaactcatactaacttgagatgaaacacataatcctaattgcagctcatcattttctaaaagaaatattcaagcaaattcccacagttaattttaccaaacctaaaccatataacaataataaaattaaaatagaatttacccgttgcaatgcacgggcttttttttctagttcagaaaaaaggtaaaattgcataaaccactccaattaaataaaaaacatgaatattatgaaatggtctgatattaaataattagaaggggtgaggacctagacgggctagcccacctctgttttttcctgtcttctgcggtgctacattatcgccattgttgcaagcatcaacaattccaaactgtttacatttcatttgagactctgggattcagtgattttgcaaacctggacgagtgagggggtcggacttttattctccgaccgattttctttttcttttttttgttgtttttcctatcgagggtatggtttagagatttatcgctttcactcaatcaagctactgatcgaattggatggctcctacaatttttttctctcttttttgcgagagaccagcaagtcgcggcaaaagtgctgagatggagcatggccatcttgagatgaaggttgacactaacagtgatcggtgcctgtcgatctcctccattgccaactatataatactccctccatccctaaatattcgacaccgttgacttttttaaacatatttgatcgttcgtcttattcaaaaacttttatgaaatatgtaaaactatatgtatacataaaaagtatatttaacaataaatcaaatgataggaaaagaattaataattacttaaattaagatgaacgatcaaacatgtttaaaaaagttaatggcgccaaatatttaggaacggagggagtatcttcttcgccattattggaggaaccatcgagaattcgaattatagcctgttttgtaatcaaaagccatacataagaacaattcacatctgtgttcagaaatacgtcgaatcttcagtcgacgagcctttgcattccatcccttagggcctgtttggcacagctccagctccagctccacccctcctggagctggagctcagccaaacagtttcatctccactaaaactgggagtggagctgtctcacaaaatgaactagagttgtgaagttgggtttaggcagctccacaactctactccagacccaactcctgaagttaaatttaggagttggagctgtaccaaacaggcccttaatttgagtcgtggagtctgtatctatcattttggcaatgcaaaactaagatgatctcccagcaaggctgtgccaactactctttttctgtttgggattaaactttagtgatccaaaataacaatctgcagaaccaacaaagcaaaaccagccagtcacacaggcttgcagaaccaacaaaccgtgcttaaaaaagagataaaatatgtatcttaatcagaaaaatgctctaaatggcatataaaaataggctagaagaacaacggcaacttctccctgaaaattgacgaccctatgtgttcgtaatggcccatgtttagcaggccgccctgta

SEQ ID NO: 61364 - DNA, 5160 bp, Oryza sativa
atatttttggacaacgttttttaatgtgatattataaaagtctttgtcgagcgctataatagggaagctaattttctagcaaatatacttaaacatacgtctattttaaagtgttcttgattaggttgatgagcctcataattttttttgctaaacattctagctaacgatgtaactgtattttcatacaataaaacgcgccaagtggctttcctaaggaatatgaaaaagtactaccaaaaataggagtacaacagcaaagcttccaacaccgtccgattctcatagcgaagatcagaagcagcataaagccactatctcccaagcgagatttttctttaccagaagcggttaaaaaaatgcagaaacagtaaaaaaaaagaagggaaaaaaaacaataaaccggagcgggtgaaacaaacccgcttcagttcaaagcgttccccctgttcatttcgacctctctcttcctctcccgtcgtcgtctcccccgtctccggctagggtttcggccgctcgccgccctcgcctccgcctccgcctccgccgccgccgctcgccagggggagcccttctcacctcaccgctcccgtctctctctccccgtcgaccccgacgggctacggctctacaccctccccgcctcggctcgtgtctgttcgcccgcggggacgctgtttccggcgggcggaggcgcggccgcggcgtcgcggctcctcctcggaggcacggtgcgggcgacggccctcctcctctccttccccgaccctctctctctatctcactctctctgccctagccttctacgctgtgtggaggcgtcgtcgcgcgcgcgcgcccggacggcgagcatctggatttgagcctaattgaaggtattttgttcatcctcctatgcgatatgggcttggatttatttgtttctctctaattaacacttccaattcgttcgatttgcttaattttgttgcatgcgtggtgtggtgctaatggcagtttgtttgtttccaaaaataattttggggtacagctgaacccccatggcccagtttaggtctgcgcctgtggaaagcgaggcggagccaggcgccgatggccctgtggatgaagccaatgctgtggaagaggagaaatctggtaagggtgaggatggcattgaggaggctgccgataccgttgattccgtgaaggattcagcaaagcctgaaggcatggatgcaaaggaggaggcggtggagcaggagggtggggccgcagcggataaggcaaaggatattcctgtgactagtaacggtaagacggatgctggcggaaatgaggtggctgaaatgaaggttgaaaaattggagaatggtgatgggcatttgaaggcggacggcgatagcaatggtgataacaagggtgctgatggtgagaaacagcttatgttagcgtcagctggggaggacgtggaggacccggtgctgtccaagcttgcaagcaactccttcatgtttgattacagctgtggtggtgatgactcggggactgaggaggagcaggctgctttcatgaaggaacttgagcggttttacagggagaagcttatggaattcaagcccccgaagttctatggtgaagggttgaattgcctcaagttagtacaaggacctctttgtctgtatgttagaatttgttatgtgctatggacatgaactaattttatcttgattttaattttttttataggttgtggagacaagtgactgggttgggtggctatgatcaggtactcattttgatgccttattgaataatatctgaccatctgggttatagtgtcttttggattacttgcttgctattatgcattgcaatggacagcaaataaatagactacaaaactcaaaacaaaaaatacgaaaaaaatatttccaactcaaaacttgtatgaccacatgagatcatttggcctatatatgatcatgtgaaaatgatgcatttttccttattaaaaaaacttgcaaacaatacatccatgtctaccacgtatatatagccacagaagatcctctgaactgagggtggctgtagaacacacctgtcactcccaaaaggttccaagtccttttgtaagattaaatatttactttctgcacatattatgtatttatgagctgggaacattaagattataggactacaatatactgttttacttattttttccctttataaactagttcaagaaaacaaatccaatatatgtatcatacagggttggttatgtgagttttttttttggcacttcggcaatatgcttatccagttgttacttccttttgttatgttagaatggaaggcccatttggaattttgaaaatgattccaacagcaagctataagccaagcaaaacaacaacaaaaaaaaaaggatttaggcttttagcatgtaatgagtttttggtatgccagtttgttatcataacgtgcatatctgattccacacctgtatataaagtggaagatgtggattttaatttgcctacctatttttctttccatataccatcagatcctattaatttgatgcattgtgtgcaaagtgtctgccactattatttctgaatctaatctgttttcggaccttttctcctgaaatattcaactgacctgattaagtgagtcaagaaaatagagatcaaaatcgacacttctatttcctacagtacatacaccaatcatgatgacagttccatttgcacagtagtgagactgaccatatataagttcagttcttgttcaccaaattgatatctctaagctattattaatttctttgtgttactaaaatatttatatgccgcattgtgatttcgtgacattgttgtataatctttaggtaatgtgcactgcatgcttgcttactagttgcatcaacaggtgacatcgtgcaaactgtggcggcaagtgggagagtctttcaaacctccgaagtatgtatctgatttcttctgcattctgttcaggccatttggtgaatctcaattgaattgtgcaatgatggaagctcgaacttggttggcataagctcagatttgaatactctttatgttttatgcaggacatgcacaactgtttcatggaccttccgtaacttctatgagaaggtatgtagatttcagagcctggacaaccttgtctgcagttttagttctctagttgcagcactgttgtggttgaatcctgtattcccctctcacgtcatgagccaatgacaaccacagtagttaattgaagaaaaaaaatcaattcatttaacatattctaagattttgcatgattcttgtaaaaggagtcttgaaacaaaagtacacgcaatactttggaagttttgccaaactgtcaacataagattatgcccttaaatgcgatcccatctcgatgaccgtcacatagatgtggatcatatttgaggctattttctcttggtttatattacttggtagataagcacaggtgctggtttgcatgatttgtttttctctttgaattgcacaagcagaatgcagcaggaacactggttcttatctggggaaactgcgtgtataataaaatttaaacaccaatgcattttgtcaagagtagtgttgtattttaaatcagcattggttttatttttgcccccttctgtctcgccgaccctctttattgtttttgttccatgcaggcactccttgaatatgagaaacacaaaatcgaaacgggcgagtttcaagttgctgcatctaatttaacagagaggattacttctgaaagtcaggtacagtagtatgacggctagcataagttttccatgatccctgtggaaatcagacataaatgggtcctgtttctaactattatttatgtcccaaaatataagaaattttgggcttagacacgggtagtaagaaagtaggtgaaattaaatggggaaagattgtgattggttgagaagagaatgtaggtagagaagttatattttggaataaattttgaaatgctagaagttatattttgggagtaatttaaaaggaactgatttcagatggaatgaagattcattctgcatttaaatttttgacttcctttattgcagatgtttgtttagttgtgttaaatacttcagcaggaaatatgttatttttttgagatgtgtaagtaaggatcttaaaaaggatgagcttataatcttgatacaggttggcatccatgcttctggttctggaagagctagaagagaatctgcaacccgagctatgcaaggctggcactctcagcgcttgcttggcaatggtgaaattgctgatccaataattaaagtacgtgttcgttcaagtcaaattgtcattagtgacttgcaatttgttgtatcagtaaccttttgtttttaccaggataaagggacggtgtctgtcttaaaaaaggataaaactcctaaaagcagcggtaccatttcttgatttttattttttaaacatcatcatgctattatttacttatgttgctttttttaggttctgccaagaggaaaaggacaccgaccttggaagatgacaggattgtaccatataaacctgacaagctacagtaagtcttgcagatgattctctttcctttgtcatcgagcatccacaggaatcatgtaatattactgtaggcaccagtctgttcttttgaatgtcacgatgatattataaggctcatccagttaactatttgggttttggcatgccaattgattttttcactcttccaccctcaatttgtatggatgtgaaactgtgaactgatttcaattatttctatttggcagaaatgactcaatggttcttgaccttggccctccagctgattgggtaaagataaacgttcggagaaccgtaagtatctcatttggatcatcatattttacctttttcatgcttttttggcctcttttagccacttgcccatattttccagttctagtagttctccacagaagttctgaaaaacaatgctagcgaaacgcatattatgtttgaaatctgtagaactatcgtggaagttagaaacagcatgtgttaaccagaaatcaggggaaacatatttttcatggtcattttgtaaaggaaaatatcttttttcttgcagaaa

SEQ ID NO: 61365 - DNA, 2129 bp, Oryza sativa
caccaagataagttctttaaaataatatgtagtgcaggaaacaaaatgggggtggagggaggcaggtggagctttgggagtgggataagcaaagatagtgtactataccttgattatagcaacgtcagcagcaggaggtttcaaatccagggcaatgccaaagcaaaatacagccttgtcaagaatgttaagttgcttgtaaatctttcccatcagtgcatacatactactttcatgaggtgcaatttcctttagccgttccaactcatccagagcatcagggtatttttgtaggcctagaaggattaaagccttttgatacttggggagtggattcttcttatcagcaaatatagcgttctccatcatttccaaggcttcctcattcctctgaaagtttcgattcagaaagaaggttcatagttaatcattgtccagatgatgatgaaaattctagttttgagggtaagtggaaaccaaaaattagtatatggtactccctccgtttcgaaatgtttgacgccgttgactttatagcacatgtttgatcgttcgtcttattcaaaaaatttaagtaattattaattctttgcctatcatttgattcattgctaaatatatttttatgtaggcatacaattttacatatttcacaaaatttttttaataagacgaacggtcaaatatgtgctaaaaagtcaacggtgtcaaacattttgaaacggagggagtatcttgcaacgtggactactggagtgtgtggatttagctgctttagctttaacaattcgagtaggactatgtttgggcagaccaaatattacttttttcatgtgttcaatcttcttttgtatatgactttaattgtttggcagttattgagatgaagctagatagtgagtaaactgaatccgatacttgtttgctgtaataagagtcttttcagttttctcatcgctgatagcgtgtagttttgttctcttagttcgtatatgaccaggatcacatgttgtactaaatgtatactactcatgtgcacagacaaatgtccagttgctagcgacttgctaccttcacaacaaccagccatatgctgcataccacatcttgaaaggtaataacatatgctcaccacgtgaccacttattattgtgtagaagtgaaatcacattatttaaaaatcaaagaaatgtgaatatagtatctgtccatctttttgggcacatttctatcctgttttgtgatttcagtatattttattctgtggtcgcaaagtgctttggtctttggagcgatttctgatttttatttctgatataacataaaggaaagaagctgccagagtcccggtacttgtttgctatgtcatgcttccgaatgaacctcttacgggaagctgaagaagccttgtgtcctgtcaatgaaccaaatattgaggtatatagcatgtttttaaacattatttgttcattgtgttcctgaaatatatttcatccaacgctcttaattttttcgtaagtgcttgaactcaagttttgttctggacaaggggtcgcatgatgtatcatttgttccatggtgtcttctggattccaaatcagaagtagaaaatgggatgtgcagcatgtttgattattcatgaattaagagttccaaaactggtgatataccatttgaaaacattaagattggttgcctgtcaatgaaatcgtatcaacaatgttatcaatgtgaaaacaagaagtgtatcatgtcttaaaagaaaatatgcatgtatgattaagtgatgtacacgagaaacattgtcactacaagttgatgttttgcttgcatagaaacgtctgcagacatcttttttttctttgggtgcatgacagcattttgaggttgtccactaactgtttgattccacacgggtgaagtaatgatgtggaaaaaaaatcagtttgcatctttgcttactgttatacttcctcccttttttgcaaggcttcttcaatacttttccaaaatataaggatgcatgtgagtttattgcttttattccttgtttaccctcatttttgacataatacctcttaaattaatgcgaatgaactcactaaccatcagctctatatttcgaattt

SEQ ID NO: 61366 - DNA, 1400 bp, Oryza sativa
tgcttcctgatcattaagtgaatgaaatcaaccacataacaggatagtaggttagcatttccaacacaaacatcgtgaacatacctgacacttaaacaagcaagaaagcctatacccttcccctagtgtccgcaagagtgccattagctccctgataccaatagctaatttggagtcctgtgacagaactcgttcagatttctcttgctcgggatatcttccatcaactatacttgtagaagacgaagttgaagttacattatctgtccacatttcatcaacaacgtggtacctgtttcctatggttcagaaggggaaataaaaccatcgtgaatattaatgcaccattcatatagagaaagctgatgcgattattatgataattataatttcacaaaccacgtaattatgatatcgaaaaggataagttgatggattggatgatcctgcatccagtgaaggagaaggatgtgtgatcattttaaaagtcttaagtgttagggctcttgaaacaggattcatggtgcaagaagttcctttcgatttttttttatcacaataatcaggaaaccttatccataggagtgaaaagttcaaacaagcaatgatacagtaaaaatgtatgaatctggatgtaaatatttatgtattttaggaataatgatctaacatgaggcgccaaagaaaaggataagcaattctgcagttcatatgctacatgaagaagaaactaaaaacaatatgataacggagacacttcaagggttgaatgatagctgataatgttctggtggtattatagatgcttaaaatttcagctcaataatagagatatttaaaaggtatatggattaacatgaacagccaataaattcggtgagtagttgcatgatgtttcttagcatcctaaatgccttgtgagttgtggcttggtgtcattattgtacttttcaagtacaatcaatacaatattgatgagtgagttttactaatgtgaacccattgcacatgaacatataagcaaacatgcagatatatcctgattgcagtgtctataacaacatatcaaccacattttttgcgaggcttatataatttgaggcttatataatttgaggcttatataatttgatgagtcatccatgtcgaaatggtaatcaccttcatcaaaattttctgttgcctgtggtttccctttcctaacttgcacggaacgtagagctgttgaacacaattttgatggtgtggacgagtttactcgcaatttacctgacgagtgatctgttccattccctccaaattgagagatatttgagtttgagtttattgttgtatctctagaaagtcttgcacttcttcgaggaactgaatcactactctgattaaacagccttccagaa

SEQ ID NO: 61367 - DNA, 1392 bp, Oryza sativa
tggttgaaattaaagatgatgtgactgaaaagttgtgtgtgtataacaggttgatgtgatgaaaaaggactaaagtttggttctaaactttggagctaaacacagcccaaattgcaaaaggtttctgcactctctactcaacctgctttggcagcttgtgttcgcagaacagccggtagttattactggttgttgcgacatgacatgggagcaataaccaacggtcagccagaaaaccgcatctatctatctaccattcattcattcattcattcaaacgtcaggttcaagaagacgaggaaaaagaagaagaagaacaaaacgttttcatgaagaatttggtaactgaagatgcagaaagtttgatcttgctcgatgtggagtcagagtgacactgaaagtctgaaaaaataaaggctttactaattgctactgcaatttttccaatcttctgcgaatgatacagtgtgttgttccaaatctccgattaataatcctcgcatcatactttggtgggtcaaactgttaactgcacaactgttcgttggcaaattcaaagggtttcgcgtccctggaaatgatgtgatttgtcacgcaagatttatttatctgctcataagttcttctaatcaagagagcaggtttgctagttacaggaatccattcgcagtgatcaatagagattggttggtccaaaatgttcatctggtaatcgattaacaatcagttcatgttttggctgtcagcagcaaaactgcagcttgaagcagttctgatgaaattcaacctagatgcttcgacagttcgactacttataatcgaataacaaaaactgcacgctcagcaagaaaattcttccaacagtttttttctcaaagaaattattccatccacaaaaattgttgagcgatgaacaaagggatcccatgaacaaataacagcgcatggcgtggagcttggtcagccgctggatcagggagcaacggcctggatgtaagatggagccacacgaatcgggcatgtgatgcgggccggaaaggggagaactattttattgggccgtgtgctcataaattgggccgcgtcagaaggtgaagcccacgcgcgtcgtactgcgggggtggcgctggccacctgggtccgttggatggggatccgatggtttgtacgggggcgctgcggggaaagtttagtaccacatcgaaagccaacagagaaggagagcagcttataaactcgcgcgctgcagctaggtcgtcacttcggtgacatccgataaaattggaacgatacagagaagattagcatggcccctgcgcaaggatgacacgcacaaatcgagaaatggtccaaatttttttgagatttctgcccaggcccctgcagcccata

SEQ ID NO: 61368 - DNA, 1106 bp, Oryza sativa
atccttgcgcaggggccatgctaatcttctctgtatcgttccaattttatcggatgtcaccgaagtgacggcctggctgcagcgcgcgcggttataagctgcttatcttttctgttggctttcgatgtggtattaaacttgccccacagcgcgcccacggaaaccatcggatcaccatcccacggacccaagtagcaagctccacccgcgcgagcgtgcatgggccacctgcaccttctggtgcggcccaatgagctaacggcccattggtatacctgtttcggcccacaaacaagtccttgtggaaatgtggagctttcctctgtaactttgaaatcctgaattcttcgatttttttttatccccaatgactctatgagaattggaatctccattcaagtgtccagttctgtgtttgggatggtttttcgccctaagttccgtttattttccattggagcaattgaattattcttctgggatagtgattatcccagttccaggttggttcatcattcatcaaattgacaacacaacaacattctaaaatatattttatcttttattttttttaaagcatgagctgctatttcacttaatcagtaggcatgtaccaagcaatccaaaaggcagtgagtagagcaacagaaataataaagcactcatgtacatatgcgcagttcctgagcaatagtaacatattatacttcattactttatctacaaaaatatctcgcattttattcaatggatagcaggtatctcaaattttcaccagcatccatcaaacaatgttctctcatagtatacactggtcagctatatgcatcagggtactccagttgaacatttttacaattttgagcgccgtatgcattttatcggattgaaagtgccatgctgacgagcaatagaatttatatgcctcccgtttattgatgcagaaggcttgaagtcccagccttctacgttcttggggacgcatacatcgtaaagcatctgacccaacactccatgggggttgttaatgctttccacactgggcatgttgaacaactccggtttcggctcttcgttgctgctttcatgatactccatggaactcg

SEQ ID NO: 61369 - DNA, 942 bp, Oryza sativa
gtattggcatgtaagaacgtgaattaggaacatgaaagaagtcaggattaacaggttcgattgggtttctcagtaatggaccttgttgtggaagcatgagccatgatgtttccaccgatgggtttgatctgcggcccagcaaacatggcagaaccatccacttgtgccactacttgattagtgataaccacagccactccaaactacagtgagtaagcaaaccaaatttaggatattgaaacatgccagagtaaggactatggtctatggttattctgctgatataagtaccatgtttcctttaaagaaagacaatagaaaagaactaacctcatctgctaatttctgaaggctcctcagaaacttagccatgtgcatttgcctcgctgagagctcccctcgacctgagaaatcagttctgtacaaagctgtcgcgctgtctacaatcatgagagcaaacctgcacatgtgaagattcaaataagaactatggaggaacacctaattcaatattatgttaggtacttgtctgaagaacaaccataactaaaaatcaatgaaatatgtatcagttattttcccatgtttaaataaggattttgtgcaaacagaatcaaacatatgttgaccttgaaagaaaataacaagcaccacataacaaaatttagctcgaatccactcatcataatagaagcatctgtaatcatgagccattactttgggcatcctaccattccaagttgcttgaagtgtaaactcagtactatagcaatagacagcaatggagtactgaagttcacttctgttttgatggaagagatgcgtgcaacttagtctgtcatacgggccaaaaaggttactacagaaactaaggtttgttggcattacataatcacttagattcataaggacaagtactatcaacttagtttcctactgctg

SEQ ID NO: 61370 - DNA, 802 bp, Oryza sativa
ttttggggttcttgaatacggctttctgctttcattgccccttttcttgttagtagttttgttcttttttgtgctctgtaaccactgatgtggtctattttgcccttctgtgtagcttcaatttaccttatgccctacttatatgctaatttctctcttatatgcttaataattggcacagctcctgccactgttataagaaaatgttcatgcatgttattatacctgatcaatattgatgataacatgtcaacataaaagaactctgcctgcaaaattttatgctacacaccttttggccccttacatttcagttacaacagaatcacacatctgaattatgtcagctctctgatcatgtagttgtggttgcatcaagtttgatacgaaagaaatcaaccttttctcaatcattggtccactattgatcacaatagcattgacatcagaaacctaatatcgaatggctagcattaacttaagcttgggtttttcaagaaataaaccatgttgccattgtagaatgaaactgcatatacaattcttacagagagacgataaatgaattattttaagattacacatagattagcattatagcgtggtcatcaacatcattaacttcagatacttattcaatttctcttttgcagtatttggatgaaaataaacagctaattttggccatcctggaaaatcaaaacctagggaagttggctgaatgtgctcagtaagttgcttgctaaacatctttgaaaggctttattgctggattactatatgaaatgcttctaggtggctg

SEQ ID NO: 61371 - DNA, 1469 bp, Oryza sativa
  unsure (1)..(1469): unsure at all n locations
ttgtaagtatatttggcatgtaaaaactataccaacaaaattatacttcaatgtattttcatataatgttggttctgttttaattaacaaaatagctagtagtcaaagtttatatgtcttgaccttttgacttcataatacgccttataaaaagaaatggaggttactttcttgaaaggatctgaaacctatgccttttcatcctaatctaggcatgacatgtttccagattttgaagcatcggctttaatgcaatatgatgtatcccatcaaggcaatcttacaaactgaagaaanaaaatactgcatgaatgcaaagattgcttggacgttagcaatgcattgtggcaacaagatactgagataatactatccacggcattcatgcaaggcaaaagctagatatcttcaatgtaaattctggtaggcaagatgagaaaaaaaaagggttaaaaaatgtcatcaatacataaacaatattctgcctttgtgacagcaactccaggtgacaaggggaaacaaaaacaaggcaaaagccatattccacatgtttcagtaattcggaaggctgggctgagcatgcataaactcaggcccaacttcgaacaatcttttcctatcacacccacattcagataaggctaaagatccttctgagatgatcagaaccttcgtcgctttctccttgtagcttcttttgggaacttgaggggagctggaagtgtcattacagaggatttaaatgcaccggccgacgaagatttgcatcccagctggtcataatatggtttaatcatctggcgggtcattttcaggtcttcacatatatccttagggtcggatctgaagtcatcagcgtagagcgtgagtacgagaatgtagttgatcagaagctcgtgtttctctgttgacaaggcgctagatcctggttccgtaaacattagcaccatcttacgatatacatactgtgggatcactggtccactggtagcctggttttcctttctgtgccgcttggacatggagctgttccgtgccagcagggataggagatgtgtgatgtaggacagtatccaagcaagcctctccttatcttcaccctaaagcatataaaacatacacatattgcatttagagcatatggaataaaagaaacaactctacaaacacagtttttagttgagttcagtatgacataagttaaacagatggctgccattgtctcgagagcaatctgagtaaatatcttaataaagaggggaaaacatgcaaatcaggattgttctacatggcatcattgcaattgagtgtctgccatccaattctaggtagaaacagtttgctcacatcacagcaaaaactctgtaactgtcaactacaatatttcagcaaataaattctttttgcactgactaaaggaagatccgagtcaattaatagctacttccctgtatgcttgagtgcttgac

SEQ ID NO: 61372 - DNA, 4206 bp, Oryza sativa
actatatcagcaactcttaagagtttacaattaacacacctacaaccaccaaaagtcaggagcatttctcattaaattttcctagaagtggattattagtatatgcatggggtaattcaatatgaaacaaagattcaggagaaccagataaaaagaaaaccatcagtatttacctgaagctcctgtaatttattaacacgatttgacacaaaactcccatagccttttgaagaaatttctcctgactcaaaatgtcctataatatccacaaggtgcggccttatactctttggaataatctcatcaaaaagatatgccctttctgatgtatctgctgcaggatcataaggtggaatgttccgtacagttggttcttgactttcattagcacccacactggtatcagcattcccaaggtcaaggtccataaaagcagaaggatcattcctttgttcatttaatgactgccacttaatatcctgcaaggaatatatagcatgaatcaaactcatgactgtatccaaacaagcaagcacaatcatgtcatggtctgctgcttcgttatgcacttaagatgggtgtaaagtgaagaaattgaggtgatgtatccgttaagcaactcttgatgaaaaaagtatgggtatgtaatgtagaaaatgcaacagtataagcatccacggtccaaaaaaaaaacagattttagttttaaaccacctgtgtacagatccataaaatcattccttttattacatgaaaaaaagggggaaacaaaatttctctagatggttagatgtgcaaaactaatctaccagaagtcgtatatcatctgaatttctgggcctgcaaaatcttctgatctgtaaatgtgcccagaccctttatcctataaacatattatctttaaaaagtataacaaacctaatcaacttttgagtttaaactgcaccgtgcatgcaactttatacaccacgttatcaaatataggaaacagaaagatagtaaacccggggcataaacataccttggccttgtctttctgggttccaaacgccttggtaatatcctgtaccttcaagtcagcatctcctgctgatgatactgcctcccctactgccccagagtgctgcgaatgcgccagtttctgcacttcaaggtgcggatctagcctaagaatctgttagcaaatacaaatatccagagcaaaattacatatcctcatgccgtatgaacaacataggttcttcactttgaaatgcaaataattaattaatcacaatggtaaaccaacaaatctatatttccttagcaagtgctcaaacttcataaactatcttaatatatatcattatgccacatcattggaattggtaacaccaaggaaagagctagcagcttcacagctacagtgctcaagtccattgttcaattgccactcaattgcgccgctgtatgtaatgtcacaagtagaacaacaatttctactcaacactaacacatttcttgcccattggagccagcatgtcatcaaaacaaaaactgcttaaaacactatactgtgacaggacctatcacccatttcgttccaattagtgacaacagttatcagatggatcaaagcttgggtggaaatggaatggtgctcaccttgttggcggcgatggggacgaccttgagggtgccggaggccttgtcgaggacaccgagcgcgtagccagtgagctgcggcagcacggcctcgccggcgtagctccgcccgacgaagtccggccctccgccgccaccagtggcggcgccgaccacgagctcgatgcgggatgggtgcttcgtgtggcggaacagcctcgtgcggggggcctctctacccttcctgccgccgccggcggccagggggtcgtagccggtcgggaagtaggcgacgacgggggctgcgcccgcggcggcggcgccggtgagggaggcgtccacggtgacatggacgacttcccgcttcttctcggggacattggtgtcttcctgcttcttggagtgcttcttctccttcttcttgggggaggcagcggccatggtggcatcgatggcttcccgcttcttcttggagtgcttctccttcttcttgggggagggggaggcggcggcggcgagggagtcgtcgacggtggcattgctgtcctccggcttcttggagtgcttcttcttcctcttggggaggaggcggcgggctggtggtccgccattggagacggctctagggcttttcgaggtcgccaattgtctagggttcttgaggttcttgtagcggagggaaaggggattggatatatgcatccaagtcctcctatagttttgtatttacattttggattattttccacgttttctgcacatttttttttgttctttcctaattcctactaccaattgttgtattagtagcaaagtttaggtccatcttatcagatgatgaattgtattccctctattttttaagattaacaaatcgttttaagtccatcttatcagatgatgaattgtagtccctccatttgcgcaaaaaaaaaaaagattaacaagtcgttttgattttggttaaaatcaatctacttactcttagtttaaccaagtttatagaaaaaaagtagtacttcaataaaactaatttggtgctgtagatattataatatatttgtctacaaacttaatcaaatttagagtagcttaactttgactaaagtcaaaacgacttataatctgatataggttgtatttcacactattgtcaggatatccacaaaacttggtgcttggtttatttacctcccaaaaagatctaaatagaaaaggtagagaattagtaaaaacctatcgaattttggagtttcgcggtaaattactcgaatttactaattgagcatagatacacacatcttcttcatgtacagtacttgtagtgttaccagagaatagggaaaattataacgaggcacatttgcaaatgcattattaaactgctaacttgtacaaattatacaatgtaaacacaactacatagttaaaaaaaaagagaactgaaatcttatgagaagtgacgtgagttgcagggcaacatcctacacagatttcccctccattcagtcactcaagtcagtatattacacatattcagttgcaggcttgcagctcatgttggacaacaacagattgactaattgagtaacaaggaactaattaacactgcttctgccgactcattggtcatacaggttgtaagtttttctattatgatcctatgtacagtgtcagcctcgcaagaatttatgtcaggagcatccacatgacaccaaccagcgattggtctgcataaacaagtttgtgtcaaacacacatgacgacataaaactcatgcaagaaagtgaaagaactactggacagcagatatagatgaaaagtacctcagggtgcttttgttcaacatggaagccatttctcatggccgctgctgcgtgccagagaccttgtacagcatagcgtgcactgcggctatacctcaaatatcaacagcaggtaacggcattttccagtaattccaagtattgtagtcctcctgaagtaaggaagaatttccatcaggtcaaggagcattgacaatatggtaaacatacttcgattggcagaacaatactctgtttacaggagtgctgatatatgtgcattatagaacatgacaaacctgctcagatgacgttgatatcggagggaacatcccattgacaagagcatggagggatgtgtatgattttgtatctactcgacgattcaccgcaacttcaccctgcacaaaatttacacacattttctaaatgccatctccaatatgttcactggctgggcctgatccaattatgcagatagagaaactttgttggatgtaggaagggaccatctgtctaagtgatctgttaccttgggatttataataaaaattttgcccataggaatcccaaccttgaggtaactaagctcatctgtatctctatttccaaatccagcatagaatggatttgagtcaggaggaaatagtgctttgatagcctgtgtgaaacaggtgaatcaagacttggtacgaattatttcatgagcgcaatgaagagcaagcaattattcaatgtatgttcatatatttatctttgtgttgctgagtactgaccc

SEQ ID NO: 61373 - DNA, 1672 bp, Oryza sativa
aaacataagatgtaaacatccaaaatttgatcaaaaacttgaaatatgatatttcatattttttatccaaattttgaaaccttttctcctaggggtattttggtcatttcgacaaatttgtacagtactaacggagactaaccggacggcgatggtaaattgtagaagttaagcaaaagtcaatggcatattatagaacatgataaagtcagtggcaaatcgtagacgtgtgacaaagtcagtggtatataatggattctctctaaaattttcctatgaagatctttaaaacaaaggattgaatcatattctaatctccgaaaatcttatagagattttggagaaaatttagtaagagtttcaatatcttaaaaactttcctttgagtctatctctcatccaactcccatgtttttctgaggtctaatcaaacggtattcctatatttgtcctatattttgcaatccactgttttggactcgtatttttattagaattctatggttttcctatttctatgttttttcattcctacgattcaaatgggcatagaagtttaagattcggttctttaatatatatatatatatatatatatatatatatatatatatatatatatatatatatatatatatatatatatatatatatatgtgctcccttttatgaaaaaaaaagaagacttatgtgagtgttcaaatacatagctaagattcgtttttttaagatggagggagctcttttttgtaaaaaaaaaaagagacaaacttattttgaagctttcaaagtcaataagggatagtaacatttagagagtttaacattgatgtcttcataaatcttctacgcaagaaaaattacacaagtacaataatattacagaatccttcttttaacaaacatgtctacatcaccttcatacaaaacataatctaagtaaacaatcaagcggttaaaataaatactactactaacaaagacgaccgagaatccgagatagttgatggtcatttcttttagggcttgttcactttactaccattttcaaccttaccttttttttataccaaagttattaaaaaatagctatatttagtttgttgccaaatttttataagtacatatgaaatcttactaaaatttaataatgccaaaacttagtaaagttcaaaatgttatcaaagtgaacaagccctcagataatgacagttgatggcgatatcaattcatccattcaaaatttatgaaaaaatttaaaagcaggtggttaatagtaaacgttagtggcattatcatgtcattgtcattaccaccagataatcccccacaaatctgaaatctatatatgctttcgtgttggaataattcacccgttcgatcccggaatatgctccgattcatcccttcttcttcttcctcttcttcttcctccatccaccatctaacattctaaccccgcattaattccttcctccccacctcctcctcccccaaaatcccactcctcactccccctcccgcttcgagatctccccctccgatccgcctccgcctcgaattggggctcgattcgaggtatcacatcccccaatcatctcggaagaatctcgatcggtgtgtgtggggattgagtttggagttggatttgattttgttgcggattcggtcg

SEQ ID NO: 61374 - DNA, 1542 bp, Oryza sativa
aaattatcagtgagcccattgatactcaaaccgagaaaattatcagtgaccccattgaagcgcaaagtgagaaaattatcagtgagcccattgatgctcaaaccgagaaaattatcagtgagcccattgaagcgcaaagtgagaaaattatcagtgagcccattgatactcaaaccgagaaaattatcagtgaccccattgatactcaaagtgagaaaattatcagtgagcccattgatactcaaaccgaggaaattatcagtgaccccattgatactcaaagtgagatgttggataattttcaagatgacactggaagggaaatgcacaccagggaggtcctttcccatgttatttttgaaacccatgctggtgagacaaacattaccattggtaagagtgaggagatttcacagtttgtcactgtaaaaacatgccaagattgttctgatgcaaattcacctgtttatgaaactgcaggtttgtcaagtgaaatgcatgacatctcttcaattacttctgctcaagatgcatgccaagagaaagtggtcattgtcagcagctatgagactgtggagacctcatataatgtgcctgatattttggttgacaaagtttgtcatgctgttggtaacccactggatgattctttacagcccaaagagcagtcgggagtctccattgaggaaatagaacatgtaagttttgaggacaaaccactgtcatattatggtgcttccagcaatattgaagacatgactaagctgggtattcaagaccaacaggtgccagtctttgaggattccggttcccaaaactcccaagaatttgttccagacaaggatatttgtgtggatactgttgttaatgatcgtagtgcccatatagtaaatgatttagcttgcaatcatgattttgtttttcctgctgcttcttccagtgttgaagagatatcaaattatgtgcctgataatcatcttcatgatgtaacaaaggacttcattgtggaaaataaaacatgcaatggagagcttaacatttcccttgtccaaacgtcaacaacgggagatgagaccacagaatgcatttctccatcagctaatattcctaataaagtagaactgcaaggttcacagattatttctgatctttctagtttgagaaaggttgaagcagaaagcaccacactagaagatactgaaagcagatctagttctgctagtggagtcgaaattaagcttgtgcctgaggctatatacgagccaagggaagaagcagaagcagttgtttcattctcagagttcgtagaagaaattcaatttcagtttagtgacagtgaaagctttgctgatcgaaagaccacagatgatgctgcatctactaaagaggcaggtgcagtagaacatgatgaatctgattgtgacacagaacaacagggagggaataatacaggtcttggaaataacctggaaaactgttctgattcatcaaggcctgagactatccctgttcctattccaggaagtgagtttcactcagatg

SEQ ID NO: 61375 - DNA, 945 bp, Oryza sativa
acattctcaaagttgcaaatctgtagcttgcaaatactgcttaaattcctcagtgaacttattctgtaaccttccttcagttgaatctcaaaattgtgcaattcttgaagtgaagttaatctgccaacaaaaaattcaccaaaaccgttactgccatatgatacataccgcagatgagaaaggttttcgatattattcacttgtttcggtgctgtacttattcttttcactgcagtaagcacttgcaaatgatagagtttagagattccatctatatcctgcatcccagagaaagagatataacgaaggtgcttattaacaacttcttttgccaaacataacttggttatcccttttaagctcaataaccgcaatcctcttagaagctgtacaacttcctccaatgcagctatccaaacatcgttgacatgataggagtcttcaatgataagtgaacgcaaattctcaaagctggaaattgccttaatctcctcggttgttaacttgttgaagtttgcaatccataaatgtctaactgtacacttgtgctgcatatagccactagattcaagtcttagacattcaccaacagaaacactgcatgccaattcatgtactaaatcatgcatcacataatattctgcgtagaatttgctacaaggatctcccactgtcgcaaaagtaaagaatgattttcttgccaattgcaccaagtatctttctccgatgtcttctggcctttctgttccactatcaattaggatcaatcctgaatccatccacattttcactatttcgtccttcttaaattcataaccttttggaaatatactgcagtatctaaagcaaagctgtaaatgttcaggtagatggtagtagctcgactgaagaactgttgtttttttttttgacgcaactgaagaactggtgtgataatggcactcg

SEQ ID NO: 61376 - DNA, 1011 bp, Oryza sativa
tgggggcacaatcaatggatttgtttatgccagataaataattctgcaaatgatttggctcagtttaatgccgtcagctgttcgtgcaagcacaaccagaaccagttgcagtgtcaactggtctgcatcataatataaatggctctttgcagtacaccacgaactaaaatgatggctcaccatgaacattgaacatgtatacaatcactcaattagactgatggctcttccaaaaaaaaaaagactgatggcaaggtcaacattctgactatctgcttttttatgcgctacagatggagcaaccgcgtgaacgcccaaattggtgaagatgattgaccgcatcagttatatacttatgttagcagtgaatttttcagaagattcctttgcattttagaactaatacagtgcctggtggtggctaagagcgaggggcaaagaaaacctgggcacagattgctgccagattgtcctcagataccctttgtcaacagaaaaaatggaaagtgcgaagggtacagttgagctacttatctgggctaaaactcgggagcgaaccccgcgaaccttccaccgccgccgccgccgccggcggattcgaacggtgtgggcgccgcggcgccgcagcgccgccggctggagctcgctacggcgcggcgcggcggcaatgcccttccgggctccggccttcccctatctgatccttcgcctctccttctcttcttccttttagcgggccgagcaaacctatgttggcctgccaaaattggcccatgatgctgaaaagaaccgaaaatccagtctcgtcatcaggttgactcgtcatcaagatcaagaagtatttggttcgcttgcaaagtccgggcctgtacaaattgatggtatttccaatcataccattatttggtaaaattgacaattatgtggctacgcttagtttgttaccaaatattgacaatgtgtatagaattttggcaacattattaagctaattctaccaaaattttggca

SEQ ID NO: 61377 - DNA, 5327 bp, Oryza sativa
tattatagagaaaagttaacaatagctccaacattttggaaaattttctttgaatctatctcttatttaacttttgtgtttttcctttagtctatttaaaatattgtttctattttttcttgtgttttatattttttctgttctgcacttgttttctagtaaaaatcccatgtttttcttgttactccgtgttctcaattatatgtttcgaaggatcaaagaatctttagataaaccttttttaggaatggcccctcggatcggtatcagagccattggcatcaacaaatagcgagtcattatcatagtgaagtagaacctctgtcctatggatggttgactatgtggtcagacagttcagttagagcgccagtggcgttgagatggaggtccgtcctttaatataataatctaggatcagaggacttcatcgtttcgtttattgacggaataagcgaaacagtatatttgcaaacgaaaaataatttataaataagaaataagtatatttgtacgtataagaaataagttgtcaaaagtttatttataaaataaacttttatagaagattcaaatgcgcaaatattgccagcatttttgagccctgaactatctgggtttccctaacttgacatatattctcttttggaacagacaataagttttatatagctgtagaaacgaaaaggatgtgacaatctctgcccaaaatgtctcgtgtgtgtgcatgcgcgttctccctgttcccgacagggtgagagcagcatagtcactgcttgcaaacaccaatcaataattctactgcccaaacataaaaccaagccaaagattcgccaagatgttgtacagaattattcacaggtacattcaactgtacacatggccggatgatatttacaatgtcggacagtttcgttgtaccggtgggtatctgtaggatcgatgtgcacaccggcttaaaaatgttaaatttgttcgaatttagaaaataaagtaagattcacgtaaatctgttgaaatttgaaatttccaacgtataagattggaccttttcaaaagtggattttctatatagtaacaattcgacggaaaattgagggagaaatctatcgagtttttaacggttggatccgcgctgagatccatgttcaccgttggatggcgcatgtggggactcatcccgtgattggtaggatctcgtgggcgtactttcgtactggattaccgtgggttttgtatatttagaaaattgagagaaaaatatatcaacatttaaaattttggatgcgttcatattcatcctcaccgttggatggtgcacctggagactcatcccatgattcggaggatcttgtgagtgtgctttcccactggattatcataggttctgtatatgagtatattttccatccttgagaaggtatcatgaggcaccaatctaatctaatcgttgatttagcaggggtatgatcggactaacaaaaagaggtgtcctttcttcgtcgtccatgcccatccagcgtcgtcgtcgccaatcgaggccaccgccgccgtcgtgcatccagtcggtcaccggccgccgccgtcgcctatccagcccgctgtcatcgtcgccgttgttgccgtcgcccatccaattggccgcctgccgccgccgccgtcgtgcatctagccggccgcccgcgtcgcgcgtccagccgccatgcatccagccacccccgccgccgccaccgccgcgcgtccgtccgccctccaccgtccccctcgagcttgccgcgtctagccccctccagccgccgcgcatcccgccgccgcgcgtccgtctgctcgccgccgtccccctcgagcccaccgcgtccagccccatccagccgccgccgctgccatcacgcgtccaagcgcccgccgccgtccccctcaagccagccgccacgccgccgctgtgctctctcgacgttttttctttctatcgtgaaacagtaaaggacagaaataccctcccacccatagcaccacttcaatgaggaggtgcaggaccatgaggtacggacgatttctgaccgttggatgatgccagatcaatggtcaggatttggtactgcacaacctaaaggacagtaaaaaatctctttatatatagttgtacgtaacttgcagctaaattatattgtaattatatactatttacattacaatggtattataattatattgtagttatatttggtataattttaaaaaactttatgtttatcagctcctttttttaaaaaaatatccagattgtgtaccagataattttatgtttcaccaaagcaagtttatctagccatcgtttctctctcgttgagcaggcccgcacggcgcggcgccactcgcgcctcccacctgccacgtaagccgcagactaacggcgttcggccgtcaactcctcacggacagggatcagcgacagcgagcgtggagctacataacgccgtcgtcgtcgtcgccgtcgccgctcgctcgcgctgcgcggcgcggtgacgtgacgagctccgatttgtcggccgcggacgaacaccttgtcgtcgcaactcgcaagtacatataaacctcactgtcacacccacacttgccgctgctgtctgcagtagctcacctacttccaccttagctcaccctctccaccgtcgcagcgacatcgacggcgagctcgagctcgagctctggctggttcttgttggcaagctagctagctagctcagctctcgccatgggcaagtacctcaggagcagctgcaagcagcagcagcagccgtcgtcgccggccgccgtggcgagcgtcgccgccgcggcggtgtcgtcgtactcgtacctgacgctgcggagcgggcggcgcgtgccggcggcggcggcggcggcgggaggcagcgcctgcaggcggcgtcaccgccgcggaggacgccgcgggtgcgccaagaacggcgccgggagcgcgcgcgcgtgcggggcgaggtcgccgacgtcctcggcgtcgtccgggcagcggcggaggtgtgaggcggtggagtgctctcacggcggtgggcgggcggagctctcgcggtcgccgccgctggggaattccgtcgtcgtcgtctccggtgacgtcgtcagtggagaaaggtttgggtttaaaaacttatataatcatgtcaatttgacgccctctcctgtcatcctgtgtagtcactaataagcacaaatcttatatttcaaaattaaaccatacgtaagtcgaaaattttattttacaaaaggtaattcgtgacaattttttttctagcttagtaattaattacactgtcagtctgtcacacactcacactcacactaattaactcttgcttctactctctccaattcagaaagtctttgaagccaaattcttgttcccgcgaagtggcggcggaacacgccggcgagcacaagcacaaccctgcagccgccgcggcggccggccgccggccaccgctgtcgccgccggaagcggagatcgaggcgttcttcgccgccgcggagctcgccgagcgccggcgattcgcagagaagtacgtatacacacacacataatcactcatctctctctagcttgcaagcttaaagctaagctaaatcaagctaattagttaattaattaatctgcttaatttgcaaactaattacactgcgagctgccggttttgcaggtacaattacgacattgccctcgaccgcccgttgcaaggccgctacgagtgggagccagtgagcacgtgaaagggaggggtagaagtgtcaactcaactcacacccatgtctgcaactcacaagtgatgcaaagctagcttaatcatcagcagctaattatctgggagaggctggggatcgagttagtgaccttgtttctcctgctaattctcaattagggaattaattaattactcctcaatcctcatctccacctgttgtcagttggatctcactaccatatatatctcagctctgtcaattaatcttttgtatagttggtaggaaataatcaaggataatccaggtgatttggaggatgcttctgatgagctcccctcttgctaattactaatatgtatcttccacataatttcgcctaatttactgtttattactacttattaagccccttcaaaaataagtatttcatccgtttcacaaggtaagactttctagcattgtacacatttatttatatattaatgaatttagacatatgtatgtatttagattcattaatatctatatgtatatgtgcaatgctagattgtcttatattgtgaaacggagagagtaattgactttttcttacctatattctgatgatatgtagtagagttgatatttaattacacgtaccctagtgaggttagaaacagtagttggttgttggagtgaactgaaaatgcagacagtgccaaattttgatgtggccaaggatgtcactgacatgtgaaggcagttttggcctgaaagaagagcatgcaaaagtcagatcgagtacgtattcgagtgtaatttgttgttttgcaaaaatttgtgcgaggcttctttgcctgatatgcacgcatgacgatcacaaaatggctgcatgtacgtatgtatatacgtacaagcaaacacttgcacaggcatgtacgtatgtatatgtagctttgctgggtttgtattgaccttttgtgagtaaattcacatgaagcctttcaaattctctctctctctaacttttgttttcgttatagccctttctttttattctctctctattccatccagcacctgttgttgtaggagttaggctttatttgagtgagaaaaaagctattttcctatatggtcatatggaaaagattcaaaagtacatttatgctatattttcctagatggaaaaagcttcaaaagttcatttatgctattttcctagatggaaaagattcaaaagtacatttatgcaaggaggacctctaaaaggagaattaattccatgcttttccactcctctctagccccaatttgcttttggtcctaaaagaaaactctagactgctttcttttcataacctagccatgcatctatatatgcactggatttcatcttataattactctcttttttttacataattcatcttttactttgcttccctattttcctatgaattaagcagaaaatgtggatatacaaccctttcttacgcaataattaagtcaaagtgaggattaaacactttcggttcggtgaaccgatagttatatattatcgttcacccataattattttaaaattttcagac

SEQ ID NO: 61378 - DNA, 2221 bp, Oryza sativa
gccttcaattccattcgaacgaaacgaggagaagagagaggagagaggagagagaggggtttgtgtggctgcgagtgggccccatgtcgacgtcggcggcggcgtcggcggcggcggagcagcagcaggaggagggggagcacgggccgttccccatcgagcagctgcaggtactggctcgtcgtaaccctagcggagttcttgtgctgtgtcttctcttcttccgccccaaatggggggttttccaagggcgggtgtttcttggggattctgatccgcgtagtggtggggtggggggaggggggaatcgtgatgggttcttggagatttggtgtgtggtttaggttcttgcggtgttgtgggagattcttggtggaagaaccctaggttcttggaatcttggttcggtttcttgcccctggatggcgtcaaggtcgcgtctttcttggaattatcgccatttgtatgtgaaattgggacgggtttttcctggtatttttgttgtgtttgggcggattaggtgtttccgtggattcttgccggggaaagtgaaaccctatgttcctgattcgccccttctcccaaatgtgtcaagattcaagaacgagcatttcttggaatttccttttgtgtttgcggcttacgaaagaggggatattctcccagttctgtattgaagctggctatttagtttcttttttttttgcccttttttaggtataggaaacataatctttattaggggcatctaggtattcatggttcgttcttccccaaaatggattaaggttaggcttttctgaaatctgtgcagtttattgtggcgcggtcatgattcgtataagtccaaagagggggattcttgattaggcttttggggaggcgtttcttgggagttcataacttgccttttctccctgtatttggcagtaagacgatttttaattcactgtttagggcatgtgaagccagcatttaaaatgctaattctctcaatttgccatcatattttaaccgtaggctgtcctgtggattcttgtgttttcacttttggaacttgtttgcaaatcggtctggtggtaggctgtagcagcttgtattaattaatttattaattcctgaaagcctattatacgtatgatgtttcaggttgttcctttatgaataacatgtaaaaaaaagaggaaatcgttgtttgatcatagtactgttaatatggtaaataagttaagaatggatgcactcctattccttagtgatatactattttctttgcaatacaagtgacctgctgtacaaataatatctcatgatatttctcctcatcaatgatgcctagtagaattaaccattcttaatggtagttgcaattgcaagaataagaagtgccattatttcttgtattgttgtatgttcagtacttcagtgccatctaaaaagcttctgaggtgtagctagtgacaagctagtgtctgtttctatgtaaaaattatcatagtgatcgctcttctatcattaactcttgtgtgtaatttgtggttaaggcatctggaattgctgctctggatgtgaaaaagctcaaggattctggtctgtacacagtggagtctgtggcctatactccaaggaaagaccttttgcaaatcaaaggaattagtgaagccaaagttgacaagatagttgaagcaggcaagtaattatgaggctcagtacgactttgtatttcacactgcaaagttcctaactgtctaaaattttacagcatcgaagctagtcccattgggatttacaagtgcgagccaacttcatgcacaaaggctggagattattcaagttacaactggatctagagagcttgataagattttggatggtattgaactgttaactttcatggttttctttaatttcttcagaaatgtactgcttgtgatcattgagcaattctattttgaccaaacaggggggatagaaactggctctatcacagagatttatggtgaattccgatcagggaagactcagctgtgccacacgctgtgtgtcacatgtcaggtgacagcttattgatccaactcttatttcattgcgcacctgaatcctgttggtaagctaaattatgttaatgattgatattgcagcttccattggaccaaggtggtggtgaagggaaggctttgtacattgatgcagagggaacattcagaccacaaaggctgct

SEQ ID NO: 61379 - DNA, 6272 bp, Oryza sativa
  unsure (1)..(6272): unsure at all n locations
tgtattcctacgttagcactacaactctaatgtctaactatatacgtatatacgtattagatcttaaccgttgaaatctagatatattataatccaatggttaaattttttttcctttttctccgattaatgtgagaatttctagcccccacaacgaacgtggtgcctcctttcaaagctgttttaataatataataactagctaggtggcccgcgnaattacgcggctagtatccatacaaaattatttacatatgagtttacttaaaatttgttaaatagcttcctcgttatattaggatttaaaagactgaaccttatcatctctatttttctaattttatagttttttaaagtcacacttgccgctacctcttgctcttttttcacacatttatttgcttgctcgatctactacggcatctattcgtcctcctttgaactttaaaatagaaccttataaattttagacttaatcaactcattggctttcatttttataatttttagaagtcccatcaaacgccgccactctactccacttatgcacgtctgtctccttctctctttatcgtcatttggattttaaaaatcgaatataatgatcgtcggtgttcacttttaactttgtagaagtcccaccaagccataagcaagttagccattatactcctaaacggcccatccgatgtcttcccttttaattgtcattgatattttaaaattcgaacgtgattctcattatggtttatttttttactttcctgctaaccatcatgtttgtgctgcttaacaggttatccgtcatctctccttttaatcgtcattgggattctattaatttgtggttttgtttattatttttacccttgttgtcttccctctttaatatcattgaggtttatttttttactttctagaaatcccgccaaccaccgtgatcgtactgcttaacggcatgtccgtcgtccctccttttgatcgccattgggattctatttgggttttgtttatagtttttgaatgtcccatcaactgctgtcactttactcctttacgactttgttgcttcttccctctttattgtcattcgttattgttgcgttttctagatggatggtgtttattgaaaattctatattttttattccgatattatattatttataaattatatttatacttgaactcctataattatttttatattttcagaatttaatttgatttttatttcaaattttaattaaacttatgttatttttattttatattttattctgaattctaattaatctcgtattaggttcttatatgtactcttcatttaatattgcttatttttaattccgaatttcaattatttttaatttgtattcctacttaaactcttatgtcctttatttttctaattttgggttttattttatttttattctaaattttaattaatatcgtattgggttcctatatggactcttctttcaatattaattattgtttattctgaattttagttatttttaaaatgtattcctacttggacgcctaatgttcctggtccctttgctcatgcatacatgatattcttacattgttttattccaactgtattggttatttgattttttttatttctaccttgagttaacgtgtcctacactgattagatttgtactctggatttgattacaggacctccatgcaaatatgtccgactcttaatcctaatcataaaggtttaattaacttgccatcactgtatatagaataggccggtcccaattttagtcgttttctagttggacttcgatatttttcatgtgttaatctgcaccattgaaaaatctaaacagctacaatctaacgatcaaaatattttctctttttcttcgactaatgtgggaatttctagccccacagcgaacgtgatgcctcatttcagaactgttttaataatataatatatagatagatactagctcaactagttcgtatcgtacttgctatgttttcttaattgtttctccattgatgcacctttttcatacaaaatgtttttttacaaacagcaattttgcccaaaatataaaggttttcttgcattcttattctttctcatatatgacactacaacgcagattgagatcctcaggagaatccgacatccaaacctggtcacccttataggagcctgcactgagaaactcgcactcgtttgagtatttacctaatggtacccttcaagatcgtctctcagaagaacacagagaatctttctcatgggaagaaagagttaaagtggctgccagcatatgctctgctcttctgttcctccacgaaacaaaacctaatccaattgcccacggtgatcttaatcccagcaacatccttttcaacgctgaaaatgaatgcaagctctgcgactttggaatttcccgccatttagagtatactcaacacacagcaacacctctccatggaacaaaagaaccaaagggcacttggaagtatattgatccggagttcgagagttcaaaacaattgacccctcagtcagatgtgtttgctttgggtatcattttgttgcagctagtaacagggcaaagtgcagtgtttttagaaacatatttatcctatagttcggcaggtgtaaatttggaaacacagaatacacccaggcaaaagttgctcaggacactggaaatcgtggacagcaaactgaacttggaagacaagtacgcaggacacgttgtacaaatgatatacctaggcctgaaatgcagcagtaatgacaggaaacagcgcccggacttggcgactgaagtattgcccaagattgaaatgatgaaaggctaggcctaatgaggatcatattgaagatacttaataataataatcttgtgtaaggattcatctatgttttttttttttggtgcggggattcatgtatgtgttactgtgtgttgctgtgtgttaattatctcccatgttatcggttgcaagttgggcccggcgcttctattgcatagagtgcgaaccgagcgcgtcatagtcgagtcgtgcaccacgatcgggggcgtgtgggatggcacacgccgtgaaccgatcgtggtgcgcatagtggaggatcatggtgctttgcatgtctttgtctttccttttatatttgcaatgagaaaagaacagaaaagctgccgcttcatcgcagcaccaaacaccctgtgttcttggccccgttcatcatctagtcttgtgttcgagcaaaggttggtagctagatctatgatctatcgataggggttcgctaacattctgcaacaaatatgatattatgtgacaaaaaccatatgacgaacatgtaaaacatcattgatttacgacctattttctagaaaatcttatgaatattggcatcggttgattttaattaatgacgaattacgagacattttgtcgtacgagttcgggtagctcacaacacgacagagctttttgatagaactagctgtctgtatagttctcgtgatcccacagttaaccataattcttgtaagtatgagaaatatgtcgtcgtggaggagacattatttgtcataagatgagttcaccttcagattagaattcatattagagacatgcaatggtgagttgaattctgtctgcaccttgtagctctcgcctctcggccgccacgtagacagacttgatccagcaagcatataaacgaatcctactcgtttatatgccaaaccctaactaattgcatcgacgaaggccacttccctcgccgccgccgccgcggttgccgccggcgaccacgttgcccccacgccggtggcgcgatggacgttccgttgcccggcgggagcgtcgaccagtcggaggactactccccggcggccaccgtggtccgcttcgacccgccgctcccgctcctccgtgcgcccgtcccgtcgtctgccgcatccggcgagccacccgtcctcgccttccgcgacgccgcgagctggcgcgccgcgtgggaggccgccgaggccagcctcctgtcgcaatgcgaggtgaatcccccttctcctccgtgacctattggcaacattgtaggattttactatttcggagtagaattcgttatgtggaaaatgtgagttctcggttagtttacaggtgcggctatgagcaatgcaaataatttgctgatggatttgggtgtattaaatattgttccattggctaatgcaagtagttaattggttctagagcatcgaaagatttttacttaatagtttactgatggatttgggtacatcaggtattgttccattgcctagtgtatggtttttttgtgttgatgataaaggcaatttaataagtccagtgcaactctgcagttagaattatttcccctgagattgtgattcattttgcagctggccgagttgccttgcgctagttatgctaggcaataagtttagcagctgcatacatcaaacagagcaaaccagctcctggctactggagattagtggttggggttgacaatgctccacaacattgtacattccacaggctgtgttacttttgcacagtacaatgctatagcgtgtcattcatacatcaggatgtatatgacaatataatctttttagttttttggagcaacatggacactcaaccagtaagttgtaatgatcctgtgtgcatcaactgggagttttactctgatagaagggaggaacactattattttggctaataagtctcccttgtttaagggaagacagcctcccatgtatgtgctgctacaacatttgctaggattgaacatgctttacacaattgaatttctttttttgaacaaactttattgattccatatgcaagacaagataatccttcttgtggcgcattatgctattgatacagcagttcactatgttctttttgcatcttttacccttaaaagaagacgactgttgctactcttgcagctggccgagctgactggctaaagctctggcagtcaggaagtataacagctgcatacattaaagagagcaaacaaccagctcatgactgcttagctttagttgtcatgattgataatgctttcacaatatattcttgaagtgcatttacaattttgcagttttctctactgaaatactgttagtgttaggttctagaagtaataattatgtgtgatggaactagatttcaacggtgatttgacatatgcatgtatcctgtagtgtgttatgctgtcttctgtgtatcttattataaagaacatgaatcatacctttcagcttgttcctattacaatgcgcagagttatcattttaaaagcattgtgttggaactattgattcctctttgtgagctcacctcctgttaggaatttatcctctcagaaggattggacagtacttatgtgagcagaggttgtcaaatattgtgttcaggtgttgcttattgacaaacaatactgtgttgatcaagaactgttatatgccaagaaacaattcatgtgtgttagtaaatcatcaaaaaactaaagctgcctttaatatttttcttcatcttctagggtgccatggtctgttttatgcatttcatttagtataataactgatttccaacaggctgaatcaatatgtcttgcttgcatatatcttctcatccaccattgttgtgtagtgtacttagtaaagtctattctagtagagaatttacctttaaaacaaaaatgatgaatgagtaaggatctgtgtttcattccacaggctggggcacggtctgggtgttcaattactgcatcacgcaaatgcaagccaccctggtggaaaggtttattgggaggagcaccaactgactatcaagaaagagagagatgtgaagagcgtgagatggccgcttgtcttgaagcagcaagagaagcttgtgttaagtttgccaaggaaaaatgcattgaacccttccgagatgcaaggattgcttctgagggtcttcttgaaaatacaaagttcgccatctggggtgctggtagtaacagaacatcatcagcatccttgtgtatcgcaaacagtcagtacccgttcaaccctcgtcctggttctacgaactacaaaggaagtgatttgcttgatagttttccgtctgaagacaacaatattaaggacgatgactgaacaacacacctgcattggtaagaaatggtctatatatgttttcagaattggatgcatttcaacaagggaattgctagaagc

SEQ ID NO: 61380 - DNA, 1829 bp, Oryza sativa
gagaatctaaacccttttttaacgctgtctgtctccccttttatttggatccagtgaatgtgtgtgtttacctcacgatggatgtaccctgactgcgacacacatttggtcattttgggggaaacttgggagtactctgttgctggacacatgttattgctactcttcataactgtactgggtagcttaatgtcagaataacactaccttcttcttctgctgctgctcctgtaatgagcttccagcttgccagcagcttcagcagagcctgatcgaaatgccttgcagtgccaaaacgttatttacctgcagaaacaggaagtgatatcgacacatgaattcggttgggcctcgtcttcggccaacctggctagaaatttcatcagttcatagaagcaacgttcagttggcctttggaatcgaccatacttatcaccaacaataataataaataataaagtagataaaactcagctaacacgaaaagcatagtgcctacacttcacttctgaaaattcaggaactactcttcttatgaactatgaaggaaagaaaggagaaataaatatatggatgcaatatatggccagcatcgagcaccccaggccagcatttcgggatttggataaaacagttctcttcaatatgccaggctttcaaatgtcaagctgttataggatgtaaaaactgctcaaggcacgcacacataaaaatagcaattagctattgcagaaaccaccaatacttacgagaactcttggtcatagcctcataggtcacttggaacaatacagactatcagagtcgatgggatctgggaacagatggtaggataacagatagcaccctggaaggctggaacaatatcatggcacctttcatgtaaggaaatgcacagaaagagcgctataaaagtaagaggagcaagaatgccatggtattactattgtttcaaagtggaaaagtagtagtataattcttgtttcgaaacataattattcacaaaagcttggtacattctaattatgaccagcaataaggagcgactcccatgtcccaagcggtcttactgcatagatcattataatttcaaatgacaaacctagagcgccgataattcagttaacaaattgtctcatgaaaccttttggcattatcaaaaccatgaatagatttgacatcatccaagaaaagtgatcatggttttcaagtagtcacctaataccaaacccttccttcaaaacaggtttgtgctagggataacgaagtaacggacatggagcaaaagaagtctaatcacaaaagaagcctgtgataacgacaacagactggctccggaacaggttttaatcacaagcactacacctcatcagtgaaatgggcggggatagggacggcttttccaccaacttgtctcacatcttgctgatatgtccttgctgtcttcagcttggtctgcaggttctcccaggacttcgttagcttttttttgccagctccagcctcaataagatgatatctctgatagcggttttgcgcaatctcttcataaaacttgacaagttttgtgttcctctcagttaccagcgggtcattgctgatgcagtccttgggtatttcaaagacgacttgttcattaaactgttttagagagaaacaaaagcacgttaaagcaaataattaccagcaggaaaacataagaacaaaatacggttccagtaaatcttgattgacaacagtagatcagtcttagttacaaatatcaggtgataccgctagcattcttcctagttagcacacaaacacaagaccaattagaacatgtccca

SEQ ID NO: 61381 - DNA, 14394 bp, Oryza sativa
  unsure (1)..(14394): unsure at all n locations
gagccgtcttcccttctgtttttgtttgctgtatctgagggagaagatgtgatggtagattgtgtgagaattaggggtttctctctaagggtaggttctagatttgcaggatgagttgggcgtaaatctcaagtgtgaggtttttggtggcgaaatttcaactatagatctataaattttggatggggttcctcgagaggtttttggcctgtatatagctagctctagcgagatgtgatgtgcgacttgctgtagcgagatgcgtgctgtcttttcatgtgtaactggtgttaatgatgctgatcctgctgctatgtactgtagttggggtcaactgcgatcgggttgaagaccaaggatggtgttgtccttgctgtagagaaacgtgtgacctcgccactgctggtaattgcatcttatcctatttcttctatcaggctggtgcaattgttcaatagcacctatgattgctcactgcattttgacaatttagttcaagatttgactgaatttatctagctaatgtttgaattatcgatttcttaccagttcaggcaagataaatcttatccttaggtagacctgtattcttacatgattccatcaggatgatcctgtaaaacatggatgttgctggtgttgttcctcatgatcttgctgctttcatttttcacaactacatgctttttgtaatctccaacaaacaaaaagatgtagattagataatgctgtttagagtaattctgatggagtctcaatcttgttgaattttatgatttaataatatgatcagtttttctggcatgtgttatttttatttatgcaaatgccaacaaaacaaggacattcagtcaaacaaacacagaaatccaagtatttcacatgtcaaagcctggaacctaatggttcatggatatttttatttaaaaataaacaaggaatatattgcaactgaactctgaagtgctcatataggagttctttttcggttaatgcataaacaattcttttctttcagcaaatagcccagtttgtttttcttgtacgtcagctttatgggttgtgacaatctgacaatttattatatcttactctctgcgtactgtagtactttgtatgtcagtgctgttgttttttttgtttaaatgatatcatgtagaagtttttttacaccctataggcctattgcccatatatgtgttatgttaattaagaagttacgtaatacctctgcataatttgtaaaagttaactacttgattctgacagaacttgatgttagactcccatttcactcccaagtttctagtttttgtgtgtgatgccactcaagttatcttttctatgattatgcaggaaccaagcagtgtggagaaaatcatggaaattgacgagcacataggctgtgccatgagtggccttattgctgatgctagaacattggttgagcatgctcgtgttgaaacccaggtacgttcttatgcaattttctacatgttttacatattatggtcattgtatgttaatttcacctaatgtgtttataatcagaatcataggttctcatatggggagccaatgacagtagaatctactacacaagctatctgtgacttagctctgcgttttggtgaaggtgatgaagagtcgatggtgagtctcatttgcatgaaaacaaatattttgtgaaggatcaagattcaaaaattaattagcaggggagcccttttttcacttttgcattttgataaataggattaacaccataactttgcatcagtgtgttatctttggaggaaactacgcatctagaaattttgggtgtttcaaataatcccatgatggccactaatactgaaaattatgaatagataggctgtaaattaatcattttttctgcattttgttttgtcttttattatgtgactattgtcttattaaggcttagtggacatatgaattagttttctaaggagtaattgctaaaatacctgactataacaattttgcttcaccccactgggccactgcaagttactttgctgcattcttttcacccttttgtcgacatttcttgttgccaagcttaaactaatatacttgtttgttttgtgcagtcacgaccatttggtgtctctctccttattgctggtcatgatgagaatggacccagcttgtaagtatttatccctttttaccaaaggaatttccatacattagcgatatctagatacctcttctgtggttctgccctatgcgaccatttgttcccacttcccagatcgcatgaactaacctttatcgctccaagttattttgagtatttgtcgaggaaataactctataacaaaatggtcaggacaatagccattttcattcatcttgttttgttccattgctcttaaattaagttgatgtgagtatcatcaaatttaactttgatggtttctagaatagctagttatttttcgcttgaagattcaacaagtttttcaaaactcagccacagtcggcatttgaaaacctggtatatcaaagaagagttgtccaaatgttgcccatatgaggttctatagactatatacattgatacttttatttccagtttcttcataaggagcagtgtnatgtcatttttttcctgaatccagataagtgataggtattatgtatttcattgtagctgaggttctttattagtggtaagtagtggtaatgctgccatcatggcatctctatccagagacaggctcatttttcccgtcatgattgctttacaaggccaactagactctccttgtaccaatctgtggatgaattcctatgttttgcaggtactacactgacccatcaggaacctttggcagtgcaatgccaaggcaattggatcaggtcctgaagcacctgatagcttgttacaggagcagtacaataaggtattaactgttaaactaatcacagttgtgaagaacaatatcaaataatgatggactataaggaggtgttaaactaatcacagttgtgaagaacaagatcaaataatgatagaatataaggaggtgcaaaccttacaaggcactttggtttgagtgccacatcaacatgaaaactttcccaatataatcttaagaggactatgttttgtgcgagccatagtaatagaactatttaacaaggttgaatccaaatctaaagttgcagtcagacctatatggctatatgacatatggcatcaaactgatcaaagccaactacagttgctttcatgacagctgagaactgaagccttaattaatttctctatccaggtagcgcccaaataaatcagttactacacctgatcaaccaaccaccaacaaacagtgtgcacgagccgccagccagaaatggaagtcccaagtctatgatccctaagaacactaactacaaagcccctgcccacgtatatacatcaggcaaaaaatcccacaatcagatgcgacgacgaacagggggatgaacacacacacacacttcaggcagaatcgcaggcaaaatcaacgatgaacttggaaggaacagggggatgaacacacgtatgcggatacccaccccacgttacacacacatcaggcagaatcacaggcaaaatcaacgatgaacttggaagggtagggtctgcgcttgtcctgacgaggccaggccctctcacgcctcccggagtgcgcgtcgtcgaggactccgacggtggcgccaccatgatttgggttcttgctgatcggcccccccaggtactcgaagctcatctcgtcgccggcgtgggctcgcctcgccgccgctcggtggggtggatttgggggaaacgggagagagagagagaccaatgcgatgcgtgtgtgcgctcctcggttgaatggatttcactttttgaggtttttcctgccattaaaaaaagatggtgcctacctctttgccacaaaaaagtttgagcctccctctatgccatcgtccaactttatcgcgtcctccacaccaactttattgcgccctccacaccattccgtcactattctgtttggttttaactgtttagcagctctgacatatgggcccgagcaggaaaaatgttgctcttgccctttcactctctcttctctctcgattcccctctctccatggcatccgcgtctgcgtcactcccagccggcacccagccgagcgtggccgagctgctggacgcccgcgccgccacgccggcctccccttccctcgtcaccgccgtctccgccgagtcgagcggacagcgccaccggccacccctccaactggcgcccgaccacctcctttgcccagcggcgacggcggcgaggtggaacggcgcgccggcggtcgttagcgcggccttctccgtgtcgtctccgccgctcctgcatctcacccatgtctgcatgccaatggcagcttgtgagcttcacacagacacacactgtggtcaggagctccgatacctcggccatggccgccccggtctcatctcgattcactatctggttcacggcgagtaatccctgcacctctcagtgaacacaagaaatgttaatcagttcactaatctaatcactcctgctaattgctgtagctaattatttcttgatcttagttgcagatatatcgagagagagagagagattgcctgaagagcgttgcagaggttggtgacctctccggagccgcggagccgcagcgcggtgctgacgagctcaagcacggcgaggggggagctcgcgtcgtcggggtcaaggatggggaggaagaggctgccctggatgtcgtagatgagcgcatagctaatgcgggcgtactcgccgctgccgtagcactgcacgttgggcgtccactccagcgtccccgtgtcaaacgccctagcgggaagcccctgcttgtcggcggcggcggcgccgccgacggggaagacgcacgtgagggagacggtcctgtactggaacaggcggtggcactgcgacgccaggacgaacggctgcccccgcgtggcaagcacgcgccgggcgccatccctcaccggcgcccacacctggaccatccacccgccacctttgccggccagtgaaaaaaaaaccgccaccccaccttactcattataaattttacaaattaccacttgagcttcttaatattaaaaacaatcaaatctaaatgacaggcacataaaataaagttaaataaagttaaggctacaggaataacatgtttcatgaacaaatatttttatttgttttagaccatattataatatactgtctccttctctaaatatatgacgttggttagttcaattttgaactaacttacatcatacaaaaagacatggagggagtatatttttatctgtagcaaagcacggacatttagctagtcaagacaaaatctctacacataaataaaaagaatattggtatacatttagctgtgcaggaactatctagatatttctatgttatttacaatgtctttgcaattcattgaattgtctacttgtatgtccatgcattttcttgttcattagatgtcggatatgcattcgatatgcaagatttaagaatcataattattttttttaaaaaaagttaaaatcttatcataaatatgcgtgcaattggctgcacatagctggtatgcaatttataggttcaaccatggttgtgtccaaaacaattaagaggtcaaatgtcacactaaaactcaatgaaagtggacagataaatctacgaatttaagttatcatttagcagatccacccatgcatcagatcgaagcagagatgatcgatcgcggcgtttcttcatccaagcgcagccgagtagccgatcgatccgttgcactagtcagcgtgcttcgtcccttggtcgatttcaggcgacggtgccagctgctaattaattgctactcccttcctgctatcggtgccacgccatgctgatggcgacgaagccgacgatgcactattttctgggatagatactactttttccacttttttttcaaacaactatactccttttccatcgatgataaaagtagtatcataacatactgcttttgttttgaatatatatatactatcttttttttcggggcaatatgtatacatcaatttcatcaagtatacttcattttatggttcggtatatataccattcggtgaaaccaagtgatatacatatatactattttcttaattatttaataagtaccactcggtgaagtagtatgtacttcatcaattattttgctaataatctaataaaaggtacatgcatacataccttctatcgacgatggatactgcaattaaatagtatataccgcttcaatgagggtttcagtatatgctggatacttttaaaaaacagtacatactcattaaccgattgatttagtatatactgaatactaaaaaaaacagtacatacttcttaaccgagtgagttagtatatactggatacatgataaaaacagtacatacacctaattaaccgatcgagtatatactggatacttgaaaacactctacatactcctagtaccatgtactgaaaaattagtatatactactagtttttgaaaagagtacatacttcgatctactaactaaataagaaaataatatatcttaaattttgaatatggccattaattcctcacggaccgttgtgcatgcatgcaaagaattgaaaagaaaaacaaaagaataccagccgcatatgcagaattttgaaaataaaatgaacattaccttttttttgtttctaactcaactatccattatcaactaatggatatccaacaaaaaagagggagtacatacacctgggtgtacaaaacagtcgtcctataaatattggcttatctggatacatatggttattcaacaaccaagcctactcagctgcatacatggacatcatcatataggtggttgatagctacagatagatagtcgacagttaattaagtaaactaacagtagatcactaagctaagtgataaaacgtcaccctacatgctcagttggaggcaaggttaaatccctcatcaataattagatcggtcatctcggcgtcatccagaaagataccctcagctttggagacggcgactctcatctccaggttgttgtcgacgacggcgtagccgcccttgccatggcggacgcgccgtatgatcgcctggcactccgcgagcttgtcctcgcgcttcttgttgtacctgtccatctcccgcacgctcttcctgagcaacttctccgcctccgacgggttcgggtcgccgccgccgccgccgtccttgaggaggtcggcgacgtggggcagctccctccgctccagggagaggatcttgtcgaccagcttcttcgacagcgcgagcttcccgcgcgggaccaggatcgcctcctcgccgtcgaccggcaccagcgtaccgccgcttcgctttgagcctctcgccgccatagctttgtcggcggcgaactgctccacgcaatgggcggcggtgcagggcatcaacgcgatcttctcgccggcatcctccgccgccgccgccgccagcgcgacgacgcaacgcttgaggtaagcccgcctgtcggccatcggtggatggatgatttcgcgggaaatctcgatgattttgcagctaaaaattggggaattcgaaaccctaacgattcgaggatgtgtggggggaagacgaagggtgtggtttatcaaggcggaggcggatcctggccgtccgtttccaaagccgaatccttctttctctgctagtttcatcgcggccgtccgtctccgaagtcgaatccctcctcggaacgggccagatgaggcagcccctacgtgagattatgtgggctgcaaactgggccaggcccaataggggaaccagcaacgaaaagcgaaggaactcgtcacagtcgtctcttctactactactactattttggagaagttgggatggttttcccaaattttcttttgctttttcgatctaaactatcgatgtgtttatttgaactagcaaaatacatgtatgttgttacggaattaaaaatgacatcagcatgatgtagagatgaaatctattttaaattttagagcttaattttacaattaattagaggtttttgctcaccaaaatttccctcaatttattgttaacttgcaaggatgatcatggttgaaagctccagggtctacccgtgactttcattgttctaccatacattttagtttggacgagggatggacggtgggcctacatgtcagaattttggaagttggtggtgggtggtgccatggtggcagattcaacactcgctaccaccactaccttttaaaaatgataatagattttgatgcttgaatgggcaacagcagaagcagcagcgggcacatattggggagattcagaaaatgcacctgcgcgatctgatgcatgatgttgagcgctgcaaagcaatgacagtgtaagggttgaattttctctgctgttgcattgcatgtgttggtttctgctttcgtttctcatgttcttgttggttgacagggagtatgaaggcatacatgtggattgctcgaggcaagatgacctcactctacctgcccctgcagcaagccgttgattgaatcactgatgtacaagctgccagatccatgagggaagatgaacagcggagggatggaggaggaagacaatgggcagtttggtccaaaattttagaaagtgtgttgaaagagtaagtacactggtggagaagatgtttttactcccggttcgtaacctgtagacccggtttttcaaccgggactaaagatcagatagtgatctttagtcccgggtgcaaaaaccgggagtaaaaatccatactaaagagactagatccgattgctactttattcttttcttttcttcattgtttttaatatattgattcactctatcctatcccaaaatcccaaatcaatcatccccgaatagtctccaaattctcaaatcgatatctccaaatacatcacaaaatcttaaaaaaattacatcacaacttctacaaaattcatcacatattcacatcacacacaaatctcaaatccaaatcacagattctacaaaaaaaaagaatagaaaaagacgaacagccaccggcgctacgcccgcggccgccggcgtgccgcccgccgccgcgccgcgccggccggccagccctccgcgcctcgccgttgcagagagagatggggaggagggagaagggaggagggagaggaggagaggagggaggagggagaggaagagataagggtgtgactgtgtgaggagaggagttaaagaagaggaggagattgtatccgatccgcgtgcatccactctacttatatcgttcttttttcccggttggtgttaacaaccgaggctataagtagatctttagtcccggttggtaacatcaaccgggagtaaagcttatatcgatcttttttcccggttggtgttaacaaccgagactataaatagatatttagtcccggttggtaacatcaaccagtactaaatataaaaaaaatacctctgagctttcaaacctggactaaagatgtttttagtcccggtttttaatacaaccgggactattgtgacatctggtcgactgaccaaagatggtttctccacaagtggtagtggcatacatcgaataacgttataattatagtggcacgagttcaaataggtgaatagtatgtgtatctttcaaaattatgaaaataataatggcatggatccaattaactctttctattttgtgtctaggttaccacaccagtataggtgggacaaattcaacgtgccacatgagcaaataccaaatagccaagggaattgttttgctcgattttaatagttgaatatgtcgatatacccgactttgcggttgaaggatacgaataatatccgaattatatttgattgaggaagtcaaactacaccttttcctttcgtggctgattcccctattgggcctggcccagttggaagccgttttctcatgttgggccctacctcagctgtccccatggataagagggattcgacttcggagacggacgggcgcgatcatatagaagtatggaacttagtatggttcaggttttgtaaaccaattgttgctgataaatcatcgaaatctcccaagaattcatcgaaatctcccgagaaatcatccatccatcctctacgttcccgatccaccgatggacctggacctggaccgcaagcaaatcaagcgttgcgtcgtcgccttcctgccgccgccggaggaggaggatgccggtgaggagatccgtgtggtgccgtgccctgccgctgctgcggaggaggagaggcggcgatcttccaagaggaaggggaagaggtgcgcctccaatggaagcaagcctgcggggacgctggtgccggccgacggcgaggagatgatcctcgtcccgcccgggaagctcgcgctgtccaagaatctggtcgacaagatcctctccctggagaggatggagctgccccacgtcgccgacatcgtcgacgacggcaacccgaacccgtcagaggcggacaaggcgctcaggaggtgcgtgctcgacctggacagggacaacaagaggcaccaggacaagctcgccgcgtgccaggcgatcatacggagcgttcgccatggcaagggctacgccgtcgtcgacaaccgcctcgacttcagggtcgccgtgtgcagggccgagggcgtcttcctgctcccctgccatgtcgccgatcttatccccgtgggatttgatcttgtctccaattgagtactccctccatcataaaatttttatagcaatcttataacggatgttctactacaacaaatcctagtatattcagattcgttgtactggatggatacattctaggacaataaatcggttgccatattttgagacggagagataaaggtattttgggtgaacgtgacatattctaagacaataaagctagacaaattctcttaccagatttattgtactaatgtgacatatgcacctaaaatttcttataattttcacaatgaatgcaactaaatgtatttccatttactagtacatggtcttcttaagtaccacgatttgttaacataacatggcacccatgacaaacaatgggaagaaatcccacatcatgaagtaaacaaacacttttggccctgttttttttctccaataaaaattagattaaattttagatacttgtggcacgcttttcaaattgttaaacagtgcgtttcgtgtaaaactttatatatgaaagttgttctaaaatataagattaatccatttatcaagtttgtaataattaaaactcaatagatcatacgttattaccatatcgttttgcgtgacacttaatcttcatctccaggagatttaaacatcatcagtactgtcttaggcttgatagaaaatatactacttcctcctttgtgttccttcgatccaaagtgtaaacatttttatatgttttcacataattaagaaattagcactagtaaaaaactatcacaggtgccggttaggaactatgatcggcaccaacattagcaacctgtattaaaaataaaaccggcatctataggtttgcacaagcaaaaaaaaaaagaaaaaaagaaaaaaaagagccggctcgaatcgagccggaactcacaatcatcgtcactgcgccatgccccacatcgagttgtttgaaatccccaattccccacatatcacagattacagatcgaaacatattcaacaaccaaatcatccacaaatcacataaacatataaaaatttctacaaatcataaaaaaaaatccctcgggcactgccgcctgccaccgccgcccatcgcctcccctcccaccggatctgatggagggaaatgtgcggccagcgccgttgccgtccccgaggtccgctgtctcccctccagtcggatctagcagaggggagggcgcgaccaccgtctggcagtccctgaggtccaccacctctcctccagccggatccggccgaggggagggtgctcatgttgccacaggccacccgcccgcattgccgccacctcgtcctattgctcccgccgaaactaggaaaaatagaataggaattgaatgagaaaaggtagagaaagcttctagaagtgatagtgaagaggaacatgagagagtaagggagggatagagattgacgaggttcaaccgaaccaagtcgccgccgtcgtggctgaagctgtcgatgcctgatcttctgttcgatacctccctaggattggtgccttttcttatatatgatgtaccatggacttgcttgagagcttgctcttgggttgcctcatgggctgggccaatcgatcatcaggaagcttagtgggttcttaatgctacagtgtccagattatcttcaatcttgttcgatttccctttaagtgagctgcactatcacgctgctgattttcattactttcatgctaaatgaataatgcaataagaaattacgaactgggagaactactgagatcatcagaactaatttactactccctccgtcccaatatgcaacaacctaggatgggattagaccattagaccatcctaggacttcgaagtcctaggatgggtccagattcaaagtcctaggatgggtcccatcctaggttgctatatattgggacggagagagtaaaacattatctatagcaagtgttaccttacatgtaattcaaaggctgacatcgtttgaaggagtaccgcactaaaacagtgacactttggaatgccccaaatgtgcattcccattcatttataaaagaggtagttgtaacggagtgtgagggtggttgcaagtaagataatttttttataaaaaaatatgtggtgattaacagtataaatactacttagagaattgccaagatgcccgaaattcatcccaaaattctgtttttaagattcctaattatgtaaaagttgactcaataataaaaagtggaaccgtcctaaaatactaaacagaaaaaaaaatcgttattgggggccgatgcgacacgttttctcactaatagggagcgagaagaacaaggaagatgattttagtttctgggaagctggctatgagaaccatggaagccaactttttttactttaaaaacactgcagagccacccccacaaacctacatgtgccacaacttaatagcgataacgttggccacccaaacttttactccctccatcccactaggtgcacttgagaggagaaaaatgagagagattaaatgagagatgatatgaaacaggaggataattgagggtaagacgaagataaattagataaatttaaatggaatgtgattgatgtggtaagcactatgataaagctatatttatttcagaaaaaactattaaatatagaattgcacgaattgtacttagtggaacgaaggtactccctccgtcccaatatgtaacgatccgaaggtactcctaccatcctaatatataataatctagaataagattaaacccatcctagaactatgaatctgaacacaagacatacaccttatgtttgggacgtaggaagtagcaatgattagcaatgataagaactgtacacacataaaaaagtacgaaacagaggaatattggatcctggtattaagttattactacatccgttccaaaataagtgcagtcgtgggaatccgtgtccaacgtttgaccgtctgtcttatttgaaaaatttatgagaaaattaaaaaaacttagttgcataaagtactatatatgttttatcatataataacaataaaaatattaatcgtaaaaaaattttaaataagacgaacggtcaaacgtaaactgcacttattttagaacggaggaaggaggtgggacggaggaagtaatatatttagtcggctgacgtaaacaagtcgaatcgctttgctagtttcatcgcgaccgtcccctgtcgcccaaaccggccaactgaggaaggtccgacctgacacaacacaacgaattcgaattgggtcagggcgtcaggccaattggccaaacatgagacggaaagcgaactaacttgagacgcccgcttggcggcactaccagttattttctatatgtatactcctactttatattgtatcaaaaataaactatggttgggaagaaaccgaagatcaagatgactgtcgaaatgttgcaaccaaatcttggaaaggattgtcgttctctttttgatagtacatggtctcaacactgctgaaaacaagcaaatg

SEQ ID NO: 61382 - DNA, 1633 bp, Oryza sativa
taccgtttaacaatttaaaaaacatagtaatgaaaccgatgtaaaatatgtatccactactacataaacgatattttcaaatgacacccccaagcagtttacatgtactagctcataagtacctcctccctccgtcctaaaaaaatatgggactggatgtgacatattctagtataataaatctagataaatgtaggatgtgttatatccaatactagattggttttttatgggacggaggagcacatctgaaaaaaaaaaactggtttaggccagttgatggaccgttgcgacaacttagatatcaacttagaactgagaggccttgtttgttactaaatgagataaagatttcatttcatgttttattagcatgttttttaagaaaatattagcacgtttttcaaactgttaaacggtatatttcatataaaactttatatgcagaaattgatttaaaatatcaaataaattcattttttaaaaaataaataactaaaactcaattaatcatacggcttttttttattttgcatctccgtacttaatgttattcagcacttacgaacgggaccagtaatttgatcgtttagttggatggagtgtttgttgatattctcagtcttaatcgtaattttcacaatcttacgagtgccattactaattactggtattttgttggagtatgaccagaaatcgcgagccgggggaatcaagagaaatttcctaggactgaaaggacaaaacctgtgagactgtgattcgtttcccatgggaattcagctaggaacaatgtttcgtagcagacaccaaaataacaaaataatatgtagtacatatgaagcgagtgtaactcaattaattaacatattaccaagatcaagtttgaaatttaacatgaatacttgtatttacggttaattatgttttcagtgatagataacgtactcattgactgtgagccatctgtggtgatttcgtcaatttcaaaatatgttgtgttagtcttccagaaatacttataggataggtcgtcgacaataagacacccatcgtgacttcgtcaatctcaaaatatgtcggttcaatcttctggagagatgttgatgggtaggatgtgcgtgtgaatttatatggatgagtatacttgtgatgtgggcgttgcgttgttttcgtccatccttatatgtgagaaaactgtgattatactattgtaaaaagagcggatccgttagtatgatataacttgtaaaatcgcacgggtgtacgccataatgtcattttcactatttcttacatttttaagtttcattttatccgtgttcgaagtacgctggctgcaaggatacactctgcaccagtgacagtgaggccatcgatggacaagggaaagtgtcaggtctcaggctctcagctcggtgcatgggagagaaaacgaacgacacagaggaaattttgtccagaaaaatattaaaagagtgaaagattatatctatttataaagagcgaaaatggtgttgttgtgtacacgcttccatggagcatggcgttttgccaaacggattagttccatgaatcaaacaggccttaaacccttagtcatctcctaagcaaagacatcaagtctaattaa

SEQ ID NO: 61383 - DNA, 800 bp, Oryza sativa
aacagagccttagtgtagtgtctctattttgctttattaaagtctgagaataattgactttctgcaggacattttttacttgataatataatataatgcatactcattgcaatgttaatgttttgagtcttttgctctctctctctctctctagtctctgaattacagcaaaatgatatacaagtattttcttgtggatgcaacaaacatagtttcttgcttacaacaattctctccttccagttttatgtcgagtgtggggagctatcatgccagatgtatcaactctctgttgatatgggacttggtggtgttcttttctcctgaaaatgaagataaatatgaagattaagttttttacgtaaaatgaagtggtattaatatatgattgattgagttttaattattacaaacttaaaaatagattaatatggtattttagagcaactttcatatataaagtttttgcaccaaacacaccgtttagtagttttgaaagcgtgccacgaaaatcttaatcttcatccaacttttgttggagaaaagaagaggactttgaaggtgttccattcaacattgcatcacattctcttccgacgtacggagtacatgattgttcatgtttgcggcatgttaccttgtacactgttatgtgactctgtataatcccaaaggtctaaccttgttgagttatattgctcagacataactcaagctggttggttatgatcctcaccagatagaaatgaaaatggcaatatagtggtattcctctagcattcacactcgtttcgtgtttc

SEQ ID NO: 61384 - DNA, 2681 bp, Oryza sativa
  unsure (1)..(2681): unsure at all n locations
cccacgatataaggaattttcagtgtttgtcttgtaacgtttgaccactcgttttattcaaaatttttttgcaaatataaaaaacgaaaagttgtgtttaaaatactgtagataataaagtaagtcacaaataaaataattaataattttaaaaaattttgaataagacgaatggtcaaacgttataagcaaaaaaatcaaaatcccttatattatgggacggagggagtaagaaaaaaaaagattttaaaaatatatgcaaaagaaagctgcagatatcttcgggcccaagaaagcccaattaagcagcttagctcagctctatcgcattccaggcctgttaacatcctatcgcgttctttgcgtccacaattgctcaaattttcagcccaagaaaaccagaaaaattcccaacaagttttcaagcgatcaaaactaattcaccgacattcaacgtgaagaattataaactttcaactgcaagtttccaacgtggaaattatctggagtatccactggactccggccctgtctagttatgaaactaatcaaatttctccagattaaaattttcagcaaatttgccgtgtacatatatatatatatatatatatatatatatatatatatatattatatatatatatatatatatatatatatatatatatatatatatatatacagtgttaaccgcgtaatcancgcgggtcnaccatgttagttgaattaattatctattgatcattactgcatttcagagattatgttgatgtcgaaaacaacaaatttaatttcgtcgcaaagagttattaagtaattatgtatgattttatagggttgggttcttgacgccggtggcgaacctgattggcacggtgagagggcccaagtatgacggctcgttcttgcacgacaagatcaagagccttacccacgatgtgaccattgccgacacagtcaccaacatcgtcgtgccagcatttgatgtcaagtatctgcaacccatcatcttctccacctacgaggccaagaacgagcccctcaagaacgcccacctctccgacatctgcatcagcacgtnagcggcgcccacttacttcctcgcgcacttcttcaagaccaccagcccctccggcgagtctcgagagttccaccttattgatcgcggtgtcgctgcaaacaacccgataccgagcatatatcatttagtatgagaaatttaattcttttaagaggtatcaaaatttacatcagaaggtatgatacctcctaatatcttcttaatcaccataaaatcactcgtttagtatatataccttcaatctcaaaaggcaacatatcaattgtgcacattgttggtaccatcttgaacacaactttgaccatttgttgagtgctcgtgcgtgcagacaatggtagccatgtctatgatcagcaaggaggtgttgcgcgagaaccaggacttcaaattgggtaagccagcagattacaggcactacttggtgatctcgatcgggacgggaacggcgacgatggcggagaagtacaccgcaccggcatgcgcgaaatggggtgtactccggtggctctacgacagcggcttcaccccactcatcgacatcttcagccatgcaagtgcagacatggtcgacatccatgcctccgttctcttccagtctctctcctgcgagaagagctacctccgcatttaggtgactaccatggtttgaaattttggtttgaaatttcggcccccactggcaagcacaaatttccatgaaatttttggattatttttcaaatatttgtgcatttggtaaaaaattttcgaaattcaatcaaaatatgttcaaaattcaaataattttggtaaaaaaaacccggaaatcatgagattttcaaattttcggcaaccacggtggcaaccaaaattgcaaaccctagtgactactccctccctatgtttcatgttataagttgctttgattttttttctaatcaaatttctttagatttgatcaagtttatagaaaaatataataatattttcaatacaaaatagatatattatcataatatattcagcgtaatatttaataaaactaattttgtgttgtaaatgttgctaattgttcctataaatttggttaaatctatagaagtttgactacgaaaaaaatcaaaaacaacttataaaatataacacggaggaagtattagctattaagttgcatatgcacccaactattatcggtctacttgtatcattacattaatatacttctaacaccagtaaaaattaacctagctactaaccgaccaactagttcacccaaaagcttctatgttttcaccttctcgtagtcgtgacactaaaattgagtgttcgtgtatataggacgattcgctggtggggcacacgtcgtcggtggatatcgcgacggaggagaacatggaggcactgatcgggatcggcaaggaccttctgaagaagccagtggcgagggtgaacatagacactggagtacacgagcccgtcgatggcgagggcaccaacgaggaggcactcgctcgcttcgctaagaagctctcagaggagagaaggctacgcagaaacagcctcagttcctcttgagctgagctaaagctaagttagctagctagctcagttctagcta

SEQ ID NO: 61385 - DNA, 1342 bp, Oryza sativa
atgatgcttgtagtgacctgcaagacaattgtgaagaaaaactgataagttgcaacacagaatattgtagtcatagcgcaaagtagagataaagctataagagagtgataatcctaattcgtgcctggcgaagaaagtagtcctaatccatacatgtaaacatggcttgtcatatgcaacttctgagcgttgaaacgaatcatgcctcatgaattaggatttcagatgatttagtgaggatgacaaaagtttctcagcaacaaattcttgcaaggtggaatagcacatttttaatgatataagctagggattgattcaataagtatctttatacattttaattttaccatatggccaacacaacacatgactttttagacgttacgagattttagcaaatatcgatatagcatactatgattcttattatttagtccaactaaaactatagattacagtaacattcggatggagtgggaatataacaggaaaagcattaaagttttcatgtaaggacgcgagtataacttggtaaattagacagctacttctgagagttgcaacttcgaagggggatcacatttccaagaatgactaaaggcaccattaggccagcctactttggaccaacttttgcgtttagtattatttgataattttaagcaatgcatcggccgtcctttatttgaccaggacacaatctactaactatagcatctctactgattggaattttggaacttagccaatcttgtcccaagttatcctaactcatttccaaagatataatgaaaacatgcatccacatcttatctctcaactgactcaaatctcaagtggacttgttggaatccacagggtgtgggcaaacagataagtctagcccacaaatgggtccacaatataaattaaatcaattcaacactatttttggaaattttagagggccaacataaacaattaactcctagcactatttctggactttgtctggagtaacatatcaatagataaacaattactggggagaaatgctaaaagatggtcatattttgtcaaacttcatgtcatcctaatttaggacaatccaatactgaaaggaggtgtagtttgatatataacatggaataagaagctcacctacatgaggagaattttgccatttaactaggttcacatcaccaccaagctccagcagacgtcgaccaaatttttgaacaattgaacacggagcaagttcatcgtcttcagaacagaatatgagtattggaccaacatgctgaaagtacaatagaccaatgtttactcagatatccacaaacacttccgttgacaatcagat

SEQ ID NO: 61386 - DNA, 16199 bp, Oryza sativa
gacagtctcttacaagttgatactcctcctgtagtgagaagaaaatatatatgaagctttcaccaacatgggtcaaaattttcctacactattttattttcggcaatatagctctaggctaaactgtaatgagcaaagtgcgtacaacaaaggaagaaagcagaaaactataccaggctcagttgaccctcgcatcttctctcgatcagctgtcaatgaaaacatattttttttaatactaagacattggcagcaacagataaattgttgagcagaagggacatagagttccattacctgaagaaccttgtatgtgcagccttttgggcctccagagaatgaggcaaacacaacaggtacaggtctaaccttcagttcctggataccaaagacaaattcagcggatttcagtatttcaccgattaacaatcaaatacattggcatgtaagtatgatccacatggaaataaactaaggccaagttgaaagagtatccaacttgtaggagtgtgcatcctcttaaacaattatacctaatgactgaccttaactagttctgcaagcaccctatcagcaagcatggcagccttatcagggaaaaacctgcacaaaacaccaaatcaaatggtatgatcagttcaactcatatatttcacctagattaaatatctattttcataggttttccaagaacaagcaacatgatatctcccctggctatccggcatacgccagttcatccaatttgccgatctagaattcttgaacagaaatatagtcctacacacgactaactgattacacaggagaacgaattttgctgtcctcctattccaatcctgagaactgaacaaaactaaaattctaaaaagcttctggaattaatcaaaacagtccaattaatcaaacaccctaaaatttacactcatcaactccaaggagtcggtgccaggtgttcaagaacacttggaaccagaatcaagacaaaaatataatctacttccttgcacgcctgtacaatatcatagtactatcatctaaatcattctcccacatccacgcgccactcaccgacccccaagaaccaccaaaaatccatgaaacaaacaaaaaaaaaacaaaacaaatccacaaccatgcgaaattgccaagatgcagaaagagaggaagagagagagagacgcacagggtgaggaactcggagtggcagacgaggcacgcccacccgagcgccgcgtacagctccacgtacgcccgcacctgccgctcctggctcgacagccacgcgaacatcaccaccaccccgccgccgccgccgctcggccgccggccgccgccccagtactgccgcccccacatccctccacctccagaacaatctagaaccttctctccacccccgccgcgctctctcctccgcttcttgaattgggggaagacgaagagggggagaaggtgggtgtgttggtgtttgttggggtggaatttttggggggcgtgtggcgattaaaagagggcgtggtgtggttggactgtgcgagtatagggtaaaaacgctacggggcacccaggaagttaccacgatgtagtagtgtagtaataatccagtaataataataggtgaaagtgacaggttggatgggagtaaaccccatgacaaacccaggtggtccgtagaaaaaaacttaaatggatattgtttgatgtagagtcacacaaaagaaattgtattttttttaatattgtttgatgttgagaacacttgtactacaagctatgggttatccgttatagtcggagtttttatactgcgaaaaaggtagaaacatgatactacggatttaagtgtataattacttataagagaattgagaatattcatcgtataatgtaattacttataagagagaagagaattgagaatatgtatcgtataatgataattgaacgccgctgcaagctgcaacaacaatagcaatagctgtcgaacacacccaacaatagcattccaatattattttatagaacttttgttggataggattaataattatacgagtacgtatcaccagcaaggatgccatctttatcatccaagtcaaggaaatataggattaccaaagcatattcgatgacagtccaaggatcagataactcatgtgagttaattaggataagcttaaatagtaattagaaatgttaaaacttgatatactcctccatgtgtgcaaaatccctcggagatgagattcaaatgttgaacaatggcaaaaaagtcaaaaggaaaatcattgttgaacgagaccttgcaaagctgatgttgcgttgaataacactaattaatttagacgaatgaacgacgagtctgatgcaataatccactagttcttgctatattaaattagaactaatcacatgcattacgtgctcatgtacgccacgtaaacctgcactacgatcgaaaattgctgtacgtctcaaaagtctcgaaaggattgagatcgagatagaccatccacgacgacagcatcttcgaaaaaagcttaatttatcaacttggagctaattaaagatctacgtcatgtatgaccaatgcaaatggattggatggtgaaatattctaagcaacatttttttaacactacacttattaaccatatatactccatctgtgttttaatagagaatgccgtcgacttcttatcaacgtttgatcattcgttttatctaaaatctttgtacaaatataaaaaatacttatgtgagcttaaaaaacatttaatgataaatcaagtcataataaaataaattttaattatataaatttttttaataaaacgaatgatcacgttagtacttagtagtatgaaagggtatgtgtttttaattagttatcgcgctttatcgtactaaaagttgagctcgttttgctttttttttttctttcaagatttctgatgcacatagcacgtatagtcgaatgcaataatctggcatatatgtggccattaatggacgcattattgaaaagttacatatggtgtggccactaaaataaagtacgcacacgcatgcatatagcttggcaagcaatacactcttgagacaaatgcttagttggtcttaaaattaaaagtaaatttcaaagaaccacaaatatttttgatcaaactataaaagctacatatttaagattgtcacaaaactacagattttgtacgaaatctatcaaagaactatagatttattatacaagtttagtaataaagttatcagaaaattataggtttggtaaacaaaatatcataaaactatagttttagcgccaatttaatctcaacacttgggtgtttataacttaaatataacattagtactatggatttaaaccatataatatgtagttttctgataactttattattaaattgtagtttgtcacgccccgaactagtcccgagcggaactagctcgtgacgctccaaattaacctgttaaccgataccagtcccaggaaaacagtgctggtatcacaggaagacagaatatcacagcaacagaggtctctttattatagagtaggagtacagtcatgttgggctgcggacagaacccgagctcacaactgcattacaaaaggggaacggaagccagacttggaccaaacatcacaggcgcgacttgggaactaggccgaaatcctaaaactcatcgtagccggcttgctcctggaagaactcctcgtcagtgggatccgcttcatcttcttcagcaactggggggattatttatatagagcaagggtgagtacggaagtactcagcaagccatgggaaataagtgtttaatgcaggcttcaagaaagactgtttgtcggtgacatgggaccgggagtactatgacttgaggcttgggcaggagcaatcacccacgtggcctgaccccctcgggggggtcgggcccgagggtgatatggccgcccccctctttgtctccccgaggggtcggaccactcccgtttcggccccgagggctgaggcgccccgaccccttgtgggttttgcgccgcgtgtatgggttaggtgagcacagcggggctcacctaaccgtatttattgcggtttagacgagcgcgtcacgccacgcagtgcagcgtgctcgtctatccggtctgtgactggtcacagaccgatcagatcgtgggttaggtggcgacaggcggtctgacgcacgcctcgccccatcccgtcaggatgagagcctccgagcactcgtccctagccggagccggcgtgttagctcctgaagatggcacgttggccccggtcagatatatgccaggcttcatcctaaccattacaagcaagatattgtatgaagaagggcgaacatgcagattgctaaactgacacgtggtggacaagaatgaccgatttgtgaccggtctgacactggtcatgttgtcagcagacagccatgttcccacgtcgcgcttgcttccgacagaagtggaggtaggtatgggccgtcccatcagaaggtcattcggatggcaaccatacaaatctccgtccatttatgaagagaagggaagtcaagttggaaaaaaagataggataagtccccacacacaaaagagagatggtgcatgtggtatccccttgagatataaaaggaggaccttgcccacttagagagggggacgactctgggaatactggagcaggagaggaaaaaaggaagaagagggtttctagagtaagggcgctcgggctctcgagctctttgtagcttcttcatacacagatccaccaaaacacaggagtagggtattacgcttctcagcggcccgaacctgtatacatcgcccgtgtcttgtgtgtttccattctcgcgaactttccgtcatcttaggagcttagaacctcacccagggcccccggccgaaccggcaaaggggggcctgcgcggtctcccggtgaggagccccacgctccgtcatctggcgcgccaggtagggggctctgcgtgtgtttttctaagctctcgcattctttcgtgtgcgccaagcttttcctgtttagcccaatggccgaacaagcaaaggcgcacaacctctctccgagtgttagcggtgacgacggggagccgaacccacgccgtcgatctcgtactccaccgccccctccacgccaaagtcctaggcgggaggaggcgctcgagagggtcgaaggatccgcgacttcgacatccacgggtgatggagaagggcggtgagatggggagcgtcgcctcctcgtctacggcgacggcagcacgccccagggcgcgctccaagctgcgggcgcgctcctacgtcacccgcccgtcgtccctgacccggagtctccagcccaacgttggctggacgacgtggccaacttggtcatgacggcacggcagcgcctaggtgctggtgggcggtcctccgccaccaagacctctggcgctgctactaccggctccgtgtcgtcaaggcggagggcgcggcgagcggcggctattgctcgccattcggctgccactccctcgtcagcgcctccgacccgggaagatctgcgtggggggccagatgcccgcatcggcatcgagcgccggcgtaatggccgacgtgaagcccacgcaacggagggcgcctcctcgtccagagtgtcacctcaacacggacgcggggatcagccctccgtgcccccggttggtggtgtcggctatagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcgcggggttggctaatgaacttgccacccgcgtccgtccactcttgggaggatttgtgccaacagttcaccatgaactttcaaggcacatatccgcgcctaggtgaggaagcggacttgcacgcagtacaacgaagggatgatgagtcacttcgctcgtacattcagcggttctgtcaagtccgcaacaccataccatgcatccctgcacacgcagtgatctacgcgttcagggggggtgtgcggcacaaccgcatgctcgaaaagatcgcctccaaggagccccagactaccgcggagctttttcagctcgcggaccgagtggctcgtaaggaggaggcatggacctggaactcctccggttccggtgtggcagcttcggccgcccccggatccgctgctcggacagggcggcgtgacaggaggaggaagaagaggtcagcccattccgacgacgagggtcatgtcctcgccgtcgagggcgcttcgcgggccacccgaaaggggaggcctgcgagcgacaaaaagaaggaggccggcgctcccagcagggagcgcccaaccggcaagtggtgtaccgtccacaacacctcccttcacgacctcgcggactgccgcgcagtcaaaagtttggctgagcggacgaggaagtgggaggaggagaggaggcaggaacgccgagagggcaagtccctggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttcaggccgcggcccctactcatgaggcgacgcgccgggcgcggtggtcggaggttgtcctcaccttcgaccagaccgaccacccaccgtgcgttgcccggggagggcagatcgcaatggtggtttcccccactgtttgcaacgtgaagctggggcgtgtcctcattgatggaggagcagccctcaacatcctttcccccgcagcctttgacgccatcaaggccccggggatggtgctccggccgtcccagccaattatcggagtgacgccggagcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcggtccattacgcctacctccagatgaagatgtcgggccccggtggccccatctctgtccatggcgacctcaaagtcgcgctcgcttgtatggagcagcgcgcggaccacctcgccgccacgtccaagcccgagggtggcgacgagaggcttggcacctccgtccccgccgccccgaggcagcggatgatcacatgcgacgaggtcccggtcaaggaggttgccctgggcgacggcccgtccaagaccacacggatcggtggtcttctggatggcaaataggaagacgcgctcgtctctttcctgcgggcaaacgctgacgtcttcgcatggagaccggcggatatgcccggggtccccagggaggtgattgagcaccgtctcgccgtgcggccgggcgcaaggccggtccggtagaaagtgcggcggcaggccccggaacgtcaagccttcatccgcgaggaggtggcgcgacttctggaggccggattcatccgcgaggtcatccatccagagtggctggtgaacccggtggtcgttcccaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcgttcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagtccttactctcggatctagcggaaacttttgagagtctccgctccgctcgcataaagctgaaccccgataagtgcgtgttcggtgtacctgcgggcaagcttctcgggttcttggtctctgcccgaggcatcgaggccaaccccgagaagatacgagctatagagcggatgcgcccccccagcaaacttagggatgtgcaatgcgtcaccggttgcatggccgccctaagtcggttcatatcgaggctgggagagaaggcgctacccttattcaagctcctcaaacgctccgggccgtttacttggacggaggaagctgaacgtgcccttactcagttgaaggcgtatctcagctctcccccagttctggtcgccccggagccaaatgaacccttgctactctacttagcggcgaccccacaagtggttagtgcggcgttggttgtggagcgcgatgaggacaatcctcatttcgcgcatcctcaccctgtgctggcttggcccgggagagagcagggaggagaggcccccgagccgaacggtggcccaaggcccccaacgaccggagctggccctctgcccgcttgtcagacggtgccaggtgcccccgacccccaggatggcccgagggccactgcgggaaggccgcacctatcgccctctgaccccaaggctaaccctgtgccgactcgacccaggagagagcagggagaagaggcccccgagccgaacggtggcctaaggcccctgacgaccggagttggccctttgcccgcttgtccgacgacgccaggagcccccgacccctaggacggccccgaggccactgtgggaaggccgcccctgtcgtcctccgaccccgaggtcgtcggcacagaagacgagtacgccccgcgaggccgcttggacgaagagcgcccagggatgcggcccctagcgaagaggatcggccccaccaaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcgcccaaatcttgcataatcgagagggtactggacgagtggtgaaatgggcaatcgaactttctgagttcgatttgcactttgagccacgccacgctatcaagagccaggccctcgccgattttgtggcagagtggaccccggctcccgagcccgtctcagtccccgaggccagctcgggcccctcgcagctgcctcacaccgcccactgggtgatgcagttcgacggctccctgtctcttcagggcgccggtgcgggggtcacgttgacctcgccgagcggagacgtcctcagatacctggttcgccttgactttcgggcgaccaataatatggcagagtacgagggactccttgcgggactcagggtggcagctggactggggatccgccgcctcctggtgttatgcgactcccagctggtcgttaaccaggtctgtaaggagtaccggtgctctgacccgcagatggacgcttacgtgcgccaggtacggcgtatggagcgccattttgacgggatagagcttcggcacgtgcccagacgggataacacgatagccgacgaactctcacggctcgcttcctcgcgagcccagaccccaccgggcgcctttgaagaaaggcttgcccagccgtcggcgcgacccgaccccttaggggagacggacgtgcctgaccggcccccgaggcccgtcggagtccaggcctcgggacccgaggggagcgctcctagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaatggaatcctcctgaagtgcattcctcgggaacaaggcgtcgagcttctcgccgacatccatgaaggcgaatgcggagcccactccgcctcgcgcaccttggttggcaaagcctttcgtcaaggtttctattggccgacagctctcaatgatgcggtcgacctggtccggcgatgcagagcgtgtcaattccacgccaagcaaattcatcagccggcccaggccctgcagatcataccactttcatggccatttgctgtctgggggctcgatatcctgggaccgtttaggcgggccccgagcgggtttgagtatctgtatgtcgcgatcgacaagttcattaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcccccgctcaccccagaagcaatggccaagtggagcgcgccaatgcagaaatcctcagaggccttaaaaccaagaccttcaacatcctcaagaagcacggcgattcgtggatcgaggagttgccagcggtgctctgggcgaaccgaaccacaccaagccgagcaaccggggaaacgcctttcttcctcgtctacggcgtggaagcggttctcccatctgagctcaccctgaggtcccctcgggccaccatgtactgcgaggctgatcaagatcagcttcgcagagatgacctcgactacttggaagagcgaaggcggcgcgcggccctccgagccgcacgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaagggggatcgggtgtcaggtttcgggctcgggccaaccccgcacccccctcgggtgtgcagggttggccgggggctaccacatatgcatatttttatttctcttatatctgtatttcaataaaagctttttcgatttcctaaaggctgtatctgtgctgttgtttccttttgaagaatcttgacttgaaataggttactcgtgctcaatcctgccctcgggggctcgggtcagctaaaatcgccaaaaggggcccagaaccgagccgtgcctcggggcgtggtgaactccgggggggaatcggcaaaaacccacaatcgggtcacccataaccctcggtcaccatgctcccggcctggccagtctcgacatgtggatctccccaggcactagccccgacccgcgccttttgaggactgggacctgggcacgagcccttagtcaagctaagacacaaaaggaccacggtacagatcatcctcatctcatacacatagcaaaatgaaattgacacaaaaatttctttattttaattgcagattaagttaatctataaaaaaggaggcccgaaggcctcggaagaaagaaaagaagaaaaatttaaagattggcgggggcctgggggctcactccgatgcacccgggtcgccagcctcgtcgccactgtcgcccacaccgccgtcatcgccctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgctgtccagggggagaagtcgggatccctggcctggtaactcgccagtacgagctccaccgctcctcgggcgaggtccctcgaggatgacttaatcgtcctctcgagctcctcggggagccgttgaagagtcccggccatctccgagaggcgctgggcgaggcccccctggttggcggcgtacttcgcagtccgcccgccccagaggcccgcctgccggccggcgcggtctagacgggagacggcgtctcgaagcatgccgggccctacctcgcctgccaagcgaagggcctcgacctccccggcggacgagtctagcgcgccctgcagatcggcgatggtgtgttcggcagctgcgaggcgggcgactaagtcactttcgcccgcagccgccccgccgctgcgcgccctcgcgtccaattcccttgcctgcgcctcgagttcagcggcccgctggttcagtgcggccctctcggcgcgggcaccttccagattacggcgcgcttgttcctctagcgcagcctcacggagggacgcgctctccgccagccttttcgccgcgacctcagcctcctcgagggctcgctcccgctcgatgagtgcatcttcgcggaggcggagtgtggactcctcttcggcacaggcggcttcgtgcgccgtcagtgtgacctcccgaatggcaacggcggcctcacggtccgccagatccttcaccatgacgcaggaacgctcttccagcgccatggcacgggcctcgagggtttcttcacgctgccgggatgccgcctcggtctccgccgcccgctgttctcgggcagcggcagcgtcaaggaccccccgggcggtgtcgagcttcttccctagctccgcctcccagctcccgtattgaaggcggagggcgtcctgcgcctcgttcatcacggtagtggcgatgagggcagccccccgctcctcctccacctccttggcgatctcccccagcaccttctgacgggcttcgagctctgagacgtgccggcggtgtgccttgcggcccacctccaccatggcctccactgagcgtcgcccctcttcgacacgcgcccatgtggcgtcgagctccgcccgctctgcttgcagggcctccatctgggcacttaacccgtccaacaccgtggtgtttgcgacggccaaggccttcagaaggggatctgcgctcagtggggcagcggaaggcgtgggggagagccgcctcggtgaggatgccgcgcggctcggcccgccaatggacgcgccggactcggggatgtcccccggacctggttggtcccgagcgtcgcccgagggagtgggccccagcgatgcgcccgcgacctcgtcgcgagctgcctcggaagtcgtcgccgcctcgtcctggtgaaatctgacctcctcccgagcggcttcttcagcttggcgagctcggacggccacctgggcagcttcctcggcttcccgaaggcgatccgcggcttcttgccggtcagtatcgcgggttgcctcggaggacatcgtcgcctcggcctggcggagtctggcctcctcccgagcggcttcctcagcatggcgagcccgggcggcctcccgggcggcctcctcggcttcccgtaggcgatccgcggcttctcgccggtcagattcccgcctccgggcctctgcggccgccggatcctcggcctcagactggccggacttggaatggcgggagggacgcgacgggatctcgctgaaacagaagaaagaccagaagataaacaagatgggtgaatgaaaactcgcgttgagaggatgaatacagccacgatgggcgtgggacgaacctgcgaggggatcggttaaacgaccaccttggaggggaaataaggtttccccgggatggttctgtccctcccatcttgcggagccgcttcttctttcgctccccctcgggctgcgacgtcggcgtggtcccctccgggcgcctgctgttggcacgcgccgccccgccccctcggggaggagatgggggaggggttcctccctgcttcctcttccccgggcgtcggcagggcggctgctccccgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagagggaggattccttggggaatgagtgatgcctccacggagctgagattcagcacccgttggaccactatcttgaagtcctcaggagcccagtcccatctgaccccctggtgggtcctcatgtagtcttcggacccggtgtactcccaggcgccccgggcgcgccgctggagcggcgcaatccggcgacgaaggtagtcgccgtacaccatggcccctgtgagcccctgggatcgcaggcccgccaggcggtcgaggacggcgtcatagccatctcccagatctaccggcgcccgcaagctggatgcctgcgccgggggctggctcggaggtcggctcggaggtcggaggcgcgcctcgtcggcgaggggggtgtagaaccagtcgctcttccagtcatcccacttcttgcggaggacgcaggggatgtagcggttcagcaccggcccccgcggctggaagtagcagccaccaaccaccgacggcggcgacactgactgtacggtgaagaaccaccggaacagccgaagggatgggcgcaccccgatgaacatctcgcacaggtgcgcgaagatggccaatgtcattaccgcgttgggggtgaggtgcgccatctggagatcgaaaaactccagaacatccatgaagaaagaagaaaatggcggaaccagccctgccattgcaaaagggaggaagaagacggaccgccccgggtagtctggcgccgggcgtccctcgcccagcgtgactatctcccggccggaggcagattccggcatgaagcggcgcggcagcccggcctgcctctcgctcacgatgcgggaaggcggcagcacgctaccatcgagcagagcggagccccgtgccatgatgccgggagaagagatgtttgagagcgagcgcgtgtggcgaaggtagggcacaggaaagaaggagttagggcgcaagcggcgaagacaaggggaataatggcgagaggaaggaagcaaatcttttcctcggtgtctttatacccttgccaacgctgtgcccggctcctcgcttctcgcgcccactatctcgctccctcgtttctcgcgcccacgcttccactaatcccattcgcccgcttgcggcgcatgaggtggatatgcggctgtggcagtcgagatggaacatatcgtgcgcgcgttaattgcgctcaccgaccgaagcgccatcaccatatctccaggcaaaacgaaccggctcgtcccgattcgcgtgctactcgagtaatgtggcagccttgaagaggccgttcattattgacagtcgagttaccgttgccagagtgcgtgatttgcgaccgttgggtttctgcccaactgtggagaccggtcccacctgtcaccaggcttttggaagtggcgtcacgcccgaccgcttccctcgaggagggcgatcgccctggcataacgccgggggctactgtcggtgacatgggaccgggagtactatgacttgaggcttgggcaggagcaatcacccacgtggcctgaccccctcgggggggtcgggcccgagggtgatatggccgcccccctctttgtctccccgaggggtcggaccactcccgtttcggccccgagggctgaggcgccccgaccccttgtgggttttgcgccgcgtgtatgggttaggtgagcccagcggggctcacctaaccgtatttattgtggtttagacgagcgcgtcacgccatgcagtgcagcgcgctcgtctatccggtctgtgactggtcacagaccgatcagatcgtgggttaggtggcgacaggcggtctgacgcacgcctcgccccatcccgtcaggatgagagctccgagcactcgtccctagccggagccggcgtgttagctcctgaagatggcacgttgg

SEQ ID NO: 61387 - DNA, 4962 bp, Oryza sativa
cagattgctaacccgacacgtggtggacaaggatgaccgatttgtgaccggtctgacactggtcatgttgtcagcagacagccatgttcccacgtcgcgcttgcttccgacagaagtggaggtaggtatgggccgtcccatcagaaggtcattcggacggcaaccatacaaatctccgtccatttatgaagagaagggaagtcaagttggaaaaaagataggataagtccccacacacaaaagagagatggtgcatgtggtatccccttgagatataaaaggaggaccttgcccacttagagagggggacgactctgggaatactggagcaggagaggaaaaaaggaagaagagggtttctagagtaagggcgctcgggctctcgagctctttgtagcttcttcatacacagatccaccaaaacacaggagtagggtattacgcttctcagcggcccgaacctgtatacatcgcccgtgtcttgtgtgtttccattctcgcgaactttctgtcatcttaggagcttagaacctcacccagggcccccggccgaaccggcaaaggggggcctgcgcggtctcccggtgaggagcctcacgctccgtcactgttgtttttgcaattgattttatttgaacccttttctgaaacaactaagggagtgcttctcaaacgacacgggtgagacagtgcgtctcgtccggtcggagtatgtgcaatgtatcagtcttttgaattgattaagattggctcccggccaacagctttcaaacgaccacccaggcctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaacaacctctgcagagggggtacactttacccacacgacattactaacccggatcatccagttcgtgcagaacggccacgactagagaccttaaggctttcatgacaaggcatttcgaaagccgacacaggttcgccatatgccaacgagaggggtcccagaccaacaccagattaggtcccagaccatactgtgccaggaagcccaggggtcctccccgacaccaccctggcgaatccacatgtcgcttagcatcatggctctcccgataagctagttactcagccaggggtgtcccattccacccatgtggttgtacttgtcttatgttcggatgaaattccaaggaaacggtccttaagtgcaagagcgggaaaccgtacacccggtatgttccccggtccgcggttttggaaattcatttagttcgcaagcaccgacccaggtgtcgggttttccaagtcttttgtaaaacccaagttttacccaagatgtttctcagattttaagtttgaaggcgaccgtcgatacccgtgcagagtgcacgattaccgaggcgcgactaggtgggtacaagggagcatggtataataattacaatgggagggtcaaatgcaacaaattaggtaggtctgccaatctgccttgcagacgggacaagcagattaagtgcgatcctatcaatgcataatatttttcaagcaacgtaattaagttcaaatataggctcaagatgttcaaaggtggcttgcctcgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagactttcctcgggcggctagggcgcgacctgagagaaaggggcggctcggccgagcttaatgggccggccggcccaagaaggcggcccaaggcacgcgcgcgggcggggaggggagagagagagccggtgggccaggtccatcccgcgtggtcccgggtgggacccgcttgtcggcgactcggctcaccgtgagcgaggtgcatgcggggcgtgctagggtttggggagggaggcgcggcgcatgcgcgcggttcgcggaggacgcggtgcggcgggcccacgtgcaaactcacggctcgcggtggaccgcgcgcacgagggggtggagggaagcggcggaccggggtctacttgacccggtcgcggccgaggtggcgccgacgtggcgcctacgtggctgccacgcgggccggtgggaggtagacgacgacgccggccgaaacggacggcggacgacagcggcgagcggcggagcgaaccatggcgatacaggcgaaggcgagcatatcgggatgttgcacaggacgaggggagacgagccaacggctcggatttgccgggggatgctcgacggcggtggattgcggcggcggcaaccggcggagagaaaagggggaaacggcgatgaggtcacgaggggccgattcccggatacgcggatacgggaacccatcccttgcgccggattaggaggaaacgcatcgagggaggccggcgacgagaggcgcttctgagctcgggcggcgacagcggcgagcacacgacgagcgacggcagcagtcggggcggcgccggctagctacgtgggggctacacatgctactaccgaaaactaaggggaggagatggattgaggagggagaacggggagatgcactaccgagatgaggcggggcgctgtgacgagaggccgacggcacgggagtgatctctccggcctcgggccggggaagtggaagaaggcgagcgcccggagtccccttccgcgtccacgaatgcaccggctctcccggtgcttggcgatgaacggcggaggcgagacagaggggtggcaatggcgcggtggcggcgagcgaaatgggaggaggaatcgatgggagggcgccttggtttataggacgacgatgtcggtttggaaaccgaccttgggcggtcaaggcgcgagctggcgctcggcgctcgcggccaaaacggcgacagaggcggatgacgccggcggggaggggaaaaggaaaaagaagggagaaagggggcttgccccttgccactttgggaaaaggaggaggggatgggggcgacgcggcagagggaggaggagctctgcctccatcccttggaggctagcgcggggagaggcggggccgaggcgatgacgacggcgatgacggccgggcggtttggagcggagcgacgacacgggcggcaggcgcgagcaggtgcggcaggcgctgacggcggcggcgactgaccggtcggccaccatggcgcgcgcgcgcaggaagcaacaggcggcgcggcgatttgggcggcgttggcgggaaacggcagcgagggcggagggcgctcggctcggcgcggctcacgcgcatgcgtgcgcagcgcacgggcagagcgggggagagggagagagagagagagagagagagccggggagggaggggaagatgggccgagagggattcggcccatcgaacccgagggaggcgaaaaagacttttgcggagggatttgatttgggaaggatttggattcgggattgaactcgacgatagatcagggatttgagatctgagatggtacggacactagacaacaagcaaagaaacggatttcgcaaatagggtttttaagagatagttttcccgctaggcgccacgacggaacgggcgctacatagttttatgatacttaacctaaatatgtagttttatgataaatttagtgttaaatctataattataattttaagtacacaatcttaaatttctagtgttgtgatagtttagtcaaagtattaatagttttatgaaatttactctaaataaacaagttagatatgcctatatcaactatatttatattttctagtaactaacttattttttaaaaataaaaaagcagttcaggtttctggcttgtaggccggtacactatagtattctattcccctctctgatcaaaatataaatattttttgattgaagtaaatgtctattgaattttttgacatattttagaagagaaaaaaaaggaaaagcaccgacatattgatggattaaatggtgactgaggtaatatcttttttacttttattttttcccgaatctcaaaatcccttatatttgtagacaaataaagagatgttaggggttacctaatttatattagtattaagtgttttaaaattcttttaagttaaagccctactccgtatcaagtacttcctctatcccattttcctccatcccattttaagtgcaaccataagttttcacgttcaactttgattgttcgtcttatttaaatattttttttataattagtattttgttgttatgagatgataaaacatgaataatactttacttgtgacttatgtttttaaattttttttaaaaaattataaataagacggatggttaaagttagacgcggtaaaccatggctacacttagaatgggaccgaggtagtatcaaacgtcctgtataggacaagacaccttgatattgatgtccattggcatcaacgataatagtatgtccatatcggagtccttaaaaaaatatacattctggaagcctttaagaatcgattagtgctgagatcaaccaacctacaaattaaagcatagactttgccaacatatagctaaccaaattaatgccacaagcttagttagagatgaaaatcgatcgaattttggcttgttgcaaatgtaacgaacaaggtaataaatagcgtatagcgggt

SEQ ID NO: 61388 - DNA, 7961 bp, Oryza sativa
  unsure (1)..(7961): unsure at all n locations
cttgtcaaaattcctgcgttcgaaaagagccgtgtcagagtacctcttctttagctaatttagctgccttgttttcttttgctacgaggactggaggagatatcagcaataagaggttgtaatttacttcctccgttttatattataagactttctagcattgactacattcatataaatattaatgaatctaaacgcattatatgtctagattcattaacatatatatatatatatatatatatatatatatatatataaataagcaatgctagaaagtcttataatatgaaacggatgaagtagctaaaaaattactcaaatgaaccggtaaaatcgacatccttttctgcactgaagaatctcgtgtttcctggtgagcagcagcaaaaacccatgcgacgcctatccacgattcttcttccctagcttgtcacctgcacgtcgtcgtcttcagttctcaccgatctctcttctacagttttacagagccatgcatgtcatgtaacatccgacgcatggccgtcctagtacctgtaccttcccttctcctcatgtcacctcctacaacaaaagcagagcctctctcttctcgttcagtgcagccatgcctctgctatcagcaacattctggcttgttggcttttcaacctctgctctgaaacaaaaggaaaaataaaagaattttagggcttcttcggaacacaatattgtaaaaacgtaggaatagaaaaatcacaatgcatttgtaaaatagaggagtgaaaaaactagaattctttagattggattgtaaaatatgtgctcggacatggcaaagtaaaaacgtaggaacattttggagtggatggaattttatctttgcttctcagtaggaggttggagtgtatggaagtttttctttatttctaagtagaattcacatgaaaggaaaatttccttttgattttccctaagataaattcatgtgaaccaaacggtgctacagtcatcgaatccttagggatctaaattcttcattttccctttgtttttcctacaatccgaataaatcattttatttcattgaaaaatagtcttatatggtcatttggaacgaaggaatggcattcccaaaatcctttgaaattcctatagaaaatattttttaaaaataaaatcatggattcacttattacaagattcgacgaggaatgacatcctatcctttttttttctatttctgtgtttttcaaatcccgcattttgaagttacccttgaggattgattttggttttctttttttttatcgtagtctcttttcataccttcatttctaaactgtttgatgtcactaataaattattagttttacctacaaatcagtagagtggagtatttttcttctttgctttcgttcacatttctagggctttatcttctcccatctcgcttttatcctgctctctcacactattgcacacacactttgagacacactctcaccctctttctctctctgcattcaggggacacagggctcgacgacaaggtgagagagaaggctacagtgcagcctactgtctacatcttcttcatggcgcacgcgaggccatggccatggcaatggcaatggcatcctaggttgccgtgccactgcattcaccatagccaacaatgccgtctctggctcctccaaaacggacaacctccaaggcccccacacatcatctagcttagctttagctagagcatgcgatgctgctgcttggctcatctcacccgtgtgagttcagttgtgaccctccggtcnaagcaatggctcgcctccccatgtggacctgtcctcctctccgtcggcggccttctgatcgaggattagtgctggattaatatggcctagtcgggttaatttaacttggttactttgcggcgatgctgatgtgttcttctttgggtgttttggcagcaacgtcgtcagagtatgagattagtttgttcagacaagcagacaaagcaagctactccactccagcagcaaaagcgatgtgttggttagtgaacctaagctggggttagtgaacctaagatagcttagccaatcttgattttagcagcaggactgaacctaagctggggtttgattctgtttttgtttttgtaggcatggcatggcaggcaggcacgaatgtcgaggcaacgagcctcttgttctagctgacagtaatttagtattagtactccttaatggcctaattaattcacctgttgtgggtaggagcaagattgtgagaaattcctgaatcctgatgggaagaactgtccgaatgaggctacatgttgtgctgtttagtgaaccagcagcaaccatggacttgagagacagagcaagacaaggaggcatggagttcagattgtagtactctgacattttgaagtaccagcaagatttatcactgtgacattttgaactagtacaaaaattttactgcaagtttatagatcactgcaagtttacatgaaatagttcgagttcctcaggacatggggaaaaaattccgcgcattcggaatgtggcttgagtttgcatgaaagtattagatgaatcgcttagctgaaaattcaggatttgctaataaattcttggttcagctgttcaatttgttcttcatattgatgatgctcattctgaatatttgcacaaaccattcatgacatttggcattcagcaatctggtatatatcaccttgaaaaatcagagttttttgatacacatgacaccattatctcccacatctccatcttcacacgtcccaaacatccactacaatcaacaagaacccgttgatctcccgaacaaattggcattcttgatccttcttccatggcggctagctgatcatatctaatagtagttcaggaggttgccactgatgatgttgttgctgccattgcaggggaagcagccgcaggaggcgttgctgccggcgaggtggtggtggtggtgatggtggctggtggccttggcccgccggacttgctcggcggcgcgcttcagctgctggaggtgctgcgcctgcgccgtcgctctccactcctcggcgcgccggtgcacggtcgtcatcctcctcatcagcttctcctccaggtttgatctcatcttctgaatcttcacctgaaaaaaaaaattgtgacagaaattctgtcaggttcagaggattattctgaaggaccatgcagctggtcttgccatgacctgggagaatgcagcatggagggaaaaagtttcaaactttgaattcaatgtgttcactagaatatagtgcatatgcattggtactagtattgtagtatcacagatcatgacaatatcactgaaagcacatgtcttgatctttgattatgggtagaaatgttatcgtgtggcgctctcggatcgaagaacttcacatggcttttggaatgatagtaagtcaggaacaaaatcttaaagaatcatggtaactggttgaaagggtaggggatggcatagaaagcaatgaacaatcatactttccaccatttctaagcaacttagataagcaaagcgacacacgagaaacaaacaagaatttgcagtggatttaaccatgttcaagactgcaaaggcaaagaaacatgggaatgacatagccatgatcccaatcttcgtctgtaatttataattctggtatttatcgatacttggaaaataccaagttatcgatcaataaacttgggttcagacaaattgtatctgaaaaatggttttagcgtgtacagccacagtgaccacctgaccattgtcaattaacaaatcacaattcacaatgcaatgtttgaacttgacagaactagatgccaatatgtcatatttggcagcatcatcaaccagctataactgatactctgctgcaggatttgaagtacttaattcggtttgttcaactgttttcagattctcagtatgccatcacggtcaaaccggtagggtccagaggttcagattcttttgttgtacagaagattgagacaggcaatttcttcctgtgaatccacaaggaaaagatcacagggctcaaaatgatcacacatctaccctagtgaactagtgaagtgaagtcaccactacaccttttggcaaatattgtcaactcatatcattgcatctacaatgatctaaaagtgtaattttggactggaagaaaaaaaaatgtttctgtttctgaattctgatgcaataattttactttgcaatatgcacagggctcaaaatgatcacacatatacccttctgaattcactactacaccttttgggttttggctacttttatcattgcatctacattgttcttaaagtgtaatcttggaccagaagcaaaatagctatttctgatgccataattgaactttgcaatatgaaaaaagatgaaattatttagcttttacctctagctttctggactgtgcttcagccttggcactctccaggttgatccaagcttgaatctttgcctcttccctctgatacctaataatcagacaaaacacaagaaaattttcatcatatgagaaattcatctctaatctttgccataatttatgctaaaatttcttgtgcaaaccttatgcagctcttggccctgtcatcgtcctcccaccggcagtcgccggcgccgccgcgcttctcgccgacggcggcgacgctggcctcgaagtgcctcaagctcttggacacctcctcctcctcctcctccttggagctccagttgatgagcatggcgtcgaactgcgcgccgaggtccagcttggcgaagtggcagtcggcgaggtccgagatgtcctggccggcgccgccgccaccgccggcgtacggcaccagggggcccgaccggctcgccggcgtgttgtgcctcgccggcgaggtgctcttgatcggcgtgtggcacctcgaggtggtggagctgcccagcggagtcatctccgtgccgatgtcacgccggtggtcgatgccgttgccggcggccaccgcctgcgccgccgtgttctttgttggctcgcagtaggagctccggaacacgaagctctccttggagggctccacattgtcagtgaacttgtctgaaacgtaaaaaacttgtgagatttgcagttctagttcttgatgaacaattatggtactgaatttttggcaaattcagaacaaacaactgaaactttggatgcatatgtgacatgtgaaggaatcgtatgaatcacatcaagatacaaaacatttggcaaattcagaacaaaatacgaaacaaaatgagagcttaagaaaccaataaagtgcagagaaattacacatcaagaaagttaagaaattactgcacagaattactctacaagaaagttcagaaattactgctcagaacaactctacaagaaagttcagaaattcattctgacagtgacctcactgaaatttcatctgcctatgaacacaaagaaaaactcaaagaagtacaaaaattaactgaaaaaaatatttcagcatctcacctttgaggaacacttctgcagcaggagcagtgtagagagcaagagcagtgacgtcagcatccaccgacctcctcaccgccgacgccctcttctcctcctgaagcttggagcccttgccatggtggtggtgatggccgccatggtggtcggacgacgcctgcctcacccacttctccgcatcctcccacttggaaggcaccgacctcctcgcggagacgagctggtgatgtgcagggctcgaggaattgaagaacagcaatggccgccctggagtagctggcacctgctgctgctgctgctcggctcgcctcctctgagctgaggccgaggaggaagaggatgaagaggccgtggaggtctcgcggtggtagccatggccgccattgccggtggcgccgttgctgctgttgctcctcgccatggtagccatggggaaggatgacctcacgaactctgaggtctccttgaggttgaggctgcagagtgggtcactgaatgtgggcccgaatgggttcatgcctcctcctcctcctccagcttcagctcccactccttggaatgagttctgcaaatcgatggatcaaacgatgaaattttcaatcaagaaactgatttgttgttgatttgtctggtcttcttgaatcaagaaatcaagtagaagaagggattggagatgtgtttgttgcttactcttcttgttgatggcaatgttgcagatggctgcagatagtgtgaggaagaagaagacttgggctccatggaggagactgagctgaagctgagcttatgtgttttggttacttggtgagcttatgtgaagttcaatgaactgaggactgtcactgtctgggcggcatgagctatgaagtgcagaggtcaagattttgtgtgcaccaccttatgtctatggctctaagcctatgattaggaggggtccctggtctgaatcctacttaatgacagtcattacagcactttgttacactaaatatatacagcaagtaggtccttctctaggatctttttaaaagggtgaacttgatgttacctttgtaaaagccctacaaacaggagccttgtcctctctgaatgatggtaaattgagtgctgattactcaatattggaaatgttcaaaactaaacttgagttatttcatttactatttgaatgttcggtgtagccaagtaggagtagtttgatgactcttttagtctttggtcactcctagctctgcttcacgcctatttaactgttggttgttgcttagggttgggcagcaccttttagcatgttgaattcattgcttttttcagtctgtgacactgaccctctgggatctgcacttatgtggatagtgaaactttctaccaggattcattgaaaggattcatttttttttagataatattgaaaggattcattaaaacatttctgtatcattggaagaaaacacaaaattcttccaacctggatgagagtatggccgagtttagttccaaactttttttcaaactttcaactttttcatcacatcaaaacttttctacacacataaacttccaactttttcgtcacatcgttctaatttcaaccaaacttccaattttggcgtgaactaaacacaccctatatatttgcacaattgctccaacatcaataaaacatagtctacaaatcaaacctagtgttgtccatttagtagttgcagtccttgaatgttctataggtgtgtttagtttacgctaaaattggaagtttgattgaaattgaaacgatatgacgaaaaagttagaaatttatgtgtgtaggaaagttttgatgtgatggaaaagttggaagttcgaagaaaaagttgggaactaaacacggtctatccgtctatgtactagtgttggaattagctactacctaatgtatcattcgtaaaataaaactgattgcttcttttcacactccatgacactctctgcacttaactctaataacctatcaaagcataaatatacagcagtccaggcttttgtcagaaaggataaatttttactccgcaacagcagctggtctgctagtatgagtatgagcatgatcagccaaccattgactgttggtcatattcatcccttggaccaatacattttgaattactggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 61389 - DNA, 6274 bp, Oryza sativa
ccgcttaggagattacactacacaaaatgcttgattatttctgttggccgtgataacataccttggcaatggatgcaacaaaatagaacgtcccttgaaaccctggagatactgaaaccagaggtgaagcttttagtaaataacctttgctctctcaagagattggaatttgatacaactcatcgtttccttgagtttcccattctgccatcttctctggagtctttcattattagaagatgtaatccagagttgttggcacgctggaaaaggaaagatagttctgaatgggacaggatttcactcatccgccatatgagaataggtatgccttgcttttgcatctatccttgtcatcatctcctgcaatctaatggtcacttggtcagtcctagagatgttattcgtatgttactttgtttttccttctagcaaaattttaagtttgtttttcacatgttaaccaaaacgatcccctgttagaatctgatttgggctgtatctcctgccaagctgactgtaagttaatctacaggagatgcatactacaatttcgggaaaccagcggacaaattttatagctgtgattcttcagaagacaagacaagaaataggtatgtgagacacgtactacagtttcagggaaccagctgaccaactttatagccgtgattctacaaaagagaagataagaaataggtacttgttctacatctttcacaatagatcagaaattcgtcaattctgatactccattattattactaatctatttcactggcactctacagattagtgaagtccaagatgtaagcccctactgtgtgcaagacccagttagaagacagttttattagtgtgactggctgtgaataccttaactgtgccaatggattcttcagaactacagtcagttccacatattttatagaaatatctgcaaggattcgaggccagtgtcttgtttctcagtctcatgaatgtgaatcacatgtggaattaaaggatggaaatgcacacacaaaaaaatgcaatgacatgttcatccgttcatgccgttccttgtcggtaaacaagcttgattgttcagtagtagcctctcaaagtaaaatggccaaccagtattgaactgaaagtcatccaggaaaagctgatcgatctcttattttagagctctagttgatatgtgtgaacattgttaatttcgcttctttttcttcaatattagtgagtttcatctgatcgatgaattttatttttatcttaattttatgaggttgtctaatatcatattagacacatgtgagtgtttttctttttttgaagaattgttatgatgtggttttatatggaggttttggtattcactgtctgtttataaaataatccttgcttgaaacatcaccactcctctatgtttaggaaaattcactgtatatctctgaaactttgtcaaatactaccttatatgtccctgaattttgcgacattagagagcttaataagcacctcgctaacggctgcagaacgccgaggtctgtgacgagaagctccagatgctccggaggctcgtagtccctcgccggcgcctcgacgtccacgctcggtgtcaccggcgcaccgcccaagtccgccgttcgatcatctcgttgttgcttgacgtccttctgccccaatgtatgcaacctcgcaaactacacgcaaaaattcatgttcaaataaaaaaaaatcaagttgagttcaaaaattcaggttcaattcagatcagaattcatgtcagggacacgaatggacgagttggattatattttcacctttgtagctttcggttgccactcgggcttacccatggcgcgaggctaccactctaccagcgagacctggaacgtggatatgcaagcatgataacttatttgaggatgaggcggcgcagaagggcgatcgtgcgaggcggctagggtttagtgtcggttggcaaaatccatgccgtctgtttttatctacgatcgcacaggagtggaagggccagcacagcgggacacgtggacatccagatcgagcctagcggtagaacggatggtcgacggttgcagggattaatgtgtaattaattgaaagagtaaggacttctttgcaaaaacatcgctgaaattctcagcaatctcacgcggtctagagaggttaatataatatatatggttatcatatatatacatataccgttaaattgttttagaattttcatgaaattttagcctgattaattcagttttactgatttaagtatgggtagttaaaaaagataatgaatatagatatcaacttgttggtattttactttgaattaagaattaaatagaattagttgcttggatcatcaataggtagccactgttgcacttgagtccggctaaccatggactcacgagtcagtggcggatgtatcctttggggtttgttagggctggagctccacctccacagtgacagcaacccctccccccctcccccctcgggcggctcaaatcctggcccattcactactataaaaaaacgtttttccatgcagccaaaacacgttttcgtaggtggccaaaccttccgactgtatctaaaggcctgtcaaaatcctcaatttttactggcggaccaaagcactgctcgcaggcagcagtttcaatcttcccaggcgttgcttgcgaaaatactcttggcgccaaaaaaatttcccgccagccccgccccctccctagggtttcaaatcacaaattctcttaaatctcatccaggaaacaaaatccaatcataaacatccatacatcaacacaagagcattggattcaaatccatagcatcaacttgcaaattaacatcaatcaacatgtaaactaaaaaaaacaacgtcgtcgttaccggcaaactcctccgtgcctcctccgctaccgcacgcaacggcagatccggccggagggaggggacagccgcgccgccgccgctgctgccctccccctctggcgggatctaggagggagaggaaaatgggggagggggggccctccaagcgttgccgttgcatgcggtgaccgccgtcaccgccctccccactccggccggatcagggagggagggaggtgtccgccgccaccaccgccctcctttctcctcgtaggggccggatctgggagagggaggggaggggagccgccacggcgttgttgtcgccctcgtccgcgctgccgtcgccgtctctcctcctcctccggccagatctaggagcgggaagagagaaagggggagctgccactgccgtcgctcctcctcccctggccagatctaggagcggagagggagagagagggagtcgtcgcaccgtcatcgccctcccctcctccggtcggattgggagggagggagggagggaaggggaaagtgaggttgagaggtggagatagaggggcggggagaacggagtgagcgtaccgtgtgagatgagggagggagtaatatgggagtacgtaagtgtgggcgatttttataagttattatttttttaggcggacgtcttaaggtcctgcctgcaaaaataacaataatctcgtcctatgaaaaatccaacaaataagaacaacatgtcaagacacgttttagatcctagtgaaactgtttatttgtgattataattggaattataatgctaaactctatatttaatttgatctgcaggtcattgatgcatttttatgtgtttatgccatcgtatttgattaacaagtaccgacagttgattccttagtttattttttcttttctatatacaaaatttaaattatatttgcatgagaccgacaaatgtatattttttaaatgtttttattgcattgtgggttggacataggatattaggagcacctcctctattttcatcctagattcaccactgttacaagtcacgtacagagaaactggttgatgaacgggagataggtcgactgaaaacagaggcactattctcaatcaatgttgtaaaaaagtcagaatatgggttacatgctcaaactattgcacaactaactattattcaaagtagttctataccaaaataccatagtgcatagacaaatcattggcttgtctggaaacctatcgctgaaagcacaaacgtaaagcatgtatatgcctagtagcttacttgggttgtgacctataggcccacatatcaagtagaaaatattttcggctcgatcattaaacgtcttaattgggtcattaactgctaatcaactttgaattaattggccattttggtttttatgcaccaaaacatgttccaaactgcagtcggatgaaaaagagatgagaagtcgaaaaaatgaaacggaccacgtacgacaaaaacgatatcaatgtttataataggtaaatgatatggggatggagtgatatggcgagggagcgatctgattaaaaaaattaacggaaagttagattagattttttattttctattttcagggtcggtatatcagaggacaactaaaacactacgaaatttttaattaggtaaagatttgctttcacatgatttcattctctcgggctcatttcttgtccaggctaccaaaaaaataataaaccctctcatatgcctgatgaggtaaaattttccatagattcttttacacacattcatgttatttttttttctcatgctcatcactcagggcaccaatgcaaccaaatgcccctacgaatgtggacttttacggtacaatatactgctaatatatacagcaagtatacaggatctatcggtgtagattgatttgattttttagttaatcagattgcagtataaaatttgaaagggtaattttatcttttctttgttattctatcatcaaatcgtactatcatcacgtgtttcgtcatcaaatgatgctcaggatgctcctgccctagtgcacgataagatccaggactagatactctcaattagagtcaatctgaacaaaaagattactgaagtgtattttttattttctatcaaatttctaacttgctcgataccagatgatggagcataaaaatacaacttagcctgaaatgttggtttcggaaagatggaataccggaatgatgaaatgctgtatttcctcaaaacaccagcgctcactgaaagaagtgcaaaatggacgtttaagaactgttttccttgctaggtctctggctctcaccgctcctcatgctgactgttccaatgtcaacttgcatgacagctttgcgctacgcctcaatctcaatgtcaacttaatttacagctttgtgctaatatatcaatgcctccaacaatgcttcaataatgtcaacttgacaggtttgtgctgatcaacgcctcaatatatattaatgtcaacagttgcaataattataaactcgatgaacaggaataattgttgtactattgtttcagtaggtaaatcaaatggagttagactaatttggctgtgttctgcttttgcaacttcctcgatcgtttactatgagcacactttctaaattattaaacgatgtatttaaaaaaatgttttgtataattttttttaaaaatcaaataaacatattccctactggagaaaccatctttgttgggttggccaaaaaccacaatagccccagtttgaatagaaaccgacactaaagatggttttttttcccggtttaaaactctatcagccctagatgatatttaggctaaccgggactaaaggtcatctttagttccggtttatttattgtcagaggaggactaagacttatcctcccaagtcccaaactcctcatctcctatttctactctctctcttatccttttctttgctgatcttatcctctccttcctttcactagctaaaacgtgaggattaattttagaaatttatttaaaataaagagtaaagtccatcaccggtccctaaacttgtaccactatgtcatccctgtccctaaactcgcaaatcgattgttcaggtcctcaaacttgtttgactgtgtcatcccggtccttaaacttgcagatcactcgtttagctccaacttatttagttgtgtcaccccggtccctaaacaggacggtctaaaaactttatattaaaaaataattcataactttttcatgtgaactctaatgaagacaaactttatatcaaaattatagtctttgacgcgacttacaactttgtagttgaaaagtttttgaattaaaactgtttaggtc

SEQ ID NO: 61390 - DNA, 1130 bp, Oryza sativa
ttgcatagacccgacggtagcactggctcaatagaggggatttgcaattataacactgcaaacattaacttttgttataatgacactggacccatattttatagacacagatggacccatttatcatccactcgaagtgttaaaacagcgaagccctcatgtttacagtcccaatattacaattttctcctccatggacagatgaacgggacacgtgtacttggatgttaggaggaaccacatccacgtctcatcacgtggtaccccgtgtgttcctatatgtgcaagtggtggtccctaagtttaatgggaccacatgtcagtaagtacttcaagccatgcgtgcatggcacgtgaccatgcatgccattatgcctcgcatggtgcgcactcacgctccattagcagtgagccgttacactactgctaagctagcttaattagtggaaagaagtaaactaactaacaataggcaggcagcaagccagctataagtggatacagtactaatcgttcgtactttagagtaattaaactaaactaaacttagtaaaattaagtaggcactaatgaccaatcaaatggttaatcgagccatagctaatcaagagagaggatggtcggcttacacggtgacagcgtggcccccgaaggtgtagaggatgttggtggcccccgtgaagtagagcacgatgcttgtgggcccagagtgcgccacaccctccacctgcattattcccaatatatgcactattacaattactatctatcactattactatcattttgttatcataaataagtgacgtttgggactttgatcttatattaaaaaaagatgagtaattttacagttcttgaagatgtatcgtgaggtactattttttatattataaatttgatacattttggtacctaaatactatgaggtaccaaattttatattaaatttttggtacatcatgatacctcctcaagaactataaaactgctatgaatattatgtaagatatatatgtacctgtccgtggatgagggaggcgacggcgatgtaccaggcggtgtaggtggtcatgaggaggccgaggaaggaccaaatgcggtagttgtgtaaaaacaagggggatcca

SEQ ID NO: 61391 - DNA, 727 bp, Oryza sativa
tacttctactgaaggaaacaccatgccaaccttaaaaactaggttcttaacatcctctgccatgaaagccttaaactttaatctcacttcaccatcatcatctgaatctgggagctgcaaatcttcatcatcagtggaaacttcctccacatcagaatttctaactactatttcttttcccttcaactaactgcccttagctttcttccaaaactttgccttgcagtcagataagtcttcaacacccacatcaacattgtcaacatacaagtcatcatctgcatctgatatatcagtcactatccataaaatatgggtcatcttctaagctaccatcactgtcactgtcatcttgtttgtttggcaccttcctatcagcagttgacatcttcctaggactaagcaccttaggcaattcactaataggattagctactacatcatcccaatctacacctgcaattgtgtcaccctgatcaaaatagataataaaattcttaaccttgtgcacaactgatttcatcacttcaaagtcagccctagtagatataaccctaaggccatcttcaagagtttttccagggagcaaccaataagccttaaaatctggattcatatcatacccaagcatagctaaaaattcatcaaaacaaacaatatcccatgttcttgcttcacagtggtcaatccaatttatcgttcgatctacatatgccctgttgctacc

SEQ ID NO: 61392 - DNA, 1804 bp, Oryza sativa
aattcctgcagccctattatgagattcagattctacatcaattttcgttagcacgtttttaaaacagctaaatggtgctaaacaactaaacttcctatatagaaaaattacttcgacaagtaaatccatttttcaagtttatactaattaaaacttaattaatcataagctaatttttttcgtgtgcacttacttcatcataaccatcatccatctcaaacgggacctataatatatattgatcaaatatatggtaaaaaaagaatcatctcctattcagaataaggtaaaaataatgggcatattccttgtgccataagaccatatagagctagtcaaatgtaatatagtgacatgcatgtttggccatttttagggagatatccggttgatgctcttatgctcctactaggggacaactttgtgctccccaccatgaggaactataggctctatatattatgcatcaatccaaaaccgcgaaagaaaatttttgccaaaacagaaagcccctggctcttgcaaccgataatttttttctccaaagccatgaaattccttagcatggataaatgtgtccccttttagttatctcgtggtgtaactcgttttaagaccgctatatttgatacatatcgtactataaaggctatgtttggaaggagtttttactatctactgttttttttcaaaatctttagctccttaaacgatgtttaagatttttactcaaattatgagaatatatggttgtatcacactaaaaagccataaccatggaaacccataatttccaaaatctcattggccacaccccagttattccttgttactagaatttatcagtttccagaacaggaccaaatacagttgtacattccccctggataactacaatccaaacccaaaaagaaaaaaaaaacaaacaactgtcaccagaaatattaaaaaaataaaaaagtactagctcatattcatggtcaacgagtcaacggtcgtaatccccctcgccgaagaaaacaatataataataaagaaataaaaaaaaaagaaggatcatactccaaagaaggggtactttgcaaccggcccgaatcggacggccaggataacgcccaccctatcttccgggaatctccagagaaaccacggcgaaaacaagaacagcaaacacacgcggccgacgacacggtcaccgcccgtgggccccacctcccctctcccctctctcttctccactcgactcgactcgacgacccacctctccaccaactcgcaactccaccaagcaaaccaaaaaccccaaatcccccaccccgaattcggaattcccccccaaatccctcgccgcccgccgattcagccccgcggagacgcgattctcgaaggaattctggttcccggaggcggagcaggcggagaatcgtttggtttttcttttgggatgggggagggggtgaaggcgatgctggcgcggccgatccagctggccgacgaggtcgccaagcagtgcggcgcggcgcggtgcttccgcgcggagtgcggcgagctcaaggcgcgggcggacaagctcgcggcgttgctccgacaggcggcgcgcgccgacctgtacgaccgccccgccgcgcgcatcatggccggggcgcagcaggcgctcctcaaggcctcctccctcgccgcgcgctgcgccagcggccacccgcgcctcaggcggctcttcacgctcagccccgccgcggggttcccccgcaccgtcgccctcctgacaccgcgctcgagacgtcgcgtggctgctgcgcatctc

SEQ ID NO: 61393 - DNA, 2176 bp, Oryza sativa
acgaaaaggaatcagatgcagtcggtcgtgcaatccgcgatggctgctaagactaagacgaatgggtcgttggttccacccttcaggccacagctgggcacgagtggttctagtggccgtggtgctgtccgggaggtggaggatccggagaccaaggcacggctaaaggccatggcagcgagagctctgtggaagcttgcccgcggtcatctaggtgtctgcaagagcattactgattcgcgtgcactgctctgcttcgcggtgcttcttgagaagggtgatggtggcatgggtactagcgtacagtacttctcagcaatggcaatcatggaaatttcccgtgtcgctgagcacagccttgccctgcgacagtcggctttcaagcctagctctccagcagccaaggctgtcgtcgaccagctgcttcacattgtcagcaagggagactacgatgatctcttgctcccttgcattactgctcttggctgccttgcacgcactttcacagcgagtgagaaccgcgtcatcgctccccttgtggagctgctcgatgagcgtgagccaccagtcattaaggaggccgtgcttgcgctcaccaagttcgcatgcaatgaaaaccacctgcatgtaaaccactgcaaggccatcgtggacagcggtggtgctcgccaccttgtccagctggtgtatctcggtgatgaggtgcagatagaggcactgatactgctctgtttcattgcattgcacgtgccagaaagtgaggagctggctcaagctggtgtgcttgctgtgcttctctgggcatcaaaacaggctcacatgatacaggacatgcgtgtcgatgcactacttccagatgccaagggaaggctggaactcttccagtccagagcctccaggtgattttggcagcaagaccagcagacatgggttagtaatttctttgctgcaatgtgtaattagagtagattttttttttctgttgttcatgattgttctatcggagttttgttctccgtaggttgtacaaatctctagcaatcaatctgtcagtaaaattggttgggattattgaattgtaattcaagaggcattttaaacagattatatgtgtacctgtaaagttggccaaaaatttagctgattgtttttcttgttacttctgtctagttggattgcaagagtgggattctgaagctttggttcctgaccaggctatttataacttttaagcaatttcacattattcagcttcaaaaacaaaagaaaactacacatttaataccaaatttatcacaaaactacacatttaaaatgaagtgtcacaaaactacatgtttagtaactaaattatcataaaactataggcttagaaccaatttaggaacaaaataataatgtgtatagctccaacataacaacggttctagggatttaaactctaaaagctgtagttttgtgataacttcaatattaaatattcagttttgtgatgttaaccttaaatctgtagttttgtgataaattttgtgctaaatatgtagttttgtgacagaacaccttaaatctatagtttcgcgatagtttggtcaaaatacctgtagttctgggaaatttactcaaaatcaaaacactagcatataagtcaactgctcatctacaatttttagaagcatgggaactccaagaaaattgttttaagaaggatcttgcatatcatggtgccctacatattgcgtatgaaaattaattttgattgttttgtattggcagatgcagattgctgaatatgtgattgattttaatgttgcagagcatccctagattgtttttatatattgctactttgttatttttcaaacttatcctactcatatttggagtttggacatttcttcatcgttcaccctgtccaatatgtctagatatttatttatgcttttagcaatgtgctatattagcatttatcagactaaggaacagggcacatcaacaaacagttgatagctgggtcaatactcaatacaacatgtgatttaaaaatactcttgcattttcagtgtatatagacaaccatcattgatacatattttgttatcacaacatgctgaaggttgacgtacaatccgtgtactctaaaagttgaccaacattatttacctatatcagccgtgca

SEQ ID NO: 61394 - DNA, 3962 bp, Oryza sativa
ttatttttgttttacattttttgaaaatgacagctgtacttttgatattgctggatagaacttctcttctgctattcaagcgtcatgtttgtcctattctctccttatctatataatgttgacaagagcaccaccacatgtacaaaacatcaaagtttcccataccagatgacaccaacttacccagctgacaccgacacctgggccccactggaagtcgcaatccagaggagccggcgtgttattgtcagttcttacccaggtgatcagtgtggccaatcaagtgaagcctgctcacctccgcagttcccggggatggcgatgccacactgcttggtgacatagaacaccttatccatgttgatgttgtccctgacgcctgggctgcccaggtaggtgcagacgcagggcacgttgacgcccttcatggaggtgcagcagtcaggtgatggctgcagcttcggcccgtccttctcaacgaacttgtagcaggttgtcttcagcacctcgacatcgttctggcattctgtacctgccgctgctgctgcagtggtgaacactgccaggaggaagatcagcagtgcagccaggctagaagacttgagctgagacatcctggtatgtgttgttctttctgatatcttgaacttctctgattaaaacttggaaacttttgatttgtgcaatgcaaatatttatagagcttttggtgcctgaggttgtcatgctccattcttgcttgggctagttgagcatttcgtcctgcactggtaaccatagaaatgcaatgcttgtgacttgtgaggtgaatggttcatggctacgtgtttgatttagcctgtgcagcagatgcaaatgcaatcggtgtgataatttgttgaaacgagagcatgcggtttagatcttgttgggctatgtgatctactgggccgggcccagttctgctttcctaaagcccatccgtgactgtttgatatgaaattgcattggtataagttcactttgggtccctctatttatcacctagtccgattttcgtccccggtcgcaaaaccgggtacgatgggtcccccaacttaacaaaaccgtttaaataaggtccttcggcggtactgtcttcggttttggctgaggtggtgcctacgtggctccttttgaccaggttttcgtccaacgtgtcgttgacgtggcgcttatgtggcaattagatgaaaaaataataaaacacgtgggacccacgtatcagtttcgcacacaaataataaaaaatgggtgggcccatgtggacccacacgtcatcctcaccaccatatctctatccccctctctctctatcctctctatccatctctctctccaaccgacggagtggagtgggcggcgggcggagtgggcgacggcagagcagaggggcagaggcagagaggggcggagacgaggggtgaagcggcgcgtcgtgggcggagcggccggccgacgggggagaagtcgcagcgcggcggtggccggaggggcgcggggcgccgaccgttgggagcagaggagccgcccgtggcctgtggccgtctgcgggtgcgtgccggcgtccaccttgatgttggtgttgccgttggcgacgaggccatcgaccagggtcttgaggttggcctgcgcgtcgccggcgacgtaagcggagcgggcagaggcgccgcgctcggcttcgacctccatgagcttagagaagacgccaaccatggccgccgtgttgtacgtgcaggcctccgtctgtaggtacgcgccccggtggtcggtgaacacgttgttgccgttgggcccgccgacgacggtgccgtcgaggtcgtgcgacttctccccccgccgcgctgtggaatgaaagcatactgctcggcaactactggactacctggtgaaatagctcttcaaatctacaaacaaaattacggaaaattacagacatgtgaatcaatgacaaattgttcattatacttttgcaaattgcaatgttttcacttgtcatttgtcaaatactcaacaaatgttacatttttatgatgccaaagcctttcctttcccctttctatccatttgtgctgaatcgggctagttgctttgctgccttgcccttgctgacttgttggtgttgctgcctgctcggcttagagctgggctgctacacgcaggcgcacagccgtgcaggccaggtggcaccgcggcactaggagcgggcaagcaccgccgcgccggcctgcagtctgcagaggctcgccacctagcctggacgctgcacccacactgttcatggcttcactcaattcgacgcgattgggattttggaatggggaattttcgaccaacggccggcgttgtgggccgcgccaccgggggcggggagcagcggcggtggtgaggacgggtgcagcttcaagatcctgctcatcagggacttcggtgtcggcaagagccgccctccctgcttcgccggctggagagagaaaagagggagagagagaggatagagagagaggggatagagagaagaggtagtgagcatgacgtgtggatccacatgggcccacaattttttttgttatttgtgtgtgaaactgacatgtgggtcccacgtgttttattattttttcgaatctaattgccacataaacaccccatcaacgacactttggataaagacctagtcaaaagaagccacgtaggtaccacctcagctaaaactggactaaataccgccgagggacctcatttaaacggtttcgtaagttgggggacccatcgtatccggttttgtgacgaggggatgaaaatcggactaggcagggacccaaagtgaacttatttcaattgcatttggaggaatgtaactggactcctttgttatctaatgctcaagtgcaactactggctgtccctctgcatgtgcatgttgtggctgaattgaacatttagcctgcaataaaattggattttctttttacgcatgtgttccttgattatatatatatggggcgtcagaatagcaaatgtatatctgctgataatctttcagttgtgaccacagaatggttaaaattgttgagaaacctgtcgattctactgatcagcacacaagcaaaccaaacacagagttgtggaacacagaaagtatgagcgagtggaagctttatttcttctggatttgagtacaagctacaagaggagaagcaggagaccgaagatcgattgtcctcgccttggaccttctgggccctatttataggcggaggagggtggaggcttacgtcgtaagccttggaccttctggcttgcgtcgtaagccggcttacgccgtaagctggcttctcctgtaagctggcttcctctgtaagctgacttgtgccgtaagctggcttcctctttaagctggcttctagcgtaagctttcttctgtagtaagcttcccacttataatttaattcgtccacaataagataggtttcataacactcccccttggacgaatttgaattatgcgcatgcctcataaaaactcatcccaaaaacctagtgggaaaaaatggtaggagaaaagagtacatggcactttgaatattgtgttgcacctgttgcctcgttaaaaaccttgcgtgagaaaaacccaatggaaaaaaaactcaccaagggaaaaagagtacaacagttgatcaagtcttcaggacttgtttgtgattcttcaggatcataatcatgggctattctcttaattgtttgctccccctgattcttgcaattcactaagtcgtctcatgccgatgccacgaacacatctatgaaaacttgatgctggcagagactttgtaaataaatctgcgagattttcgcatgacttagtttgcaggacatttatttccccgctcttctggagctcatggggataaaagaatttgagagtaatatgctttgtgaaattg

SEQ ID NO: 61395 - DNA, 8464 bp, Oryza sativa
aggatcataagatcccctcggccaccttttgccagcaatagcctgtatacgtcttgggttgcctgcgtagtatacatgggcctgcagattagaggattgcatcggagatatagagtaaacctagcccattagttccatctgtggggagggtaacagcctgctttgctggcttcttttcctcttccttttcgttcaattcttgagaaattgttcttcttaccatcgagtaagagagctgttttctccctaaaagttactacaaatctttatgattttctcattatatagaaaatccgctacaaaccctggcgtacgtgcacaaacatatagggaataagttcactttatgtccctcaatttatcacctgagtctgaaattcatccttaaaccgaaataccagatataacaagtatctcaatttataaaaccggaccacctgagatcctaggcagtattacgtctgattttagttgacgtggcaagttgaatcagcgtgggacacgcgaaccccacatgttagtgactagcattttcttcctcctttctctcatcctatctcttctcctctttctcctgtcctctcctctcttcccaatcccctcctcggcgacggatgacgggaagatggcgtacggtcatcgggtaagtcgtccctcctgaattgcagtgaccttacgccattgacaagcagcatcagccatgccgagaagaagacgagaggcggatgcagaggacgcctctccattgcatctcatccggatgcacagcacgttctatcttcttgtctccaaggtagatcaggggcagtatcaggatgtatcgatttcttattgttcgataggaagatcgaatcagggccggtcctgacattttggaggccctaggcagacttgacgctatgggccttggagttagcccttaaggagttatatctattttttttacttctaatacatacaatatactctataaagcacatataccatagagtgacacaaataaacatttttaacacggtaaataataaatcaagcagtttgcaagttgcgatagagcaatttaatctttaataaataatatcaatagtataattgacaactaaaaataccatagaaacaaattagtatgaacaccttaataggagaccacaaatatcccatgtcccttataaaaaagagctttttcgcgaccttatgagttatgtatagcacccgacaaatgtttctaggtaacattgtaacacctgaagcagtgaaattgcaaagtaaattgatagaggcatagctgcatagagcttctcaattgacttctaggtctgtgacctacctgcagcctgaagaagaggggtgaatgggaaatggccgatgagccgatgacaatcacagatcacgcgggcagggcagggaccagccaccatccaggcagccggcaggaagcatcgacagcgataccagcttgggggcttggccgatgggcgacggcgatcaggcgctataggctagtggcgccgatgcggtctcggcactcacggtggcctctcgcggactagggcatcggcgagacggcgacgaagcgacacggctcggcctgggcctgcgctgcggttctcgtggtgtggggccggtgggcagggcggcaggcgaagcgacgcgcacgcgcactgctccctggctgatcgctgattcgctgagcagttaagggcggcctgaggcgcgcgtctggggctctgggctgtggctaggcctgttggccgggctggggtgggagggggtaagtgatgggccccctctggcctgggccctaggcggtcgcacaacccgcctaggcccagggccggccctggatcgaaaaattcacgattttattgtactcttggacattaatttcttcgggacgtccttttcaagaaatgtcaagggaaaaacagctcagccgagccagccgatcaacatttcggctcctggcttggcccaccgttggaaactcatggagggaagcgaatcaggtttcattatgccgcccgtctctccgccgggcgctgccttcgtttcccaccggctgcagctcgtcgtgctgtccttcatgccactcgtcaccttggaggggattgggaagagaggaggggagagaggaagaatatagtgctagccactgacatatgggaccagcgttcctaccctgactcagcttgtcacgttagctaatactgatgatactactagatttcaggtgatgcggttttgtacattgagggacttcttgtgttggtattttggttagggatgactttcagacttggttaaaaattcagagacttaaagtgaacttattccaacatacgagttgggctgtaagtgtgtagggtgtggtagtcatggacaaaaggggaaaggaaaaagtccactttgactcccttaattgttcaccgaatctaattcgtgacccttaactacaaaaccgggcaggatgactcccccaattattaaaaccagtacaaattgaatccctcagcggttttggagggcggttttgctgacgtggcatgctgacttggcccattatgctgacgtgtcagcccagtcataaggcccacatgcaattgattagggaaaaatataagaaaacgtagggccagcttgtcagggccctcttctctctctatctttaaaaaaaaatagcagagcaactgccgtcggcggcgatggcgatggcggtggtgcggggcggcagcggtggatggcgatggcgatggctgtctgtagcgccgcttcgcctcgtcgccctcctcctcctctttcgtggccgactgctgcgtcgcgcacgccacccttgtggagcgcggcgccgctctagccaaccgcctggaggtggcgcgctcgctcctcggcgagaacgactacaccatcacgcgctgcagatgcgggcccgtgtggcaaatcctccggcgcaaccttgtcgccgagatgctgcacccgtcgcgcgtccgcctggtggggaggccgagggaggatacaacagatcaacagcaactcgtgtttcctggtaacaactgcagagctgagcaggacacaagccgccgcaagatttcatcagtgataatcttcttttgaaaattaatcatcagtgataatcgagcagggcaggcgtatccttgagatccatcccctggaaatgcacatcctgcatgcacatcacaagcaagcaaaaataattcagtcatcacaaacctacacaaagcacacatcaagcttgggaattcacacgcacgcacgtaccgattcgaaatggttgacgtcgcggtggtgcgcctcatcggcgcagacaacgacgacgacgtccttgagcgtggcgtcggcagggagccgccagtagtcgatggcgatcggtggcgtggggacgttctcaatcttgccggcctcgatgtccttgaggtactcggtgtaggagccactgctagaaaaatcatttgttgccacgaaaaaaatcgtgacatcaatactaaaattgtggcaatacatacatgttgccacaattgtaaaatcgttgctagccgtgataataggttattgcaatgatttttattttgtggtaataaatttagatgttgccacggaatggatgtggcaaaaagtcatattgcaacacttcacatcgttgtaataaaaattattgccaccactccatatgtggcattagctttacgtaccaaattaaaagttcaaatattaatctatcatgctatctatttatctacttattttttttgattttgtgtcttggctaggattcgaacccaagacctatccttcacgcgtgctctcctttaccaactcacctacgtatcaattctgttggaaaatgtatatcgttccatttgagcctagctaactgagatttgaatcatagatttgaatatctaaaagatttcaaatgaaaaagttatcacctacaaaattgtagatctcgtcgagagctataattttcatataaaatttgtctcaatccgtgtccatatgaaaaaattaagttaaattatgtgacgacaatttttttattgcaacgaatttgttgatcgtggcaacaaaaaatagtgaaaagtaccatgtactatataaattgccacaaaaattaaaattgtggcgatagaacatgttttttgcaacagtacgattttttgtggcgatatctcattttctatagcaacaaaagtactaaataaaacaacgattgcagatcgttgcaataaaaaataattatttgccacagaaaaattatcattgcaatatattgctacgaattattttttgttgtaataatttggtggcaatagctcaattatgttgtagtgagtggatggcctcctcttcgaggtagccgatgacgcggtccgcgagcttgggggagaggaggtagctgaggaagtaggcattgaagaagacgcgctggtcggcgagcacgagcgtgcgctcgtaccacctcagcttggccacctccatgaaggtcatgaggtgcatctgctcgttctcggcctcctctaacagcgcgcgtatccagccaccgctgtgctcgaagctggtggcgctggctcagtcccgggccttcctctccgactacctcatcaacgccaccaacggtcaccccttcatcttcgagggtgccttcttcctctccctcgccacccgcatcaacttcggcacccccaccaccgaccccgtccgctaccccgacgactgcgtctgggagtccgacatggcgcgcagcccaacttcctcgttgaggtcgcgcccgctaccgcctagacctgaccgaggctcgagagcgaagctcggcggccgtcgcccctcgcccgccgtcgccggcgtggccccccgcccgccgtcgccgccggcggcgccccccgcttgctgaattgggagggagagagagataagggggagattggggaggatgaggaagggatagactgacatgtgggccccacaaagtcttcttctatgtgaatgacgaatgggtcccacgcgtatgtttttagttataatgccacctaagcgtcacgtcaacagcagaccaagtcaacattgccaggtagacgccacatcaacgaaaccactcttcaaaaccgccgagggattcaatttgtactagttttagtaattgggggagtcattctacccggttttctagttaagggtcacgaattagattcgatgaacaattaagggagtctaagtggactttttccaaaggggaaaccaacagacaagttgggctgtaagtggttagcggcccatggaacagccttagttgtgcgtgtgttagctagaagctggttatattacagagtaaattttagaaaaccatgtgtattaagacatgtggcatctaacttaggtattatggttttaaagtttcacaaaatcccatccttatgcgttttgagtgtaaatttacttaaaattcaatagcaatgagagtacataaaaaatttagttattgagtttctattaagattggtaaaaatccaaaataaaatacaaatagtccgatcatcaaacgggtaaaaatttaaaaaggaaatgtgacccgagtcgatcatgtggccaaaaatagaaaatccgagttgatcgtgcgctgctccgaacatgcggttgattacgaattgacattattttcccacgtaacgcagatataggccacgcccacgacgattggatatgggaaaagtctaatttatccactaaactattgggtgagtacgaattaccctcatatcccgaaaatcaaacatatttcaccctccaccactaaaatcggatgaattacccccttgaccaaatccagagtggttttgtcctaccgcgtggtgtctgataaaccaatccaaaaataaataaataaagaaggctacctcacccctctcttttttctctctgtcgaggcagcctacattgtgggtgctcgtggtggtgtccatggcaacagccagccgtccacgccgaggtccatccccttctccctgttgcgcgtctgcaatgccctcctggcctccgccgagctcgatgcccctctcccctcttcctttcttcctcattttggcggtcgaccgacggcggcatggcgcgatgcgatggagtagacggcaggggcaaggcgtgtggcagcatcggtgatgacagagatgacgcggcaaacgcagatatgatgaggacatcacttcgtcggatacactcataacttcacacgttccaatgataattccaagtccaagttcaattcggcctccggagacagcactgacttcaaacggacctagcgccttcatgccaactccgatttgggtgatcttggacttagtggaaagattatctcgctacctttcaaacgcatcttgtctcatgtccaaattcatctcgagtcaacgggaatcgccaaaacaagacagtgctgttgctaaaaccgaacttgggccttgggccttgtaatagactaggcccatctcggaagtgtctccctccacctctacaaattagcacttaaccctagctttattttcctctacaaatagctttatacatcctaaaaaataactgggttttgtttagttgaattttgccaagtgccattcaccttgtctctagtcctcgttcgattagtcggcgactattgattcagagcccccaacagttggtgtgttgatttgccgagtcgattagatctaccacttcaatcgcaactattcctttgtgtttaatcacctattcgcaatatttagattgcatcttatcttgttcttgcagtgttctctcgtttgtattgcagggatcatcaaccgcacgtcacggttggtacgacatcgtttgtggtgtagcgattgcacgacgtcctggacttgttctggttggtagccacgtcgcaaacgtcgcactcgatcaaagcgagagttatcccctcaccagaaaatcaggccacgagagagagcgtcatcaagataggcgcaacaccgagcctccgccgccactctgagttgcctctcctgtccccacccattgccgccgtcctcggctccccctccgtcgtccctgccctacctccgtcgtcctcgctcgccgctgccgtccttagctccccctctgtcgtccccactcgccgccaccgatgcaagttgctccctatcctcgcccgccgccgatcttagttgcctatcccgtccccgccctgcctccgtcgtccccgcccgttgtcgttgttctcagttcaccctctgccatccccgctcgccgccaccgctccgagttgcatcctccatccccgcctaccgctgccatcctcggctcctcctctaccgtcccctcccgacaacgccgctacccactgccaccgtccttggctcccctaccgccatccccacctgctgcctccgctccgagcctcctcccccgccgccgccatcctcggctccctctccgacggctgctcggtgatatagagagagggggagccgagaagaggagagagagagaggattgggagagagagagagagagatagagaggtgaggggaaagagatagagaggatgagactaataggtgggaccttgctgactggattgccacgtaggaccaaaaccactctggtttaagtcagggaggttcttcatttggtattggtagttaagggtgaaaaatgtctggttttcaggtctgaggaggtaattcgtactcacctaatagttcaagggtgtaatcggactttcccttagattaaagtgatgggaagaaattaaaatgtaccattcatcctaaaatataagggattttaatatgatgtcatacggtaatttttttttattttaggacagagcgagtaagtccgatacatgaacattttgaccatcttaaagtgatggttcttaaggttagctgtacgctgttgctttaattttatgctgacacggcgatgatcagagcaagctcgatacatcgcgctagcgccgtgctgatcgtcaaaatccaaaaggctcgtaaaaagcatggccgatcgacatgataatgaaacatgtcattttccatatggataatatatagtactatgttcatatggataagtcgtcgctgtgctgcgaaacttcgtcttgattactactattccagctgcttaatttgcacaactttaattctctttatctagctaagctaggtccatctctctttcttatccttctagagatcaaccacacaaaagggctcgtacgtctccctttttaattccttgcatgcatcctgtcatcatccacctctttctgtcctccatcgattcgatatccaatatggtgtatatggtctttctcctaacacacgtttaattagtatcgtcatgccttacttcagtttcttacttaaattactttttggcacatgatcttctgtctgtccttgcaaaaaagatagcagttgaggggact

SEQ ID NO: 61396 - DNA, 1507 bp, Oryza sativa
tacggaaacaacctgcggatataggaggagttccggataagaaaagacaaccagagttctacatggaaacgataaggactactcggattgtatccatattggtttccctagttctacttggacaaggggacacctatgggtataaatacaaggccccctaaaaggagaggggatacagacgatcaacacacacccaccatagaagacacaaaacaatatatcaagacacaagatcaacatacaagccaacatacgccaagacaagatgccggatatcgatttcagggataagcacggctagtcccctacggtgtctccagatactgtcaggagagacgaaagcgctatctttgatctcgccgggcacgaactcgaggaggaaggctaccctgttgtcaactacgagtcagaccttcagaccgccatatcgacaacagttagatagactaccccaaatattgtactagtgtgattatgatgaataagagcaatgaccggcatcagccaacaggatgtagggttattacctgacaattcaggggcccgaacctgtataaaaatccctatctccatctcttttacctcagtctcgtgtatatcctagtaccaatgatccccataccatgcgaataccggaatcgcgacatcaaacgtcgacaggagggcaggagccagcgtgggtcaagctgtcaagttgtatgctctctcaccagcacgagtatctcgcttgtggtcaaggtggcctcgacatatcctcgctcatcaacgacctcaccgtcaaaaataccggaggcttgtgtcatccatccaactgcaactgtacctgggattcccacgccggagaggaagaagagaagatatgagaggggcagtgaggtcattttctgtttcttttagtatgttggccgtcaaaagtgataaaatagaaacaatttggtgaatcacgatgacaaacaatcaaatttactgggaaagatggatagcatttgagaatgtgccattcaatagagtggcaaatagtccaaaatctcgcatttgtatggcatgtcacatcaacgccacgtagcaagctaaaatggtccatagctatcttggaccagaatgacacacttttgctggaatggtccgaacagagtagaaaattggagagcaaatcgaatcaaaaaaataatatatgacaaaatgatcttgaatggctctcttggcacttaaagagaaatgttcagacttaattttcactcttaagcaaacggccggcgagcaggtgcctgcctttcactggatatttcggattgttgggccgggcattaccgggccaggatttggctagcttcattcgatgggctatagcccagtctaaaatgcctctcgttgagcactgagcccattgggtttgtacatcgctggcactttcgaagcgcgcgcacctgcgccaagagaggatcgatggtgtgcaccgccaacgcggcatctccgacgcgtgtaacgttaatcgcctcccagcatg

SEQ ID NO: 61397 - DNA, 1050 bp, Oryza sativa
catgactcgtgaacttccaggtaatttcatcattctcgtgttgagagttttatatgtaaagttgaaagtttaggatttgagttggaagtttgaaaagttgaacagaaattttaattttttagttaaaagtatttagagattaaaaatcaagactccacatcttcgtttggtacacttttagcctcacaaaagcctagcgggccacgtgagaaaccagcctatgcttgtgggctcatgcgcgagcgacttctttaagttgcatgtctgtgcgaaaacgactcctctcgccactattttatacgtaaaatctaattcgagagcccctctcgttttagcgctattgcgcgatgctggcagagccgtccgatctccaaccacacgcacacgcaattcctgcttcaaagagagtcacagagagaaaggctacagttttctctcccatgtcatttttctcttcaaacaaagttttctctcaaattatttatccgatctacaatttgattacaccattgtgtttgttataattaaatcttcacaacaagatcttacatgattatattacgatgaaaaaatatttatatttgtaaattacttttattatatacgtaagttacttttatcatatatataagttacttatagatttcactaaattacttcttagacatataaaagtaaattcaataaagtctgcaagtaatttacatatattataaaagtaacttaaaacaaaacgtaagtaactttgtcacgacattagaagtaaattcgttgtagggataaaaatatactttatctagaaattaaatttaatcagcacagatcaacacacgtaagtttaacaatttttaaaagtaacttcaatgttaattggaagtaacttttgcatggttcaagttgaaaggagatgctagatagagtacaaactagctaccactagctgtgtagtcacgtccaatgaaaaaaatgtattaattagagttactttctttttgttataagttacttctataatatatgtaaattacttttaggctttatgggggatcc

SEQ ID NO: 61398 - DNA, 1112 bp, Oryza sativa
tctagatgccttactccccctaatgttgggaaatggtcctcatcacagatacaatcaggcgtaccgagccgtatgaagatccccagtcataggctcaagatacttgattatggacagtctcataaccaacgtatatccccaacttccggtggggtcctatagaagtacgctgtggtggtggggattacgcagatgggaaatacttggttcttttccacgcactagctgaaggggggatgtactatgatatgcagttggcctgagttggattagtgttgctgcatgcaacacagcatggccccaacaactggttggcagcctacaatcttgcaacagtgtccgtgcaatcaacttgatcctcttgatcaaggactcagctaggccatttcgagtgtggacatgtggtactgaatattctaccttaatgcccatggctaaataataatcatcaaaagccttcgacctgaactcaccagcattatccattcgaatggattgtacgcagctatcagggaagctagcttttagcctgatgatttgggaaattagctttggaaaagcatggttccttgtggacaataggtccacatggctccacctggtagaagcatcaatcaataccatgaaatacctaaacgggcccgacagaggctggataggtccacatatgtcaccttgtattcttgccaggaaaacaggtgactcatccctaatcttcaggagggatggcctagtgatcaacttcccttttgcacaagcagggcaaataaaatcttcaggattagggaagtctttagtttcaacattgtgaccagcaaaattgttgatgattctcctcatcatacccaacccaggatgacccagtctgtcatgccaaactctaaatgactctgggtttctaaatatggatttcatcgcaacatattccttagtgggttttatgtacgtgtagtacaaacccgatggcgatgaagggagcctttccaccacttgcttttgatatccatctatttttgatatgagcagatattcagcatcttgctcaatctcagtttctatatggaaactgtttgcacggatatctctaaagtttaagagggtacgctttgaat

SEQ ID NO: 61399 - DNA, 1424 bp, Oryza sativa
tactcccttcattttttagatgtttcctttttcagatgtttcctaatataaggcatacatgaatacatgctattaactagcacttctttctcactaaattattatttttttcaatgctctatccttaagatctttaattttattgggtgcatgcattatactccctccgtattttaatgtatgacgtcgttgaatttttgaccaacgtttgaccattcgttttattcaaaatttatgtgaaaatatgaaaatatttatgtcatgcttaaagaacatttgatgatgaatcaagtcacaataaaataaataataattacgtaatttttttaataagacgaatggtcaaacgttggacgaaaagtcaacggcgtcatatattaaaatatggaggtagcatatttattagggtgatccaaactatgaggtgataataactactctctctgtcccagaatatagggatttttagggccggatacgggtattaagaaagtaggcagaattaaatgggagaaggttgtgattggttgagaagtggaggtaggtgagaaaattgaatggtgaagggttgtgattgattgagaagagaacgttggtgaagaagttattatgttttggggcaaaacttgaatgctagaagtcgttatattttgggatagaaggagtatttcttggcctttatgggttaagtgtggttgcgccttatattttggaatgtagggagtaccataaagtaagacatcatttattacttattcacagctttaatagtacattgtggatatccttagagcgggtacaataagctgactaggcgggctccaaaattatgcactacagcatattcctacgtggagggaagagaactgatgggagagaaggaaatggatgacaaatttgtcgccgggcgatatctctcttctcaacgtgactgcagtccaactcgactattaaaaacacgcttggtaggtcccacacaccacaaccaatccccttccccaccgagcgagatcgatctctctttccccctccaccccagccgagcccgctcgatctccgcccgcccctcccgtgcgatcttgtgcgctcgactcccacgcgtgatttccgcctctccctcgcgcgcacaatctacctcctctctacttactacttcatccacgagcgtgaaaataaatttacatcttcctattttgccggccccaaaaatccggtggattgacgatgccgcctccactatccgccttccctcttctacctcgcttaatcgctcaccgaaaaccctagttctttaccaccaaggcactaacaaccttgtctcgccagaggaagagagaggttgcgccacctccatgtaccatcgcgagcttttcttaaactcccggtgtttcaaaaattgtgatatatgtgcccatatgcaataa

SEQ ID NO: 61400 - DNA, 1713 bp, Oryza sativa
aaggctggacagatggagaacgctaacatggcctgcgcagagatgaaggccatgggattaatgcctgactgctgcaccttcaacattctttcggctggagcatacaagtttgggaaggctgcgttgtttgtacttgatcagcagcagttgcatgaaatgtttggttcacagttgtcaacagatgggatagatatgttgatctgtagactttgttgggatgggcgattggatgatgcctgggagctcctgtgtagcgctattgagaagggtgttcaagtgagcgtttcaggatttaatgcgctgattgctgcatatagcaaggagggatttgatgaagaagcttttgagctatataaaactatgaacaaattaggtcttgcaccatcatcatcaactttgaattacttgataatgggactgtgtaatcgtgggagacttgatcaggcacggctgttcttagaatatatggttagaatgggatattgtgtgattgcatcttttaccatctacttggactcatccttcagagctggtgatgtattaggtgccttgaagtgttgggatgatatgaaaatagttggtttacagcctgattttgttgccttctcggcatatgtcaatggtctttgcagactagattttctagatgaggcttacaatggttttatcgagatgataagaagagggcttgttccaaataattttacttacaactccctcatatctgcattttgtagggctgggaatgtgtctgaagcattgaaattagagcagaagatgaggcagagtggccttgttcctgatatttttacgaggaacattttaattgatggcttttgcagagaagggggattgaacacagctaataaccttttctttggcatgtacagtattggtttaactccagatgttgtgacatataatacaatgctcaatgcatattgccgctctaaggatattaatggtgccatgattttcatgaataagatgcttgcagatggctgtgaacctgtatattttcacatataatatttggatgcacagcttgtgtagcaaccatctgctgaatcgagcaatgatgttactggatgaattagctgcaacggattgtgctcctaattctgttacatacaacacattgatggatgggatctgcagcgatgttctagatcgggccatgattctgactggcagactgattaagttggcttttcaacccaacactgtcacaattaacattttgttttctcatttctgcaagaatggttttggaaagcgggctcttgtgtgggctgagaagctgagagatgattccttcaattttgatgatgctacaaggaatatacttgactgggcatacagggatatggaggatgatcctcatgctagcagtgcagacattgataagtgcctatttctcgagttcttaatgctcatgacatgcacaactattcgcaacagcagatccttcaagtttacacatgtacctataaatacagtttttggtcattctggcagaaaaagtttggatactggatgatcattgaaatgttgaattcatatccgcgtgagctactggataattttcaggtcatggacagctctgctgcaggagtaacatattcactgttatgctttttcatgactgacagtgcgataagatgcaatggctactgttcacattgttactgtcaaatggaaagtcaaaggatt

SEQ ID NO: 61401 - DNA, 706 bp, Oryza sativa
cccccattttttgtggaactatggggctgagctaagaaggtctaatccaggcagttgcttctttttgaacttggtagacagttgtttcagcacatgttacatgtcctttgatgcatgtaagagagggtctttgagtggatgtaggcctttgatatgtttggatggttgccacatcaagactaaatttggtggacagatcctaacagcagtaggtattgaccctaatgattgcatatatccaattgcaatagttgtggttgagacagagtcattgaggtcttggagatggtttctacagaccctaaaggaagacctgggcattgacaatacctacccatggacaataatgactgataagcaaaaggtatacctgttctttatttttcttataggttacataacaagttttgttcttataatctgacatatttcaaattgttcttatgtttgtttttacataacacagggtcttataccagctgtccaacagattttccctgattcagaacacagattctgtgttagacatctgtactccaattttcaggtacatttcaaaggtgagaatctgaaaaaccagttatgggcatgtgctagatcaagttcagaggttgagtggaatgccaacatggaagaaatgaaatctcttaatcaggatgcatatgagtggcttcaaaagatgcctcctaaaacttgggtcaaagct

SEQ ID NO: 61402 - DNA, 3355 bp, Oryza sativa
tcggaaatgatatacatattaaatgtgaagattacctaccttactactgagggtaattataagtcatcaatatataagtgtccaacccttaatttgcactttgcgactggtgtcactgccgcattcgatcacgtcgggccctgacgctgccgccgtattcaaaacttgaggaaatatgtttctagattttttttttgcgtcctatacatgcgtctaaaatcaggagaaatatgttgtttgactgaatgaatggtgatggaagcatcgaacgacgtctattaattgacatagaattggtcttgcgtcatatatttatgtcaattaattaatatatgtcattcgatgttttcatttccattcatttagtgaaacaatatattttccttgattttagaccactgcgggagaaagggtttttaatgccagttcgtaaccccttagtcccggttatacaaccggaactatgattctgggactaaagatgtccatgtttagtcccggttgaaataactaggactaaagatgaatctttagtctcggttggtgttatcaactaggaccatagatggtaacgccatgtggctggtgtttccatctttagtcgcggttgttgttatgggactaaagcttttttctttttttctttttttttttttgctatcttgcatatcttacgccatccccaaatcattccaatatcaaaatattatctcccgacatccaaaatcatctaaaaaacataatcccaaatcattcacaacaacaatatcatctcctgacatcacaaatcatccataacaacataatcccaaatcatttacaacaacaaaatcatcctcaaatcatcacaaaacaacaacataatccgccgcggcctacagctctccgtgcggcatggccacgcctgcgctgctgcttgcggccctctgcattggccgccgcagccaggccccgccctccgcgctggccgccgcagccaagccccgccctccgcgcgcgacggctgcgcctgccgccgcctcctgcggccctcaggcgccaccctttgcgagtagaaggggaggaggagaaggagggagaggggaaggggacaccctctgcgaggagaaggggaggaggataaggagggagaggggaagggaaggatgagaaggagagagaggagtggaggaggaggagaggggataaagaggaattaagtacgtgatgtataaagataaaggtagagagtgaatgtgagagatgctaagacttgggagattgatatttactcccggttggtaaataccaaccgggattaacgatacgatttttagtcccggtttgtttgccgtctaacatagcctgacagtaattgaaccgggactaaaaatgatgtataaagatcaaaaagtacccatgagcttttttaccaggactaaagatcatttttagtcccggttcctattcgaaccagggctaatataatttttgcccaacccagtaaagatggtttctccagtagtggacacacgactatagaaatagctagaatacgttaatgtattgcatagacggttggccccatatatggaccgtctgcaatccgagagcatctccaaaaatcattttccaaagtagtagagggcaagttatatattttcacaagcatatatatcctctagttctactcctagttattaatgatttactagctagtactaaagtttcatgacgtttctaatgccattgaaacgcggatcggatataagctaatttgactatgaatttgcttttgaaccagaggggtgcaatgtgatgcatatgcatgcgtgcgtggctgagctagctatgaacttagtaaagtaacgcaagacagtacgtcgatccatgcatagttcgatagtaagtacttaatcatgcttgaattgtacgtcgaaccagtaggccgggtagaaattagctaaagagaggaaacttaattaatccattgctgctatccgggcaatcgaagctaatttttctataccaaaattttggtagtgtcagaacattggtaagttttggttactactaaattttgtagcattgaatttgaactattgtagataaattttggtatcaaaccaaacatgcatgtgtcattattaaagttataaaaattttgatagggtaaaaattagcatcaaaccaaacaagctcggcaagtcatttctatagctaggatgccatatattatatcatacatcgatcaataacaatgagaacaatgttatacatgttcaagttgtctcataagataagctcacaaagtgtccattctaaaagttaattaccttcgagctttcttaatacattacttatagctttcatcaggattgagctaattattgtattcagaatgctttgaggtaattaactttcacacaatcctgatgaagctaattactgtattcagaaagttcttaggtaattaactttcgcaatggctaattggctatacacatcagtataaggcactaacttttttttcagctagctagtttactgatctgcatgcacggtcaatttcttagaacaccatggtcaattttatctaatagcaatatatatatagctgtaattaagtctcaggtaactgaaattcaattaatacgagtgtatgcatggaaagtttcattccgtagtacagtacgaactgccattgtttcaaaaagaaaaaaaaaacgatctcgatcgattttgatgcataattatactccagatggataaggttgctatgtcacagccagcaggtgctagcttgtttagcaacatatataattaggtagcaagtatatatagtggaattaacacaaacaaaaggcatacattacatttgatgcatggctcaacgacggccatagcttttttcagcttcttcttcttgtacctaccgatcgaccttgcacgtaccgacgctgccatatgcatgcagagactagcttcagcattcgtacaacttttcttttactcttttttaattttcagtgcagtatgactcaaaaaggtcataaaaatttggaccatatatatctggtgtacgagctgatcaacagatattacattccggataagcatgcgtccattaaagagagagtatagtagattaagactagatagctacgtgcctaaatatagggctagatctagagctataacgaaatggcgagagtttgcattactctactttgatctaaatttagattgatgcggttgcttaaatttaatttaaaccaactaaaatgtttttttactaggttcctgggcaaattaattaatgtagctctacccctgcctaaatagtcttaatataatatttaatctagtatataaa

SEQ ID NO: 61403 - DNA, 2056 bp, Oryza sativa
cggtacacaattaccagtagtactagtataccatggcaaagagcgaccgaggaggctaggcccatcccacccatacggaccggactggacccgtcacgtccatctcctctctcgtcgtgggcccccaccgcatttgcgcctcgatgtccgcgccctcaacaatcacatcgcatgtgcccccctctcctcgacacccccatcgcttctgtacattcctactccactccggtagcattacgattagcatcaacattagttacttcagctaagtgatttagtcgtactattagcacgattttactgttaattggttaagtaaataattagtatgctgtagtagtgctaattaagtatagtagtagtagattagtagtataaaaataatgtaatagtgcgtgccgtgcccggctgcccgtgtgccgggtcgccctccctcgagcgacgaatctgccggcccttaaacaagaaacaaaaccacacgactaatggcatgtacaatgatttttattaacggtctctctttattatcatacaagcatattggttgatgtggactagagagaaaaaaaaaagagaaaaatgtttgctacgtataaaagatgattgctccgtatgagtatgagaacgatacagagtcgactcttagtatttattagaaatttttttattgcattgagtgtaataaaggaaagatgactactaagaaagtattttgttatattaatggttagataccgtattatcttaactattgtaacatgatggcctctaattaacatagaggccttactgagtctctcccttggtacttgccctaatctcatcgtgaaaagcctcaaaacctgcaattaactaacatcctaattaatcaagtaattaatcaacaatctacagcgtacaaccgatacagtctaccactaccccctacagtacaacaacaaagctcatcaaaaatacccccactcacactagtcaacacatcgtctcatgactaaaatgtttttgttactactacaatggcgccgacatggccgccgggcatcaccggagcacgagcagccgcagggcgtggaccaagaacagcgccagcgccgcggcgggcgacggccgggacagggacgccgccgccgtcagctcgccggtggccatgttggcgatccacgtctcgctgccgctcagcaccacgccctcttcgccgccgccgccggcgtcgccgcccatcggcatcggcatgctggtgtccgggacggcgtccgtgaacgtcgtccccggcatcgtcgtcgccgtcgccgtcccgggcatcgtcgccccaggcatcgccgtcgccgtcgttggcgtcgtcggcgtccccgtccccggcatcatcgccgccggcgtcggcgtcgccgtcgtcgacttctggctgccgctgcgcaccacgtgacatggaaagagaaagaacaagcgcacatggtcagctcacgagcaatgtgtgtatatgcatctggaatcaaatccatggctgcaagcaaaatcaacagtaaactaatcgcgcgaaacaaaacaaaagctcgggtttgcacttttcttttcaccctatctgcaactaattaactaaagataatgccaagatctcctccacctaattactactacactacaatccttgcactttctttccatttctagctcacaacatgaacagctcactaagcatccagatttgcagctcagatcactctctgacagtgacagtgagtgagtgacagtagctagcagacagcagtggaaagagcagatgaatggcgggagagaggtgaaccttggggaggaggcggggcagaaggtgagggtgtagtcggggccgccggagcaggtgaaggtggaggtggggtcgtcgaaggcgtagctgtaggagcgggggcacgccgacttgaacacctgcgagtacgccgtcggccggcacgtcgacgggttcgcgaacgcgccgctgcagcagaactccggccgcccgaacgcgtcgcacgcgctccggcacgccgcgccgccgcccgcccggagctccgcggggcacatc

SEQ ID NO: 61404 - DNA, 2012 bp, Oryza sativa
ccgcccgcgccacgcccggggggagctcgaaccccgtggtggccagccgcgcgctcccggcgttcgacagcacgcccggccacaccgtgtccgtgcaccggttgacgaacgtgaacgtcgccgcctccaccccccaatctgcgcacacacacacacacaaaacaaaccatgccgccattaccaaccatccacaacaacaacaacaagaacaagatcaaacatcacagatttacctacctctccataagaccaagaagagcacaagaacggcggtggcagatctcggcaaccaccccatcgccattttcttgatgcaatgcaaatgcaatgcaagaagcgtgcagttgtcagagattcaggcacagagcagagcagtggagttactccacttcacttcacttctgcagtgcactaatgcagagagagagagagaggtaggggacagccaccacaagagcacttgggagtcttggagatggagaggagagagtcacaaggatggaggagaggggaatctttgggatgggtacaaggttatacagggagagtgggggcaaatggctttcttttttttttttttaccttgcttttggggcaggagtgtacatatgcatgtatgatcatgtttcctgggtaaaagtgagcttgggaatgggccttggttgttgattgttcctggggcataggctttcttcttttttttttactttttattatcctccccatctgtgtatattttgttatgggattgacaagggttagggtagagtgagtggattttgaggtccccctcccccctagattgaatggggggaaatatataggattttgatactaagtagcaaatatataggattttgatactaagtagaagtataaaacagaagttgcaaaacacattagcttaagagtttaagaaggaaaagaagactagttggaattttctaatcccaccattttatattatggggttgttcagattatagtcaaaataaacctcactaaattttggcaatacaaaaaatttagtaagttgacaatattaccaaaattttggcattatttcttacgcatttatgaaagtttggcaaaaagattttggcattatttcttacgcatttatgaaagtttggcaaaaagttaaatgtatgtacattttggaaactttaccaaaaatgtatggtttaaaatgacatcatatgaactgcccctgtaagttgtttttgatttttttttctaatcaaatttctttaggttttaggtttgactaagtttatagaaaaaattgtaacatctacaacatcaaattagtttcattaaatataacatcaaatatgttttttatgttagaaatgttgttgtatttttttataaatttaatcaaacttgaaatagtttgactaataaaaaaaagttaatgtgacttatgtatttaaaacagagggagtaatactattaggttgaacctcaatactaatttttatccaaaatctcattgtcttgagccatttcaattgaattcgtaggagcggcgatcctttgctccaagtgaaaatggaataaggattattttttgtaagaaatgttatgtactgatcgatcgtgcatatagtgacagctctagttatcatccatgcgtgttctatttattagaacatgcggcttttattagttggtctaatgctgattataagccatataacttgttaaaaaaatatgatttgtggataaacttatgtatgttgtatgtatatttccttggcgattttaaaaaccaatgctaaaaaataaactttgataaaaaaatcaaaatcaagtttttaaattcaaaaattaacagctgaagggcaaatgacgaggtgatgagtttctcgaatgcaatgtaagtaagaaatgaagggttccatttgaaatatgcagaacttttttccatgactctacataaattgtactaacttatataaaagttcttcaaaatctccatttgaaaccatgaatttgataggacttct

SEQ ID NO: 61405 - DNA, 2310 bp, Oryza sativa
tggataccacaatttgttgaatgacctagctttttaaactgctaataggaccagtaaattgtggcgaatgatctagaagttcatttcttcttttgcttctgcaagtattttttttatacatgttttcttagatggcttcccccatatatgttccatatttggcacagtgtttcatagatttctagttatgattttaacttaatattggagtcaatcatctgctttattgtatgtatctgatggttagtttgtttctttatgctttgaatgcaaagtgcttcaagatcgtaagatgggtatgcactgatcttaggtttagaatttctacttgtggcataacaatatttgattgctgcatcctgatagttcctgtgattggctttgctcaaaccactgatcttatgtttaacattgttgtatgagtgcctttggtactattcatatctgtgctcagtattgatgttctcctcgatgtcacttcttttgcatatgactttcacaaacagtggaaagcctaaggactatgatgtctgtgaaggaaccaacggatggccatgcggtagatccggaaaaatcctctgaatcaagtgtaggagtttgttcaaaggagctatctgacagttccagtatttcctgttgtagagagaaccaacgggacttaaactgcaaagaagtcctacacgaatcatcaatcaatagctcccctaaccccaccgtttctctcatttttttggattatttttgggctccttgtttaatttacacgttgtcttttactgttttgggctcctcatgcagattagcttgacgctttgccttgttgtgtccggtaccatcaaccgggtgttggatgtttatgccgagcatgtatgctctatgcgttttttcaaaaaaagaaaaactctcaggaaacaacgaagtagtcctccttattctaatttttacgaaaaaggacttacctttatatgaaatacaatgtaatcccaaaaagtacgagggcattctcaaaaaaacagatcctaatccaatccctcctcttactctgctgccaacccatccccaacacgcaacatctctctgcccaatccgccatccccatccatcaggctaatccatgcggcctcctcccggccgggggcaaggacggcgccggcgtttacaaagacgacggagcaaggggacgacatgcctcctgtgctgacctcctctaccgtgatggcctcctcgaccttgtggttgcgtccacggggggagggaggaggcggcacccgcccgagctgccgccggtgctcccctcctccttctccatccacttgtggtgacggcggcggtggcggcggggggagggcagatccggcgcccgacgccggcggatccgccgtcgtgccccctcccttcccttgtggcggcagtggcgaaggtacctacgttggcggcagagccggccgcgcgtctgccgccgatgcccttccctcatggcggcgtcggaccggccgccggcgcaggactgccatacgtcttcccccgtcgccgcgttgcctctccgtcctctcctccgcagcttcccaactgttcccctctcaactctcgacctctcctctctacgcggaacaccatgaccgtcgccgccgaggtcgacgcatcccctgacggagaggagaggaggaggcaagcttgcaatcgcacaaccatctatcgatttctcccttccttctctttcttctttctttctttctttcgtttccccctctcacatgtcaggttattttttctcctcatcctctccggatgatttcacttttgctcgaaatctctcatgttgttgtgttgaaggcggcgaagggggaaactttggtggtggtggtggccggagaggaggatggcggcagcggcagtgacggcggcgggtacgacaaggccgggatggactccggcaagtacgtgcagtacacgccggatcaggtggaggcgctggagcgggtgtacgccgagtgccccaagcccagcttctgtcgccgccagcagtcgccaacatcgagcccaagcagaagatcaaggtctggttcccaaaacagaaggtgagcaaaagcatgcagggatatactatcaaactggtttgccttctgtgtgtctggctgtgaaatgttctggacaaattggttgacatggagcaatagcaatagtagtgttcaattgtttgccttggttgtgcatactctgcttcaactatatttaggaattgcaagtctatgtatttatttgttttgttcctttcttgcataatggaacaacctttatataatcaaggaa

SEQ ID NO: 61406 - DNA, 783 bp, Oryza sativa
gcgagctctgtagcatatatagaatgtttgctatccactggtacatctttaacccgagcctacctactgtatagatgtgtttagtacgtgcttactatgcttaattttggggataatatagtgcgacgtgtaagaaaattcagaactatgttgtatgctctagctgaatttgtttacttcctacaaaaaaaatggatgaactactgatccagttcatgttgtgatcctcctccaaggagtttgttttgtttctttgctatctgaaagattccttttttttttttttgctttgttgaagtggaaggagctcattggtgtacctttgttgaaatggctccttttaatcctcattgtttcacatgtctgtttcattttcgtttttaaggggctggccttattaaaggttgtttaaaagcttaaacaagacttctgtttgattgatctttagtccctattttacctaccaggtgaattgtcgcctcgggtaagatattgctaacagggaattaactctatttcattgccttgtaattaacttgttatactaaatcagaagattctccggaggaggggatcaggggagaagaaaccaaagaaatggcagcaaccctcttttttccggaggcgatacattgatactacttcgatagtagtagcggtagtagtcgtcgtctatatggatatagaacgctacagagttcactactgctttagctattgatactacttcaatagtagtagcagtagtaatattttggaactaaacaaggtcatatatatata

SEQ ID NO: 61407 - DNA, 1708 bp, Oryza sativa
tttctaccataattgaatatatgtgccttttatgggtaagaatattcttatagcttctgatttctcttgaatatatcattgaaatctggtaatcagctatcaggggatgagctaaagattgtactggtggatgtgaatggtgatcacatatttttggagtcatccgtatgtaactacagtgttgcatattgtagaaggagctatgctttaccttccatttaaaaaggaaaattctggggtcaccctcacccatatagaactatagcatgtttactctataatactgatacaacaacatctactatataaagtttgaaagtttttaaagtataacaaatgattcgcttagctattttaagctccgaagttactcatttctgtaagaaagctgacgaatttatgacatcataaattggccaaactagttcatgctcttgtcttttcagaattaactagctttcttcacgtcgtacatgcctgcaaaaatagaggctgtgatgtgggggtagcattgtagcaaccatgcacgacaatctcatatttcttttatttttcctgtgactgttcttgtgcatctgcaattcacaccatgagctttgttggtaaagattacatgaataatactccctctgtttctttttatataacgttggttagttcaatcatatattttgggatggaggggggtattcatttggattatattgtatccagtaacctttcatgtgtagtcttttctgattgcttttatttatgggttacgttaaaggatggacacgaatattcgtttcatcatgcactacactgaactaattacagagagctttaacatgcattcttgattctagtgaccttcagaaagatggattctagtgaaagaacctttctttcctttggggttacccacaagtagttgtcaaattgctagaatttcgaattgccatatatgtgttgtgcgttaatgttgttacatatcccagttttgctggtttctgtgatggactgatggtcttccataatttggcctaactctccagtaatggcaggtggaggtggtgaaggtgaagatgctggtgcagttcatggaagtggacggctgtaggatctttggtttgcagaggtgttcaaggatcagctatgcatctgcactgctttcaccaatgtctaacgtattaagcacatactaccatataagtattattagctattctaacttatgttagatcacgcatgtttcagtcgtaaaaggccaatgtgtcagttgctctatgtttgagattacagctaatactccattgagcatatatttgctttatgcgaagatattatcagattatctttatgctccgtagttcttctgtaaacagaagatgatcttattctgtttgttctgtgataatccagcagctgctctagcctgtaggctcttctcagaagtagcagttaatatcttaaatggaaaattgatgattttctccatagttgcatgtgcttctacattttgtccaaagatattttttcttgatcttctgtaaacagatttgggacaaaaaacatgaagtacagtctgtacagacaacttcgtggcatatttgtcgaagcgcgtgcaactgtagagcgaacaataaaatttcccatttagaagtattctttgttgaaaagaattttaaaatcgtgaacacacggaattttgaatttcaatatttga

SEQ ID NO: 61408 - DNA, 2923 bp, Oryza sativa
ataggttcctttcctgccacgttcatagtttctacctgaaacaggaagtgacatatcacaattcatacactctccagaggtgtgtcgctctgtacccacagacgccttaaacattttaatactcacgcccgttagcgcttgaagcatacttcatggtgtatgccagcaaggctaaggtcataagcttttcatcaatcccatctatcaattatctctacgggtgattccctcaacaacggcgatccacatcatctaatcggatcccgcaacaacggcaatcctcatcgctagcctacgctcacggggttcacggaagtccttaagcccgcaggataaagccattaagaaagatctactacgctagcctgtcccattccaggtcatgtggtctataatacaccgagtttcaaattagtgtatttcagaaaatattagaacagatgcgcaaaagtgcaatttttaaattgttgttcgaatagacgaccaggaaccatggatgcgtagggcttgccgactaatgcaaaatagactataagttagtttatagtaatcggagtccaaacgaagtctcggggattgaatcgatttggaccgttgttctcctttctagactatatataaccaacagtaaaaaaaaaagggggcaaagagagggatcgatcccagccctagccgtctttatctgttttgggcaccgccatcgccggacgtcgccgctgtcgccgatcgtcgccggtcgtcgccacagccgtcgtcgtccacagccggtcgctggtgagctgctgctccttctgttaatttccctgctgctgccgatctgatctcttccttgctgctgatgcatggcttgttgttgctgccgatcctcgttgctgcttctgctgttgttgatgatctgcaacgaatgctgctgctcctgttgatggtctgcaacgaacagagaggaggagggttagaaggcagagaagaacatgaaggagggagagggggaaattagatagaagaaaggaaatttggggaatttggtggatatttcaaaattcattgttttttttacaaattagtactgctaggtaattcgttttagtctctatttgtttctaatttatacataagacgatctgtttccgatagctcaaatttattttattggctgctgggctgaaaacgtatttttaaatctggtattaaaccatcgggattcagattagttgttctaaataaagtttgtagtcatcgccgatatctttctaacggcgctggtttcactcgattctgataaacggtttgagacaaacatcagaaacaacagtgctgacctggtccggaaatcaagatagcaattcgttttgtttaatctgagaccaataaagacttaatctgattttgtgcccaacatgaaagatgtagacaattttatctagatgtccgaagtagtattatttgctagatttcgtaaacggtttgcgagttacgcataaaacagtaatgaagctgctatatgttgtttaatataaatcggttaaagtttatatgttctaggtttcgattttagtgtaactattattagttgaacatagtggtttattcgtagttttgctgcataggtgtggggagatctggtgtggagggtggttcgtcgggttaccgtcaaggttaaaggcaagtgcatgatgaactaattgtgtgattcttggatcgtttactctatctatttatttctgacatatttttatgtgataagtgactgtttatgttcagactgttgtttacgccatttagatttcaagtttatcttatgtctatgacgttattcttgtttcgatattccggattctggttctggttaaataattcaagttccatgcttgccatggatgtgcaatatggtttcaatttggttctttgtttccggtttcagttattcatgttccatgtgagtcatggatgtgctacttggttttctatttatattcctgtgggtaagtgctgatcacgcttactcagctttgccggcaaatgctaggatgtattcacaattgtccgggatggaaactactatttcaattcatatttgtctgggatgggaactactattgtctttaacttggtgtttgaaatatgattcttttcaaagaaagaaagttttctgttcaggctttattgcgcatgatgtgtatacgtgttttctagttccatattatacttgctgagtatttctgtactactataaaaaaagtatttctgtactcactcttctgtttatttgattttagatacacattgagatcgacatgcatgggcgggaagtagcacccttggattacacatttatagcactaaaaaaatttggttttagattatgatcctgcttagcataagttttgcgtagaatttgtaaatgtcaattaaagttatggttcgtattcttatgtgggatttatggaactaggatggtttggattgtgcgaattatttcattattgatttatcttataactgcctgtcgtggatgttcgtatttataggggagactgtcgaaatttctaataattttgggagttagtggttttgagtgtttttggtgtggcactctaggtacgtggttacctgggctgttacatagtcgacacgatcgctacgacacttgcatgccatataccagttgtttttttaaccttatgatgataaatatatgcaactgagcccccaccacaatgacaagtttagaatacatccataatatgaccaactgctccaacaaccaatcgaatccttcaacatatttattttaattgcagaaaatataattaatgcaaggtgatacatatagattgcaaatacgaaaatataacaagagttggtcaaaggtgttggacttgcttgagatacccgaaatcgaagaatgaataaatcaataaag

SEQ ID NO: 61409 - DNA, 1721 bp, Oryza sativa
gctgccagcctgaatatgttctgtggctcctcatgagtctgcccccaagctaaccctagccatcaacccctctccaatcgatgctgctgctggctactgctctcaacgactgagattggaatttcccagccccatcgcccctgattcaagcatggctcagaccagccgtgtctccccgagctcccctctgatcccttctttccctacttctgtggtgtgatctaattggtgttctcttgtgtggtaacctattgtgaatttcgatgcttgtgaacacgtcctaatgacgaacttgatggtgctatactaaggattatcctgctgtctgtagggatgaatgaatgaaggcaaaaaattgcttaagggcatccaaaaaagtgtaataaaaaaagtgtaattagttggtggacaccgaaataacgtgagtttgttgttgggcaccacgaaaaactgataattagctgatggacacttgcaaccttattttatgattctgcccttgcgtggctccaacacaatattctctcaagtcctcatccctatttacccaagatatttttgatgttcttgttagcaatagctaatcgctttttgggaattgaatttaaatttttctggatcacaccgtcagtccaaaagctagggaaagcaaggaagcagcggactcaccaatgcacttgccggagctctccttgggaggcggccgttgcggttcatctcgtccaagaagcgatcgacatacttcgatccctccttcctgccggccggacgtcttgtcgaggaagtggaggtcgcggagccccacctgcgcgttggactgcatccacgtcatccttccccccggtcgcatgcccatcccggccaccctttccggcactagaacgacgacgtcgacagcaactgctccaccccattcgccaacgccatggacgacagcatcgacagcaactacggagctcgagttcggcgagctctaccacaacggccagatccagccgcgaaccttgtccccgcccccgaatctcgaccctgacagcgatgacgatgacgactgctgccctgtgccagtacgaggctgtgagccatcgtcgcggagcggatccgcgcaccacacgcacaaggtccatgtcgtcgctctggatcttggctgggctctcttgcactcggctgggtcggaggagctagccgcgaaggcgtcgcatgaggatccttgatgccgcccaggtccctcgagctccgccgccgccacccaactgctggtcgctgtcgtcctactgccagcctcgtcgaactagaggaagatccagcgaagaagacaagtcttacaggtaggccccacagaagaagtttgacaagggtaaatttgtctttaatgagtgtttctctctctaatttctccataaatagtaaaataatcttaggagtgttcatcagctaattatcagttttttgtgatgtccaacagcaaattcgtattcttacggtgtccaccagctaattacatattttttgaatgccctgtagcaaattttgccatgaatgaatacttacataatatatcctagagtaaatgcagtactgaaattaaaagcacactaacatgattttgtccttataaatatgcttgcatgtagaataaccgaatttctgaaattagtggcacattagcaggattaaatccctgaattaggtttattgagcaatttacatgttctacaatt

SEQ ID NO: 61410 - DNA, 1528 bp, Oryza sativa
cagggtcttttgttttttactgaaccttatcccacataactagttatatatctagtttttaagcccaacagcacaattaccatacttctaagcaatataaaatatttcttgctgctagctacatgatgatgcatataattttgaactataactaatctttctacttgtcagctaaatcaaaatatttataccctattggttacacatgttctacaactgaaattattatatgttccttttactgattcagagatgctcttgttcatattctttttttttaataatggaaatgggctacatctccggcctctgcccgtaggcacacagccaaaaaattcagacgtgaacagaaaagttaaaaaaaggcgagatgggacaaacccctaacttctgccgatgatatgatctactaaaataatatttttttcaaaatcacgtgaattctatcacgaaattctgtaggtactacgccatccaaactggaataaaagttccttggctactaattctaagcgtgtagcaccattgcgcatagtatcctgttgttcctgtgaaagcatcatacaccaagagtggagccaattggaacacatgaagataacctgcatgatgttagacatttttttatggttaaaaactatatcattacggcaacgccaaattgaccaacataaagctccaaacaaaatcattttttttgtgggtctaggtactccccttagccagtcaccaaaaatatcttttgcattgtggggagggggatgttgaaggcaaagaagacacatcaccaagcaaaacgtgcaatatgacagtcaaagaaaagatgttggatggtctcttgtgtattacaaaaacaacattgcttgtttcccctctaatttctctttatgagattatctttcgtcaagattacttttttttgtgaagaaaccacataaatactttgatttttagtggtacctttacctcccataagatcctcttgtggattcttacattggaattgatgatcgcattatacatggatttgaccgaaaaatggccatttttatgtagcgaccaaataaagcaatcattttcatttgacagggttatgttagctagtcgagagatcaaattattccactcaactaactttggtcctacaattgatcgtcggaatgaaacattcaacggtgttgtgctcataacctctgccaaagtagaatgtcttttttggaccacattgtacagagaaggatattgatatttgagaggttgcaagcccaaccatgtgtcttcccaaaatcttatttccatcccattaccaggtttaaaagatccatactgaaaaaaatgatcttttactttcattaggcaagcccaaccatgtgtcttcccaaaatcttatttccatcccattaacaggtttaaaagatccatactgaaataattgatcttttactttcattaggccagcccaaaattgggatgttcctggtttgtgtgacatgtgggagaggggttcaccctttaagtacttgttgcg

SEQ ID NO: 61411 - DNA, 2882 bp, Oryza sativa
atcgtggattctgagtcgtcgccgccgctgctagggttccagatgagatggaatcctctctctctatatctcgcggtgatgttttagggtcaccataatccgaaattgctaattagcgcccagttgcgctcccccctccccgcgcgcgactgggcacgtggcgcgatgggggagggggagggctgagcgacgcgatgggggaggggtcacgtggcgctggttggttttttttcggttttttccgtttggtttttttccggttttggttttttttcttttccttttttgcggttttcctttcaggttttttctttctgatttttttatatatacgtatataaactttttatatgtacgtatacaaagtttgtatacatgtatacaaactttgtatatacacatacaaactttgtatatgcatgtatataaagtttatatacaaacttttgtatacgtacatatacaatgtttgtatatgtgatgttttttttttgttttttcaattttttaatacgtacatatacaaagtatacaaagtttgtacacatcgtatataaagtttgtacatgtatatatttcttttgatacattagaaatatatattttttatagtagtagtactaatagttatagtagtagtgtagtactagtagtgtactgtagtagtactagtactactagggggcaccgcacggcaggctgggcgtgcgtccagtcgcttgtggcatcatcaatgtttactacctactttatgaataagggtgggccctgcatcagtgggtattagttgttgttgtagccacaatggtgaaagaataaaagtgggtagtaagctggaccccacaatcactagccatgagagaaatcatttgtttattccttatgactaggtagtaagtatatgacctggtattagttacttactactcccacaatgtatacaacctggtagtagtagtattttattctttattatccactttagatgtacattgtagatgctctgagtggatgtaaatccggctcctctaactgctagtaaagagtatacaaaacagagttaaactaggaccactaggagggatatttcttgcaattgtctgtagcaggttcagtcacgttggcgacaaaaaaactaaaaaagtcacaaaagaataaaagcaaaacaagtaattcctccgttttacgatgtaagtcattttaacattttcattaatatgaatgtggaaaatggtagaacgatttatattgtgaaacggaggggtagatatttagatgtgaagcatttacacatcatccatattttgctcctcaattttgtactacttatcgtacttccttgtacgtgcgattccattcattacttcttgtttgggtaaagactatcttatcagcttaagtgattgcgatgtgttacccacaccatttaactcgaatggataaaagtcatgtgacaccaacatcattaaatcttaactaattaaaagattcatatttttccgttcgtcacatgattttcgtccgtatgcacgatttttcacccgtccgtgcgatccgtccctcccagagtccgagtctgtattaaaaaaaaatccccgagctagatccccaaatcaatcaatcaaccagacaaccaaaaacaacacgaaaataccaaatttaaccttaacctcatgaatttgatcaccacaagaaacctaatacccatgtatttcctccctcccaatccgatccgatccggcaatacagaaagtcaaacaaaggcaatcatgtatgaatttgctggcaaacaagaggcagcaggaggcacgtcgggttgcaggcgacgtgcggcggcggaagtgtttggcgcggtcgttgggcttgttgtaggatcgagatgtcgactagaggggggtgaataggcgatttaaaattaaatgacacctaatcaaaactaacctaagttactaggctcggtgagggacaagactaactaagcaactaagttatgttttgcaatcctggggtgaaagtggctcaagtatatcactaggaaagtaaatcacacttcctaagtctagtttagcaatcctagggtgaaatgatctctagtatgtctctagaaatataaattgcacaaatgtaaatgcaacaagtaaatgagacaaggagacgagatttttgaccgaggttcggaaactcgccggtttcctactccccattgaggcgatctcaactccaccgctcaaccacgaagccaccgtacgcccccttcgtcaaggggtgggcaaggcgggagccggcccacggagaggactacccaagcctcgatcactagggtagttcttccttcactccgaaggtggtgaacttcaaaccactcacaaaccggcaccgggcctcctccacaattttctcggagaggtcaccgggaaactcctccacaagccgtctaggaggcggcaacctccaagagtaacaagcaatgacccggcgtggagataatcaatcaagtgccacactagctctacaatggaagcaaatgcacttgactcttggctagaacaacctcaaccactacaatggatgaacactaagctcaaaggtgtgtgagagaggtgcaaggggtgtatgcaattgaattgggtgccaagagaatccccttgttgctagagggggagtatttatactcccaccaaccaaaactagccgttgggggcgaaatcccccaactcagtgctctgccggtctgaccggaggtatgtggccggtcagaccatactactctacaacagctagttttctagccgttgcagggctgtcattgggccccactgcctaggccggtcagaccgacttggggtggccggccaaacgggcctcggtaaagtagaccgcca

SEQ ID NO: 61412 - DNA, 3556 bp, Oryza sativa
caattagcgctgtcattaattaccaaaattaacaccgggggcctagatgcttcacttgtggacaagctcgacgcgggccggcggcagggatagcatcaaggcgaccggcgcatttggtggcggcgtggctctgaagcccttcctcctgctagatctggcggagggagggcgcctctgggcggccgccgctcctcccgccgcacaccgctgccgtggaggggagggcgcgaccatcactaccgatgccgcctcccgccgctgggccgcaccgtctccacctgccgccgccacctgtcgtccgccgcctcccctcttgcgccgcggcctgccgcctcggctccgagagagaggagagcaaaacgagagagaagaccgacagagaggagaggaaaacgagagagccttatttcctcggtgggccccgccgaggggagggcgccgtcagccgggcggagggcgccgtgcgagggggacgggaagcggcgcactggtgaggggagaggggagggcgtcgctggctgcgacggcagtgggggagagaacaccaagaaagaggaaaaagaatggaggagagagggaggataagggaagtcgggggaaaacgagaagatgaggagacaggaaggatcgagaggcgccgctcgctccgcttgctctctcggtgataagtatcagatctgacgggcctttctttttaaaaaaaagagcactctgtattttaaaaaaacaacacaagtataccatataatcggcacatatagggatttataggggttggtttttaatttttttcggtttaaagtctaatgggtctttcttttacaacttttttatttctataaggaatatttttttaagggctcatatcataaaaactaaatcctaatcatctactatttttatatttgttataattttagtttacccgtagcaacgcacgggtatctatttattaaaattgtttaaataataaaaaaattcttggcctgtccgtctgctctctttttcctatgtccttgtccttttattttgtcccctcattgtctaatcttctttcattttttatgtcaacttattaatatttgacctcaaatacaatttgtaaataaaaaaacaatactcactctcacaaaattaataagatttatttttaagatttgttaaactccacacatttttattaggtaacaatacacaggtacattcgcataaatgtaaagtgagtatagtttaacttgataggtttcttgtggtggaaccagtcaacctgcattcaaatatttgatttgacacgggtgctcgaggcgttcgtggtaacttcgtcaatctaaatactcgtgttgtgagtgcgtttgcactatgtgtttctaaaaatatatatattctcgcaattcaaagtacattgagtacaaaaattccactcgtgttctacataaaaaaaaatatttccgttcatgatacaaattttcatccgtcgccttttgggcaaagacagtcgcattattcgtccatccattttctctcatgctacaaatcatccaaactaaacatcatttctacaaatatagagcagattatttatctaaaagcaaacaatttttttagcagattagttgactaaaccaaacaacaccttttgtcactgtacacattccgtaatcacccggtgcaacgcacgggcacttttgctagttaaatggataaaatttagaaatttattcgtgtcgttttccgaacgcaaattgcagattgttgactccatctggtcttctcccccaatttcttgctcagttttttctacacccagttgtacgcaggttacttattggatcgatcatgcatatcaatgtgttgaccagttcttgatgcatatacaattgtgtgtcatctcctaccttacaataacaactaatctggcctgttgcattgcaatcagagcttccgaccttgcaaagaatgagctgctaaaagcatttcagtgacagctcgagagtgtgtccaaacatgggggtttctccatggattatcatcttcttgttgagtgttattgtgctggtttttgtcgcttcggccgacacgaacgcaagacagtaagtatagttcagttcctcttcagtatttgttgctgcagtgctaattttgatgttcttcttgtctatctctgcagctgctggcctcaatgggattgcaggtagctgggacacggacaccaaaccatcgaactgggggaatggcaacgatccatgtggagacaaatggatcgggataatttgcaccgggaaccgggtcacgtccatgttagtatatcagcatcagagatttgtatatgtccatggagtgatttttttttcttgcaattatgcagtaatatgagtaacaaagatcactcatgttgtcttcttgtttcatggtgtttttacagaagactgtcaagttttggattgtccgggacgctttccggggacattcagtccttatcagaattgcagtacctgtatgtattctcttctctctgtagtttgagcactttggattgcgaattaggcgtaaacatgtgcatagttggaaatttggaaatttatgcaaacttctgaaacgcttctgtttttgttgcagggacttatcctacaacaagaacttgcgtggaccccttccttcaaccattggaaccttgagcaagctccaaaacttgtgagtagtttaactttggagaagttcagttagtctgctaacttgagatttttcagtcagttcatggattcttgtttgacttgtcccctctcatttctctgcagaattcttgttggctgcagctttactggtgaaataccaaaagagataggccagctctcaaacctgatatttctgtagggaacttagacctgattcttgattatgtctaaaatcttaggcctgcggtcgcattccctgaacttctctagatcatatctaatctgaaaatagaatacatctaatagatttatagtctggttgaaaaatgttttaatataaactccatcatttgaaaaataaacaatttcgaactttattggttggacttttacctcagaatttaaagttcacctagtgatgtagattgacatgatggtaacattgtatattttaatcctaattttaaaatatggcaggtaagattatttcacttattagccaaccatgcttatacagagtatccattatctaaaaaaatgcttgtacagagtaaacagcaaggtaaaaattaattaatttcctcctgtgagagtattacctccattgggataataggaataacaaccaaatggatggcctaaaaagcttaactacaaaaaaaatcctataagcttgtaacaagttacgaacttgtatctggacatttagaaagataagtgtgatgcagttaaaccttttcccttttgggataatcaagtaccttaggtatggaggaggtggttatctggttttattagttggtaatattgaattctcaggcctggtgttcatctattatattattaaaacaacctttacagaagtcaccatattcaccgtgaaa

SEQ ID NO: 61413 - DNA, 1002 bp, Oryza sativa
cgtcagcgaaaccgctcaccaaaaccgtcgagggagtcaaattgcaccggttttaacagtttaggggtcaagatatactgattttgcggttcagggtcatggattaaatttgggtcagttttaagggagtcaaagtggacttattcctcatcataattgtgtttaattattgttgttaagctcagacctgagactgatttctaccatctgtatattatccaggcttcttgacaacaacaaattatccggaagcatcccttctactttaggccttcttaatacattggaagttctgtgagtacaagcgcatattatggatgagacaataaaattcatagattgacactgctgccttatgtcatgaagttcgatcgatgcaggcgtttcgataacaatgcgcaattgacaggaccagttcctaccaacctcaacaacttaaccaggcttacagaactgtgagtttactatgtgtgtctgctttattaattgtcaattattcaatattaatagcttacgcgctatgctttcatttgacactagccatcttgcaaactgcaatcttactggtccactgccagacctaactggaatgaacgaactcatgtatttgtaagtgatcagtcaacccttccaatgttaaaactaaaattgactttccatttatcatactatgcaactttctggatggtttcatcttactaacttgcaattcaatttgttacaggtacatgaacaacaatagcttcagttcatcattatttgaataatcactagccgacgcattataggctgaggcgctatcagattcataatttacatacctaaaataattatttgaataatcaccagccgacgcggtatatatatccattaaaaataggtctaacaacatatgtatgagaattaatggtacttgtaaaattattttgagaaacatatatatttgtaaattttacctcaggcttggtgtagtagggaaacggtgtagttctatggtatgct

SEQ ID NO: 61414 - DNA, 2009 bp, Oryza sativa
gcatatatgacaactcgacgatttacataaataggattagagtatcatgaagatgtcagcactaatcacgagaacgcaagccgccataacaagttttacctcttgccggagatcgaacccgatgcagcccgacttgaaagcaagaattcgtcgaaacaaaaatagaaaaggtggcgatgcgccaaaagtgttattaaactgattgttcttcatttacaaggtcttgggtcatatttatacccaaaatacataatatgtccttgccggatacgactccaaatctgttacaactctaagatacgaacaagtcttttaggcaaacacttgccgacaaatatctctaaagaaactattcaaaatactctagttaatagatacaattgcccctttttcggatttatcccaatcgtggaaatacttgctcagcacatcaatcgatcccgaagatgattctagaaccaccttaccaagatcggctacatcggctgttctttgtccgatccaatgtcagccgatgcagacgttagccgacgtgcccccgtagccgacacgtactctgtttatgagaaacgatctcctatcaaatccgcttcgactttagctttgaatttgatgcatgatttaccaaatttggtcatcaacagggtcgagctatactacagatcaagcaattacccactcccgcttgtggtaagcgttgtatgtcttccagggtttcccgtgaactggtccttaattgctataggtgcgactagcaaaaccatgcacccacaaccaccattcagtcgcattttagttggataattacgaccaatgaaacattataacgccccaattttcggtcgggattaaaaatcaattaataatgcatttccagaaattatattaaaaattaaatcaatttaatcaagtgacatagtgagggaattaaaaatttcctttaaaaatcatggccgaaaatattttgtaatattctctgtgccctaatgtactctctggatttttccacgaattttcagagctcaagaaataattttaaagttacaaagttcatttaatcaattaaaataaaagcaaacaattttaaatctccatccttgtctttgggccgctatcggaccaatcctccatcccctccccgcggccttcctactcctctcccttaccaggctgtcggcccagcttggtccctccctcgcaagtccatgccgcctcccttctcctccctcctctccccgagttgcctacagatgggcccatattgccgggctctccttgaacctctagcctgggctggcagccgccacggccgcctgagccgcccacgtcgccgcctcctccagctccccctcgccctctcccgtgcgggcccgacgctgccccactccctccactctccttcccccactcccttcgcggaattcggcgccgtgccgccgcctctctctccccacgatgccgctccacgttgccgccacgcccggccacggttttccctccccgagcctataaaatccatccccgggatcccctcgtccgtttcctcctcctccccgagcttctcacgcccccttccgctctctccacgccgcctgccatttccgccgcactccggcgagcttcggccacgtgccaccgccgctcagccgtcctcgttccgtgccgcttgtaccaccagcatcgccactccttgccgcaccttggcctccgctccgcgccttcaatctgccgccgaagcaccacttccaccgccgacccgagctccaccaccgcccgccacacttcagccgcctattgccgccatccccgtctacctcaggttgtgccacctatttccctctctccaccgccgaatccccacctccattgcaaacccgaggctaccgccacattcgtcgcctccggtcaccgtttgccgccgctcccggccatcctgagccgcgccgtggccacctctggcgccgccgcatacatccgcaccttggccgtcgctcctcaccgctggaatc

SEQ ID NO: 61415 - DNA, 1804 bp, Oryza sativa
gtgtgcatgaaagtatatttaacaatgaatcaaatgatatgaaaagaataaataattacttaaatttttcgaataagacgaatggtcaaacacgtactaaaaagtcaacggtgtcaaacattttgaaacggatggagtattatttaaatcacaccaaatgtcacatgacactctaactaataccactagtaaatgtgttactaccccaacatagtgcgttcgtaatgatctttggtcagacacgaaatcgttagccgaatactagtagcttttgagaagaatatagaatggcgagttttgtggacaagaaaaacgtgcaagttgaacccatcattacacaatatgtgaagaatgccgccttttttatttatgcccaagtccactgaattggaactgtccttatctgcattagcgatgcgatcacgtcagagctagctccttgtacccttcgtactagcaacaatgatgctgtactagtactacaaatccctttcaaatcactagtaactaatctcatgcaaaatcaaaccctacatacataatctgattttggtgtaacaaagaatgaacgaatcatccgtctccgccccaacaaaatcacctaataaatacactaaaatccccccaaaaaaatcaaaaagaattactaaaactataatcatcgatatctaggtcaaccctgtaacagagctcggtcaacactgtcttcctccaggggcccactgcgcagtggagcgcagccaggaggcggccgccggcggccaacctgctccattgcgccgccgtgtgtgtacgtggacattttgacgccgacgccgacgtgccaggctgccagccaaggcggctcaaagcagagcggcgagagcgacggcggcgaccgagaatacggcggcggcaatggaggagtaagccgaagtggtcgtcgcgccgctggattgcgggcttccgccgccgccgccgaagtagaccatggtgtcgttgagctgctgcagcccggcggcctgcgggttctgccccgacgacttcacgctgttcacaacaaaaacaacacgattagcaatatgaccaaaccaagttactctcactgacaggtggggcacaccatcaaaccttactaaggttgggaccagccgtagtaaatgagctgagtactttgggtccagttgtcagtgacgtggaaatagcgtcaaaagttgaccacattggggcccactttgtcaattgttttgttagttaatgataaacgtgcagtgcggccacatgggccccacgtgtcagttctagccgttttttatccgttactagccgttagcaccatcaccacacctcctcgaaatggctcacctaacctctttctttttgtcagcttcccctctcgcacacccaaccaaggtcaaaaatccaactaaattaacgtgatcaaatccaggaataataataataataataacaacgttttctttctttaattgcgacttactagtactccgtaactgctaattactggagtagtaagaattttctttttttaactagcggggtcattatttactattgcaattgcggattttatttattttatttttacctggtgggagcggcggggcagaaggtgatggcgtagtctgtggcgccggcggcgcaggtgaaggtggaggtggagtcgtcgtaggcgtagctgtaggcgcgagggcacgccgccttgaagaactccgagtacgccgacggccggcacgtgttcgggttcccgtacgcgccgctgcagcagtactccgccgacccgaacgcctcgcacgcgctccgg

SEQ ID NO: 61416 - DNA, 1966 bp, Oryza sativa
aggaaggagcagaggcgagcttgactatggcaggcttactaccgtgtttggactgaaccgtttttcccggctattctgtagagtttttaaggcattttctgaccaaaaagtgttatgttgagtaagtttctacgttttgggacgacaactcccttactctctctgtcaaaaaaaaaaactcaaccccctcctaaaacaacaaatttagataaaggatagtacagatttactatactagaagatgttacatctctttctacgtttatttttttagaacggagagaatatgttgaaaaagtttcccgaattgctaaacagtccgttttatataaatttttttcttatagaagttcttttaataaccgaaataaatctattttaaagtttattagttactaatactcaattaatcatgtccctgattatctctcctgtgtttcgagtcactaaccgctctagcctaatagcttgaataagccttagggcccattcgaaccatcattttggggggtgtttagttcgtgaaaagaaaatttttaggtatcacatcggacgtttgaccggatattggaatgggttttcggacacgaatgaaaaatttaatttcataactcgcctggaaaccgcaagacaaattcattaaggctaattaatcagtcattagcagatgtggtttactgtagcactttatggttaatcatggattaattaggctcaaaatattcatctcgcgatttccatataaactgtgcaattggtttttttttaatctatatatccatgtatgtgtacgtccaaagatttgatatgacgttttttggaaaaaaaattgagaaaccttggtttagctgatcgagaagtatgctaacgtaaaatgagaaagttgtcggcccttcagaagtcaaccttaattaggaagaaccttttcttgctgagtaattgctgactctgcgtgatggccatctgcgcatctctacttcaatcttacagtgtggtactgagctactagcaaacagagagggattgcttgccagcatgggcgtgttggaagtatgtgtcaaggtgtctgtgctttgagtaggatgaaagatgagggatcattttcacagatatagaaaagttaaatgtcctagaatggtgggtggattttctatgcaacacaaattaatcaaaatgttgaatgttactaacttgtatttcctaaatatatgacttttgaaaataacacatctaactattcatctcattaaaaaaaatcatgtagtatcattcattttattatgacttgttttattattaaagatactttagacatgataatttgtaccaaaatttttagtaagacaaatggtcaaaacatcatatattttttaaaacaggagggagtataatacaagatagaaaaagtttatattcgtttaatatttacgcactaaattaaaataccattccagtatattgtccttgataacccatcagcatatagcccagttataatgtgtgaaatatctgtagtagcactgattagtcagctaacagtctccaaacatcaatatagctcttctataggagtgtacttccattcttgttgttgggaaccattatggctttatgttacgagtccgaatatctgaagtgaatatcttggatcgcctatggacaatatttgtatgtgtggtttgtcgaaaccaaataaagattaattatatggttcattcatggagggggaaccattgcaaattcttattgaggaagtttattgtcaagagattttagtcgatctcttttacgcctattgattttgctataaattagtcgacaattttttttctaaaaatttaatagatgtaaatatagtacaatcgtggtgtaattacgttgtaacttgcatgtaactacaatctaattttgaaccgttcgatttgctttaaaattcgtgcaaaggaggtaaaaaaggggatccact

SEQ ID NO: 61417 - DNA, 814 bp, Oryza sativa
gtatatttaacgatgaatcaaatgataggaaaataattaattattacttatgtcagggttatggataccacatacctaatagtagttgactaaatctcggcagggcccaccacataccatgtcctatacggaaacaacctgcggatataggaggagttccggataaggaaagacaaccagagttctacatggaaacgataagaattactcggattgtatccatattagtttcccagttctacttggacaagggaacacctatgggtataaatacaaggccccctaggaggagaggggagacacgaccaacacaatcaacagacacccaccatagatcaagacacaagatcaacatacaagccaacatacgccaacacaagacgccggatatcgacatcagagacatacctagatcgaccctatccggtacctacagaggccggccgtagggatctagcgctgtctttgatctcgccgggcacggattcgaggacgaagactaccctgttgtcgactacaagtcagaccttcaaaccgccatgtcgacaacagttagataggctaccccaaatattgtactggtgtgattatggtgaataagagcaataccggcttcggccaacaggatgtagggttattacctgacaattcaggggcccgaacctgtataaaaatccctgtctccatctcttttacctcagtctcgcgtatactctagtaccaacgatccccataccatgcaaataccggaatcgcgacatcaaacgtcgacaatttattttttaatattgacttaattagttaacggtgtcaa

SEQ ID NO: 61418 - DNA, 1319 bp, Oryza sativa
aagagatcgatttgacaatcagagagctatatagaaagtagtttaaatccatgaatttggctatctaatacagtactactaatctaggggggcaaagtatcttggaccagtagctagccagccatgacagaaaaaagccataaggcattcatgcacatatatacatagttaggggcggatccagtatgggggcggcggggtctcgagcttccactactgacgtgaagattattagagccctacgaagaccccactaattttttttaccatatatagatgggaggggactgtaactctatctagtttgctcagacccaccgttatttctttctagatccgccactgtacatagtcatatgtactgttgccaaaccatttccttcacgtcggtatatataaacggcatgatcgagtgaaacgaatcagggcatatcaatcactttccttaccactttacgacggctgctgtaattaagctcaggttccagtttgactagctagcagccgtgtgattgatcagtctaatcaataaggaatcatcttaactactgttacagtacgattcgttacagtatcatacatgcatgcacctgccgcgtaactactgttgttgactaattaagcagccgcgaaaattactccgaaattaaaatgagttcgatatatagagaggatactactccctatgactaaaaaactttctttgaaggtttttcttgcaaaaactgtctttttaaataagatctattagaactcgttaatattattttaacatgtttcttctcgttttctctatcaaaccagcaataccctatcatgttctcctttttccttattctctttcatattaatgaagggtataatagaatgttagtcatcctcttactttaataaccaattaaaacatcaattaaaggctagtaattaactatattaatcctagctaactggactttcaagccagttagcttttttttattattctattccattatattaaaaaaaggaaaaagtacgaattaccctcccccgaactatcgcggttgtctgaattaccccctgaaccacaaaaccggacattcttcatcatgaactatacaaaccggacgaattacccccctcgacccaatccgcggtggttttggtctacgtggcatatgcgtggcagtctagtcagcattctatataaaaaaaatatggggcctacatgtcatacgcttctctctgtttctctcactctcctccctcttgaggccgccgccctcagccgctgcccctgcctgccgctgaccgtgagagagagaggggaagaatgagaa

SEQ ID NO: 61419 - DNA, 1618 bp, Oryza sativa
tggggggggggtaattcgtactttttccgtaaaaaaaaaaagctaactggcttgaaagtccaattattattattttttcttttggaaaaagccaagccagtggttttgactagccaagtgatcagattgttcaattcccagctaactcccttctcattgacgcttctaccaagtcccttgaccagacctgcccaactaactctacaaaatgttgtttaatttatccaaaacagtattctccatgtgcaaaatttatctcccgtcatagtcgctgattactagagaggagagcaagcaggtaagaagcttcgaatacgcattaattaatttattgcaaaaggcattaatttgaacgcaaaatttctaaaacctgatctggagtagtaatattaaatatataaatatacaaagtaatgacgtggatagaagcacgtgcggaacacatgaaaaatttggtggttggatcagctgttcggttttaggaagaattggggaaacttcaaaaacaataatgatccctcggttcatgacatgtaaaagcttctagatattgatgtagatatatttgactaccaccactttatatgcatgtgtgtgcacgtggcgcttacgtgtattaaattattatataaaagattttacaatatctataacatgaaaactaagacataataatagtttggtgcatatcacaatcatcagtttcgtcattgagagacaatgacccccgtagttagagcaagatgtcgggaaggacagaaggagacaagataatccatatacacagcctctacagtcttaaaaaaaacaaatttgagtacgaatttaggtttaactagttgtagtttaatttatttttttcgttacgagatgtggaagttgaatttgaacttgtatatatatttatgagtaaaatacagtagcggcccttaaacttgcgggtggatgtcatccaggtccattaacttgcaaatcgtgtaattaggccactaaacttgctaaatgtaccatcgccggtccaaaatgccgtttgaccgcggtcgcgccgacgtggcatgccacgtgcacagctgagctggcccgcaccatgccttttctcacgcgcaccgtgtgtgacaccggccacacttgttttttttcatcgaggcccctctgtttttctcattttctttcgacatccactgctgcttcgtcttccccggagtgccctagcgcagagtgcagcggagatcgtgaggggagtgatcgccggagaaatagggttccagcgaaagcgcaaagaggcgagattggctgttgcggcctcccgccggccataatcgcggggaggcggcatgattttccgcctggaaggggaagggcctccgttgtacagtgagtgtaacttcaaaatttcatccattaatctgcaagattagcatgcactgattgatgttggtagatagatacaaaggaatatggcgtttgattatgcaaaaagatgttattttttcctgtaggatgattatcctgacattgttctcgagtaggctagaacatgagagtaataccgctaattaggattgcaatgcaggtcctgatgatggtaaattcaccgtgaggtacaccatggtggttt

SEQ ID NO: 61420 - DNA, 995 bp, Oryza sativa
gcctaatgctgcatcggttaggttcgatctattaagtaatatttagaaccataatttagcttgttctatgattatcggtagagataatattggagtttcagccgatcttacctggtttagttgtcttgttccttatatttaatcgatatgctaaatctgccctttatattaagatcttgctgcgttgaaacatattaagcttgttgtttagtatattttgtctgtattaacatcttagtataaagtagtatcggagtagccgatacatcttagatttacttcatcggctatgctatgaatatatataatctctatcttgaagtacttttaaacataagtgatttatactgtcttggcaaactgttcgatctatcccaatcactttggtttaaacatatttttagaaatagattatatatcattgatatctacagccgatcgggtagatttaattttatcctgcttcattcttcattgccgatctggttcacatcacatcggcctaatattgaacgatacgtcatcggcagtacaaccgatcggctatcgtttgaagacttaactgtgtttctgttatttcttgttggttgcaagatcaaaccaactggcacgatcagaaaccgaaagcaattctttagacctgcactagagtaaagcaaatctcttaggcctgtgtgtttttcgcatcaacagaccctttcctaggcaccagtggcgagggtgggcatgatggagttgggtcggccgagtgtccggttgtccagctgctggatttaccgcggtgcatggggggactgcccactctcggggtaggggtgggggtgaaacctcagcgtggtgtggatggttagaggagagttatgcgaagggtcttgtcacaatcactcgacatggtcacgtgtctacgcaggcatggtgacatgccggtggattgtgtcttgtgggtacagttgtgcacctctggccagagtaaaactattcgaatagccttgctc

SEQ ID NO: 61421 - DNA, 736 bp, Oryza sativa
cagatgttttagttcgctaagtttgaaaagtccaaagagcgcagactagccacggagcttggatacggtttcccgatcggagatccatggatcacggatgctctctctccccatggcctttcacctctgaaagcgtccttccttctaaatgcccgggcatccatccaatgcatgattttcgatagcgtcgaacatgagcggtagactgaacacccacacaatctcaatttgacacagcaacactttccacctctcttccttcccttggatcagataggaaatcctcacttttccaagacagaagagaagcaagcaacggattgagcaactagcgtgaaagaacaagggatgagcgctttgttgctaaagcgcatacgttttcttgcttgatttttatacgattttttgagcaactagccgatcacgaaataggctcatgctcactcgtggtccctactgcttatgggactgtgatcgaatccgatctggaaaacagtgctttttgataactaatcactggaagcacctgattctctctactctgtttcacctctctttcttttggcttcttcttgagaatattttcacgttggatgaagggatgggctttcttttgagttggctttgatcgattgcttggtgtcatgctatttactacaacggttagctaaattcgtttatgacaccgattcatttctagttgatccattcgtaaggtcgttcagaagcaaatgct

SEQ ID NO: 61422 - DNA, 1543 bp, Oryza sativa
ccaccttcttgagtttgcctttacctctgggtttacccttgctcttgcccttgaatatgatacttcccttacctttccctttcttttcaccatggcctcttttacggccatgtgagtttccaacaacattggcgtgtgcttcaggcactgccatagatgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcacaccgaaacaaaagcggcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgcgggcacagctattcgaatagttttactctgatcagaggtgtacaactgtacccacaagacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgaccccatgtaattagcaaaacatgcatatttgtttgcaaacagtaaaacatttgtaaattgggatcaacatgctcaaggggaatgtgtgacttgccttg

SEQ ID NO: 61423 - DNA, 2535 bp, Oryza sativa
gatctccctgaactcttatccttgcgaacgcgatcttccgaaacgacgggaactacacgctggcatgcaaaacgaggaaaaactctaataaaaaccaagaaaacagtacataaaaagtaaaccaacatgtagagctcaattttagatgaattttgcaagttgaatggctcaattcgtagttcgaatgaattagatatgaattttagaagttttgggccatttaaatgaatttctagaattaaacacgatttattgcgcaattattaaatattttctcaaaggaaatggcattcgctgacgtcagcaaggggcgccgacgccgacaggtgggcccaacacgtcagcgggtcaaggaggtgcgggcttggaccgggtccaccaaatgagcgggccccacgcgtcagcgggcaaaaggatctagcccaccgtggaccgagtccacggtagaggtgcaaggcggaggggtgggttggctcgccgaccaacccgaccagacggcggcgcgcggccggacggccaccggcggcggcgcggcgcggcgcgacggcgacacgcatgcggcggccggcgggcaaagagagaaaaagaaagggaggggaggaggagggagatgctcaccgacgcgggaaggacgacgacgacaacggtgatggcggcgtcggcccgacgagcgagggggcggccggggagcggcgaaaacgagcggaggaggcgaaaagggaggcggcggagctcaccgaggggcatggcggcgaaggaggcggctgatgaggctcgagcagagggaggcggcagcactccacggggcgaagacgacggcggtgattcggcggtctccaacgaaggtggaagagcggccggggtaccacgcgatgcagcgaagccgacggtggtagggcgcggcttggcagtggctggagcggcgaggagcggcggccggagctcgtcggtgagtggtggagagagggagcgcggtggggaggtggttccggcgatgaaatgggaaaacggagtggggccgaggtgcggcaaggcacggcgaagccggtggtgcaagcggcgcggcgcggggacgtcgacagtggcggcagcggccggctggagggtcgccggcgatcggcggcgcttgggctcgtgtggggagagcgggagagagcgcggggagtgcgggaaagttggggaaaagggagaggatggccgggggattgtttttataggggaggggaggcgggatcgagcccgggagaggcggagtcggggcggcaaccgccggtggcgtgggcggcatcgtggggtgtgggtggcggttttggaggggagaggtggggggaaacggcgcggacgtgggcggcgaggtcccacggacgagcgcgcgcgcgcggggtggaggaggtgggcggaaacggccgcgtcgtggggcggctcgggcggccatggcagcaacggcagctgccggcctgaggttggggatgacaggtggggtccacgggtcccatctgtcggagagggagggagggagaggccggctggggaggcaaaacagacttgagggagagagagagaggcgagcgggctgagggagaaggccggcccgagagggagagagggggggaattgggccgaaaggggcccaaagagaggagggaggattttatttttttttctttttattttaattgatgcaatgatctttgtgctattaaaactatttctcgagctccgaaaattcacggaaaattccggagagtacattagggcacaaagaatattacaaaatattcccggccaatgatttttaaaggaaaatttcaaattctcccattatttcacttgattaaattgatttaacttttatttaatttctagaaaatgtattattaattgatttttattcccgaacgaaaatcggggcgttacaatagacccagtgggtcgggcagaatgattctttagaagaacctaattctgcctttctgcaactaacaggactgagataagatcagagtacttcgggtactttgagttcctgtattgctgttgcagcactatgttgttgggatgaaaggtagataaggttttctcgatcatctcagcgtcagtgatcttcaggccacataaacgcaactgagaaatgatcctatggagggcagagttatacgtcaccacagacttgtagtcttggaagcgtagggtgatccagtcatgttgtgcctgtgggagcacaattgacccttgctggtcaaagcgatccttcagggattgccataataccagtggatctttctcggtcatatactcagacttcagatttgggtggagatggtggcgcaagaaatgcaatgcctttgctttctcggccttcgtagactccacagtgccaacttcgggcaacacaatagtatgatcgagacccatggagtcgagtttaatctcaacgtccaatgcccaagtgaggtagttactaccatccaaggcaagctcggtgaattccttctttgctatgtccgacatgttctgcaacatcattagtattta

SEQ ID NO: 61424 - DNA, 2277 bp, Oryza sativa
gtttctccctttcccctctccatttcctgcaatatagcagcggaggtggtctggagcgaagaaggccgtggcagggagggccaccacctttgcgcgagcgctatctgctgctaggagcagtggtcgtcgctgcagggaggaagaatggacgagaaggcagctcagtcgtgtcgtcagccgtttgctcccccttctcttccgctaggtccgccttctcctccgccaccggccgccaggtctgccttcgcctctgccactagccgcctgggcgcctagtccgcctctacgtccacccatcaccgcctcgagatcccccttcgcctcacctcagcggatgggtggatgggccaccatgctgccgccgcgtgacgacaccacacgccgccacccggagtacgagctggtgccgaacgccggcagggacatggtcacaggtctcccccacgacgcactcgtccaccgtcccttagcctctgcgctcgccgccacactcgtccaccgtccctcagccaccgcgccgccgccgccgcctcgcctcctcagccaccgcttgcatagttgacagtgagagaagagagagaggaagaatgagagaagagagagaggaagagtgagaggagtatgacaggtgggtcccacaactattttataaatagtattgctgactggactaccacatagaccaaaaccaccgcagattgggtcgaggggggtaattcgtccggtttgcatagttgggggtgaagaatatccggttttatggttcaggaggtaattcggacgaccgcgatagttcggacgggggagggaggggggtaatccgtactttttcctttttaaaattccgttgtaacgcacggtgcaaaggagaaggccggcacgaacatgtagccatgattggtgattctgatgagtcatgagcgaggagtccccgtcatgtgtagtctcactacatcttgactggtcagtggtcactacataaccttaacaaatgccttgtccttacttaggggtacctaataggccatgcgtgcctcttcaataagatgcaggttttctaaccttgttggctgtgcttttgatgtttctatatccttaattctctgtagcacataggatcggtattgttgttgtagtagctagctggcatgatcatatatctgtaggctccaaattatgcatccaacagtgaacaatgaaaacttatcccagaaattatggtttgctactcctgataatggtgtgatcatgccgtcaacatgtaatctgattcgtatacataaatgttgtacactctagctaggcagctgctagaaatgttgttcctccgcttccaatgcaaaacatggaatcagatagaatttgaatttggaccggaatgtgatatttaatttccttcttatatatcttaatctagtgatatgaaaacagggttttgtgtggactgaaatctccaaaatcagtaagatttggagaatttcagtaccctgacagagtgcattctcaataacaccaactactcccttcattccataataaaatcatttccagatacattttattctgtaactgaaggagattgaattttgccttttttttccactgaaatttctcgaaattcttcacatacctgtatgaaaaattaagacatctatatatattacagggaaaacataagatctatttagtaggagcaaaaataaaaagaaatcccttggaattcccaagatctattatatgtcactggtggacaaaccctttttaatcccggttcacaacccccctatagtcccggttatgcaaccgggactacgaatccgggactaaaaatacctatttttagtcccggttgaaataaccgggactaaaaaaggatctttagtcccggttggagttaccaaccgggactaaagatttagtcccggttggagttccgaaccgggactaatgctcttttttctttttttttttggtttcctgctgcttgcatgatttcgagccccacgaatctccacaaatctttcgaacaccacgtatcattcaaaaaatccctaaatacatcaagctgcattttctatccccaaatacatcacaaatcattcacaaaatcacaaaatcatctccacaaattcattcacacatcacatatcacacagatcagaaaaagaaatccacatcgcacagatcggccgcacagatcagaaaaagaaaccacatcacacagatcgaccgcacacatcacatagatcaggaaaaaaccacatcgcagagatcggg

SEQ ID NO: 61425 - DNA, 1052 bp, Oryza sativa
cacacccactaaagttcaggaaagaaaatgtgtgtcagctagctagtagatatagacggttatgatcgagtgcatgaaatgatttcttaattaattaatataatttcaatttccctttgaaataaaccctctgattaatttccagcttcttcaggattacactcattatattgtataataagttcttctcccattcggaaaattgcattcaagcaggttggccaaatatatattctgcagaatataaaaggagtaggccggctcggcgtacaaacaaattgtatcagtcaccccggccgttgttgtaacatttgcatggaaagccccaaaagagaacagcaaaaggggaaacactgtgccaaaaccaagggaaggaatgtcccccaggccaagctgcaagagctactagcatgcatgaacataattatattattatatattcggattaattgcacactcccccaactcggtcactcactgccacctggggcccacaccaccatagtctcccttatgggcccactgccatagtctccaaaggctctctggtcactggtctcctctccatctgtgcaaagtgcctttggagtttggagtgctcacatacattcataggacattgttcttgctacattctctctctctctgatattctctctgtgagatattctcatgtgcagagaggatgcagctgctagctgtgatggatagctagggaggcagtgcaaactcgggagaacggaaagaaagataaacaaggtgatcgaggtagctagcaagctagagagagaggatatatagaatgcattgcgatgctcaaaagccataacacgctcgccacaaaacgcaatgatgcggttctctgctctccatgctccctctgatggtgtagattaatgtatataaacctctaatctttatttatctagttaaatcctttcttgatcaatgcatgcatagtgtaaagcccaatgcatgtatgggacatgcagatcaaatgtcgaatgtttaaattgatcttcatatatatcttatcaagattttagctgtaa

SEQ ID NO: 61426 - DNA, 4443 bp, Oryza sativa
gtttgggcatgtcgttctttgggagtaatttaatttgcagaaatttctctgaaaatatattgtagctagatgcatatgaataggtgaatatattattactcactccatcctaagaacttagtatttgatggaatacatcctagtacgtacttcgaatatgaaaagtcaatctagattcatataagcactaactaggacgatgatgtgtcttattcagtactaggttctaatatttttggatgaaaatgttactaaattggtttctagttaattaatcgatcatatcatgcacgcctatgttgccaaggcttaggataccatgcaagagagagcaatgcaagggcttgcatgcttgggttagggctctcatttgataacgtggaggggcctagattcccatcatttgggttgtaccaactctgtctccttcagttcagcaggcttcagagctcaagtcggcaaaattgtttgcctcacaaatttggcatgatgagtgtggttctacatgcaaaggtcagcctgcttgtctaccgactttataacccggccatatatatagttctcttttgaacaactagtagatcttacatatattgtttattttgagatatagcttaattaacatattcacctctgacaattaagaacacaaataattgagatgatctcaggttcatcacttgaaaggcacttccagtctcagatcacttttggtcatgtgtgctgatgacatgttttgaaagtttgcatgatgcgcacatatgcagccgcttgatgtcaattaggtccactaagttcatatcaagtcataactagtataggctatagcccagatacgaatatgctaaagttatactagcaattagtcagctctttctgagtgcatgtgactgaaaaacacaattgattctcacaaactgcgggtttggattgtaatttgtttgggttgcccggcccgcaggggccttgaggtaacttgagcataattaaactaagaattttttttcactgccaagaaaaaggcattaattaattaagtgtagtttcaaaatcagcatcaacggttgctctgtattgaaacaagcaatggtaaattaatgccagttgtgaaattaaagtgtgttttgattattaatttgcgatgaaaaaatggcatagtagataattggttttaatatttagagattattagagaactagttttgttgactgtgtggacaggtccactagctactacagaaaactaaatagggtgctggttggaaagcgtgcataggtgtcggtttccccaaccagcacctagaatgcggcactgatgagaaatataaaatgtgccggtcttagaaccggcacctttgaggtccctagaataaaaaaagaagcgctcgatcgatgcttcaagccaagaatttcatacaaaaattgaatcacaaaatcttagaaaattcatcacaaatctaaatcacacagaattcatcacggatctaaatcacaaatcaattcatcacaagaacaaaggttggagaagggtgtcgacaggaggatcacactgccgatgggagggcgtgccatggccaccgtgcgccgtgaggaggaggttgccgcgcgacgaaagggtgccaccgccgccaacgggaggaggccgccctgagatcgtgtcggtccggataagggagctgacgtaaggaggaggccgcccagagctcgtggcgtcaggagctcgcagtggccgccctttgggttggagaagaggactgccatgaggaggaggatcactgccaacggagggtgcgctgcagcgcactgtgtgcagtgaggaggaggccgtcgctgtcaccgtgaggaggccacctcgagcttgtggcgttcggatctggacgcccggagctcacggtggccaccccgagattagagaatggggccgccatgaggaggaggccaccgcaaacgggagggcgccgccgtgggagagagagagagggggcgggaggagggggaggggaggagaaggaggtcggagggcggcgcctccccattgtctccatgtgagagagagtgagagaggaggagggagaggagaacaagataagacggaggagataaggaagagcgagagaaagagagagagcgaattgataagatctacatagccctcccccgtgcggctcggcttataggtgtctttttttaattaatcagcacctataatatataataggtgtcaattctctcaaaaaaccgacatatataatattgacacctatatttgttcaaaggtgctggttattttttttttcaacttgtggggatgggaaaagcactatagttgccagttttagctattccgacacctatagagccgacctctatgtgcttttctgtaatagtggtcagaccgggtaggataggccggtcaaaccagcgtgtatcatgtgattagactggctagcttgacggtctaaccggtagagacctatttagtgtcggtttcaggttgtttatttgaatacttacgattatctcgtgattatgacttctagatgattttgatacgtgtgtaatactgtgtagagtcaagttaagaacttgtgttcggatatggttcttgtttagttcatgtgtagattattgaaggtcattaagtaacaacttgaaccgtcaactcctacataaaagatacaaaatataatatcaaatttaatggtcggggtttattactaactgttttcacaagtattggtaaatatttgtatgcgggtgattttagatgaatttacacccaccatgtaactaaatgtacctccgaccaatcaaacgagagaacaaagattggagggcccacatgacagtttaaaccaacttaaagtggggccaaaccaccgtgcaccaccttagaggcccacatgttagctcctggaagaaggtggtggagagagttggggcccacaggtctgctgaaccaggggtttggccgaaccaccatagccccacctcatctccaccttccacgtgaacgggcaagatcacctcccaatgatggttgtggatgcaccgacctccacaaccgtaattccaaccgttatatggcccaaaaaaggaggagctcaagccatttcacaatacacaacaaagtggagtacaagtcacttctcatactttaggcatcccttagtagtgtggagaaaataggtagagagtgaggggaaggcctggaggaattccgaagctatcggtactctcttcctctcttgtagctcagcgaatgcttctttaataaagtaagtgtttgagatttccttttggtatttaaattacttacttgagtgagatatattctcaccgttgcgagttcatcgcttagtatttatattaagtactccagtactaggactctggataaagaaggaagttcctgcgcgaagctagagtagtaatcaataacttagacgtgatgtctaggttagcggttatcttcatttgttgtgtgctccacggaaattgaggtagacagcagacggtgacagccatatgcgccttttgtatctttccacgtccgggtacaccatagagctacagggccgtctcagcttcgtagaccagaggagaatcggtgcccgaagtaatcgataaggttttacctttaacttaagtctaattaattaaaccataagaatcctatctaacataagtttagcattagatgttgttcttgattggattatgttcttaaataatatacacacacattccttgtgattaaataaacctataatactctaaggtgaaatgctacaacaatattcttatgcttgcgaatttatctgtgaccgtatcaaataccaacataggtgttgtcttgatgcctcggaagttaatctctatcaatatatacgaggttaaacttttaccatttttttaaaataaaatattaagttactaaaaaaggtagctagctagaaaaagttggttgtcaagggccgacatctccctcgtccactcgatccactatttatagtcatgttgtatcttaaagcttacttatggcacggatgtcttttttaagcgagtaacatgaaacaacaaagaagaaaagccggatcgaaccctataaataattacgacttggaataatataaaagaagggaatggaatatccacctaaaccgaccgtttgggctttcacgtgcaatcagattaagacagcaaaacaacacccaacaacaaacaacaacatgcatataattaaacaatctcttaattttctttggattgatataattctctctcagacgatgtggagacgatcgaactaaagcaaacggcaattaagcatcatgcagagacaagctagcagatgcgcgacccctgaccggattatatgtttactagtttaatcacgcaattattaacaagctggcacacattcgataagtgggggatcca

SEQ ID NO: 61427 - DNA, 1561 bp, Oryza sativa
gtcacaaaaaatacagaatgataattatataattttttaatgagatgaatagtcaaatatatcttaaaaaatcaatcacgtcatgtataggaaaacaaaaacagaggcagtatatttttggatgcagatactaatagaaaaatgacacatatttatgctggtttgcatgcagggatgggggggggttttgccttgccggtgcaggcgcggcgtctgccctgccggagtcggaagggaagacgaggagaaaagctctctgtctatctcgggagaggtgtgggtggtggtcgccgggcgctcgtgcggcgtggtagaccacgccggcggccggccaccgagagcgcgcgcgcgtatatatggcgggatgtatcgcgcccccgccaaattttctttttatactatacgattccccgtgtaatttataccaccagcagctatagcttctctctctctcgccatgcatgcacactacattatggtattttgcatgccactactgagctagctagagagacgtaaccgtccctaaataccctaaatatttgacgccgttaatttttgaaacatgtttcaccatttgttttattttaaaaatctaagttaattctattcctatcatttgattcagcataaaatatacttttatgtatacatatagttttacatatttcacaaaaatttttaaataagacaaacggtcaaacatatttaaaaaagtcaacaacgtcaaatagggaacggaaggaatatatctatagagatcttgctatatactcccttcgtttcgaaatatttgataccattgactttttagcatatgtttgaccgttcgtcttattcaaaaacttttgtaaaatatgtaaaattatatgcctacataaaaatatatttaacaatgaatcaaatgataggaaaataattaatataattacttaaattttttgaataagacaaacggtcaaacatgtgctaaaaaatcaacggcgtcaaacatttcgaaacggagggagtataattaattttgtatatactccctccggtttcattttaattgacgttttagacaatgacacggtctacaagatacatctttgaccttatttttctattataatatatataataaataaatgcatgtttacttttttatagtattttaaaagacaaatctatatatgttgttctagttcctttaaactaaatatttttaaagttattgatagtctaagttataaaagtttgacttcaaccttatctaaaacgttaattaaaccggagggagtactgctagaaaagcattggaacccatacagtgcaatccgaacaagacaaagacacaagaaatactctatatatcttgcatgcatgctgctgtacgcctgttcgatcgtcgtgatcaaatcgactaaacaattcgatcgtatactatatacagacgaacggacggatacatgtcaaattaaatgtcagctgcaattgttaggttgtagccagccctcaatcgtatacatatatactccatccgtttcgaaatatttgacgccgttgactttttagcaca

SEQ ID NO: 61428 - DNA, 1513 bp, Oryza sativa
taaaacatgtgctaaaaaatcaacggtgtcaaatatttcgaaacggagggagtatgatgtagtatgtcgcccttgcttgataaacgaaatgaaaaatataaaatcatatgcagactccaattaataaacataaatttgtcagatacgtgtattattgtttcacgtagtacaaaaatcgcaagctcatcgaatggggcttgtcactcacctcatccttccagttgtgttgcatcgcagcaccagcacacaggcagcagtagcacctcgatccatctaccattttatttgctgaaaagttgaattttttttttcttagatttgtacactactttatgtctcacactaggctctatctctctccctggcatgaatgccccaggttgcaggcctcttctttccccaggatttcgttagaaaagccccagtagcacacggattaacaatctccgatttaaagtcagaagagacttggtcactgatatgcgagcccactacttctagacccacatgtcaatgaccacgttagaggtacgtaaaatgacacatgtgcctcttcatacgctctcttctctcctctttctctcgcattgttttgttttgtttttaattttgaagcgaaaagagggagggaggtgcaaagaaaggttaggaaaagggacaggaaaagagggtcactgatttctttatgccccagctgctggagccctgccggcctctaccatctccatatataccacctcactcctccccttagcttaacacaccacacacacccacactggcagcagctcatacacatagctagctcagctgagacacacacacacacagtgagtagttcagctcaaagctagcatcagcagcagagctaattaacaaacatggcgtccgggagcagcggcggcggctacgcggacgagaaggggccgggggcggcgacgatgcaggcgctggggctgcagcagcagcacggcggcggcggagaggtggaagaggagtcgtcggagatgggggagaagacggcggcgaggacgcggctgtcggggctgctgtggcacggggggtcggcgtacgacgcgtggttcagctgcgcgtcgaaccaggtggcgcaggtgctgctgacgctgccctactcgttcgcgcagctgggcatggccagcggcctcctcttccagctcttctacggcctcctcggcagctggaccgcctacctcatcagcatcctctacctcgagtaccgcacccgcaaggagcgcgacaaggtcgacttccgcaaccacgtcatccaggtacctacttaccttctcaaggactataaaatcgatctctcacatatataaatcaatatgtgatatgatgatacatgtctctctttttttttatcttcttaaagtatgtttatggctggctttatatagcctactattatacctgctctaatatcgttaacgatatataaatcagtacgtgatatggtgatacatgtttttgtaccaaaaagtttgggggatcc

SEQ ID NO: 61429 - DNA, 3435 bp, Oryza sativa
aatataagagattttaagtttttgcttttaacgtttgaccactcgtcttatttaaattttttttgcaaatataaaaaacgaaaagtcatgcttaaagtattgtagataataaagaaagtcaaaaataaaataattaataattttaaaaaaatttaaataagacgagtggtcaaacgttacaaacaaaaactcaaaattccttaatattatgggacggagggagtatagtttgtgtctttatgtaccaaaccaagacaagacaagaccacactgtatacatgctactacaggaaaatcactttggtacaggttagaaaaccaatatttaacttcgatcggtcacctataactaaaaaagatgttatgaacctagaacaaacacctataaactcttataggtgccatattttaaaccgtccggtcacacgtggcatgacatgcgcaatgcccaccaacatctgggccctgcatcgtcgtttctcttgcacgaatctgaaagcacacacatgtactccctccgttttagattataagttattttgattttggtcgaaatcaaactgctttaagtttgactaaatttgtaagaaaaaaataatatttttaaccaaaataaacatttaattatagatttgattgaactgatttggtgttgtaaatattactacatttatatctataaaacttgggagtagattgattttaaccaaagtcaaaataacttatagtagtagtaattaagaaagtaattaagggatgaaatgcaaatgcagggagataatgcacgcgatgtggcggccgcagaagttcaaggcgatctacctgctggcgacggtgtacgtgctgacgctgacgctgccgtcggcgtcggcggcgtactgggcgttcggggacgcgctgctgacgcactcgaacgcgctggcgctgctgccgcggacgccgtggcgcgacgccgcggtggtgctcatgctcatccaccagttcatcaccttcggcttcgcctgcaccccgctctacttcgtctgggagaagctcgtcggcctccacggctgcccctccctctgcaagcgcgccgccgcccgcctccccgtcgtcctccccatctggttcctcgccatcatcttccccttcttcggccccatcaactccgccgtcggctccctcctcgtcagcttcaccgtctacatcatcccctccctcgcctacatggtcaccttccgctccccgcaatcccgccaggtaccttcttacttttcttcttactccatccgtttcaggttataagacgttttaactttgttcaaacttaaattgttttaagtttgactaagtttgtagaaaaaagtagtaatatttttaacctcaagacaaatttattatgaaaatatattcaattattgatttgatgaaactatatttagtattataaatattactatatttgtctataaacgtagtcaaatttgaaacagtttgactttgagcaaaaccaaaacattttataacctaacacggaaggagtactaattttctttatctttctaattctcatcatcaaaatgcattttacatatatacatgcttgaatttatttgtctttgagtgcctacattgggggtccattgcaaccatatttgctgaggctttaggtagagatgatatagtttcagtgctgttcctatgtatacatagttgccaaatgctagctatctagatacagaagcaaatgtttggtgattgatggaacagctggttgttgcaatgcagcctagacagcatgagcccaccatgcttccccatcacaccttgcttgcttcttctagtgcttactgataattagaacagatcaattaattaattaattgtttgtcttaattaatcaaagctagcgctagccattaacaagactagctagttggcgtctatttgattgatctgctgctgggacgtggcaaattccaatgaactcaacgtaacactggtaattaaacactattattattgtttctgctgctgctgagtgttgcaagtgtgtcattctcggtgaagaagagactgaatgcaagacaaatctgagcagcgacagcatgcaattcctttgagctgagctagaaaccagagcaagtggcgatatgatatgatatgataaaagaaaagctatatgtaccataaagctactgaaagtggtgtagagattaatcaggacgcttgctgctgctgctgtgctgcatgcttgcctgctgcaatgtttttgtaccatctgctgtccgggagccattggcaccgagcagacagactgcattgcaatattgcattgtatttgcattagagagagagctaggtcgacacccatgataccatgtctagaaagcaacaaaaataaagctttcagcaacagcatcatcacagtatactagtagcagtagaataccatcattcacctaatgacctacttgtgacatcatcccaatgcaagcttaacttatctttgcataatctttaatttcttcctgatctgcatccatatactgttctgtttgattctgaaacagtacatacaatacatacagttgcatgttctgtttcgtataattcggtaacagtagtataataactcaaacatatataattaagtaaaggtgcaatattattagacttttgcataatcttttctttctgatccctgcattcatatatactgctctctgttggattcttgaacagtaatctaactgaaaattataattagagcaagtttaatagtatagctaactgctgactctaaattatctatagttaacttaatagccaattaatagccaattcatacaatagttacctataaacatatactacataatcaatatttggtcccacctgtcatacacatatgcattttacagtctgtgctgtagctggcttacaaatctgtagcccgctactcttacctctactcttttatcttcttgaaatatgcttatagctgacttatagtcagctattgtacctgctatcacgagatgatagtaattaataactgattggattggattggattgcagaacgcggtggagcggccgccgaggttcgccggaggatggacgggggcgtacgtgataaactcgttcgtggtggcgtgggtgctggtggtcggcttcggcttcggcgggtgggcgagcatcaccaacttcgtccaccaggtcgacaccttcggcctcttcgccaagtgctaccagtgcccgcctcaccccgccgccgccgccctctcgccgccgggtgccatcgctccggcgccggcctcgatgctgccgccgttcaactccaccgccgccggcatctttgccgctccggtgccgtctcctgctccggctccggcaccgatgcatttcgtccttggtcaccaccaccatcaccggcaccaccgccacggcctct

SEQ ID NO: 61430 - DNA, 1582 bp, Oryza sativa
ttttgtgtggagctgcttttgagaaagaaagaagagagatcacaatttaaaaaaaaatggaaaaggaatgttactgctgagtcatcaggagatgctacacctacaaccaaactcctagctagtacactatctttctcttactctcatgtatgttcctctcttttttttagtgcagggttgattcgtccctgtgactttttatttactccactgaacttgtgacgcagtcaatccggcacattttactttggtgactgaggagtgacaggtaaatactcccgcatgaaacagagtaaaaaccttgtctgtttataagcagtaggagtaggtactacgagcgtttgcagagtactctgattttccagtgcccaaatgcttttgctgcagtggatttctgcacattttgttgcttggagaatggcttggcaggtgattcaaccaaccagcctttcatcagttcttcagtttagggcagagaggagaggaagtgccacatcgattgatcacatcagggtcatctctttgaccacttgactgaggtttcttaccatgatttgacagttttgacgacatgttaattacctctaaagcattgaacccgaactccacattattggctaatagtaatttgttcatcaggatgcacctttagtaatatcacaacatacctattctctccatccgtaaataggtaccacctccgttctaaaataagtgcagccgtaagtattcatgttcaatgtttcaccgcccatcttatttaaaaaaattatatattttttttaaaaaaatagttacacataaaatattattcatattttattatctaataacaataaagatactaagtataaaaaaatttcaaataaaatgacggtcaaacgttggatataaacggtgtaaaactgtacttattttgtgacggagggagtatagttttagctaagcaaaacaaattaaggaaaatgttgaaaaaaaattatatcttttagtaatatggagagaaaatgatgaggagagagtactattggtttcaaagaggtgtagtggaccactctgaaactattttttttctgataaattcttatgttaaaactagggacgaaagaaatactcactatgtctagaagtacaggggattttgccccattgatatatccagaaatatagtggatttatcttctcccaaaacaaacaaggactgcaagccctccatcaatcgatttctgtgagaaactaaaaaatacagagaacgtctagtagtaccactactccacaccatccgtgtcaaaaaccaaaaagattacagagaacgtactggtactactactactttgtcaaggatgttttttcaagctacacagatatactattttctctttcttaatttgtgctattttagaaataataccctatattcttggatgaagggagtagttgtgaagtacatgtatttgcggtgtttacgagtcacttttaagggtgtgttcggatgccccttttcccaacccccctcactcgtttttttcatgcacgcttttcaaactgctaaacggtacgttttttaaagggctgcaggaat

SEQ ID NO: 61431 - DNA, 3858 bp, Oryza sativa
gaaagttgttcaagatgctatctgtcctcattttccgttcaatttagtaaatggtatattatagttgaaagtaaagcattaccagctaccataggaagtattatgttttcattcaaaatcttgtcaattttggccagagttccatccccaatgtacagatcgacaatggtgaattactatcagtttagtaaataataataaattagaaggtttttcaaaagaataattccatgatctaatgtatgtttttacctttttagatacgcatatttgctagtaaaactagtgatgaaagttgtgtcatggagatctaggaaaagaacaacacttgtatacctagaggtgatgcattttttgaaaatctgttttactggcttaacaaatttagtcactaataaaactagtgatgaaagttgtgtcatggattagtgcacaagttttgcaaacagaatttggcttaaacaaacagtttggatgagtaattccttaactttttccccttatttactaaattgatgagcatgatttaagttgtacttacagtcttgcacactggcatgatgttttacaagtttttggaagtactggaaacctaggatccaatatcctagtttgagaaaacaacactcatattgcttgttcctgttaataagcctgggtagcatgttcatcgctcagctatgccttgctcggttgctattgttggatggatagaagtggaaaaaaggggggggagggaatcagtctatgattatatacttgtatggttcaatgtagattaaaatccaaggctttgacttaaggttcctacacttatgtacttcattgcaaatttaactgtgcatatagtacattactagccaaggtagtcaatactcaatagtattatatatttcttcatattgaataaggctcgcttcatagcttaacatatatgtaccacaattttattgtccactacattatatagtacataatcacaattgcttaccacttgctgtttcttgactattaaactatttagattaaaatgaccaatattttctaccttcttttgcaaatcagtttcattacagcacttctgttaaactaaaggtatactatagggtagatttaaggttatgtagttctgttttggcgttttgtttgaaccagttggattagtattatgaatccacatccttagtttattttattgcagaacacaaatagttgcatggcttatgcctgttggagttaataggtgttaaggtaaaacatgtaagtaaaaaaggttctccaggacttgcaatgatgcacctgtacactggatcaatctgatggaccagtatctgactttagaaatgacaataaccacactgatttaggagactcaagagtcaagatatttactgggtggagagagaaaacattagtgttagatttaacggctaagctttgtgtttgcatttaaccatttgtaaatgtgaaagcaatactatttttgacagaaaaatacaattttgattagtgtatctcgcacggttaacttgattaagatctaaaatactgcaacttcatttgtactaaccattagatgatttagttgctcagtgcctgtttgggacttcatgtgatataataacataatataaccagatcggcttatatattaaccttggagctcaatcactaagtcttcttctgtattatgacatggatatttggaaatgaccaagtgcaattcgatttacatgttctatttatgctatttcttggtgttgctttaaaacaaccatttaagtaatagctatgagaaataaattagtgccacttatttttcatgattttcaatatattttttgctttgttgctgtcaaatctcttagtaaacctgataaagatataaaattagaaatttgactgcagatgccatatatagtggatagctttattaccacactggtgccaagcaaaccaagtcatagtcagccaaacatctttgatatgtttttactcgagtatctgaaataaccaaacattttggagatatgttatcatcattctattgacctctttgcataccttgtttgcatggtatcaatgcaatggaatatgccttcgaggactttgctgaaagatcacctgcaagtacatcaaaaatcaagagatgattctggccgccatgtattatgaccacagtgactcgtgctcatccaatattcttcgtttctcgtatcttaatggaaaccctcacagtagcgttgccaccttatatcgaaggacaagttgtttgaagttggctaccaattggtgccctactttaccaattgtcagatggaagggttgagcgtacattaatctggagatgcttatcgagtttgttgcatgacaagtcaatatattctattgatgtggccaatatttgcacgatatgatttcttggcaagttttagtaacattttaactcattcttccagacaatagtgcaaatcgccgaactctctattttacttgttttgttgtcatggatgaaaggtttgcaagactttgttccagaggtgacgtttcctgtgagccttttacatagcattttctttttttacagaaccgtaattgacaaatttgcctaggttaccattgttcatgtacagcgattgaataggaagctcaccgttgtgttaattgaacaatccagtatctccagtttatcatgttaaatcatgtaatctctgcaattacatctatgcttagtaatacatatttcttcatacatacgctggcaatgttgaaactttataaactaacccagttagtgcaatatttgactgatggcattgaccataagctataaagtctgcccatctgtgaatgtatccacatttgcccttcatctacttcatgtttttctctggttattaaccatgttttgattacatatgaggatcaagccatcgttaactcataaataaattacaaattaatcggttagttagtacagtacttcatttgttttagattataattgtttcagattataagtcgttttgactttggtcaaagttaaactattttaagtttaactaagtttgtaaacaaacatagtactcattaaattatttatatttttataatatatttgttttgggttgaaaattttactttttttttttacaaacttgatcaaacttggatcagttttactttgatcaaagataaaacgaccaagggagcataagctagcctgataaaacacgagctggaattcaatggttgagctgcaagcccggcaccgaaatagttgagctccatttgggctcccctttttgggccgcttctgtcgtggtcgccgcgcgtctcctgcctcctcgacgtcgcccgctgcgcgcgcgctcgctccgtcgtcgccacggccgcccggaacggcggcgagatggggcgccaccagcgttcgggctccctctcggtgacctcctccgcgacgccctcgtccgacgccaccgagctcgacttcgccgccgccgccgacgtcggctgcccgttcggacgcgtcgacgcgctcggccccgtcgagctccgcgagaccgcctacgagatcttcttcatgtcctgccgctcctcctccggcgggaacaccgccggcgcagcagaggtgtcgtcgccggtggccgggccgaggggcggcggcggcagccgcgtcaagaaggcgctggggctcaaggcgaggcggctgtcgtcgtcgtcggcggcgatggtggcgcagccgatgatggtgcgcacgctgagccagacgtcggggccggcgtccccggggcgtgggcggcggccgatgacgtcggcggagatcatgcggcagcagatgcgcgtgaccgagcagag

SEQ ID NO: 61432 - DNA, 3788 bp, Oryza sativa
gcgaggtgatgcgtgccaccgagatccgcgccatcgacaccgccaagagctccgacgccatgcgcaccctcaccagcgccgtccacgccctcgcctggcgctccggcgtcggcagcggcggcggcgacgcctgccattgggccgacggctacccgctcaacgtcctcctctacgcctcgctcctccacgccatcttcgaccaccgcgactgcaccgtcgtgctcgacgaggtcgacgagctcctcgacctcatcaggaagacgtggccgacgctgggcgtcaccaggcccgtgcacaacgtgtgcctcgcgtgggcgttcttccagcagtacgtcgtcaccggccaggtcgagccggagctcgccgccgccgcgctcgccgtgctcgccgacgtcgcagccgacgccagggggacccgcgacgcggtgtacggcaaggcgctcctcggcgcgctcggcgccatgcaggagtggtccgagaagcggctgctggactaccacgacagctacgagaagggcatcggcggcgcccccaccgaggtcatggagatcctcctctccatctcgctcgccgccggcaagatcatcgccgaccgtgatgccgccgccgacgccgacgacgccgccaatttcgccggtgaccgcgtcgactactacatcaggtgttcgatgaagaacgccttcaccaaggtgaagttcttgggttcagaatcacaatttgtgttgcatcaattcatgttcgttttgattccagattctcgagagcggaatgggcgacggcgacggcgagccgggggtggtgctgacgcagctggcgagggacacggaggagctcgccgtcgtggagcggcggagcttcagcccggtgctgaggcggtggcacccggcgccggtggccgtcgcggcggtcaccctgcacggctgctacggcgtcgtgctgaggcagtacctcggcaaggtgaccatcctcacggaggagctcgtccgcgtgctccagtcggcgagcaggatggagaaggccatggcgcagatgacggcggaggacgccgccgactgccgcgacgaccgggccaaggccatcgtcggcgacatggagccctacgaggtggattccgtcgttatgggcttgctcaaggtgtggatggacgacaggttcaagatcaccatggactgcctcgccagagccaaagaaaccgaggtaatttcgtcgaacaccttgatgacgtccaacttgaaaaatcatttttcatacttaccattgatttgcaacaaaacgtgttagagctggataccaaaatccaaagatgaaccttttgccgggtcagcgatggagatgatgaagctggctaagtataccgtcgaagagttctccgagatcccggcgagcgcgaaagacgaggtggtgcaagacctcgtcgacggcctcgaggcgatcttccaagagtacatctccttcgtcgcctcgtgcggtgagacacatccactcacgtgacaagaagtcaacgataacagagtatcatatttgtagtgttcagatcaaacttacacgtctctgaatcataggggccaagcagaattacctcccaccgttgccaccattgacgaggtgcaaccaggactcgggcttcttcaagctgtggaggaagacggtgctgccgtcgtgccaagcgccggagggcggcccacgcggcgtcggcgttggcggcggctcgcaccacgtcccgcggccgtcgatcagccgcggcacgcagcgcctctacgtccgcctcaacacgctcgagtacgtcctcacgcacctccacgccatcgacaagtcgctcgtcgccgcgccgtcgccacgcttcgacggcgcgcgcgccgcggcgaagtcggcgatcgcccgcgtcgccgaggtggcggcgttccgcctcgtgttcctcgactcgcgccactccttctaccacggcctctacctccgcggcgtcgccgacacgcggatcaggccggcgctgcgcgcgctgaagcagaacctgacgttcctggtgtcggtgctcgccgacagggcgcagccagtggcggtgcgggaggtgatgagggcgtcgttcgaggcgttcctgatggtgctcctcgccggcggcggcgaccggagcttcgcgaggggggaccacgccatggtggaggaggacttccggagcctgaggcgcgcgttctgcacgtgcggcgaggggctcgtgccggaggaggtggtggcgcgcgaggccgaggcggcggagcgcgtcgtggagctcatggcgcggccgacggacgccctcatcgacgcgttcggcgtcgccacgtccgagtccatcgtcgccgccgtggggcgcggcggcgacgacggcgacggcggctacggcggcgtgacgccggtgccgccgacgtcgaggcggtgggacgccgccgacgcgaacacgatcctccgcgtgctctgccaccgcgacgacgaggccgccagccagtttctgaagcgcacgttccagctcgccaagcgacgatgatcatgcaaaaaaagcttcgcgtcgtcccgtctccaagctcagcaatggcgcagccgcgcagtgtatccatcggagttgaagaagacggtagctacacgccatacagctctagatttttgcgatctttgcagtcggaattaaacctcataatctctcgaacgaactgtaaacccaacacaaatacgaatatgtaaaattttctggcacggatctgaaagtttcaatattggtgtcattcctatgtagttacattcgaaagttttctagcgaaaaagcttacgataattttgttcagtcctccctccgtttctaaatatttgacgctattgacttttttaaatatgtttgaccgttcattttatttaaaaaatttaagtaattaataatttttttcctataatttgattcattgttaaatatacttatatgtatacatatagttttacatatttcacataagtttttgaataaggcgaacggtcaaacatgtgcttaaaaagtcaacgatgtcaaatatttagaaacggagagagtaatttcctacaacgcccactcgctccccatccacagtccccaccctcccactccacctcgctatgctctccgctgtatccgccctcgacgccgtcttcgctccacgcgccaccaccttcgcctaccacggctgccgtccgctacctccgctccatctccaatgcgtcctggttcttccacgtcgcgatcccacgccagccctttggcccttgccacgtccgccgcctcctcaccgccatctctcgtaaggttgtcgatggccgtccggaggcgaggaggcctttgaggggggacatggaggtcggcggcgagcgcgcatggagagggaggaggcaggctcgcccgctccgccccgccccacccagcagcgtgtagtgaggagaaatttttttaattattttctagcgtaactgaaatgtgggcctcatgttttttatcaaattgccaagtcaatgcctcatgggatgaataactattcaaaggagccacgtagatgccacatcagccaaaaactgtaactggcacgtgggccctcatgttttttattgaattggcacgttagcgccacgtcaacaccgcatatgacaaaaacctaatcaaaggagccatatatgcgtcacattagccaaaattggtgataataccacgaaaggatctcgtttgtactggttttataagtttgggatgtattgtatttggttttacagttaaatgacgattttgtaattcggtgttaaaa

SEQ ID NO: 61433 - DNA, 1299 bp, Oryza sativa
gtactagagtgtaacaatgccgataaatttaggtatagatgtgtttgcaaattctgcattcgtcaaggcagctacaggattactgctactgaaaaaaactctgcattttggtattttattgcatgctatcttctttatggaattatggatatgtcacgtatatgagactgcataacaattactggtgggtttctttgttggcacagaatgctgccattcattaccagtgttttgataataggagatgagatgagatagttcagtaaatttttttagataatgggaatttataaaacctggcttctacaccaactggggtgtatacagccacagaatatccaagcaaacaagcttagttcatacacacaagttcacaaacaaaagaagcacaaaggctcaagcaccttacataaaactaaaagagcacaaagactccctacgcctttcaaagtgaaaagaccttccaaacaaactaaaaaccacattcctcctttaaccgctttctcatgttccatccatctttaccaaagaagtgcatgacagatgtctctaacagtttgcatccttccttcatcacatcgcgctcatcttctttaagcagcaaggaccattgtcgagcccaatacgtccccctgaaaataacctgcaagtaagagttaaaattggagccattgaagaccacatcatttctagaaatccacattgcccacaacaacgtcgcaatccctgtaaagatttggtactttagcctagactgtaaaccctttagccaaatcccaaacatattagcaacattgttaggcggatttatcccaaatgttataaaaagggtactccaaacaaatctagccacatgacaatcaaagaagagatgttgtatcgtttcattgtggttacaaaaacaacacttagtgctgcccttccaatttctttttgctagattgtccttcgtgagaatcactcccttctttaaataccagaggaagattttgtttttcaaaggaattctaagcttccaaattaaatccttcattggtactatattctcatacataatcattttatacatggaactaaccgaaaatatttcggttttgttaactttccaaataagcttgtctctatggtttgagagcctaacaagaaccactttagccactaggttaaaccatgcaaccaaattctcccccaccaaagcaactcaacatttaacggcactttatctataacatccgcaacaatagcattcttattccttacaagattgtataaattagggtacaacttttcgaaaggaaa

SEQ ID NO: 61434 - DNA, 18660 bp, Oryza sativa
  unsure (1)..(18660): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagggcttgttgatttgatgtcattttcaacccttcagtgatattttatggtaattccagagctttccactctcaaatattctaccaaattttggtaagatgcacaaaccaaacactttcatccacaccttattaccttaccaaaaattggtcatggcaaaatttagtattatcaaattttggtaggtttattttcgattttgctatatctcactcgaaagattttttcttatctctcactcgattttctcacttaaatttacagtgcattttcttgtaagttacagtgtaatttatgaaacttacattgtaatttgtaagttacagtgtaatttttgaatcttcgcatgtaagttttgatatttgtattggatttggtctttttcttgaagatatggtaatttagtgtccattatgatatttcttagttgctttttgccttttactgtgtttatcagattttaattcaaagattaaaaatctgtatgatacgattataaaattttttcgaaagatacataggtactcccgtttattttagtgaagtaagcaagcactgaaatcctacgtcagccataccctgttgaccatagaatctcctatgctggtagtagataaatacattcacatacattttttcagtgatatttcgtacaaaaacaaatgttcttaacacaaaaatcaaacaaatggccctcaacaatagacaaaatgtgaaaataatttgtacaatattaggtgtgtaatcatcaatacagaagttacaataaaattttccttccaaaaacacaagaaggtaaccgggcattcacacggccttttttttttctcctttgtactttatactaagaaagtgagaattttacattattgacagtttaaaaaaaatatagtaattaataactatgtacacccacactaatacttcttccatgcttttaatatctcaatttattatttaaaaaatagaaataatagagttatatctgtgtttgagtctcaatttagcatattcatgatttgataatttcgaattttggaattaacaaaaaccgagctgtcctatgcttggtctgtcaatcatattttctataatttaggtcctatttggcagatctcacatgcacgctggagtagtagtttaaaattttgtatttcatctaaaactaaagcaaaatgattcatccaaatgtaatgaatatagtaattcgatttcagatgtaatgaatatccaagcatagcagcatttgttggtagtatataagatggacatgttccatataattttggatggatgcagtaacttcttacatcttagtcttgatacaaaggaagtttgttgggggtcctatgactcctgccaattacagaacactgacaaaactaaccatgctacatcttcagatggtacagaaagaaaacacacagctacaaatactgatcagtatttcctcttgaaagaaatttatcaacagaggagactttctgcataactttacattgcatgccatcaacaaaaccgaaaatggcatacctccaggttccgatggaaaggagcattccaaaccatagccaaaaaccgaaaaccactccagccattacacagtagtagaaatactggtcctcgcatgttctacagtctctctcatctgacgcaactgaagcatttgtgcatgaaatgttcaacggagggccacagagccctgaattatggctgtatattgatgggtcagtgaaggtttgaagttgattcccggtgggtatcttgcctgatagatgattatacgagagattaagagtgctaagggtagatataccagcaaggcttggaggaatggctcctgaaatttcatttgacgagaggtcaagggactcaagatttttcaaactacctatgttttcaggtatcccacacgatagattgttccttgacaagttcagaaatcgaaggccttggaggtttgttaactcatcggggatgcattcagacaatgagttacctgacaaatcaatacccgtcattaattgaagtgttttttggaaaattatctcctgccccttccagattatatcgattctatcctgataggtagacccatctaatgatcccgcactggatacaatttttggattcttcatggatgttaagttgccaaaagatgtgggaatcgaccctgtcaaactgttgttggtcatatctagcagttggagttgagaaagatgtgataactcagaaggaatttcaccggtgaagttgtttgatctaaggctaagaatcttcaaagatgaaaggcctttcccaatccaaggaggaatgccaccaaagaaattgttgttcccaatatctaaagtgaccagcgtctggcatccctttagcgctgatggaaaaacaccggtgaagccgttgccggcaagatgaaccgattcaagagaacaattgtagcttgtattgactgcagggatttcacctgagaagcggttgtgggagaggtccatgaactgcaggctctgcagattccaccagcagtcaggcagcttaccggtgagcttgttgtttgacaggtccaggatctggagagaaagcaacctgcaaaaggccgagccggagctgctgttggaggagttgccgttcaggacgttgtacttctccggcatgactgcgccgccgtcgtatagcctccgagccggcctgctggagaagtctacttcatcattgcggtagtagttttcgtcgtcgtcgccgtcgtatattctccgtaccggcctgccggagaagacgtcgtcgtcgtcatcatggtagtagttgtcatcgtcttcgtccccatcgtaatggtagtagtgatcgtccacatcggcatcgaggctcaagctcgtcacccgttgaggagatgataacagcaagagggagagggagatgcagaggaagagacagaggcgcagcacgagaggggccttggctgccatggctggatttggtagagtgcaaaggagcttgtggaactgaagtattgaactccacttgtaaagctgcaggagtatttctttctctctttcttggtatggctatggacagggggcgaggttgaccgtgaccatgggggtcgtcgggtgggggtgctgcggattaggaatttggagcgctcgccgtgtcgcggtcggcgcatgtttcacacggcacagcgacagcgatggaccagccggctccaccatgtgagatgacttggactgatgacccgagaaaggcacaatggcacagtatccagccagagtcaaggatggagccaatggcgagcagtgcgttttgcagtcaaaatttcagaacacacggtggagttgtcagagacgaatggtaccttgatcatgagaggctcgcccgatgatggcgctcccgcgcgagcgacgtcgcccgccgcgctcctgtcccctcctcgccgtcttcctcccgccccgagtccctcctcctcctcccaggcatttcctcgagcacatcatgcgcgcagcacgccggcgagaccgagacattcctcaaagcgccgccgcctgggcaaaacccaggctaggtgggggaccgagctctggccgccgcggatgctgcagcgcttctattggagccacgacggcggcggcggcgcgcgacggccgggaccctcgctccgccgcgtcggagacagaagccgacgccgacgcgagcgcaaagtagctcgttctgacgcggtttcgtcctcgattcgcgagcccggcccaaacaaaacgaaacgaagtccgcttccgtcatctatacggcccattattacatactccacacggtgcttttgttcatgggcttgatccatttagtacggcccagcacagtcctcgtctcgatggcccatcacctgtaatgggccgtacttctccacggtgctactagagatggcaatggggacccaaaacctgtgacccgacgggtttttactctattaggagctaattgtgttctaactcttatacccatgggtctactaatgggcaaaactcttacccattaggtacgtgggtatgggtccgttctttacccacccatacccaccaacccgtgggtgaaaaaacctattgattaagcctaaaactataagcaatataagtctcaacgactactaaatcataatatgaaactcctttcacatcttaagcattgttctattctagttatatgaaattattatttgatttcttgattatgtatgtggttgtataattttttttactcgcctttgtatgctaatgttaatatattattgctagagaaaatattgatggtttacaactctaatatgactaattatagtacaaaactataaatgctacaagtcaactatatgggtatgggtacccgttggatacccgttacccgcacgggtgtgggtatggggaagattttgtacccgcgatgggtgtgggtatttaagtgggaaaatttagacgttgcgggtgtgggtatgggataaggaaacctgatgggtatgcacccgttgccatctactgctacacgcgcgcctactaacgagcggagtcgtcaggatgatgaccagctgacgtcacgttggcttctacttactctctccgtcccataatataagggattttaagtttttgtttgcactttttatcactcgtcttattaaaaaaaatttggaattattatttattttttgtgtgacttgctttattatccaaagtactttaagcacaacttttcgttttttataattacacaactttttaataagacgagtgatcaaacagtgcaaacaaaaactcaaaatcctttatattatgggatggagggagtaacattttctgaacttcatcgggaaaagcaaaaaggtttattccgtaattccgtatgaaacaagtgaatagcgatattagacgaaggcagcgacataaaattgtactaggctcatagcaaggaattcatatcaagttcagttatacttgtaagaggaggtgcactaacatactgttagccagctataaacatatttgtcaaggagtaatcctctctagcgggagatcgtgagatcccctttttgtgagttcggccgagggaaaaggctcgcttggggagatcgcgtattcgccttgaacgctgctatatcatgtgtgagccccaagattatacaagttcgggccgctatcgagcgtaacaccctactcttgtgtgtgggattatggctgagtgttagaagggttcctaaactccggagagcgctcccgcttctcttctcctagagttcaggtttactgagagtcgtccccttttctcggtgggcaaggtcctccttttatagttcaaggggataccacatacaccgcctctacctactctttcatgggaggggcacccactctatcttgaccgggccacgatccgtgccttcgcccggaagctaagcagcagtccgtccttgagcgggacccagtgctgccccccgcctgacacgggggacagccctttcattccctcataaatgggtgaagacttgcggtggtcctcctccacggagggaactccaaatgacgcttcgatgggacaggacatacctatctccactccgccggagacagaaacgacgtgggggcacggccgcccgtcaatcggacgtgaccggcaacaggccggtcacagattggtcacgtccgactgacgtgggtcagtcaggcggcaccgcacgtctgcccttaccgcattaaacgcggtgagggatagttggggcgccgcgcattgatggctgttcagcccgggtcctctccccactcactccccccgccacatggcagctgggcgagagccttgaggtgaggcagcgcgaaggcccgaggggcacgacatggcaccccgaggcccctcggctgcttttgcgactcgcgaggtgcgggagtagggccaggctgtagagccacgcggcaggataggaaggtaacttcccctcactttgcatacccccgggcccatatctccgacagtagcccccagcaccacgtcggacattggtccctcgaggacagtctgacgtggcgcctcacgacttctcgtgccgtggttgtgggcccgacgggaaatccagacggttgccggcgagcggccaggttggcacattagccaaaatggcgatttgaccgccgttaaccgcgctgatgatgggggcgcctagggcgcgaaaatcagggggtcggctagaccacgcctagaatcgtcacccacgccgcctcgactccctcgccctttgtgagttcggcggggggcagcgggtgagatttgagggcttggtgggcaaagctgtgtgatcttgagggggttcaatcccccaaagacgatgagacaaaagggatttatacaggttcgggccgctaagaagcgtaataccctactcctgtgcttgattgattgagtgtagaacacaagtgcttggggttgcaagacccaagtgccagttcgctcggaagtcccccctccccccttctctcactaggactggacctccttttatacctcaaggggttaccacataggcccaacaacctaacttcctcgagaagtattacaatctttgcattaaatgcatgtcttgttccttaacttggaagccgcatacacgtcgcctcggtcgtagggcctaccaaaccatgccgcctgacacggggggcgcccatgtcattcaccatttaatgggtgaagacttctgggctcctttacaccgggaaaacgggagcctagctttaaccagagcgggaggaccgactctggctgggataagaggatgagaacctctcattatcattatttgatgggacatgtcaggctgcacgccgcctgacacacgagcagcgcacaggcgtactagccagtcccatcggtcattcgaccggtcacagaccggttgagtacactgacgccgcattaaatgcggcgtggcgcgaccgctcgagtcgccataaatgcgggtaggtgggcacctgtaggcggacacctaacccaccgtacgtggtgacctagagagggggtcgggggagcccaacccctagtcatgggagggggcggtcgccgcctgacctcgggcccgatcccccctcggggagggccacgtggcattggggggcagcctcctctcactagtctttgggaaggagtggccgccaccccacctcgggcctgactccccttgggggagggccacgtggcattggggggcagccttctccgtccaatctctgggagggagtggccgccgccctaccttgggccggactcccctcggggagggccacgtggcattgggggcagcctcctccgactagtctttgggaaggagtggccgccaccccacctcgggcctgactccccttgggggagggccacgtggcattggggggcagccttctccgtccaatctctgggagggagtggccgccgccctaccttgggccggactcccctcggggagggccacgtggcattgggggagggccacgtggcattggggggcagcctcctccctctaaacatgatacccccgggcctatatcaccgacaatattttaatgagataaaatatgagagagaagagcagcgggctacagatctgtagccagctgcagcacggatttcaagacgtagtgtgtgtatgataggtaggacaatatattaatagtatagtaagtaactactgtataaattggctattgtattggctatatgtgaattagagctagtagtgggctattctcctgaatttgctctaactgcaacgcacacgtggacccacaatccagagtcacacggatcgagcctacataaattctctgtatttattgtagaggataacatgtcataagtaaaataagagtgtgtttaattcacgttaaattggaatgatgtgatagaaaaatttaaagtttgtgtatacaaaaattttaatgtgatggaaaagttgaaaatctgaaggaaaagtttgaaactaaactcggcctaaatctcaatgccatagtgaattgccgtaaattgttgtatcgtcattagtgctagttacgacggcaacataagtaagtactcctaaatttgttgctgttgctggcttgctgccgcggcagctatacccagctggtgcaccatatatagacagtttttttctttactgttgcgattcgacgtactagtattatttgatccggagagtccacacaactgaacaaaatggctaaaattgatcctaattctgcccccatgttctttcttttctacgtttattagtacttcagaaaaaactaaccaacttcaaatattaaaagatggagggagtatatatcaacctgttgtattgagctttacattagctattaccgcaaattatcctctttttttcttaaacaacaagtacaatatagtatgacgtttctatcgatattaccggagattatcctcattatgcagaagcacgtgtctagcattagtatgacttttacgcgaacattcgtgtattagacgtaccctcgactcctaccgaaatgtggtgggaatgtgagatgatcaaagcagtagcttgacagtcttttttgctagccccctcaattatttcactccttcagcaaacttggacacaatacgtcaatatcttgttatgtttttatttcttttgatttttttttaaaaaaaactactcctgcatagttatcgtgttatgcatggtggtgatcgttcggttcaaagtttcaaacacacttgttcacattaatggaacccaccgcagttaatagcgctggagagggccatactcctgtgtgaggcagtacagtttgttgcgtgtcgtgtagccgtacgagctaccagtctaccacagctatctatctcgcggagtaataatgacttggacttagagcaggtacattagcaggctataactgcaaacatattttaagaatataaatgaggagagagagaggagcggtgggctacagatttatagccatgtgtagcacatactccaagacacagtgtgtgtatgataggtgggactagatactaatagtgtattatataactattgtatgaatgaactattatattggctatagataaattggagctagcagttggctatactattaaacttgctcttaggaatgtactactagtattattttctgttcctaaatatatacatcttgattgtttaacaaaaatggtactactacattggttgacaaatcaaaatattttttattacctcattggttagattttaaattgtttgtactcttctgattgatccatttaaaattgctagagatcggaatcaatatctcataaataattatataaggagaaccaactagctaggttcattatggtgtaaccagcctaccctcgttcaagttttaaattttagacaggtgttcgtatttacagctaattattgtttcactgataaatgatgtacttattagtaatgaggtgcatggtagggtgtacagacgaccgtggtgaattcatcaagtttatagcatagttattaagaccggaccggtgaatgaaccggttgagctctcggttcactggtttagcggtcgagccagtggttttaccggtccaaccacggtctgattactattatagaatgaatgtttatgtgatggcacaagcagcaggatggtggcatggctagcgcgtgaacctgtcaatcccgtgaccagaggtcgaatcctcgtctccaccaatttttctcgggattttgcgcgcgcatgcacgggaggcaactagttgggccccccattagccggtctttcccggtttgaccagccaggttaatctccggtttatataaaaaccgcccgagttaaccggttttctccggtccgattatacgtgtatcttgaacgtctatgtttatacatttgtttttttataaaaaatttgaataattctatagatgtttacatactggagtactatttggacatctatctgtggctttgtttagttccaaactttttctttaaacttctaacttttccatcacatcaaactttcttacacatataaacttttaacttttccatcacatcgttccaatttcaatcaaactttcaattttagcgtgaaacgccaccctatctctcggggagtaataaatggctggacttgaagagtgtcgcagtactgtagcagggtcgacagcgaccgtcctgccaatagggaatcaatgcggcccccgtcttaagttcgcttctgccctgtcaggtttgcccagccactccccgcgcagcagctcagccgtcgctaccaccacctcaagctcccgcctcgcgtgcagctagctgagagcgagcgctcgccatggagaacggcgccggcgccggggacgacgagtacacgcgcgacggctccgtcgacctccgcggcaaccccgtcctccgctccaagcgcggcggctggaaggcctgctccttcatcgtcggtacgtgtaacgtgttcgtgtgtatagtcgtcgtcgccggcgagcttggtggtgatgtttgtgtggtggtggtggtggtggcagtgtacgagctgttcgagaggatggcgtactacgggatcgcgtcgaacctggtgatctacctgacggagaagctgcaccagggcaccgtggaggcggccaacaacgtcaccaactggtccggcaccgtcttcatcacgccgctcatcggcgccgtcgtcgccgacgcctggctcggccgctactggaccttcgtcgccggctccgccgtctacctcatggtcacatctctctctctctctctctctctctctctattcagctacataccctgttctcttctgcctctgtctctcctctctattcaacggaaaacaatattaaactctcgacaactcaaacaccacggttatggaaaaatctgaaaaaagtttcttaggaattttgaaacagttttactcctgcatgaacggagaaaaaaaaaattctgaagcatggtttgcaatttcggcgtatgcaaattatagctcagtaccgaaatttctgacgaaagagtaatttttttacacattttaaaatttagaattcgggtcttttaaaactgtttaagcttgattcttttgttttcgtgtaatctcatctgcatatatatatgtatgcagtggttaattattgacttctcatccaaatatgataatatatataattggaagaccctatcttgttttactcaactaatttctcaaatgtttgaaaggcatctaatatctccttatcataaatgatgttatattatattcaatataatttgtcgatatatgattagaagaggtaatgattaaagacctctcgtcagctaatagtaaaccggtcccttgtccctatccaaatttgcatagtagaccgtatcttcatgctacttcacccctgttaattaagaagctactactctctccgttttatattataagttattttgggtttgtattaactcggttctcttcaagttttaccaagtttataaaacggtcaaattagttttataaatgcatcattgaatatatttttatagtatatttattttgtgttgcaaatatcgtaaagtgaaatttactcttatatttttctgtaaagttttacttatgacagactcgaagttacgaagccgggtagtggtaatgaagcaatcggcaaaagaaaaccattctcccttttttttttaatcaagaaaaccagtcttgattggacaaaagaaatgtcataatactcacttcacttcatttgtcctgtttgcacccataatggggttcacttcacttcacaatgtcccttttaaaaaaggttttacaatgtcgacagtaaccgctttgttatcgtaaaccgtgttgcactcaccacacaatgttcataaaatttacctgtatacattattgatggtgtcaatatcattaacaatggggagagcaatatttcgacggaatcttcattttgaaggaaatgcctggatttggagataccttctgtacaatgaaagtgcaagaatgaatgccatgtgtgtgtggcatcccagtaggccggccgtacgtcattttgtatctttgcatttgtatcttcgaagacaataatctgtgtctttccaaactaaatccgacaaaaatgaaaccatcaggaaataataggtcaactaccatgaccccatgtgagatctggtcctgaaaaataggacaatggggtgtaagattgacaccaggttttgcttttgatataagcaagtaggggggtaatcctttccaaaatgtccaaaattagtacagaggattgatgtgttcatgttgtgacttcaagtccatttccactaaaaaattggagatttgggtaaacgtcacagctaattacgagagcatgctggaaaatgcatcttttgttttagcacactttgtactgttaataaaggttaagttctactccctccgtttcaggttaaaagacgttttgactttaattaaagtcaaattgctttaagtttgactaattttatagacaagtatagtaatatttataatactaaattagtttcatcaaatcaataattgaatatattttcataataaatttatcttgggttaaaaatgttactatttttttctacaaacttggtcatcaaaaatcaataattgaatatatttttataataaatttttcttgggttgaaaatattactattttttttacaaacttagtcaaatttaaaacagtttgactttaaccaaaatcaaaacttcttataacctaaaacggagggagtagttagtactaatatgcttttctaaagtagaatatcaacttcaccaatttttggtttggtgggaactcaggcttctaatttgggctttactggtgcaaactgcaaacccacacatgcttgacaggttaacctaacacaaaccttgttcatcacagtccaagtagaacttctagaaaccaaacccaagttcaatttcaagctgaacacatgagtttgaacattatttattcgttcaaattaaattcacctgaaatttggaaacacatggaagaattcctctctttcaaatttcttctgaatctgaaccatccaaattaacaaacgcagggcatgctgctgctcacactggccgtctccgtgccagcactgaagccgccgccgtgcgacggcggcggcggcgccgcctgcccgcgcgcgtcggcgctgcagctgggcgtctacttcggcgggctgtacaccatcgcgctcggccacggcggcacgaagccgaacatctccaccatcggcgccgaccagttcgacgacttccacccgccggagaagctgcataagctctccttcttcaactggtggatgttcaccatcttcctcggcatcctcttctccaccaccgtcctcgtctacctccaggacaacgtcagctggaccgtcggctacggcatccccaccctgggcctcatggtctccgtcgccgtcttcctctccggtacgccgctgtaccgccacaaggtgccccagggtagccccctcgccacgatggggagggtcgtcgccgccgccgtgtggaagtggcgcgtcccgctccccgccgactccaaggagctccacgagctcgagctcgagcactacaccacccgccgcgggttccgcatggacgcgacggtgtccatggcgttcctgaacaaggcggcggtgaagccgggcgaaggaggaggaggatcggtggcgcggctgcccgggtggacgctgtgcacggtgacgcaggtggaggagacgaagcagatcgtgaagctggtgccgctgctcgccacaatggtggtgccgtgcacgctggtggcgcaggcgggcacgctgttcgtcaagcagggcgtgacgctggaccgccgcatcgggaagttccacgtgccgccggcgagcctcggcgcgttcgtgacggcgacgatgctcatctgcatcgtgctctacgaccggttcctcgtccccgccgtgcgccggcggaccaagaacccgagggggatcacgctgctgcagcggatcagcctggggatgctgctccagatcgtgacgatggtggtgacgtcggtggtggagagccagaggctggggtacgcgaggaggcacgggctggtcgccaccggcgggcagctgccggtgacgatcttcatcctgctgccgcagttcgtgctgctgggcgtcgccgacgcgttcctggtggtggggcagatcgagttcttctacgaccaggcgccggagagcatgaagagcctcgggacggcgatgtcgctgacggcgtacggcgccgggaacctgctgagcagcgccatcctcgcggccgtcgagcgggtcaccggcggcggcaaggggaggacgccgtgggtgaccaacaacctcaacgcctcgcgcctcgactactactacgcgttcctcgccaccctcgccgccgcgaacctgctggcgttcgtcgtgctcagctgcaagtactcgtaccgcgtcgagtccacggagaccatcgacgtcgacgtcgccatggacaacgtcgcgcagggcggcggcgtggtgacggtcaaatcagaggcagccccaatggcatgacagcacttccggaattgtatcctgtctattcccgtctggattctgaagttgcaatgtaatgaagaaacggtgatgatacatattagcactttaaaaatgttaaatgaaaattttatttactcgttctgtaaaggaacggtaatacggacaatattcacagcttcacacaatcgcactagtagcaccatcgtttctcttatgcctatacttaagctaaaatgtgaattttaaagcttcactttagagttgattttgtgttttttttaaatatagtttattttacagtatttgctttcgaatcgataaggacacgtcgcataaattattttttaatttgttaataaacgattcgcatgaacgtaagtataagtaaaaggatggaaccataaatatctaggagtaatttggtgacaacgatggagatgcactattacagtcatgacgctagaggcaactaactccatccatcctaaaatatagcaatatagtacatgatgggacatgtatgtccatattcatagtactatgatatatcacatctcatattagattgttatattttgcgacggatgaagtatttgagagatactagctccgttttttaatagataacgccgttgactttttctcacatgtttgaccattcgtcttatttaaaaaatttacgtaattataatttattttgttatgagttgttttatcactcatagtattttaagtgtgatttatatcctatatatttgtataaaatttttgaataagacgaatagtcaaacatgcgagaaaaagtcaacggcgtcatctattaaaaaaacggagggagtatatcatatcggccgatgatgtaagctagtagctgatcctttcaaattatttatctttctaggtttggacttaagtcaagtatttccatctttttaccatcagatatatgttttaacaacatggaaattatgtaccaccagaaaacaaggcacgcttatatataacgtgttcatatgactaggtaacactctaactcaactggattgaccgtagtcagctcgccacctgagctgaaagcaggcacaatattgtcgatctcggatacttcgctactgtaaattgacgaacatgacatcaagacgagaaatctaaggaataagtccagtttgactcccttaactagtgaccgaatttgatctgtatccctaaaccacaataccggatatcttcgacccccaaactattgaaatcggtgcaatttgactcccttggcggttttggagggcagtttcacttatgtagggcccgctcacatatgggacccatatacgatcctccctttccttcccttattcctccttcctttctctctctcccccttaccttcccttcttcctcctccctttctctcccttaccgttggtgcaccagtagttcagcagcggtgccgggaccgggccgtcgtttgttgtttgttgggaggacgccaagtagggcgacgtcgaggagcgagacggtggcctctccccggaggtcctagtggcgtgggcgccgagccagccgcggaaggagacgcggatctaggtgttagagacggcggcgcggagaggaggagggcagaagggggaaggtggggccgggactccggcgagcggggcaatccccgttcacgtcgctcctctcgaccttcgttgcatgggatgctaccatcggttgcccactcatccgcgccaagctcgatgccatgggggccacatctaccaccagcggggcccaatgaggcacgcgggggcaaggacatgagggcgcgccacgttggggtgctcgtcaagatgtgctggtgtggacgtggatccctgacgcgcttgtttggatttctgcaggaagtcgaagctgtcccgccggcgccactccagcacctgcccgccaccactccaaaacatgctcctcgcacacgactgaagaaggggtagagagagggagagaggagggagacagagggaagagtaagaagggaaggagagagaggatgacatttgggtcccacatgtttgtgggtccacaatttttttttgaataacaagtgggtccacaatatatatatatatatatatatatatatatatatatatatatatatatatatatataagttctaatgacatgtaagcgccacgtcaacgccacgttgtacgaacactaggtcaatactaccacgtaggcgctacgtcagcgaagctgccctccaaaaccgcaaatggagtcaaattgcgcccgttttaataggtgaggatcaatatatccggtattgtagttcaatgataggaatcagattcggtcactaattaagtgagtcaaagtgggcttattccgaaatctaaagtaagcttatttcataacaaaattcagctcagttactcttgggtcaataagctagcctaataaaccgggaagaaaagtcagaaaacaatctcgctagcttccacctctcatgctgcagcatgcttataaagcaaagacaaatctagggttgatttagccttcatactcaatggagttattcctatatgctccgctgagatatgttgtttgtttcactttcaatcggttaaacgttgactgaacagtcgtcatcatcacgatgtaatttctacctttcaatcggttaaacgttgactgaacagtcgtcatcatcacgatgtaatttctacctggaaaggaggcgtcgaaggagcttaatgaaacatatcaaatacaatgcaattagacaatatgagtgaactcttcatccaaataaatccttatccatgacccaaaaatcattctcttccattatctgaagaagattagctcaccaagttagtagaagtgttcatcatctatcctcgactagttcaaaagcagcaagaccaccttcccacggtgtgtaaatgaaccccaaaacagaaaaaaaactcccaaataacacgccacaaaaggtatggtaggtgtggcttgacaatattacattcactggttgttaggttaagcattaaacaatcacatgtctcagcatctgccactataaaagttcatttttaaggacagtcatatagaaactttaattttctgagtctaattattggtcttgataatgtatccaaacatttacaatcgttatttttcatgatccacacatactgactatgacctatatgaataatgagacgaccaatcaagaaaactgtagtaaagaataattaggcaatttgttttgttggtttgttgtgggatatgttatatgttaatcaagttagtccttcttattggagttgaagagatgacataaaaaatgtttctatgtgaacaaagtaacattaagaagataacccgttaaactctttttttcttatagtaaagcgttcaactttgtgttgcgactccaaagctttattatggcacaaaaactttacacaaggctctaattattcttttactataaatcttaatttgttatgatgatgatttttaaaactaacttttaacttttaatttgttgagttggacgacaagttcagttatgtaaagctccaaggtcactgatagaagtgagcaactgttagtattttcatatttacttttcaatgatttatatcctaaatggcaattgcggagttcattacatatatatcaatagctaaacttgttatatgtattacaggat

SEQ ID NO: 61435 - DNA, 766 bp, Oryza sativa
ttggtaataccagcatcggagatggagatgggatcgaagcggaatcgaagatgatggttgttgcggaaacagagtaaaatcggctggagtccgggtcggctacgactgggatcggctaagtctgagttagactgggttaagtgatacagccgattccgacaatacgatctgtgtacgatgtcgggttcgagttgatgtgcttcaagatgattgccatgcatggatagagtcctgggaaggcaattgtatctattaattaggatattttatgtaaattccttagagatatgtttgggcaaaagtctgccgcaaagacttatggtatcttagagtttgttagaaatagtagtcgtgtccggtatgggcatatcttgtaattttcgggtataaataggccccgagccctatgtaatttttaacacacgcacgttcaatacaatttcggcgcatcgccaccttttgctttagttttatttcgacgagttcttactttcgggttgagctgcatcggtttcgatcttcgacaagaggtaaaacttgttgtgatgatttgctttctcgggattagtgcttccatctcatgatactctaatcttgtttatgtgattcgtcaagttatcatatatcttacgtaatctctggcaataccgttatctaacctacaattggccaacatctatcgaggaaggcagccgattaggttagatgtcgatgttgatttagattatataagatatctaccaccctatgaaatatccagcggctt

SEQ ID NO: 61436 - DNA, 1420 bp, Oryza sativa
aattttagaggataaacttttggattaaaatgatacgtttttcaaactgctaaacggtatatttcgtacgaaaactttctatgtaaaagttgttctaaaatatcagattaatccatttttcaagtttgtaataattaaaactcaattaatcacacgttattatcacctcgttttgcgtaaaacaattaatatttatcttcaaatcttgaggagattcaaacaccacctaaatattcgctgattttttgatgcgaaaaggaaatttatcacctttctacacgtcgtctagtactgctgaattatcaggctgtgtctgtgatgtctgaatatctgaatccgacaagacataacactgttgattccaactgatctgatgagacgagaatcagtgcagtattgcactgttgggaagaggccaaggaagggagggaagggaaagctactttgctgcttgcttttttcccctcgaaaaaaaaaatcccctcgaaaaaactttgctgcttgcttttgagttggttgctagctgcatcttagtttccaggttgtgaattagtacttcctttatcccaaaaataattaaatcctaaaaataaatttaaactcttttatcagaagaaaaacacaaatattagagaaatatctaatatcaaataaataaaataggtgaggttttaaactcaagccgactagcccaccaccttatgaagctagctaaaaacctcttcgtgtttctaactagcttaacagatcgagtactgtgaagcaatacagaagagctctctaaagagattttgacttcgcttacagttctccagtgtagtagcattggatcagggtgagatagatcagttctactccatccactttaaaatataaacattcgtaacatctaaaatttataccaacatatatatactttacaaatagatcctttgaagtaaaacaatgctgaagtagtactagaaaatgtccagatttagatgatgggagtacttaatataaatagaagtatttaaaacgtatttactccctctgtcgcaaaataagttttgcactattcatctctaacgtttgaccgttcgtcttatttgaaaattttttatgattattatttttattgttattagatgataaaatatgaataatactttatgtgtgactaatttttttaaaaacaaatttataaatttttcaaataagatggatggtcaaacattggacacggattttcacagttgcatttattttgggacggagttagtatattttagaacggcactcataatggctggctcgacttatgtgacataacagtgatgttatattgtcctagtttctgtgaaaatccattaaatttcatacgctcgcctcgtatggaacgcatgaatatcatgacaactggagtagtacagacaacagt

SEQ ID NO: 61437 - DNA, 7748 bp, Oryza sativa
ccatttgatcggagatgaagcacatcaacgtaccctagttaggtccagttcatttatagttcagttatgctacttgttctggatttgatacgcaggggagggaccaagctagctactaagggggtgtttagatcagggatgtaaagttttggcgtgtcaatattatatatgatgtcgcatatggtgtttggacactaataaaaaaactaattacagtatccgtcagtaaaccgcgagacgaatttattaagcctaataatatgttattagtaaatatttactgtagcaccacattatcaaatcatggaacaattaggcttaaaagattcgtttcgcaaattagtcgcaatctgtccaattagtttttttagcctatatttaatacttcatacatacaggtgtttaaacgttcgatgtgacggggaaaaatttttgggtgggaattaaacagggcctaaactaaatggtgatcaattaatcgatcgagagccagtacttcagaattaaatgtaggcttgatcaatgcagagattaattaaccttacgattgcctgtccattcctgactgatatctgcattattcagtgtggtggccagcaaaagcaagagatcagataaaaccatgcattgttatatgtctcctttaattttcagatctcattctgtcagaggttgcatagattgggcgttcggatgcatttgctgctggaaagttggcataaattgggctggaatttgagcgtctctgtaactgtagtctgtactgcaaattgcatgtgtgcaatctctgcttgcagtagtggagctacaggcatgaagggtggatatatgagacactggacccaaccgtcctttttttatcttcaaaatcattaattccttttggaggaccacaatttgttaacttttcttctggtgaaaagaaaaaaaaatcaaagctggtttttagaaggaaagataacaaaagcactagctagcaaatatctgacagggtttgcattatcatcggtccaacgggcaaccggacttaccattggggtgcagtaacgaaaaccgctcggtatcgaccgagttcaaaagaatttaaataatattttaaattccgataaaatttatttggtttttttatcggttttacttgataactggttactgcggttactgtcattattaccacataggaggggtaaccaccctctgccacgtaatataagcattaagcacgtgttttgattacctacatacagtgataatggttggcttgcacgcatggttgcaaggcccgtgtttggttgccctttgcccacattacctccaggcccaaggttccctgagccaaggcccgaggtgaacggccgatctgagcttctctccccatcctggctgagcgcgtaaagggcccaagcccaagcccaaaaaccttaccaggcccccaaaccaggaaaaaaattccggcccattaccacgtgggacccacagcccacagagctgtcagcgaagtgggccccaccggtcaggcgagcgccccccgctcctctgtttctgttcttgatggtgatgatgaagatgagcatacaaaagctgtgattttgaggccaccgtgcatcgcgccgccgccgacgacgacctcgacccactcacctcgactgcgacgcgtggcggcgggaggagaggagaggagagggatatggagggcggcggcggggagagggcggcgggggtggtgcggcggctgatggcggcgaaggcggagtcgcggaagagcttctcggagatcggggaggaggcggggctgaccaacgtgtacgtggcgcagctgctgcggcggcaggcgcagctgaagccggagacggcgccggcgctgcgggcggccgtgccggggctcaccgacgacctcgtcgcgctcatgatggagccgccgttccgctcctaccacccggacatcgtccacgagcccgccatctacaggtgcctcctccttcccctccctcccatggccgtaccgtactctgcttctcaattgagtctcgcctctgattccaaaccatacatgttgatgctttccttttgattgttcttctagaattttatctttgagaaaatctatcctacggttttccgtggagacggaatagtactactcccttatctctctcttcccctccattcgatccctctctctgtgaataccacccatgagcacggaggcggcgacgacggcgacggcaacggcgacgacggcggcaacgacggcggcggcaacgacgacgacggtgccgtcaccaccagcccccgcggacgacctggacgacagtcggcggagctcccgaccaccacgggcgacggccgccgtcaagaagcctccccatcaagctcctcaaggcgctcctcctcttcgtcgttcttgtcggtagcttcctcgccgctgccgccctcctcctccttggcggcgctggcgcctcctacggtcggggagcgatggacgcggccaccgggggcgagcacttggcacaacatgagcgacgaggagctgctctaggcggcgtcaatggagccacgggtttggcggtttggagcgaggcacgacgacgagcgacggaatggcacaaggtaggcaccagatctatcgcctcctcttcctcttcctccgccgtcgccccgctgctcgacttccctgacccacgactcctcctcctcctctctcttgggatatcacactgatacccagataccaaggcctgatacctaggtatcagctcgatacccagggtaccaggtatcagtcgatacccaggtaccaagacctgatacctaggtaccaaggcctgatacataggtatcagctcgatacccagggtaccaggtatcagtcgatactagggtgtaccaggtatcagtcgatagtcgataccagggtaccagctgataccaatgtaccaggtaccacctcggtaccttacccaagataccaaggaggattggatatggtggaatcgcaggatagcgtgggcctccccacaaaattgatgaagcttattaaatctctcgggattttagttatcccgtgactgctaggagcaacggaataccgtggggtagcagccctctttatcttttcgttatttattatacatgcttgctagagttgtgaggatggcgaaattaagtaatttctttgtgctgttcttgattctgaaattttgaacctttggcatagaaaaatagacacgatgttgcttaattctatcgcgttggcgaagactaattatattcttagggattctatgtcagaaagtgaatatttatttcatttttccattaaaattaagaagccaaatagttaacttgtaagagaatatgctaaagaacatgattagttctgtttgctttgtaacatgcaagagccttttatcgacatatatgtgctattgtaatggaagatgttgtctctatgaaaatttaccagattattacaagtttagtacacggttgatttaaattattgtggtaatgcacttttacaacactctagaaaaggattcttgttgatattttttttaattatatattgcgctcagattgaatgaagctgttatgcattttggagagagcatcaaggaaattatcaatgaggagtttggtgatggaatgtaagatatctgcctatgcttcattctatttgattttcatttaccccagtatttcttgacttcctgttcctggtaactgcacatggacgaagttaaggatttgtatacagtaagcactgatgtaaagcatgcacctttctctgaaaaaaaatgcaaagcatgtacctttatgggaacaatccctggaggttcattaagtctagattaatcactatattcttattagtggtagctggtaaccgatcactatattcttatcaggatgtcaagtaaaatattttcttctcttcaggctgatatagaggcctttgtatttcaagactactgaccatctaattttggctgccatgcttatatcctttgaaaaaaaaaggtgaaagaatccgtttaactgcttcctaatgcagcatgtcagctatagacttctactgttcggttgacaaggtacaaggtgctgatggaaaagatcgcgtggtggtcacatttgatgggaaatatcttccttacagtgagcaggttagtgttttcttgcttccctattctcgatataatcatcttacttttttgaattgatgcataattgaatatgttgaatcatctgccgtctgtatggaagattttggaattgaatatatgctttacattatacttaactttggaagtgatccgtcacaccattgtactatccttgattattattagcagataagcgttggatgaggctacagagttacagatttaatcattatacccattctatctttttactagaattcttccatcttattacctctcttgctgatctgaatttgacaagcagttctaagcacagaattttcatatttgcagagatctgatcatatgatgtctaggctgacccgcaagacatcttgagatggctggtgttgtgggaaaaatgatgtatcatctgcttctgcttgtggattgaatagaatcgagcatgttttttactcccaatagtcgatgaaataaacatactttgtaatgatgtatacatgaataaattgtttaagcagagatacagttcgatgtcacctttactacttctatcattgaataaagttaataaacaacacatgaagtgttaaattgcatttcattgtgttgaacagaaaagatattgtctgaaatgtcaagtgggccgatttgtctttctttcctatttcttttcttcttcttcttcttcttcttcttcttctttttgcgatagagccaatttgttttatttttagtatcataacagaatgacaagaaatttagtatcatataggtaagcagtaggtgtgatgcttcaagtcgacagatatgattgatggaaaaacatgctgctcatttttttttctttctttttttttttgaagaaacaaacatactattgtcttggtcaagtctgaatgtcagaatagatgtttgctccatgtaacttctgtttcatgtaccaagaaacaaaaattgcacggagtattacttttcaaaccacaaggactaaaataaccgctttagcaattgcaatttgattcaagttctcactattgtgttcttgcatacgatactcggtcttctctaaaaatacagaagtgctggataatacgatcaagcaagcgcttgtcattcaacagatcagttcaatatctgttgtgcctctattaacaacaagaggactcggtatcttcttccattgtgttcatatcgtgaaaggaaacagaccggttcaatttctgagatcttcttccattttcgttggcaaatgagtactgttctaaaagtcccagcaatagatcaaaaaaatgtttcgaagtttttgtccgtattaaatttttatattgatttatctattttatcccgtttgtccatgtaaaaagcaacttgctcccggaaaatcacaaaaaataaggggtcaactctaacaagcaaacgaaattgaagggagtatacaaaagcactccctggtatagctgttattttagttctaaaactgctatatggaaccggtatagatagcatctagtggtgaacgttttggctgtgcagcagttctactgctgccgccacaacgccttttccttcagaaaatatgtcaagtgcaggctcctcgatcttcctctggaggagtttgtccaattcacctcttaatctctgtcaaataaaaacattcctaaattagagaagaaggcatataggtctatctattacaacaaagtgattccaaaactgttttaacatccttatgatttgcttgtgcaaacaagaaaataaagcaagttctgtgcagacatgtgaagaaatgaagatgttctattcgctgcaatgcatttgagggactaaaaccgtaaatcagtcaagcaaaatgattgctcagtgtgaacaaaggaatgtagatcaaatagcaagcatgaaatttaataccttttcctgttcgaaaaataaaccttaaaatagaaacgaaatagaataactgaaatccttttttctttagttcaaacaagttatcttgtagggaagttagagatacctggatcaactctatgatacgccttggtgcagagaaatgaagataccccccaagcatctcaatgccttctccagttttgctctcactgagagaaccaccaaagaggagaagagcatagtcggaaatgtttgtggaatccctgacataaatgctagcagttttaaccttctcgctataaaccagataaggcaatgggaattggtgaattcccgcattgactgatgatggatggatatccactttgccaacatctttggtgtaaaacgctgtcctcttgcctcgtcttttgcactgaacgacatttgggtaaagcccagcacataggacagcacataccatctccagatcctttccataataattatatgcctgaaattatatcatggaagtaagaacccatactgcaaacttatgttctggaacacgaaagtagatatgattcaagtgtgttgaaatggggaaaagagataattataagatcgtttaggaggccccaaaatcctggcccatcttcgtggattgtccataattttgggctctccaaacaggccccatatgtgcccgtacagttaaacactaaattttacagaccatggttattaagtagcaatcaaatgacagtaactattggacaagtgcaaaagtgaatgcataaacaccacaaatagtgaaactaatgcagtcttgtgaggaaataaagacctcagcttagatgaatgctatagtgctatttattagcacggtagcaaacacaatcagaagttgaaggaagctatataattaattttgaaaatttagattgcactacatgtttgaattaaaatgtaatgtggaaagatagtcaaccttcaatcctcttgttttgctaacaaacccaatgtcagatagtagatcaaaaaactgattacgcatgtcatccatcatctgcagggtcatgggtgaaaggaaattttcccagcagaaagagcgttctcttccactgcgtcttgcttccttccatgcttcgaacgccttaacaagagcaatgtgatcactggaaaaataagttacaaaaaattatcaacataacattactttcaaaactaaagtacttgtagaaatgttataattgtcaaagtaagttatcagcggtaacctagtacgcaacccagcattctacatcaatttggtacttatgtctgaggtaataacagtataacactcacattctttgcattatatggtgacaaagatattttagtacaggtaagacaaaaggaatcaatacggaacagagaaaagattatattaattacctgcaggagtcaccagcaaatgatcttttgacagcatcagcttcttctttcctatctattgggagcacaaatggattacgatatgcaagagcagcagcgattgttaatgcaggatccagacactgaaaaacagatccaataagcagcatttttccaatgtttggatctagcggaagtgtacaaagatgtcgccctgcatacacagaagaagacacacagagtaaataaaaacagttagaatagaatcaagaaagagatccacaatacaag

SEQ ID NO: 61438 - DNA, 9262 bp, Oryza sativa
actacttctcgttcactggtatattgagtcagtatttcagatgggaagttgtgtgccctgataaaattctgaaggtgcagtgccatgtggaccatcagaaagtagattatggcattcttgcgaatcactttgtgcgcataggatcaactttatacattatcccttcatctccaagcaaaaagatgggcacaattgagagcaggtgctattagccagctctaaacatattttaatgagataaacgatgagagagaagagaagcggactgcagatctgtagccagctgcaacacggactccaagacacaccgtgtgtatgacaggtgggaccatatattaatagtatagcaagcaactattgtataaattgactatttaattggctatagatgaattggagctagtagtgggctgtactattagacttgctctgatgatcaggctattacggtctgctttgttcgaacagaacgatctcctgtatctttcagttgatttcgtagttgaccatggtagcattgttggtctaggtgacactctgaagcatgtgtttatcctgcaaatggcgaaatggcaacacatggagacaatcctcgagttcatctctagatcgaactaggagcatcattgtttctgggttcgttagcctaggtgatacttctttcacagtgaccgatgccaagaccagtgacttcttctttccttgacttaatggatcaagaatggcgtgtcatcgggccacgagtaccctaaagcatctccaacagcctctccaattttgactctccaaatgtctatttggccaactctcaatctaatttggcaagtcaaactctttactccaacagcctctccatctatcatctccattacaagtcaatgataaatgaaacccatatgtcagcctcatcataccttcttccatctttttttccccacccatggccatactacatctcccttggcatgctgtttgggagatgtatattcattggaggatacatctacacaccatgggaaggtgaccttgctacattcaaatcagaggcacccccaatggcatgagagcacttccgaaattgtatcctgtctattcccgtctgaactctgaagttgctatgtaatgaagaaacggtgatgatacatattactgtagcactttagacatgtttaatgaaaaatttatttactctttatgtaaagaacagtaatacggacaatattcacagcttcacataatcacactagcagcaccatcatttctcttatgcctatacttaagctaaaatgtgaattttaaaacttcattttagagttgattttgtgttttttttttcaatatagtttattttacagcatttgctttcaaatcgataaggacacgtcccacaaactattttttaagttgttaataaatggttcgcataaacgtaagtataaacaaaacgatggaatcgtaaatatcgagaaaattgcatatctatcatcgtataagatgggattagctcaaataccattactcaaatgggcttcactgaaaaaacaatcctcaaccaagatatctttgctcaaataccatcccaggcgaaaatgccccttagcacttcttcttcctccctccctccttcgttgaataggttgacggtatagatggccataaggcccgcccggcacggcctagcccaggcactggctaggcacttcatgcccacgggctacacctcaggcccaggcacggcccaccagtagtcgggccgtttcgtgccggcctgagccctgaagacacgtgtggcccatcgtgccttctttaaaataagtttatttcccctccatcctttttgggttgtgacatatatatagctaaaataagtctattttacgtcccaactctttaggccatgccatataatatgtctattattcctccctattctttgtgccgtaccacacatagggttgaaataagtctgttttgcatccctgaacttcgtgccggcctagcgtgccgaggtagcagcccgggcacgacactgctgttgggccggccgggccaaatcactgggccttgggccatatggtcatctaccgtcgagggcaacgagtcagggtggggcggcaacgcgcgacggcggccagcgagtcggggcggggctaaagtgtgtgacaatgtccgagactacacgagcgacgacggtgaggcagtggagccggtggtggtcgccggtgaactattcagccactggagggagggagagaggaagaagaaaacctaaggggaatttccatccaggaaggtatttgagcaaaaacattttggttgaggatggtattctagcgtagcccatttaagtaatagtatttgagtgaatcccatcttatgcgatggtagatatgcaattttctcgtaaatatctaattagatgacaatgacagagatgcactattatagtcgtcgttgcgccaaaagcaactaactgatactacatccatcccaaaatatagtaacctagtacttcctccgttttacaatgtaagtcattctagcatttcccacattcataatctagatagatatatatgtctagattcattaacatcaatatgaatatgagaaatgctagaatgacttacattatgaaacggagggagtacattacatgatgggacatataggaataagttcacctgccgtccctcaactttacacagagtttttttgacatcccttatccacatactagaaatcttcacccctaaactatacaaaaccgtctaatttagatcccatggcagcattgatgcctagtttcgctgacgtggcatcctagtcagcacaaataaaataaaatgtggggcccacatgtcagtgagagaaaatgatgtgggccccacatctcctctttcttttcattttctcttctcttctctcgagcaagcgtggcgacagatgggggagaggcggtcagcggcggagcaggggcggtggccggcagagcgggcgcgacgggggcagagctggcccagcgggcgggcgagcgcacggagaagaagctaggcggcggccggcggagcgggctgtcgtaggctctccggaccttccattataattgagagatgaagtgaataattcaagtcatcaaacaagcataatgaaatatccgacgcctcgagagaggaatattggagatattgctaggcctttagcttgccagtcaacttcagcctgagatgtgcccgtcaaaccactcgaaggcggcgaccagatgtgttacacattcaggagacttgacaaaaatggctaaagttctacaacatctcaaatatttctaactcatactcatgtgaatctagttcccaggatgtgcactagattcacactttcatctcaagcatgattatacatagcaaacacaaataagatgaaagcatctactttagttacattggccgaccggccaaataaataatagaacagcggaagcttgtctacccaatccacaagcacaccgactaggggtttacccattatgttcaagtcctagaagaagcagtcgataacccgcatcactcaaagactaagtctaaatcctgcaagcaaaagttaattcaacagcaagagtcagtacattattagaaataatgtactggcaagcaccaagacaagcctaacaccctacttgcaaggtatataatcaaggaaggcatagtatggttctttttagcataaagcaagttttatttgcataaaacacattcaaaacggatttgctttcaaataaaatttcagcaagctagtacttagcatatgggcatcaaagtaggcattaatcatgtataaatattcacctcattgccatccatggcagcaaggagatcattctcaaatctcatcacaatttgaaggtaaatttcagcatttaggagaataaacacaagtctatactcaatacatatccacacgccgctcatgaccgcgagcacggctaatcgattagttttaactctgcagagtttgtacactttacccacatgatgcgaaataataatcatgcaagagcatggcacgcgatacataagtacccgatttattacccgcaacaaagcttttccaaaattcatgatttagccttacaccagcacgatacgtgttcctccatcctagtcatactggaaatatgacctagaaccgttaagtggcgggcccacgccttgaacttaacgccgtggtggcggacacaacgggaacccacccacgtggcacaataccgttgtattggacagacttagtcacctaaactaccacgtcggggtaaataggaagttcctctgagttatccgaactcatacacaccggcctaccagaatgtaaggctaaaccataaataatttactaagcttgggctatcccatactagcacatgtggttgtactgtatacgaaatgaactgatattgagtgaagtccttaggtcggtttgggcgcactctccccctatcggtacacaactaatcaccatatgtgcaccacttgaggcccaaacctaaaatccatgttttccaccattttatttatcaaaatcacaagtattaaagttttgtccagattaattaaaaatcaattttcatgtttgaaatgagcccataatgacaaggaagaccattctaagcatggctaagctttatagtaacctagtgtcaccaaaactcatatataaagtggtatagccatattgttcctaaggttaggaatgaggaatatggatatatgtggagttaaggtgataatgcaaataataggagtttatctaacaagtttaacaaaattttaatttattagtgtacaatcgacatgcaagatttgcaaacattttcaataacctccaaaagataggttcaaagtgatcaaagagagggaggtgggacttgccttgaatcaggaaaatgtcagcacctaaatcacttcttcaccgattaagcaatcatctatacaaagtatacgttatgcaattaaacaccgaaatatgcgaaaaatccaaaatgttctaaaatgcatgatttgtgcacagagatcaggtactggtataaaatgaatttaggtgaaagaatttctattttatctcattttatttgggagttatgaattttagaagtttcgtcggtatagtgtaggatttacttagttactattgtgaaatgctgttgtaaggtgattcttattaagtttatgttttctggggtgaagatatttgttttctaagactaacacatttggtttcataatttttagagttaatatgaattatttatgtattttacaagttttaacgtgttctaggcatatagtccctatgtgtacatggctttggagatttaggtccagaacttgctctaacttgctagtgttgtataaaatgagtattttagttaactaatctaatcttagtttataaaattttagtgttcaaattactttacttcacattttataagctaggggatgttctatgttagaaacttaagatatcaatctggagattattatatgagttaaggatactaagttttggtggaaggggatggatctatgccttcactggttcaacaagttttatttggatttatttggagctaccaagcatatatatactttttcatatgtattgtttaaccactactatgtgtttagtacctattctaccaaattaaggttcagagccatggtctgtaagagggtgctataattcactctactaggttgaagtatattacttactggttctatagaaaatttggttcacttcatttagactatagatgaattttctacaaatgttacaatttaaggtatgctccatgttgcttataacttacttaaatacttaggggttttcattatactgtaagtatgtctttttattttataacattgaagtgcacaaccctatgattctactgaatttgggtttactcaaaaaggatctaagatgaattttatataaacttctaaagttcagcttatgtaaaactagtcattttaaaggtaatagttttagaggcattcgatgtatagtatgtatactatttcattttgctttataggagaacataagttggtggatctgtagaaactgagtttgctccaaaatgagttgaaatgaattttgtatgcattttataaatttgtgcatgctttatgtgtgatttaacttggataaattttagaggctaaatttgtactgtgagtgcaagtttttattccataacactaaagttcacaatttggtgagttgacagaaatttgtatcatcttaaaatgagctatatttaattttatatggattttacaagttttaggtactttccttttataatttcagatttttgtttccaaggggtccactgtcagtgaaagatcaatatacaaaaagatccctgaggtttctaagaatcaacccgcagacctagcctcatatgtcagtgagttgaaaagttgcacattaatccttatagttgtttaaattctcgaaacaaggtccctgacttcttttctcatgcacagaggcagaacagccatggctgagctcgatctctagctcaccggcgacaaacgatggctcgtttgggggtgcaaccaaaatacaaaatgaagatcatgttattgcgattccattcctctacttttctcggtcagtggacatcggagtaacgccggcggcgagtccgaaaggaggatgttttcggggggtgatgcatgtgcttctacaatcatgtattggttaattgggtgcatacatgtatgttctacaggctgaaggatgctcaccgagatgctagacatggctggggtagctaggttgatgacggcggctcgtgtaacggctcggcggcggcaagaacctccgggtgaacggcgatggctcaatcagctccaagaactatcatgcatgtgtgtccatgaggttagagaggccccagagatgctactgatgcatggaattgggttggtactcaccggagggggtggattcggcaacggcgacggtgaccggaggtggagaagacggtggacgatctccacactcgtagcaccatccttcgagattcttgaggggaaatggagaggaggttgaggcgaagacgctggcgcgacagcttggcccggcttggtccagataagcgggaacggcgatgatgtcactgcggcggtgcacagagcgcgctctagagcgaccatgacatggcggcgttcccgctgctgtagaagatgaaatggaatgggatcaaaaccaaagttgttcgtcatggtgagatgagaatggaacgagtatgagttagagatgaagagggctcgacgacggttggcgatgtccctcttcttggcggccggcgacgaaagagaggtggagagggagagctggagcttcctccctcggttggatcggtactgggatggtgggtgaagaatggtgacgcagatgggtggaggtgaagcctcggttcggcgctgccacgtcgaggccacgcgtcgtacacagccggcgccaatctctctctctcggctgtctctggtcggctgcaagatttgcacagggtgaggacgagccagagtggctgccaagtgggtccaggtcgtggcaaactaagctagggtgagagggttgggcagaaacgtgggtgaacaaaaggtttgaatgattttaaggattatttctctctcccactttagtatttcaattatttaatttgtgggtagaataatttagtgtggatttttctgaaggtagatgaagatacctagattccattttctttggttgcactcaaaaattatggatagattactcacagaaattagaggaatatgggttctttggaaactagttcgaatttttaggagacctaaacagagaagataaattctggaaaaattatttttattcatgataaattacctagcatttgaataaattattttacttatacacttttatgcagttaaattcacttttagacaaagtatggttttagccgattaagaactacagttaatctagtttttattagtttgactgatttatttgaggtaccaaatttagttattaaattataccaaaattacagtgagttgtatgtgttgattagagcctacatgaattttcccatgattttatcttgctcgcaggacttatgtcttatatgtgtttccctttcctaaatgcatgtaaatgtttataaaagttatatttggactctcattaacatgaggtgatgttgatatgttagaattacagtttaccttacacatgtcataagctccttccctatttatgcataagtttactttagtattaaattaagagaatgcttatagagatgattaagatagaatataccctatatgatataatttatttgttcactttcatgttcatgacatgtcttcagatggatgtccaaattagttttgtgaggcttgacattagccatgttgatttttttttaaggtgtatggtttctgtgtattattttccattagttagcactaggccctaatggtttagttgtttgtctagattgcaattatattcatgagacctattatgaaatgcaaatcgaaaatccaaatgcatatgaaggactcaagtcaaaatatgatttatgcaagtatgcatgctttcacttgggttgcatccaagtcctaggttaaagatgaaaaagtttttaatttgttctcaaattttattcatgcaagagttggatcaactccacctaggtttaaaatggaaatttttggtttacaaaattgaagaacttccctttcaactagttttgatggaaattccttaatcctagaattcaggtatgttacacgggcgcggcgggcaggcaagcgcgcgggaaagaagctacgcggcgggtggcggcaggcaaagcgggcatggtggcaagcggagttggcgcggcgagcgggcgagcgcgtggggaagaatctatgcggggggcggaggccggctcccctcgtgacttcgtgggcgtccataccttcgccgccgatgtcccttcaccatcgccgatgttgtgctcgtcttgcatggagatcccctcgcgacttcgcggcggcgggcaagtacggtgggcgagcatgccggcgggcagagcaaccccgtcctcatcgtgctcctccccttcgtcggaagcgagagcagcagcgaggcatcaggcggaaaacgagcacggttgcgggctcgctgagatgaaggcggc

SEQ ID NO: 61439 - DNA, 29709 bp, Oryza sativa
agttttgctgactaggatgccacatcaacaaatccacccatatatactgccataggaccttgagtgcacggtttgtgtgagttcagaggtatacatttctgattttgtggttaagggacctcaaaaaatatggctgttaagttgagggacctctggtgaacttattccggacatatatgtccagatccatagtactataatatgtcacatcccgtactagtttgctatattttgtgatggatgatgtatttgagagatagatcatatcggccgatgatgtatgaacgccgatgggcaccatagtcccttttatggacgaagctagtagctgatactctccttttagattatttatcattctaggattggacttaagtcaagtatttccacgcctatatataacgtgtttatatgactaggtcccaccctaactcagctggattgactgcagtcaactcgccacctgagctgaaaccaggcacaatactatcctggatctcgggtacttcgctattgtaaattgatgaacacgttatattagtattacagttcaaaaattaaagtacgcgattcaaacacgacatcaaggcaagaaatctaaagtaaccttatttcataacaaaatttggcccaattactcgcttggggcaataagctagaccaacaaactaggaagaagaaaatcagacaacagtattgcaaacagcttccaccacctcttatgctgtagcatgcttgtaaagtaaagacaaatctagggttgatccagccttcatgctctattaggatacaaatctacatgctccgctaagatatgttggttactttcatgtccgatcgcttaaacgttgtttttttttaccaaggcgccgaaggagcttcagaaaacatactaaatacaatgcaatcagagacctcatttgtgccaatcaaacaatacaagtgaactcttcatctaaataaatccttatccataaccaaaaatcatcttctttcatgatccaaagaagatgggcttaccaaggtagtgaagtattcatcatcctcgactaactcaaaaccttctcatagtgtgtaaatgaattccctaacgtagaaaaatctcccaaataacatgtcacaaaggtatggtaggtgtggcttaacaagggttaattagatttatgccattacaaatttcacgattaaaatataccatcactattcacatatttgtaaccatgcaatcacaatttcacagttatttgatacataccactacttaccctttcatcttatttttcaaaagttttagaccaaaatgcccatgtcttcttccttcatcccctcctctctctcctgttcatctcatctgttcagatctagcctagccttaaccgatgcgcatccttgccggcggcggagatagtttgggcggcgccctcaccgacgttaaggaccaccacagcaacgagcgccttcaacgcatgttctagcaggagttcgacacgcatgttgtggaagaatatacgctcttttgtttttttcatttttattcataacgttcttggttttcttcatcatcaattgagaaggttacgcaaaaaaaaaagagatacaaaattcatgtgtgcgcacgtgatgaataatttatgctatgtcattgttacatgcatgtttcggtaaaacatacaacaaataaattctcttttatttgaaagaactagtcggtcgggatattatttcagcttaagaaacacaacgttgtccctcaaattgtcgcacaagcaggatgaccgttgcttgtgctatctcggggtcagatctgagacaaggaagaatatgaacaggagagagaggagaaaaggtgatgagggaagaagaagggcaatttgatccaaaaattaaaaaaaaaatagatgaaagggtaagtagtggcatgtatcaactaactatgaaattgtgatggcatggatataaatatgtaaatagtaatggtatatttcaaaaccatgaaagttgcaatggcacgggtttaaatattacattcactagttgtaagttaagcatggaacagtcacatgtctcagcatctgccactaagaaagtttgtctcaacatctgccactatgaaagttcgttgttaaggacagtccatctataaactttaatttttcgaatttatgtatctaaacatttacaattcttcttattcttaatccatacatacggcagggtatgacctatacgaacaataagacgaccaatcaagaaaaccatagttaaaaactaattttttaacttttaatttgttgggttggacgacaagttcggttatataatgctgaattataaaattaaaattctaccattgaacattctaataggaaatgatgacaatgtcattaataaaagtgagcaaattcaatcatttttatatttgcttttcaatgagatatatcctaaatggcaatatcctaacattgcggagttcatcactctgatgcgcaagacacaacgtaagctcaaatgttatatatatttaataaatcacttttaaaatttaagaatgagagcctatgcatcgttggaaattctaccattaaacattcaaaggaaatgatgacaaggttgttcatagtagtgagcaaatgtaattatttttatatttgcttttcaatgagatgtatcctaaatggcaagatcctaaccttgcggagtttatcactctaatgcgcaagatataacataagttcaaatgttatatatatttaataaataactttttaatatttgagaatgagaccctatccgtcattgaaaggggtggtggcagtgaatgtctttcttttgaagtggtaaaagtttacatatacatatatcaatagctaaacgttttatatgtattgcaggattgatcagttgctttcatttctcttatcgcctctaaatatatatcttatagaaaattataactcaaacatatagaaaaggcatctaaaggatattattttttctagataatatagttcattgcatgttgcgtttttttgttacaactatataggatatatagttctagttgatgcggcttaatatatgttgagttttatagtaatgactatattaagtgcgttataaatgcaaatgacatatcaatgattatgatcaaaacataagaaagatctaaatattattattttctatattatgactcactgcatattgagctttcgattataactatataaataggatatatcgataatactcacaatagcacatcatatcttcaaagcaggttgtggagaacaatcctatttatatttctataaaagtgtacggatgtgtgccaagtggaaaatatccaaatcccccctcccccctccttaaaaaatctactttagagtttttaatgctcatgagttatatccctatttagatacttttttatcctggtaaagggatttcttctaggacctctttaaggaatacctaccttttttccttcaccatgtctagaatcatcctagagaaataatattgacaattcaacatatctctgaacctttcctcttgcttgccttactttgagactttgagtagtctgcatgctctggactattgaatagatcaatgtggaaagtggcgagacggggaagcggcggcggtgtggatacggggtcctgcggcggcggtgaggtggggaggtggcggcgaggtggatctggcgtcccacgcggagctgccatcgcgtggcagcctctgcaccagcgcagcagctgaggacagccagtggcggccatgagcagaggtggaccctcgtcgtcgtctgctcgtggtgtatggctcatggcagcaggtttgaggaggacggttggccatctcctttgatgctggccaggcaaccccctctctgtggacatccttccctcctcagtggggagctccataggtggatggaggtagtggcttgacgacatgggatggcttaggtcaccgaagcggcgtggcccaactccgggctctccttggccggattcgacaaggaggctggtgggtagcagagtggaggagacctaagacaacacatagggaagttggtggcggggtagagaatgctggcggcgggcagggacgtctcccttgatgtcggtcgggtgtcgtctcgacttgtggagcatctcccgttctctatgggatgttctataggtaggtgggggtaacggtatgtcaataggggaaggcttgggctgccgaagctacatcgtccattaccgggctttttgccggattcggagctgaggtcggtggatggcagagcgaaggaagctagctcagcgttgcgggggagtgacaactggtaaaaggcgctggcggtgaggcgaagtggccagtcttgatgtcggtcggcggtgaggagccggaccggtacggcggaggacacacgctaccgaataccaatgttgggctggtggtattagatctggcaggcgacagaccacagaaacggggtgaagaggatcccaggcgaaagcctagcctagcgcttgattgggctggcagtagctacgcctttggacgcggtaaccctcttgagggtgttgccgaggtaccctccttcctcgacgggggtctctaggtgaaaaccgtgtccaatttctttggacggatgatgactgcgtcttttggcatcgcaaccttcatgggggcgttgtttttttggactatcattctatggtgttgctgtaagcctggcggcgaccggcatgcatagcggtggtcggtccgtcgttcggccctcctctctatagcttgtgtttgtgcggttggcgtgtggtgtcggggcgtgtgctttggtgcactttctttctcgagagctagctgttgatgaaaaactttgttgagactttttttcttctatctttataacatttggatgacttccttcactcaccccgacaaaaaaaacatggatatgtatatcctatagaatttctggcttcaggttttttttaacgaatttcaggcttcagccgtgctccaagtcatcgtatgaagtatgaaacttcagccatcatttaacagttaacatttttgtgccaaatattaactatatctctatctctactattataaaaattaaagatgtttttgccataattttgatacgttatctgtatttgaatcggttttaattttgtgtttcgactttaatctatatatagaaaaaaaataagtccgactcaaaaaaggttaaaaaaaagaaaggaaaaacgtccaaattaacgagcgataaaaaaaagcttccatctatctattatattatattattaaaacagccttgaaaggaggcaccacgttcgctgtgggggctagaaattcccacattaatcgaagaaaaagagaaaaatctacaccgttagatcgtagtggatctaaattataacggtatagattgatagctatatatatgtagtacaattgtagtttttaaattataataagttgtggatgaaatatagcaatctactactcatatttggaatcaggcatattagaatcggctttttttctttgatgaaaccgttaaggagtaggattaggattgcagccgcacgaattttttcttttctttaatgaaaccgttacggggtagaattgcagctgcccaggagccaagtgccgaccggcccttcatactctgtctggctgcacggctcttgtgcttagaattctagatttactgtgaaaagcataggctcatggtaaactgacacacgaaccccatatgagattaattaattttcagaaaaaaataaaatctgaaattagcaaaaaaaggaaaagaagagtttgagtagaaatacaatttaaaaataactaaaattcgaaattaaaattatgcaatattggaagaagagtctatataaaaacccaatacgaaaatattaaaattcagaataaaacaatagaaattataaaaaaaagaaaagaagagttcaagtaggaatacaatttaaaattaactgaaattcggaattaaatataagcaatattgaaataagagtacatataagaacccaataatactaattaagattcggaatgaaaaatagaataaaatccaaaattggacaaattaaaaagagagttcaagcaggaatacaatacgatattagttaaatttcgaaataaaaaataaaataaactctgaaattataaaaattaaaataagatttaaactaggatacaatttataaataattaaaattggtgataaaaaaataaagaccatctaaaacacatgacgggattaattgagtaacaggcctataaaatagtagagcggtggcggttgatgggatatctaaaatctattaataaaacactaaatagaatgataacgggcatgtcatgaagcaaccggtacaggcggttggtgggacttcggaaagtaaaaaaaaacaatgataaccatatttgatttttaaaatctcaatgataataaaaaggagaggcggcgggagggtcgtacaggagtacaatggcagagcggacgatggttggtgggacttctagaaagtaaaaaaatgaattccaacgataattatgttcgatttttagaatcccaatggtaataaagagtaggcagcggacgggtcgtagaggagtatagtggcagcgtttgacgagatttctaaaaattataaaaaatggaatccaacgagacaataaattataaaaactataaggtccaaatttaaaaggttcgggcttctgaaaagtaaaaaaaataatgataaaatctcagtgagagtaaagaagggaggcagcgggcgagccgtattggagtacagtgacaaagtcgctgacgttttggtggaacttccaaaaagtaaaaaaaaagaacctaaacgataattatgtttgatttttaaaataccaatgacaataaagagaagaggtagtggatgggccgtagaggagtataatggcaacgtttgatgggacttttacaaattataaaaacgaaacccggcgggacaataaactctaaaaactatatgatccaatttttaaatgttccaagaagaattaatagaaacagtggtagatcgaggaagcaaataaagaaagatatgacataattaaggggtatcaactggcgtgtgacttttaaaaactataaaattaaaaacacaatgatgataaggtttggtccaacgagataattatttaataaattttaagtaaaattatattaaaaatatataattttgtatgggtgctagccgcgcaattgcgcgggtcacccagctagttgtcagtaaaaaaaagaaaaaaacatctcgtcgtaaaaaaaatagtccgactccagtagagaaagggaaaaaaatctcccagtaaaataaacaaaaaaaagtcggtttggtttttttgcaccggtattttttccccttttttctttgcacgcaaaagagttttttatgcgcacacggtaagtcttttggttttttgtccggctttttttaatccgatctgttcatcgcgtgcctctcgggcacttttggttttttttcgtcaatcttttttgtcgctggttttttctcctgtgcactttttgtttttctcatccggttttttaatcccatctgtttgccgcacgcctccctaggtgaaccctagcgccgcgccgccgccatatcgatcatgcattttctcctccaatttgattacaaaatcgattccccactcctctctcatcatttctccatgattttccctttgattcagtgccagatttaatctctgttttaccgttgccgatgatgacggcaatcttccccggtcatttttatcccgagttttacgctctgatcttggggaagacagaaagagtagatcgagtggatcaaaaaccctcgaccaatttgactggtcgagaaagattctgccagatttgatggggatatttgctctggctaccgtacgggcacgggattatcttcgggaggttgaagatggtaatcatcttcccagacacgggactatctttgggaggttgaagatggtaatcatatttgggaggtgaaagatggtagtcatattcgggatgttgaagatggtagtcggctgtgtgagttgggtttacggctctacttatggctgggtcgaagagaagcagaccaaatggagagaggtagcggactagcctagggctgaaaaggaaggaaggctttcggacgaaaatccaggaaatattttcattaacttttttaattataatctacagcgatcccaatattaagatttttattaactttttcaattatagtgtatgttgatcataatatttcaatttattgctcagctcttaatatatcactgaaaaaacgtctttacccattgcaacgcacgggtattttttttattttttctagtcaattattatgtctactactcttggtaaataatccctatctaccttctattgtgttgctaagccacctataacattttggttgctaaacaacttctactacgggaggtttgggcctaggcccgttttccctttttttggtgggggcacttctttttcttgacaggcaatgtggaccttatggaccaaatgggtgttgcgttttttttaaaaaaaaaaacttgctttctaattcatcccaaattcatatgcataaaagcttcaaacaaatatatagttcatgggtaattttatcatctttgagaaagtactgaaaggtatcacattttctaatgtaaaatttggtacatctagatacaaaatatcttgatgcaccaaaaattttaatataaaatttaggtacctcgaggtatttttctcaagtactataaaattgctatgtttctatatcaatttttttatacggtaagtttctaggtagatagttcacgtagaaagtttctatgcctaggtgggtttgtctttcttttcttttattgaacttgccttttgaacttattttaaattaacgttcataaaattctctactgcggatatttctatgtagaaacttttgagtcaataagaaggaacacatcccgaagtggaaaaaaggaccttaaggccctggtcgattaatcccaaaggaaaagggatgagagaggatttattccacatatattatgatgtggaattattctcatttaatctcctccaaacaagatctagggactaaactttaattcatgtcacatcagatgtttgaacattaatttagactattaaacatagactatttacaaaactaattgcataaataagagcttatctacgaaacaaattttttaagcctaattaatccataataagggaatgcctactggcatcacatagactaatcatggattaattagattcaatatattcgtctcgtgaattagtccaaggttatggaataggttttgtcattattctacgtttaatatttctaattagtgtccaaacatccgatgtgacaggaaaaaaaaaatttttagccccatcaaaactcgcccaagagaaaacgaacgtggactcgatgcacgtgtggagtgaacctgtcggaatgcgtttttgcgtggactgaaaacgcacccacgctcacccgcaccattagacgcgcacccccaacaattcacatcatggctcgcttgtccatgcccatacacgttgaaagccaccagctcgtccaccgtggcaatatcctctaaaattgctcaacgtgaacttgccacaggtgaggtgagcatgcgcgcgccacggccgcggcggtggccggccgacggcgacacgttgtgctagatgaggtggtgcatgacatccacggcttcaacagttcaacttccggagttgaactgtgcaaaaaatccgactcaggaatgcaggattgtccaagcacacacaaacaatctccaaaaatccaaatgaatcggtcgcatttcaactaattaaggctgcgtctagttggatccaaagtttggattttgattaaaattggagatgacgtgactgaaaagttatgtgtgtatggcaggttgatgtgatggaaaatgactgaagtttagatccaaacacagcctaaactgttttgacttgaattttcgacgagtgtcctgcatgcacatgcgtgaacacctcagttggagttgggtcactccgattgaaccagcaattggggccaagtggccaacgttgattgcatcagtgggcacacgatgacttcgttgcttctactgtgcagcgagtgatatatatgcgcgtgatatatatgcgcgcgtgcggctgacttccttgcttctactgtgcagcgagtgaattagagcagctagaatagtagactatataagagcaggtacaatagcaggctataagccagctgcaaacatattttaagtagataaatgatgagagagaagggcagctggctacagatttgtagccagctgcagcacggattccaagacgcagtgtgtatgacaggtgggaccaactattaatagtgtagtatgtaactattgtatgaatgagctattagattggctacagataaattggagctagtagttggctatactattgaacttgctctaagccaactataaacacatatcgaggagagatgaaagaaaagaagaaaaacagcagctataagcacggactacaagaaataatgtgtgtatgacaggtgagaccatgtattaatagtgtagtatacgtttatggataactattgtacagattgctaattaagtcgactatagttgatttgaagctagtaattggctatactattaaacttgctcttaagctgcagctgagctttgtcactgtcgcgcatcttagccgcacgccggaattccaaacgagttgcagccacgcgcgtgcgacaatacattgcgatctcgtcgtcgccattgtcgatcgatcagccagagaggtggccgatagttggctgtgaaacagtgaaagttgcagcaattctggaagctagctgctgcagagagtcaatcggagagaagacgacagaatagtcgacggttgagaagaacgttcagaaaagttgcttccatctatcttttcctgcgaagaaatgaaaatctgatgtggaaattagttagcagctataatatcgtcacgtgcacatgagtggccagagtccatcgtttgtcctatatgaagtcaaccgttgtcaaattttgaatttcaaattttatttcgaagttaattaacttggtgtcctttttaccgttggtttttaatcactggaaatatatactccctccatttttgtaaagaaaatcattttggacagcgacacgatctccaaaatgcaactttgactccttctttctataaaaatattattgaaaagtgatatatgtatacttttatgaaaatatttttcaatacaaatctattcatataatttttacattttcaaactcaacaacttaagagttattcataatttatattcccaatgtttgacttaaacactgtcctaaacaatttcctttacgagtacggagggagtatattgtaaaagttttaactacaatttttttattgctaataaattgtttttgtttataatctcatcttatagccaacaaatgaggcccgaggatataagctgtcagctgtcatcacgatcttttctcttatatatgttgttaactgccgataagattgactcgtcacaccatggtgcatggtgatctacaggaaagaagttatcagggaaaacttgattgtcattttgtcagagttccagtcaaactcaaagctacgagcattctgccatttcgagtcttggaaaggcacaggttagtgtatctactcgcattttggaaagtggcaagaaaaatatttcaaagatctagaagagagttactccgtaccttcaaaagatgatctagaaacgagccagtgatcagtgttggaagaaagaaaaatgacatactataataatcttataattgaaaaagaaactcgaatgatgttcaatactaataaactaatgatatttttaatcaataaaacaacgaaatactattaacattattcactttaaaaaataatcaaaaacaaattccatccggttattgttttaccgatagtacgtgtgaacattttgttttctttttagaaaatagattaaaccggcctctattcaaaatagatatacacaacgaacgtgcgaacaatttagcgaatattcagtagtccttcagagagaattgtcagaggtacgaactgcttaatggtgatcgaatcgacaaataatggattaaagacaatcaataaagcgcgccattccctaaaaaagaaaagacgagaactagcatgtaagagcatgcccaacagctacccaagaaccctccagcgcgcgtgagacaaaaaccagatgattgggaatgaaatatcgcttcttggaagtggggatcgatatatacggagaagggaacgagatattttgggagcagtcatagtgaatctgttggattcaatttttgaccaaaaatcctaaaatttcaggatagggaatgaaaaagggaagctattggtaatgctctaagtacgttcaaatcagctatattaattcatatgatgtacaagggatatatactcaccaataacattttccacacgatatgtagtctagttaattattattaactctgtctcaaaatataagagatttggtccgtataattagttaagagatgaggttgtattttacagatagtacgcgtgaacattttgggagaaaatgttattattctaccgagagtacgtgtgaacattttttgggacaatttagtttcagagagaattttcataggtacgagttgtttgatggtgattgactcgatgaataatcgattaaagacaagaactagcagataagtacgtagcacaaatcagcgtacgcataaggtgttgtttcttatacacttgcacagctcgaatataaacgattaaatccatacatcttagcactctaattaattgctgatacgatgttccaaaaaagaaaaagaaattgcagatatgattatgtgtagctttcgtcgttgaataatcaacacaaactagtccaaaggcaatcttacgtacgtcacaggggttcatggtcagtggtcagagaagactatgtagctttgactaatttactccaattatgctgctccttgttctctgttctcactttgcttacatcggcaaaatgctaacccacacgtaattaacaatttaacatgcttgctgtgtcaatcaaaattttactacttgtgaaagccgtacaattagtgtgtcattctcctgtatatattatggccattgatgggttaggttagaacagaaatagattatatacaaattaaacactgcatttgtgtttgttttccaggtaaccattaattttctagaaattaacgttgtaaaatttatgtttttaatcagccatgagaaatactttcatagcatccatatattgtgaaaaaatatgaatttatagatactgacagtcaaaattaaaaatgtttgacgaaatacaaaactaaaattacaagcaatttataaagcggagagtcctttttctttctataatagtatcaaatcttacagtataaaatgtagttttcacggatttatgtattcctacctaaaaacatgaatgagatgaggattattggtgaggagcagtcaatgcaccaaatcagccgccacatagttaagtattaccactaccagttgtagtgctatatgtagctttccagttgcctgattttactggagaactaaaatatttttagaggcagtcttggactccgacaggatgcttaatcatcgagatcaagacatgatggaccggtacacaatgttagaactaattaatcatgcatttcgtgttaaattagtgcacatgggtcgatcaggatcagtattagccgccgtagattagtacactctttacctaccgtcttggaagtatgtccctgctactccctcttggaagtacgtttttatgtcaatataaaaataacaacattcatactaccaaaatattttcagtgtcagttttaatgaaatgatttggtattgtagatattaccaaatttttctataaatttaatcaaacttaagaattttttactatgagaaaacatcaaatcgtcaagcgagtagaagactattagctgagtggacaggggaatcgaacctctggtatgtccgacatcccggatagaacaaaaaagactattagctcatttctgatactaagcactaatttatttccattttccttttctttttgttggtttatggtattccggttggatttggatcagattcttcatctagaaacagcagtgttgagagatttgacttggagagtcttggtcaaacttagtgcgttgcaaagtcttcatcctccctaccaatccaaggatggctgcacatctggactttcaaagcatttccgtacacacacataatgcaagatcccgatccacctaatgtaagaggacagtacgtaagaggatccggttccgttacaaacagggcgtgaattcaaccgagaattatcactgctataatcgattacattatggatctgtttagttggtgaaataaaaatattttagtgtcacattggatgtttgaccggatgttggaaggagttttcgaacacgaatgaaaaaactaatttcataactcgcctggaaaccgtgaaacgaatattttgagcataattaagccgtcattagcatatgtaggttactgtagcacttatggctaatcatggactaattaggctcaaaagattcgtctcgtgatttacatgcaaactgtacaattagtttttctttttatctatatttaatgctccatgcatgtgtcaaaagattcaatgtgatgtttttatgaaaagtttttagggaactaatcaaggcctatatttacaaattactacctccgtcccaaaataagtgtagccgtggatatccgtgcccaacgtttgatcgtccgtcttatttaaaaattttttgaaaaatttgaaaatatttagtcacacataaagtattattcatgttttatcatctaatagcaataaaaatactaatcataaaaaatttttaaataaaacaaatggtcaaacgttaaacgtgaatattataaaactgcacttattttgagacggagggagtacatgtcctgatggcaggatggcaacatatggacgacgagcaacatcacgtatcagcgtcgcgtgtcaccgcgggcagagcatatatgcttgtgatgcccatcgacggatgattgacagactcatcaagatggacacagaaaccagaaaaagaaaaattccccccgaatcgcctgaattttacaggaaaacagttcgtttcctttttaaaaatcgtgaaaaaggaatactagtgaaaaaggagaactgcatatggcgcacacaacacgagggaatacgcttctgcaggagagaatacgctttccagtccagctctcccatcatcacgctgaacaagctaccggccgccggccggcggttggtcaggcggtggccgccgtcagtctggtccggccaagtgtccatgattctgcaacgcgagaatgcaagccagctgtggcgtcgcctcgcgacagacagacaggccgaccggccggagaattattccctggcgcctgaagcctccaacgcattcggacgataatctgttcttattgtttgtcttatgcttatacttatgcatataaaccaaaattttaattttagaattttaattttaaatttgatttttgtttttcatcgtattttattttacaatgtttttttctcttaaatattcttttatttatttgttaataagcgattcggataagtatatgaataagcgaaacaatggagcttctagatggcgtgactggtcgtgcatgtcttcttcaaaagttgtacagtgttccatccgtcctaaaatatagttaattctaaaattcaaattttaccacaaatataacaatctaagataaacaaaaaatattttttcactaaactgcccacacaagcatactacctattggttttattatagtcttgatctacacctaacacctcaccatcccaaaaagacgaacaaatctctctatccgtctccttaatatatgtctaatgtcttcctttaaaattgctacattttaaaatgaaggtaataatacaacaacttgtaaatataaatttagataagtagttctctaaacatatagatgtagctatagaaatacttatattttgggatgaatggagtagcatataaactttgaattttgagagttgattttatgattcttttttcatcataggatattttctacttaattttcaattgataatgacacaaatataaacattttatccttatatcattttttatccgtttatgttgctatggctgggtcatagcaggcatgattgatttatattatagtatggattattattacagattatctacttaaatatagtgtcaattcaaaattataaaaaataaatttaaaaaataaatcaaaataaattatctaagcaatatcaagttcttttaaacatgaaacaaataattcaacttaataatatgtcgaataaactaaaaagaacatgaagttttggtcgctgataatggaaactattttaatcccgcgagctcgagggatgttctcattaattttaaaaatgtcgaaaaagttacgaaaatttctcaaaaagtttaacagcactcatacaacatatatattccaccctagaaaaatcttatgtccaaaatcgactcgcacatttagatataaaagaagacaaattcagtgtataaataatagtgtattattatttacgcgaagtgagtatagctcaactggttaggttccttgtggtggaaccaaaccacctaggttcaaatcctagatttcacacgggtgctcgcatttatggctaattattctttcagtggtaggcgacgtacccgtcgacagcgaggcgcttgtggtgacttcgtcaatctcaagatatgccggcctagtctttcagaggtgctcataggggtagggtgtgcgtgtgtgcgttcataggggtgagtgtgcgcacgttgtgagcgcttgtgtttgtactgtgtttcaaaaaaatagtgtattatttacacacgaatttgtatcttttttctcagtgtgttggtcgaatttgattttgattttttttaactgatagatgtcactatactctatttttctcgttattttttctaaatctttttagaactatttatattagattttaaaaaagatacacgataggacatcaactcggattggttatagaattccattcctcgctgacaggtcagccagagttgaggccatggccattgttgagcagcaggagaattttctgatggcttatttggtttagaggaatttgaactcataggaatggaaaaaagagagaaataggaagatatgcacatatcaatctatatgaatttttccaaaaggtttgagtcgatgaaaattcccctatgttatctttttacaacttggagggaaagaaattttattttgatttttctatacctcatccctacaaatctaatgacatttgtagaaattaattcttaggaatccaaattatttatttttcctttaaacccaataagccctgaatttgtacggagctgaactgagctcctgtgttccatcaatcgggtttatgctgtcgcaccggagtaccggacacgcacattcttcagatcaaagcctcctcaaactttccaagattcttcttgttttcccttaaaataaaaaacctttccaagattctcggtgacgaaagacggttcaatcttgataaagcttccgttcgaccatcacacacagcctaactgaaactgtaggtctgtagctaccgtcctgatgccctttcctttcctcgtatggtaagttttccacaagcttttcacgcattggattcataattccagtgtaatccggttttgttccgtgaaatccaaacttttcggaccaggtcgaaaacacgaatcactcggtttttttaggctaagttcaaaaaaaatcaaactagattttaaatctccaacggaatttttctgtattttatcggttttttcgacgggtttcgtaaaatccgatgatatcgctcgtgaacggatttcgatccggtatcaagaatgtgaacttcggcgtcatgatcggtccggcgttcagctcactggccaccgccgtcgacgcgactccatggccgcgccatgggcgatgatgctttcctcttctccctctctatttttaggctttggaaggcaaagtgtgtgcaaagttgaggttgatccgggcgtgacgtgcgtgccatggcatgaccaaaaaccacatccagtcacgtggctcaaaatgcacggttttttgcaggcagcatgtgagcgtgtctgccggcgctcttttgctgtgtccaaatcctaacgacacagccacccgcgctcgtgtgcaaacttagtttttgattcctccccaaagtttgttgccttagctacaataataaatatccagaaagcacgaattatgttctaccaataccattaccaatatctactacggatattggtaataacacccttgaatattaataagctacttttttcgtttcagattataagttgtttcgactttcatcaaagttaaattatttcaagtttgattaagtttatatttttaacccaaaacaaatatattataaaaatacattcaattattaatttaataaaattaattgttatgataaatattattatatttatctaccaactcagttaaactcgaaatagtttgattttgaccaaagtgaaaaacgacttacaatctaaaatagatggaatattagtcctttatgatttttctactaagtagctcggtggtctctactggtagagctgatcactgtactattttccaaaagtataatagtactccctccgtttcaaaatgtttgacaccattgactttttagtatgtgtttgaccattcgtcttattcaaaaaatttaagtaattatttattctttttatattatttgatttattgttaaatatactttcatgtacacatataattttacatatttaacaaatttttttaataagacgaacggtcaaatatgtgctaaaaagtcaacggtgtcaaatattttaaaacggagggagtattttttttagaagctagagtccaagcgtttaaggctctcgccgagcagtccatctcccacttgtgcggtgtgttgacgaaattcactgacaggggagcatggggtgtgtgcttatataaacacggacactcgatttagctaatagctagctggagctcgatcctgaagagcagtatcagtgctcagctcactgttcatcatcaccctcacctcttctctctccctcccttaccttcctccatagacgactgcagctagctcgatcggagatcgaggccatgtccatggcggcggagagggtggaggctgccggcggcggcgacgacgactacacgcaggacggcacggtggacctccatggcaacccggtgctccggtccaagcgcggtggctggaaggcatgcggcttcgtcgtcggtaaggattgaagacgatgaactctctctcgtgcatccggttggattcagcatatatgcatgcagtgatctaattaatcctttcagcttgattaatctgtcatgaacaattcatggcagggtttctcctttctttcatgggttggcatatggtttaattacttgcaaattgattgatattcttggttagaaactagacatatcgaggcttgtgtttgatttgtttatatgccacgagcgtttgaacattttcctcatctgctcacccctcaccgcatgcggcgggtgcaggatttgggagatttgttttgataggatcgatgattgtttgttattttgtccggccaatcgccatggttttcattagctgccattttgtactcctgccatagtctttggtactactatttttataatctccctacctcgtgtctcagacaaaatatcctccttggtattataacctctacggtatctctcaaggacgtaagagtagagtacttcgtcatgcctgataaccttttttcacgaatacgcaaaaggtttgtgtttctttgttccaagaaggtagagaccaccatgtgcaatactagttgttaactggtcgcttgatcgcatcgttttctgtgaagtcagagtcaacatatcacagtgtatctgctcaaagtctctcacatggatagtaacatgtgctacagtatttctgtacttgcgccactttcctgtagaaatggttcttcagtgattgtgtatacatgtactgtactgactaatcagtcagagcatacggttcaagtggtcaacgctgacaagaagcaggacaaaatcaaaaacactatagtacaaggttttccctacctccttttcttttttaagggcctattcggattggagaaatttcacgggatttttgaaggaactgaactgttgttacctgtgaaaatcttgtaaaatcgaaggagccctaagatttctcctacatcttctgaatttctgatagataacaatacaagtacatggtgtgccaatcactgaagactgaagatgatatgtatgggcagtgtgtagctagcacagtaggaaaatgtcaaaaagttcagtatgttcaggaccactgaatttatcctactaggaacaggcgtgcatgattttctgaatttctgatagatacaccagcggtggctatgaactgaagaagctggatagaaacttcactgttgcaatatgcagtgctaatttaatacagtactacttctaatcctcccaaactttggagtgatcttttcatagattaggaaaaggtgtagttaaccaacttgaacatggactgccgttttgtctgaagtgttggttcgattcagacccagctgaaaaacaatttaaggcaggagtgagttagtttggattcctacggttaattactagcagttgatccaataacagtttgcgtcatcagagatgcaatttagactgaatctgacagggaaaaagcctaagaaattgtttggtgatggctgccctgtcctgtctgcttggagcgacaaataggagttggaaattgacctttgtgttaatcaacggtttagggtagggacccagctgatccctactatatgattgcttggaaagaggcgttttgttccagcccggttggaatctgtatctcatcgcattatttgttcatgacaagaaagaatgattatgttagtggctgtcaccttccaatgatcacaacacttattagctcgttgtaaatgtgctatcttctctgtcatagaggattcttgttttactttgacaaataacaaaagaagtacatgttcattgaaactggtttgcatgaacaacttgtccaaactgcaaaatgttttttttctaaataaaagagaagagttaaaacataggatgctctgttgcatggttgtgtggtggttatggtttggttagaaatgcagagaccatgagtcctgtggctcatgagagagaatggtacctcggtaaaaaatggttggttgatctccatgcatatattttcccaaccatacataaatctggtccttaattagttaactaaggttgtgtttttccccttttccccccaacagcccaacttaccttcctcttttttcccacgcacgtttttcaaacggctaaacgatatattttttaaaaaagttttctataggaaagttgctttaaaaaaatcatattaacctatttttctaaaacaataactaatacttaattaattatacaccaataagtcattctgttctacgtgcacgagggattagtcccaacggccactgccaaacacagcctaagaattcatgtgttccaaacagaatgtactgttactactgtataccatgttttaaagtgaattattgttgtgctgataatgaaaaaaaatgcagtgtacgaggtgttcgagagaatggcgtactacgggatatcgtcgaacctggtgctgtacctgacgacgaagctgcaccaggggactgtgtcgtcggcgaacaacgtcaccaactgggttggcaccatctggatgaccccgatcctcggcgcctacatcgccgacgcgcaccttggccgctaccgcaccttcatgatcgcctccctcatctacctcatcgtaagtccctcacctactccatctccctccatctacagcagagcacgagaatcttggaacagatcaaatgaactataccctctgtgctaaaatataaacatttttagcatcgtggcaagtcatacatttctaactttgatgattattaatagcaaaaaattgatgattaatagcaaaaaaaatataaaaaatcaatcatgtaaaattgatcttaccattaaacaaactattataatatatgtaactatttttatttaaaacatcttacttttatatatattgttggtcaaatagcatctcggatactgtgacaggatctaaaattacttatattttttaggacgcggggagtagaaatcaaaagctagaaaataaattagaaaccagaacttaaaaaatctattggacttttagattttcaaaagttagttacccaccagctgcttggattgctctcgtgttgaaaaatgcagtccctgtctgaagactgtacgaccatctagctgctctagcccacaaaaatcaagatgggctttagctcgaagcccacaaagtccagtgaaaaaacaaattgcaagcccaaatccagcacgactaattcaaaccaaatctgtagatttttgttaccaaatttgatcgatagattccgaatttttgaacgtcgctcgtctcgtctcgtctcgtgcaggggatgagcctgctgacgctggcggtgtcggtgccgtcgctgaagccgcccaagtgcggcgccggcacggcggacccgggctgctcggagaaggcgtcgagcctccagctgggcgtcttcttcctcgcgctctacatcctcgccgtcggcaccggcggcaccaagcccaacatctccaccatcggcgccgaccagttcgacgaccaccacccgcgggagcgccgccataagctctccttcttcaactggtggatgttcagcatcttcttcggcaccctcttcgccaacaccgtcctcgtctacctccaggacaacgtcggctggaccgtcggctacgcgctccccaccctcggcctcgccgtctccatcgccatcttcaccgccggcacgccgttctaccgccacaagcccacctccggcagcagcttcgccaggatggccagggtcatcgtcgccgccatccgcaagctcgccgtcgcgctgcccgacgacgcgagggagctccacgagcttgatgatgagtactacgccaagaagaagaccacgccgctgccgtacacgccgtacctgaagatcctgagcaaggcggcggtgaagacgagcacgacgtcgaggtggtcgctgagcacggtgacgcaggtggaggagacgaagcagatactcaagatgctgcccgtgctggcggtcacgttcgtgccggcggcgatgatggcgcaggtgaacacgctgttcgtgaagcagggcacgacgctggaccgccgcgtcggcggcgggggcttcgagatcccgccggctagcctgcaggcgttcgtgaccatctcgatgttggtgtccgtcgtgctgtacgaccgcgtgttcatgccgctcatggcgcgggcgaccgggaacccgcggggcatcacgctgctgcagcggatgggcgtggggctcgtcatccacatcgccatcatggggatcgcctccgtgacggagcggcacaggctcgccgtggcgcgggagcacggcatcgcggacagcaagggcaccaccatcccgctcaccatcttcgtgctcctcccgcagttcgtgctcatgggcgtcgccgacgcgttcctggaggtggccaagatcgagttcttctacgaccaggcgcccgaggggatgaagagcctgggcacgtcgtacgccatgaccagcctcggcgtcggcaacttcctcagcagcctgctgctgtcgacggtggcgcacgtcacgcgccgccatggcggcggcggcgggtggatccagaacaacctcaacgcgtcgcggctcgaccactactacgccttcttcgccgtcctcaactgcgtcaacctcgtcttcttcttcctcgtctgccgcctctacgtctacaacgccgaggtgtcccgcgtcgtcgacgtcggcggcagaggcggcggcgaaggcggcgaggtgctcaggcccaaggaggtggccatggtggacacaaatctatagaaaatgtatcgatcgatgatcaaatataccatgaaattaatatcaccttcagaaatgctaacaacagcggcttcagcttattttcagaacagtgaacatatggatgcactctgaccagaaaaaaaaacgaaatttttgtgcaatttcaaggcgaattgtgcagatgtcgaacagagcatttgttcatggctccttattgcaacagaattgtcgaacacacaaggtttttcatggacatatatacaacagagaacgtctagaatataaccttcatcgttaattcattctaaactagcaaattacccatacaaaattccatgctttatatatatatatatatgaggcaaagctattgccctctttaaaaaaaacatacaaaatggaaccgctttgtcgtgttcttagcaggcaacagtttttctttctaacatgtgggaagcacgggacgaagaggaggaggacgactcttcttttattgtactcgctctgtttcatcatattataagtcgttaacgttgattttttttcctagtcaaatttaaagattaactaagattatagaaaaatataatagtattttcaacacaaaacaaatatactattaaaatatattcaatattagatttaataaaactaatataatattttagatgtagcaaaattttctataaacttggtcaaatttaataaagtttgaccaggaaaaaaatctaacgaattataatatgaaacgggatgagcagtagtagtagagataagagagaccaaacgtaagaaaggaacgagctttctcagaattttggttgtgactttgccagagttcaatcaatcgtaacgttaacagacaggacggcattattagatttcttgggtggttcaaagtaggtaaagattcatgcaaactcttgatctgcaaatcctctatttttatttcaggggatgatgaatggtgctaatacaaatcatacgcaactatatctattataaaaacatgactaaatctcctataccacataatacatggatttgttaacagattcgaaattgctaaacgccctgttgtcctcatttcagagtctcaacaatcgtattttcttgatttattaaatccaaaaattaaaatatactccctttataaaaaaaactaatctcaatgtccagattcaaatatagaattgagttttttttctttttcacagagggagtaacaaataaaaaaaatactgatatgtacatgttctctgtagtctcgattataacctaacaatgtcagtattgtaattatttagaacataatataatacacagattgatgtagtagtttgatttgaaaagaaccccaggatttggtttagagtttagacaggattttgatagagttcctagaattttttttatttttaattttttttattaaaagttttacaaaaataattttccattttgaaaattgacggaagtggtcgcctaccgccctctgggagggcgatttttaaaaatcgccatcccagagggcggcgaaaatgacgtggcagacggccgttcgctctcgggcgacggccgtcaacgaaatttgcaggcggcccccttgccgccctccgctagggcgattttgtactgtgcggggggccgcctgcaaatgggcggcgagggggcatggaattttgcaggcggcccccttgccgccctgggggagggcgattttttcctccccctataaagcccagtcccccctctctgaaatttcattatattcactaaaaatccaaaaaaaacgaaagagagagagaggggagggcagcagaaggggagtggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgatttcatcaggcacaatgtcaaataaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttcaacggtcgtggcccctcgttatatttgtgtcggtacaagagaaagatataaatgtttcaatgcaaaccgaagatgtagagggtcctatcaatgcaggggatgttgttggaccatcgatgcaaaatgaagaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgctcataaggatgagatgaaggaggcggtgaagcattgggtagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacaacagtgttgttggtaacattggctttgaaccaaaatcaattattaggcacatcgagaacaaattcaagtacaccataagctatgcaaaggcctagagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgatgcaaagagcctttttctcattgggtgcttgcataaatgcttttgtgcattgtcgacctgttctatgcatagatggaacttttatgacaggtaaataccgaggtcagatattgacagcaattgggtgtgatgggaacaaccaggttgtacctatggcttttgcatttgtagagagtgagaacactgaaagctggtactggttcctagagagagtgcacattgcagttgtgcgtatgaggcccaacgtttgccttatacatgatcgtcatgcgggtatgttgcggactattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcggatacttccattggttgctattgttgaattcatccttcacggcacgcaagcgtactttagggatcgatacaagaaaattggtctgtccatggccgataacaacatagtgtttggcaacgtagtgacaaagtacatggaagataaaatcaaaaaggcaaggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaaacaatctttcatacatggagtgaggagatatatgggttcgggatctcaggatcttacacaacgctgagtgcccaagttttttacattacagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctatcgaacatttattacttatgtgttagtaattcgcttatgaacatttattacttatgttgaactaattatttatatgtttctgatcaatctatttgatgcaggtatggcgtacgacacaccggcgctgttgaaccgtgggattgacaggaaccaccgctcgttcctgtcagcagtcgagggtgcacagctcggcaccttccatccacgcacgtcgcgcgagtggttgcgtgtcgacctccgtcacgttccttggtacgcgtatgttcacatttcaactcaactttgctttgtggtgtactcatgtttgaagtttgctctatacgggtgcgtgcggca

SEQ ID NO: 61440 - DNA, 4870 bp, Oryza sativa
aggcggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgctggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctgatgataactcggtccgacgctcccttgaggcgtacctgttgtggttgttcggttgggtgatgttcactagcacccacgggcacgttgtggacttccggctggtccactacgcacggtccatcgcggatgctcagccacaggacgtgccgcagtggagctggggttctgccgtgctagcagccacataccgtgccctctgtgaggcgtgcacgaagactgacgcgggagtgatcatcgctggctgccctatgttgcttcagctttgggcagccgagaagtttgccataggtcgaccagtggtggacagcgcaccctacggggttggtcgcagcgcgcagtggccagaggactgtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctgcgagagcaccgctaggactttcgtcgttgtgcacacgcgaccaggcttactggctcaccatcctgccgatggtgttcgacattttcgttgagcctcactgcccgcagcgtgtgatgagacagttcggacttaggcagttgtttccgggcaacgtgcagccgaccgtcctccctgccgaccactcgtgagttcggattgttcatttctaaatttttatgataattactacatcgagccatataatttacctctcttcacaggttgactcgacggggacagctagcaggcgcactttgggctccacgtgtacagcagtacgttgatgactgggtgttagctacagaggaggtgatcaacgagctcttcccacacacggaggagaactaccatgactaccttcgctggtaccttcctcgcactcgtgcgcgtgtgaccttcactccagacgccccagagccgcacgttgccgttgtgacggacgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggtacctgtttcgcacggtactgctcagcccagaggtttcttaagttttgtttctgtttatgtacgaaaacatcagcccgtcgtaacttgatgttccatcctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaacggcacgtttcctcatcgcaggacctcgtctgccttcgagcgcgttcgcaggcacgaccggcgcttccgcaagctccgcaggggcgttcgccacctcttcgggcgcgttcgccagctcttcctctcacggagcgtcgatccctcgcccacacggtactttactttttattaatactattaaatacctgtatgaaactgatggtccttgtccagcagaatttgcagccgggatcttcggtactggggcctcttcgtctcacgccggtaagactggtcctactagccagttctacgacgacgacttgcacggtgcacaccaccacgacgtactaggctcctctcagcttggaggagctccagaggcgcacactcaggagcagccagaggtcacacctgtacaggcaagacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtcttgtctacatagttcttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatcttattgagttcacatatattgcagtgaaaacgacgctatataattgacaatctgaaggcaacctcttcatatcttctttcccactagcacacaacacacaaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccataatggatgtacataggaggatgtaaggaaatgtcaattcgtacaatggattgacacagtcagagttacttcaagtggcgggctgataacgcaacctgaaccgaccatacagttcattcatgtttggatggagtacgaacgttgggtggaaattgcaagcttagactggaggaccaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacatagtcagaaacacaagtagagtatcaacgattgaaggaccacgagaatgcaatgcattctgaccgacctagaaggtgccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttataaaaaatataaagcacagtataaattcgccctc

SEQ ID NO: 61441 - DNA, 1753 bp, Oryza sativa
ccctccccgacgccgaaatcccccaaattccacccccgcctcctcctcctcctcgcgtcgcgagagaatccgaggcgcgcgagcgagaggaaggagagaaggtgagagcagcggcggagggaggagatggagtcggatcaggggaagctgttcatcggcggcatctcgtgggagaccaccgaggagaagctccgcgaccacttcgccgcctacggcgacgtctcccaggccgccgtcatgcgcgacaagctcaccggccgcccccgcggcttcggcttcgtcgtcttctccgacccttcctccgtcgacgccgccctcgtcgacccccacaccctcgacggccgcacggtatcccctctcaaaccctagcgaatattcgcgttggattccctcctctcaaggttcggttcggttcggtttcgtaggttgatgtgaagcgggcgctctcgcgggaggagcagcaggccgcgaaggcggcgaaccctagcgcgggggggaggcacgcctccggtgggggcggtggtgggggaggcgccggtggtggtggtggtggcggcggtggtgacgccggcggtgcgcggacgaagaagatcttcgtcggcgggctgccctccaacctgacggaggacgagttccggcagtacttccagacctacggggtcgtcaccgacgtcgtcgtcatgtacgaccagaacacgcagcggccgagggggttcgggttcatcaccttcgacgcggaggacgccgttgaccgcgtgctgcacaagaccttccatgacctgagcgggaagatggtggaggtgaagcgcgccctgcccagggaggccaaccctggctccggcagtggtggccgttccatgggaggcggcggtgggggttaccagagtaacaatgggccgaactccaattctgggggctatgatagcagaggtgacgctagcaggtatggtcaggcgcagcagggtagtggtggttatcccggttatggtgctggaggatatggtgctggtacggttggttatggatatgggcatgctaaccctggaactgcgtatgggaattatggggctggaggatttggaggtgttcctgctgggtatggtgggcattatggcaatccaaatgcgcctggttcaggttaccagggtggtcctccaggagcaaacagaggaccatggggtggtcaagctccgtctggttatggcactgggagttatggtggcaatgcaggctatgctgcttggaacaactcttctgctggaggtaatgcacccactagtcaggccgctggtgcaggcacaggctatgggagccagggctatggatatggtggatatggaggagatgcatcgtatggtaatcatggtggatatgggggttatggaggaaggggagatggtgctggcaatccagctgctggcggtggatctgggtatggtgctggctatggaagcgggaatggcggttctggttatccaaatgcttgggctgatccttcacaaggtggagggtttggggcttcagtcaatggagtgtctgaaggccaatcaaattatggcagtggttatggtggtgtgcaacctagggttgctcagtaaatgaggccattagagcatctatgagatgaaccagcaaaattgggcagtctatgtatgttgtgttaccctggcccctctgattgcttttggcctcttgaagatctcccatttgctggttaaatcagtatttctccgggttggaatgcttgaacctt

SEQ ID NO: 61442 - DNA, 1138 bp, Oryza sativa
tggtggagattgaaatttccaaattttcaacagttggactgttttcacctgatatgtactcatttctagagaagcttctaggatcttaacacagattgactggaaatatgtccaagcgcagttgctgattctcgtgggcaattttcttactacataatcctgattccaagctggctagctacttgatactagttcctcgcttccttttaataaggtactctcttttgttcattttttcaatcacaattttgttgatctttttatatgtttaatgacatattactgcatgctagttgtactatctattttcttaccattaaaacatgataaatagaagcatatcattcactctcaactactaaccatcatcttataagagcaggtactctaacaggctataaaccagctttaaatatattttaaaaagataaacgaggagagagaacagcagcgggctatagatttatagccagctgtagcacggactccaagacacggggtgtatattacaggtgggagcaggtattaatagtgtactagtatgtaactattgtatgaataagctattagattggctacagatgaattagagctagtagctgactatactattaaacttgctctaatcggctaaaaaggaagaaaaaaatatacatcgttttcaacacaataaatccagtgatgacctatgctctggccatttaatctagatgtactaatagtggtactactgatgtttcagccctattgattgcggagagcaaacggagttgtctgcatatgaaggaagaacgttgcaaagtagtaccaactaacttacctttctgatgggcctcataaatcatcgtcattaacttacctttctgatgggtcactcttatatcagtattattccaatactctgcataattgcaactggtcacagaattcacagtgtttggtccttgtgctttttatctgaagaaaggaagatgcatatagtacctccttgatgctgactcgtggtacagaaaaacatcgctttagctgctgtttatttattaggtccttcgattatgagacgtataaatgaaacattgtgcttattacacagtgcaaatgtagattactgttggtggctggctgctacccttcgccg

SEQ ID NO: 61443 - DNA, 1674 bp, Oryza sativa
ttttaaaaaccatggcagatgaaattactcagatactatatctcttcttgcaacagaacatctctctttctgatacggtgaccacatagcataatccagctaaaacttattctgatactttgcaactgaatcatcaaccttgagcaactgggcagaacccatgcataattgcagcagaccaaactttgtccatatcaagcaccttgtcaccacattcatgctcattccatccctccaacgcatgaagaattcccgcgattcgccatgcgctcataaccctccttggcagccaattctgtcaaaaaaaaagttcaaaaattttgtgattagatcatgtgaagttcgtctgaatctctggattatttcaacaggttattactactacctcgcatgaatgcacattctgcagcgtttttggtacagccattgcaggagttgtcgagtagctgcagctgtccttgcgtaccatctttggaggaaattgtgagtatgggataaacagagttcctttctgtgctctgaattgttcagcagaatctagaccatcaccaattaaccaaacctgaaaatttttggtttattaggcaatgatatttctcttatacattctattcatttgtccagagaatgtaggaaaaatgaggaaatctattcttacctttgcggtgcctgttttcgaaaacgaaagattgtcagctacagtttctggtatttctggcttgagtaaatgataatcttgcttgtttgtcatcgtgacctgtacaagaatagtggtttgttacaacatggtatccttttgcatgctataaaataaatcagaggtgagtagtggattaattactttgatatttttcttgcataatgcttgcgctacagcacgcgccaccttggaaacatttcctgcaagaattacttggtctgtgccttgggggatactgttgacaaccactgcagcagctaagctggttccatcgacaattcttgctcccaactttgggtatttcagcagatattgttctccacttttattcagggtatgtgccttatattgaagatattgtatgtcaattaccagttcaaccatgcatgagtacatacttccctaatttctacatattgtattctcatgaaatgtacagaatttattagttctgttggactactgtcaacggactctttgctacttaatttttttattttcctacctttatgactaaaccttttccctgaagataaacaattattaagcactaactgttttatcttgactaaaatttggcagtacatgtggacatatagctaacatctgaattctgaagtatggatgataatgtttcaacttgctctgaattcattaggaaatgagctacctgattcaggagtccaaggcttacaactttagccccattcttgtcagcttcacataccgccttttcgataagatcattgatagcttccttctcccaatccaatccatactgcacaaaacaaaatgtttctaacctgattatcaatttatcatgcacaccatctgtgaatcatgcactgaacatggttactcttacatggaaactgtatcttggtatggcccatgactgcatcctgatcttcttcatgacattcctctcaacagtgaatgaagaaccgtacgtccatgtcagcaccatggagagc

SEQ ID NO: 61444 - DNA, 10001 bp, Oryza sativa
aaaatatggtacttcccctatgctttcttaaaaactgtaaagttactcttttacatactccctccatcccaaaatatttgatgccattgacttttttaaaaatatttgaccgttcgtcttattcaaaaatttaaataattattaattctttttctatcatttgatttattgttaaatatacttttatgtatacatatagttttacacatttcacaaaagtttttgaataagacgaacggtcaaacatgtttaaaaaagtcaacggcgtcaaacatttaaggaagaaggaagtattattaagagcctgatgaagtacttacgatggcgtgtacatgagatacttgagaggagggaaccatgtgaagagccagctgggtaccaactcgaagttgcagtgccccatgttgttcatgaaatcaatgtaaatcaaatacatctcgaatgcaattatggaagcagttccagtcaaggcacaggcgatcagtgggatcgagaagagcaattcgtaggcaacgagctcagcaaacggatggatgacggctgcaacaacgttaggaattgtaggtaatgaacatatatgcatttaggtatatgtatctgcttgctcaattacaaatactgcagtctgcagggttctcttcttctgcagtgtaaccagtagacactattggtttttttttaacagtacttaaagaaaacaccataatcttaaagggattttatggttatcaagaatcactgaatatatcgtgttctctaatgtaaaatttagtactaatacaagtagtgcattattttacatttgaaaagcgatttctcccattacacatccattcaaatcactttaaagtcaatttatggtaccgtcttgtacatcttaaaattacaagatgacaccaaaatctttactactattaaaagatagtagtggtggtagtgaatctgccatcaccacaatcactgataaggggcggacccagaaataggccaaggcctaggccgccccatggaaattttggcccaacacaaagttacatggttgaaaggaggaaaaatagacttattcctagtaaaaatgcatatttctcatcgggcctttcatctcaggccctgggccgtggaccagtttgcccagggcctgggtcactgatatatgggccatggtattaaggtttgggagagtcgcctgtactatatatactgtactatactttagctctttaattttctaagcatggcatttttgtttgtttctttaagatgaaaagttgtgtttcaaccatttttttttaaaaaaaatttaacaaggacttaattttgctatttttaataatccgttgcaagttgcaacgcactgatatttggctagcttacacgaaaaatatagtacttctcgatacctctcaataaaaaaaactcttccactcaaaaaaaagggggaaaaaaccccttagaatgtgatttctctcttgtctaaaagtctctgatacgttgttcatggaccacgtttgcttctccgtttggtcaggcattcagcaacggattcgatgggctacataaatttagctcgcgatcgatcggtcggcttacttcgatctcaatggtccatgaaatatcgtgtgtcctttgcattccttaactcacacactctctaggcctacaattattgttcaggcatgcattgaaggaggagggaattgaagtagcgatcgactggccacaggaacactctgtgtttcctgaggaacggacacgcgcgacacttgcatctgacgaagtacacctcctgttttgtgtccttatggaaaagacttgttttttactttgttctattggaagattaccgtggtttaatttatcccaaggttacaggtctagtaatatttctgtctcaaaattttaagaatttgtattaccaaaatcttaatattcatttagaggtttgggacgaaagtaatatcatgtaataggttgtttggagcaatgatggtacaactaggtagtacaacttacttcctctatttcaaattacttgtaactattagtattgattgaactttgatcattgataactttagatgatgaataaaaattttgtaaaaatatttatgacgcaacacaattcgatactaatatagaagctcaaaggttattgcctaaaagagaatgtaatgtttggagcctcgaggataaaccgtctctagtggcaattaattacgtacatgtgatgggctcagtgacgattgaagagtggtggtgcgagtggtagtgggtgtagagaaagtggtggtgcaacgcacgatggaaccagtagtagaggaactccactggccccgcatgcagcaaggcgatcagccccgcgccatccgtcctccacagcggtaagtgttgcccgcccggtacgtacagtgcgccgaggtatagtaggataccgctcaggatgatctggtcgtccctgcacgcacaccaccatacacgtaacaacacatcaactataatgaggttgaattaattaatctcgaaggtgaagctagccgccacgaacacaccgcgtgggttgtacgtaattttatggtgtttggcataccagttcctctcgcggtcaacctggtcgaactcgatgccgcggcgaacaatctggcggcggccacgggcgttttggaggcgggagatggtgatccaggcttggttgtgcagcatccgcagcagcaacgacgggaggatggcgatgtacccgagatccacctcccgccaccccttggtcgccacctcataccacccgtgcgctacccacggcgccagcaacacgtactgcatatgcacacatatacatgcatgaatccatccatcgaattaactcacatgtgctataatttatagctgaagttactgttgtaatttgtaaaggtcggaagttgtgtatactgaatgtttttgcctaatcaaagacgatgtggcaaaagcttatttaaccatgtactctttaacagtttatttgctgcacagaggtgctgcaggaaagttcatgcccctgcattactgatctgcagcagatgcaagagaattaatctcatgcactgctagctgcacatgcggcaatgtatgctttgatatcaaacagaagctagcgaactcaaacaagaacataatggtcatggtgcagtgctgccatggatggaactagaagctgtgcgtttatttgctcgatcgagctgccagaagacagtgaagtaactgaattaaggagaagaagatggaaggttaattttgattaccttgaagctgccaagcttcttccatggccactccgtgaagagtcctgggtttgtggccatggtagacgatctatgggtgcagaatcttcttgcagcctctggctagctagctctcgtttctgcagtctcaacacggcaagagtcttgcaagaactggcctgagaatggaggacggatatatctcaatttataaactcgaccagggcttcgatctagctgtgcgtacgtgtcagagtctcatatactactcttacatagtgctcccccatcttaaaatataaggaattttagttgaatatagcacatcatagtactttaaatccggatttaagtttttttagaacggatagagtagatgagaagtatgttcagatttcgttgcactgtaatatatcccatcaaactaaatttgctttttttttttttacggaaggagtaccagagagaatgccagtaacttctgaataattctaccttcaaaataaatattcttgcattgattggggttgctcgaagggaagatatcggtcctttatgaatcatgtgcgtcagaaataggtaactagggtcaggtttgtgatagatgcagcagacggcatgaatgtaccaaaaacaaacgagttactgctaagctaaccttcctgtattatttttttattattatttgtaacataattaactgcaaataataaatatatatatataatcgaattccatcatgaaaatgttgtttttctttttcctaccaaagcatttcaacattgatacgatcattatgtatttttaggtaattctttacgggaggaggacgggttattaattccattttgatactgaacaaaatgatagtacaagtttcggcgttaaaccggtgttcgacgaggggtttaaagctatgatcgatcgtctaaaacttaatagatagatttttatcaggtttgggtctttctgaagataatagctctagtgacccggctatattttcttatgtggattattgatttgaatacaaagaggagagcttaagggaacacaatcttctccatctgttcgggcagtctgtgtctttgagaagagtaaaaaagggaaattaagaataaaagaaaaagagatgagtcattaatgtatgattaattattaattattttaaactttaaaaagtagattaatatgatttttaaaacattcttataaaattttaaaatatatatgtatatatgtatactgtttagtagtttttttaacgaatcggcaagctgccaatttcattgaatagagaaggagtaaactttacaagtaagaaaaacaaggctcaggaccttcggtccaaatgagctaaaattataaagcaagccagctaccaagatgcctcgcccctgcccgagaccatgttttggcctcctctttaattttagccaacagacttccggtagatagctctttgtgctggaaacctcgcccctgcccgagaccatgttttggcctcctctttaattttagccaacagacttccggtagatagctctttgtgctggaaaattctacagtttctctcgttctagatttcccagttgaccaggagtgttaacgtgtggagtgctttctttggggctttcttcaagttagcggtggcctctctgtttagcagtttgaaaagtgtgcacgtgaaaatcgagggacttttgtgcctttttgtttttcaaacgaacgctcagttcgggaagtcagattcctacccaaaaccacttttgaagtctatgtatttcttgattctttattattattattattattattattattattattattattattattattattattattattattattattattattattattattattacacacgcacaccctacccctatgagcacctccgtaagactgggccggcatgtcttgagattgacgaagtcaccataggtgcctcgctgtcgacgagtacgtcgtctaccactgaaaaaataattagccgtaaatgcgagcacccgtgtcaactctaggatttgaacccgggtgggctggttccaccacaagtaacctaaccagttgagctatgctcacttcgcattttttattttttattttgctagctgttttaatcatatatacacatttattgacacagattgtttccagagtacataataaaaaaaaatagaactacggctcgagaacgccggaatgtcaaccagaacattcagaatggaattgatgacaaagtatggtgaccacgttcgcatgaatgttatgtcatatccattaatttgaataagttattcttttcactacttgcgtattctttcattctaaaataaacaaatctaaataatacaggataatatatatctcggtatagatttacagtatcaaaatatgttatatgccgtacagtattacgatataatatatacctcggtactgtttatgatatttaacccaaatcaaatctatcgacaagttctcattcaacataaatttgtccatatattccgcagcaaagcaaataactttatctagctagcttttaataactttgtaagccacgatctgtacacttgtaagccacaatgcaagtacggttcagctcacctgcaaagctgagcgaaattaattaaggtgaagcctgaacattgttacgagtgacggtgacaatgcgcaagaacatggccagttccgtgtatacactgcacactgtacgtttcttttcgttgcacacacaattaatcgtcgtcagccacgctttaatttgttcaaccagatttggttgcaagtattggttcggtaataatcagatcgacatatagagtatacatgcaccacgcgtgcattctatcactaattaattgactatattttttttagataatggattttcattaataatccagcctctatatccacgaaggatatacacagccaaaaagatacaagagcacttagactcagatctcaatagagagaacacaaaaccaaaagaaaaagaaaaaacaactaccggcacatccttgctttccgacatcctctcctaaatcagcgagattcggagtggaagtcgtctagtcgtcaacgcccctagtgcgtcgtcgccgcgagcctccgctgatgccatcttcattcgcttcagatgagttgatgtcatacgtcccggtttagcccaccttcatccgtcgttgcccagcctaaacaagccaaccaaatgcaggccgacagatccatttccgcttcactgaattcctaggcctctgccgcccctagggccgtcaccatcttcgggatcctcctcccctcctggattcccagctcgtcaccgccccaagggccgtcgtcggagacctctggaaccgctgtcgaggaaaatcaatctcttccaccggactcccaggcatctgccgcccctagggcagccaccgtcaacgggatccgcctcctcactgcgaaccttgaactggcactcaggctgccaccgtctcggttggacgctgcccctagggccgccgccgccgccggagaagccttctgcccggactcccaggcgattctgccatacgctgttgcgaaagataccacctccacccaatcccgctatctccttgccaaggatacaccggcgacacttaggccaccgccgtccgaagggacgccgccgtcgactccagaacacctcagctcccgcacttaacaatcacatggctagatctctgtcctccgtcgccaacttcaccaccgcgccgaaggggacaggccacgcgcagaggaaacatatatatatatatattgttctagttcttttaaattaaatacttttaaagttattgatagtcaaaattataaaaaattataaaagtttgactacaatcttgtccaaaacgtcaagaattataaaattagtgggagtacacgttaagtttataatagtaactttcatatgctgactcgtggcattaatttcgcgtgccagaatcagctaaagcctcaacctagctcacattcaatcgagccttaatgtttgcggtgtatgtatacaacaaccttaaagctagcatctattactatgattttaattattttttgttttaatacgaagaaactgtagtacatggatttttcgtttctacagtgctcatatgaaaccgttacaatattaccataagataaaattgtgacagtatatataattagttaaactatatatctcaacaatttgattagctgtaaacttgtatcgataagaatcctttgtatacagtgagattgacaacgtgtgatgagatccatattgtctcctagagttgtgtaatcttctgctcctaccccagtgtgaatcgttaaaaaatactccctccgcccaaaaaaataaaccctgggtttctatgtccaacatttgaccgtccgtcttatttaaaaaaattatgaaaaaaattaaaaagataagtcacgcataaagtattaatcatgttttatcatctaacaacaatgaaaatactaattataaaaaaatttcatataaaacagacggtgaaatgttggacacggaaatttagtgtttgtttttttagacggagagagtaattacttgtataccgtcagatattcaggttgtcagacgactaagtacgacagtgcatttggttagtggttggtaccggtacgcggtacagtgcaacttttgttctgtcacacacttggctggttgggttttaatttctacttctcttgctgattaattggcacatgtacggcatacactacagtgctcaaagcaaaaattaaaagaaaataaagaaaaaaacaaatggcacggcacgtattttagagggagagtgttttgcaagcagcttctcgttgcatgctattcaaataactaagattttttttagaaaaaaatgtctcagtttatattattacctgttattgtactagacaaaccatgcatgtgcgcaagagtaaaaaattgatctaacacgtggagaatatatatcagatatgcatttggatttatttttgttttcctccttgtttttggtgaatttatggaacgatatgatggatatgcaattgtaatatactacatcgctatttttttctttaaaaaagttataattatttagataattgacgaaggatatgcacatttaaactataaaatggctttccgacggaagcatatttgaaaagcatatatagatacaataaaattgttggtgtcatccaagatatatctaatcgatatatagtgtactatatagttggcattcagatccttaatttggatttactacaaggagctgtatatgtagtgggttggatcgagttggttaaatcttgtatccataaatatatatagctgtgtttcagttttagttggtatagttatttgtataaaaagcagccagccttttgggatgggatattttcccttccgttttatattataagctctgacttttttgacttattaagtttgatcattttttttaaaaaaaatatactccctccgtttctaaatagttgacaccgttgactttttagcacatgtttaaccgttcgtcttattcaaaaacttttgtgaaatatgtaaaactatatgtatgcatataagtatatttaacaatgaatcaaatgataggaaaagaattaataattacttaaattttttgagtaagacgaacggttaaacataattaaaaaagtcaacggcgtcaaatatttagaaacgaagggagtatatagcaacatctagaatatcgaatgagttatattaaatataatattgaatatatcttgatagcgcgtcttttttaatgttagtttgtttctaaaaacttagttaaatttaaagaagtttgttttagaaaaatagttaatgccaattataatatgaaatgtagtaaataggaaattaactaagaatatgagtttaggttgggttcagaaggatgatccggtggtgcaatggggtgcaggggtaaaattaataagatgtcgtgaagtcatagaacagagacgatgagaatgggtcgaattatcatgtttctcgtggcagacgtctgaatatgccaacgatatatttcctcttatctcaaaatataataatttagaatcgaattaggcacattctaatttaggatcgattagacacatcctattatgattaatccgaatagaaggtttatccatcgtaatattagaatgtgtttaatctgatattaggttgctatactccctatgagttgataatactttttttttacaaagtcacagcctcagaaaataattttggtaactattttctattacaatatatatagaattatcaacaaattacgatattgaagtattatggtttatattttatatttctaagacaagtattttagaaactattaataatcaaagattttaaagtttaacatcaaccttattcacaataataagtattgttaatttggaggacgtatattttaagatagagcagagttatgtacttactaggcgtgaccgtgtgagctagattggacatactccctccattatatccgttatatttcaagtgcaatcatgagttttcgtgtctaattttgatcgtccgtcttatttaaatttttttttataattagtatatttgttgttataagatgataaaacattaatagtattttactcgtgacttgtgtttttaattttttttttaaaaaaaataaataa

SEQ ID NO: 61445 - DNA, 2752 bp, Oryza sativa
taggggcgtagggcgattgacttcacttgtacgaagtcgtgagagatagatctcatcactgcatgcaccatcttcgtctcggtcgccggccggcccacttcattcaatgaacacacgcggctggccgttcgatatatccattgattgatcgtactcgatagctagccgccggtgccctgtggccacggtgacaatgcacgcgtgatatcgctgtgcagtccaaagcctaagctaggtacatgcccgtgaatggcgactagctagctcggccacagtgtactcagtacagctgcctctctacggtgtacacagtacgtaccgtagtgctgcacgcaatgcatcctagctagctattcactcattttaaaatatactctctctccattttatattattactcgttttgatttttttttctagtcaattttttttatgtttgaccaaatttatagataaatttagcaaaatctacagcaacaaattaattttattaaatctatcgttcaatatattttgacaatatgtttcttctgtgttcgaaatgttgttatatttttatataaatttgatcaaacttttaaaataatttaactatagaaaaaaatcaaaatgacttataatatgaaacggatgaagtagcaaactagtaaatctggatggatcattataaaaattcgtagcattaaaatatattttataactactatccggccatgacctatgcacagcgtggatggtgttctttcctcattaatatatattttacctcgatttctgttaccatattttttaaactgctaaataatatatcttataagaaaaaaaattaaatgaaagttgatttaaaatatcaaataaatctattattttaactttgtaataattaaaacgtctacggccggcagaggagaatagaaataatgcagtgagggtgacgagagcttttgtcaaggccagatcgacacgcactcttgtcatctcgtgttggaatcaactggggcattcatgtgcacaacaatgcacttgctaatcaagctgacgtcttgattgattgtcttggtctgatcagtgtgcgaattaaattaagctatggaagagactgacaaagagaacgacttcaacacatgtcctgcctgcttctaaagagtcaagagctaacacattctaggtagccggctagttatgagattttgatcagatcattatgaccttaatatagaccgtgtttagttctaaaataatttttcaaacttttaactttttttatcacattaaaacttttctacatacatcaacttttaatttttccatcacatcgttttaattttaaccaaacttttaattttgatggaaaaccaagttgatcgagagctgggcagctgtacggctactgtcccggcgtctgcatccttgaccaagagcagtttgttgccagagattaacactgacggtgatggtggtcattctgcagactgcatatattaatttacaatcggattaatttgttacataacattcgctagaaaaattccccgcaaaaaaaaaacattcgctagaaaaattaagagaaaatcgaggaaatctattgtaatggcatatgcttgttatattataattacaacataattatgccataattaggtttaatagatttttaagaatattttatcaaatgttagctaggtaggagtaggcagtgccttattatgaaattcaatttattttccatttactagtttttattagaaaacgaacccaaactaaagattccgacatgcatgccggattcaattttattctgtgcctttcaacgaataaatttactttaatactacttgatgtgctttcaaggaaccgttataaggtaaaggtatcttcttttctaaagaatggaaggattgcattcacctgcagctctctgtgattttcataaaactctatagtatatgtgaatgtcttaaaatatgttttaaatttacttttcaactttataataattaatttatttgtttgtactttcgagtccaaaaatcatttagctattgagccattcagcaaaaaaataaaccggcttcctacatccgtcaacttgtcacataaacggtaaaccgtattattttgccatgatttattttgggcatgacgaaattggagtactttattgtttaaagtccgtattttgtacttatgactttaattatatgatgatatggagccacgatggtctctgcaactattctttttgtctgattatatagtaaatgatacgttatctgattttgtaataatgttttaagggtacaaatgaatgaattttctagtacaaagttgaaaattaaagttgttttaatattattcttagatattcacaccgtttataagtttaggaagcgtgcctgtgatagtttctaatatgtaagaggaaattgtttttctgcgaacgtgtaaaaagattgaatttcgatgtattagaagaaatcatagtttttgttacacaacacaaccagccaaatggccatttcttgggaacaaggaaaaaagagaaaggaaacagaaagaccgctaaagtgctaaggttaaaaaaaactacggaaaaaaaatactactcctatacagagggaaggtgatggcggagccccatgtaagaggaaataaataatccatccgtctcaaaataccagtatttttggacttcgtcacagtcttcgagattctactttgattaacaatatctatataaaaataagatgtt

SEQ ID NO: 61446 - DNA, 792 bp, Oryza sativa
cattggcgagccgccattgcagatggcggttgtgaagcagcctcagctggtgctcctcctcggctttccctgcgcttgcagcctccctggaacggcagacgccgccgccgtcgccgagcacctcgccggagacgggctcgccggcgaaatggccgccggcttagttggaggtggctgtttaggcgacggcctggtgaatggcgaagagagcagcccgttgaacagcgacttgaccgacttcttcttcgtcgttgtcggcggcggcggcgccgtcggcgtcgtcttgggtgacggtgaggccaggaacctcggagtgcgcgacatgaacggcgtcgagtggtccgcgaagcgctccgagcggctccccatggcgtcgcgcgagaaccgcgcgggcgaggccatgatgcttctgggagacggacgcgctctggcggcgagcttggcgtcggcgtcggcgtcgccgtccggtgacccggcggacgacgtcgcgctctcggtgtcgtccgatgacagcgcggcgcggaggggattcgggacgtccaccgacgcgcgccgcggcgtcatctcgtcgaacgccacggaccgcgtggcgacgccgccgcggaaaccgtagggcgccgagttcgccgccgccgccgacgccggccaccgggcgtcgcacaccttggcccgcaccgccgccgcgccagctgcgaaactggccctcttcttctccggcgacggcgcatgcggcacttgcttggccttgccgccatccaagcagtagctcgcgtcctggaacgcgaccgacac

SEQ ID NO: 61447 - DNA, 8315 bp, Oryza sativa
cggaggtaacaatttcagcctagcagccttagatggatgtgcttttgtaacaaaataggttataaggtaaaatatcgaaactagattaacaattggagtggtctatgcaattttgccagaaagaaaagatatttcagggttcttaagcacggattacttgtgttgtttcttgacagattgatcatggtggaatcaaaaggagttcctaatcctaatggctaatggcatcatctatatgaaatgatccatcagtcacatgtatgcctgcctcgctgcctacggcacacggcgcctctccgtgacacacgcatcaaacttgtagctgaaaccatcagttcagaattgcttctccatgcttctcctaatctcttaatgttaacctcaattaatccaggaaatatcatccattcagtctggttttcatgccgtctttttcatgctagtatgtgcttatattcgttcccgttgacattaatgcattgtagtatttaacacagatgatcacatcaaagatagcatcacactctttttgtttctctgttttgctgtctgtctgttactctgttatatgcaggctgatattcctttaatttttctgtttgcttaatatgttcgtttgtgtcggcaagcaatttggtcgtatttgatctttggcagatgtgctgttctctagtgcaaaataatcatagtatataaactgcaaaattaacaccttaaacaatctgggtgtactagtatttctgtgtgtgtttgtcagagctgcaggttatcagtgatcacacgtcaaattgatcaactctgataatcagaatcagatcactgtacaggactaaaaatcatgagaatattacaaacacaaaccaagtatacacagattatcgtgtgtctctatcttgccttcttccctgttgaattctgtatggtcggcattcaactaccagtatatttgaatgtgtgatgtgacgttgatgaattttctacaaattaagaaaaaccaaaatgaatgtgctctagagtattccatgaatatcaaataacggtggttgttagcaagcctgccagtttgcacatctctcttatcctgcgttatcagagatataaataataaaattcgtccaaatcagacgtcgaattaatatattattttcccaattttctattcttcaaaaaagaagtaatttgcttgtaatcatcccatgtaatttggagaaacacaaagagaacaatacacgacaaaattaggataggaacaaaattggttttgtacattgagcataatcctagtagtaatgtacatgaatcagaagcagagcagcttatgtgtacatacaactcatgaatacatacacgcaaacgcaaatagcacatctttgctctactacctacttccccgttttgaacacgagaattttatcctttttccaagtgaattgaactgattttccatgaaaatcatccaaattcctccgttttgaaggctgcctctcgaatgttataatccaagaaggcaaaaggaatcaaagggctcctttcgactctgaatcggatgaacatttctcagaaggcgcagcagcagcaggagacaaggcggctccacgcggcggtggcggcggggcgacgcctcttcctgccggcggcggcggcggcggcgtggcgcggcggcgcggcggcgtccatggagctgagcatctcccacatgacgtgcacgtcgctgtactcgcacgtccgcacctcattccgcagcttccccaggcctgcaatcacgcacacgataccgatcagtctcgtcgtcgtcggcggcggcggcggcggcgaccaaatcaatccaagaagcacggcggcggcggtggactttgactagctacttaccggtggttcgccggaggccgaggcgggcggagaggccgagccagacacgcttcaccggcaccgccgcccggccaagcaggcacgacatgatcgtcggccgtacgtagcttcgattgcactccactctctgctctcctctcctttcgccggcgatgtctctcgtctctcgttctctttctctcttggagctcgtgaagcttagcttgatttataggcgaagtgggggtgggagaggatgtggacgcggcggaggaagaggagcgcgcacgtggatggaaggaggtctcgatccgtcgacgtcgcgttgtcttctacctcgcgccttcacttccttcccgccgcgcacggtcacctccgacggccagggttattcgtgcactcataccggcgaaaatatttagtgccaacttgaaaactacaccgtcggatcgaagagatttgttcacgttatcctgactaaattttttattcccagatttaatcagagtaaaagttttactggagtaaaaattttattcagtgtgacgtggacaaatctcggacgtctatttttttttaatatgatggtgtttggttttttttactacatattttccgcctgataccataacaattttctcacccttgatttgaaattctttttgaaacatggtcatacacacggcacacacacccacccttacgaacacacgtctggacgtattttgagattcattaagtcattactggtaggcacgtcgtctatcactaaaaaaattaataattagctataaatgggagctctttactgagtttgggaataaaacccatggtgggcagttgatctttatttgatttccatatggggtgctctttatttagtttgttttttcgttgttgttcattggatgagaaaatatactcacaacttctattctctcgtcttcccgcgtaagcttttctggacttctcaacggcatattgttttttcaaatattttctattggcaagttgtttttttaaaaaaaatcatattaattcaattttaagttctttttaacaaatacttaattaattatgcaataatctccggctctgttttacgtgtcgaggaagaagggttcccaaccttcccaaaataacactaccaagaaggaaatatatttttgtcagaaaaaaattgtttgaaatcataaattcaaaaccaattttgttttgtattctataatcttaataggcagtggcttaaaatagaacactactctaaaattatacgtttagcaatgttcgaaatgcgaaatagacatggacgatggaaaaatgggtgatggagccagataatttgaaatgtcgttttttgtgacaaacaaaaaaaatgtgttcgtacaagtatctgtctaaactctcaaatcccagttgttatgccaaattaaataaacactcccgatgtggacctcttaatataaagaataaaaacaaagcacaacgcgacgtcgactttcttataccgaataaaaaatgtttcttgaaaaaaaagagacggctggagtaaaatcttttagcagtagctctcgcatatattactgtcacaaattaattcatcctagagatgaaaaccaaaattaataaataaatatcctattggcctggcccaaatgataagatatttaccagttaccatcaggtcatcatctaaaaaagttaccatcaggtttcccttgcatatatagaattgccaacttgttcatgatcagttggtgtcaaatccgtgttagaattaacagtccatctcttcttctgtctcctgctgtcatacacatctgacgaagtagtagtaacagtgagtagtattgagccattttaattaatcagctaaaatattcagctaacagccgccttagcagcaggattagtgcctgattaagcttatctattcctgagctcctaacacgaggcagcacatttcacatttccatttcttcccttgtaaagattcctatattaaattagattggttgatgatcttccttgtcatcttgcaagagcattattgtgggccaaaatcttgatgattgatcacaatctgcatgaccatacacggagaacttgggcaacatgtgctcaaatgaaatactactacatggtattttcctcttcctctcgtgtaacacatgctcatttttctccatccataatcatgttcatataactgcaaaaatatggtcatctgatattttcagaaatcagcataccagcctttatatgtaactgtaaattcagagttcagacatttacttggtagtaactgcaatttacagagttgtggatagcactgtcattcattcgttcaggaattgatgcggaaactaacaggacatgaaggttcagacgtaacagtcagaatcctgagacgcccaattgcagttgcagctttgtcagacaagaacaattctctattccaatttcttggaatggaatgaattttcaggcgtgagtgcgtgtgcaccgttaattagtggaattcgatttggccatcacatctctttctctttcagggtcgcagtcaccagtgtgtacaagccaagttattttttattatttattttgcaaaaaagaatgtaccaatatgccaactttagttttgtctgttgctaatctgatacatacgtgcatgcactgcgacatggtttgattggcattgacatcaccaggttacacagttggatccatctcagaggaaaggaaggaaagcataatcaagttaaatttttttatttaatttgaaggataacacgagattaagttgtgtttctatttgtgttggcttgagaaacagtcgtgcttcattagctagacctgatctcattcattgcctgaaaaatatttcagtcactcgcacccacactgaaagtctgaaactgaaattttcagagttagctgtgtcaattttcaatcttctttttgcatttaagtttactacagaaagtttactcaatgtgtgtgatgctccaatactaagtcactggatcatcacatccaactctctaaattaggctctttgatgggccaatggatgattacactgacacactcacaccccactctgaattctgaagcctgaactttttcaccatatatatataaataagaaagttccaagagctcttatgatccactaatcttggcactttaagtgccaaggaaaagcacattaggccagttttggggggcctgcttagagattgacacttggagcaaacgagtggctcctctttcagattcggtgtagattattgatgatgatcttcatcttttgcccaaccaaagcttgcaattgttggggtggccactagaacaaaaaaaaaaaagagaaacaacaaaaggagattttttttttcagattatcatccaaagaatagcaaagcagtgcatgcgcaaatgcaactatcagagaatggagattggcattccttttgttgttttgggttcctttctaaattctgatgatggtgtatggatgtcatgttaggatataaaactttacttttgtggcatgaaagaaacataagcctaaatgtgcactcaactatatttgcttctcttggactaaggacccccatcgtttcgtttatcctctgcttattcataccgcttattagaaaaaagaaggtataagtaaaacttttatatacttatccttagtgatacaaaagtaaatgttgtaaaataaaccacaattaaaaaaaatacaaaatcaacttcaaaattaggttttgaaattaaaattttggtttattagcataatgggaccattagtacttgatttattcattccatttgtgcagcataccacaatgatcttttcctgcaataatacgggtcgtttcttatgttttacatcctccatttcataatgtaagtcattctagcatttctcattatctagattcattaacaccaatataaacgtgagaaatgctataatgacttacattgtgaaacggagggagtagtattcagttttggtcttctgaccatgcagatcgcagaggctgtttgctctgcacgactagccacttgagcttgacagctgacaacaaaagcgcgttgattttattttattttactttggtcgtcgttagattgcgttcttgttgcataataaaacgacaaaaacagtcttctctcagttcactgaatttgcagtttttacactgaaattatcgcctcagtttagtcagttatcaatcgatcgcagacaccaacacgaacactgaattttccccctattttccaatcttgcaatgccttctctcttgggcccaaagcccagttactgcttacacagcacaggcccacccaagtaatttgggctcaactcccttcccctcttgagcccaaggaccatccggcccaagccccaaaacccaacccaaccagggcgacgactgctaactcctcacctccgctgcccgaccatggccgtacctccggtcctccgccggcggcgacgggctccaattacgccggtgcagaacgccggcaccgccgccgccaacagcttgcgtgcgtgtcccgcgatcgataaagcctcctcttttctcattcgggtgccgccctgcactgtaagtacatggagagagagagagagtgggacaacgcgcggccgcacgccaactgctcggcgaaatgcccaggccaccgcgccgcgggcagcgcacggtatggacacaggtatgttacgtatgctcataaaatgtctgggatccaaaaactggtcacttggcattggcacccacctgtttgcacaaactgcactatatgcacattcacaagctatgtgttgccgaattcttcctttattcatagtattgttgaagtgatttcagcgagtgccctctgttaggctaactactttgtttatcgtcatttattaatttattattattattagctaaaagagcataccttggaaattttgcatgatcgtctaccagtatcttataacctagcacaaaatgctcaacagtaagcaggaaaacatgatggaattatgtatgccatgaaagaacctcatgattgcatataaagggaatatgtataagcagaattagacaacatcttcctccttatttagatgaacaaacaacactcacggctaaacacgtactagtatcttgttgagatcttcctctcacctaggttaatacacaactatgcccgttgtgttcttttgccaaggcattggacgttgccgccttcaaagtaccatttacttattcttcagctgcttctcttgccaagcttgaccaacttacaaccaagaatacgtaaactctatcatacagcttgtcaaagagccggaaataagcaatcctccatatcttgttgaacagcaggacacaaaataccacccagatccccaccacaagtcctataccgaaaccaaaataaaatgtcatcggtttgaattcttgcttgctgctgtggatgaatgtataatttcttgaacagttcttttgaagaggaggtccacaaagtccttcatttccaatatacattagtgatggatcatttgcactgaagggtgtcaagttggcggcctgagggtatcattccagataaattgttgtaggacaaattcaagtagcttaggaatgccaaacttgataagctcgatgggattccaccagaaagtttgttcttagagaggtcaagagattccaatgactgcagggtaccaatcttgttgggaatttctccactcaactggtttgaagataaatttaaatttattaatgcatcaagagaagtgatatttggtggaatttcacctgtcaatgagtttgttgataaatcaatgcccacaaaatattgaagtcccccgccatatggaagttgtttcccttttgtagatattaataatatttctccgaattgaccacttacttcgactgtgaccaaaccagaactcatactagcaccagaaaaaggctggaagcctttcattgtcatgcctgtaaggttagatagatgccacggtatagcaccagatatgttgttatctgataggtccaagtactggagagacaaaagatttgtaattccagctggaatgctcccagaaaatgtattatgacttagtcgtagaatttgtaaatctctaaagtctcctatccacgcaggtaagctcccaaagaacttattccatgcaagatccaaaaactgcaggcctgtgcagttctgcaaaaaagccgggaattttcctgataacgtattgttgcttagcaggagaaaattgtagctgatctcagaacattgtgggatttcacccaccagaaggttgcctgacaaatctatatctcccaacagttgcaattcgcaaatagattgcggaatgttgccaccaattcggtttgaatacatgagtaatgtttgaagtctggagcttcaagatgtggcggcag

SEQ ID NO: 61448 - DNA, 858 bp, Oryza sativa
attgttttcttcttatcaggtcgcacggggttccaccgtcctaatggggaatgggtcacatgcttctgttcatgggttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcatgtctaaacatggatattttattggtaaaggttatgagtgcggagacctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgatgctctagactattttaaaatttataaggcagaagttgaaaatcaacttgacagaaagataaaaaggcttaggtctgatcgtggtggagagtttttctcgaacgagtttgacttattctgtgaggaacatggcatcacacatgagaggacgcctccctattctcccgagtctaatgggattgctgaaaggaataatcgcacactg

SEQ ID NO: 61449 - DNA, 984 bp, Oryza sativa
ccaaccacccagaggattagcaacggaagtgggcacttgtattcccataaccatgaaaagaatattccaactgaatgtgcaacatgacaataaaaaacagatgttcaattgattcttcagagttacagaacaacacttaccttttcgtctccttttaaccaaattgtcttttgttaagactactcctttgatataccaaaggaaaatcttaatcctaagtggaattctaagtttccagattatcgactttcttggtaccacattatggtacataagagccttgtacatagaactcaccgggaagactctcttcccattggcttcccatctaaaaatatctggactattagataagttaaacaagaccatttagcataccagcttgtatcacgcattcaggttatcccccaccaaagctctactaaagggcacatttagaggaacattgcccagtacatcgcttactctcgcatgcttgtttattgttagtaaatagagggagggatataacttatcaaaggagttagtcacccacccagcgatcctcccaaaatctcacttgttctccgtgtccaactaccatagatcctagttgcaaaaaatctttcttaaccatcataagcccggccctaaaatgtaaatccccagaccgcttttccacttgagtgattgttcaattggctaagtacttccttttgaacagattttgccacatgcttccctcgttaaacaatttatagagccatttgcttaataggcacttattttgaatgtctaagttttgaatccccaaccctccatattccttaggcttacatagaatactccattttgctaccctatacttctttttatgttcatcacattgccagaaaaatcttcttgagaatacctttagttatttcaaaaggttaaactacttgcacaaaaaaagtcagattcagcacttctgataatagagcaattttacggtccttgaggagg

SEQ ID NO: 61450 - DNA, 7832 bp, Oryza sativa
cgtagagggatgcacgatgtcgaatagcacgatcattgaggggaagaaaatcacccaagtcagaggctttgcggagcatcgcattgagcacatccatgactagaatgaaaagcatgggggaaagaggatctccttggcgaagacctctctgatgggggaaccgtggacctggcaccccattaaccagcacccgggaagaggaggcactgagaatgagggagatccaatcacgccaacgttcactgaagccaagctaggctagcacctcaagcaagaaaggccagctgaccgtgtcaaaggccttcgcgatatccaccttgagaagaagtcggggaatgcgtttggcgtgcagcgcccttgccgcaagctggacatagcggaagttgtcatggagagagcggcccttgatgaaagcgctctgattaggcgccacaagctcgtccaggcgaggggagagacgagaggccaagatcttggagaacaacttcccaaagctgtgaataaggctaatcggtctgaaatccttaacgtcaacagcctcgtccttcttcggcaagagggagattagggcgtcgttgagggaagcgaaaccttggccgttggtcacgaacaaggagttaagagccgccagaatttcgaccttgatcacaggccagcaagacttgtagaaacggcccgtaaaaccgtcaggaccgggcgccttatcagagggcaaggacttgatcaccgcccagacctcatcctctgtgaagagacagtccagcccctcaagctgcgcagggcggaggccaagagagtggaggtctagggctagttcacgctcgacgctcgtccccaagatggcgcaaaagtgagaggaggcaagctcttgcagcgcatcatgggagacggcaagctggtcaccatcacaaaggcacgtgatgaagttcttccgcctacgagctctggcgtgcaggtggaagaacttggtattggtgtcaccctccttaagccagaccaaacgcgaacgctgacgcgcgatagtacgctcaagcgaggcaagaccaatacacttcaactttaaatctcgccgcagccaggtctccaagggggaaagagaccgactctcctgcgcaacatcaagccggaagacaagttccttcgccatctgaagctgcagacgaacactgccaatgtgacggtcactccagctctgtaagcgcttggccgtggtagagaagcaccaggcaagagcggcaagagggggtaggttggcagggggatgccaggcgtcctgcacgacttgaagaaagccgtcgaacttgggccaaaaggcctcaaaacgaaaacgatgcgctttcggggaggtgacgcaggtatgaaggagaagagcacagtgatcagaggcgatagaagaggccgcttggaggaggcaagaggggaaaagctcctcccaatccgcagagaagaggacgcggtcgagcttaacaagcgtgggcgactcacgctcattgctccaagtgaagcgacgtccgtgaagcggcagctcccggagttccaactcgtcgacgagccgacgaaaacgacccatcatacgacgattgagattaaggttgtttttatcctgatcttcgagaatgaggttgaaatcgcctacgatggcccacggccccgtgcgagaggagcgcagcgaacgaagctcatctaagaaacgaagcttgtccggctcctcctgtggcccatagacgacggagagccaccagggggcgacatcagaagagtgtcgaaccaacgaggcaagagagaaatccgcaaggtgaacatctgagacagaccagacggtcgtccgcgaggcaagcaacacccccccactccgaccgaccgcaggcaagaaagaataatcaaagtcgaggcctagcatttccagaatagtacgagaggggattacatccataatagtctcctgaagacagagaagagagacatgctcatcacggactacatcacgcacagcatcccggcgggcgcgcgagttcagacctcgcacgttccacaccaaaatgttctcgttgcatgatcccattgaggaggaccacaccgagagcagaagagaagaaaccgatcagccgcacacgaccaactcctccgcagccttggccgggggcaaggagctggagaagagcgaggagagcgcgatgatgtgctcctgggaaagtggcttggagaagagggcgttgtaagccgcgaccgcctcggccgtgaccgggcccctctccggaactaggccgagcttccgcatcaggttgcgctgggcgcgcgacactgcgtggatcggcccctcaagcgcctcaagtgccatcttagcagcgatacactcactgcgcttcggcacaacctccaccgccttggcggcgagaggcggcagcggcaaaggcggcgggaggagcgcaggagggagaggcctggagcagctggtgaggaaggcgtgaagagcggcgttgtctgccacagaagatggaagcgagtgcgccagtgggcggccatcgaggtcaaggacaaccatcggcacatcgtagaggacgccgtcgggcacatcaaccaccaaagttggagcctgctgagaaagcggcgactcaggcctcagccactccccaccagtaggcggtgtgcaggcagtcctcggcagagaagtgcctgcaccggaggcggacggcggcacaggcgataccctgggcggcaaaggcacagccggaccaaactccgcggccagggcgtcgagctcgtcgaagaagagaccagtcggctcggcgtaggaggccgcgatcccatcggccaacaacggcgaacgtcgcgagcacagcggcgaggcagggaacgccgggccgccaccgaagggccagacagcaaggaagatgcggtcggcgggtggcaggcagcaaccggtgaagtggcgcagaccggagagacgacggcggctagtgaacccgcaaccagtgagttggaggcaaccacgacagtcggcgagccgaaggcggccacggcggcagccggcgaagaagaggcggccacgatgtcaaccggcgaagcagctggcgagctggaggcagccactacagttggcgagctgaagacagccacggcagcaactggcgagtccggggcgaccacagcaggagccgtcgagccagcagcggccacggcggcggccggcatgccagcggctaccggagagcacgtggtggccacatcggcagctggcgagcccgcgtcgaccggcgggacgacgtcgaccggagaggccgtgatggcgtctgcagcagctggcgaattcgtggcgtccggcaacgccagcagcaagccccgtccgtcgtcggccaacggagaaaatgaggtggccgcatgggctgcatgggccagcgcaggcggcgacccaagcggcacaagaggtggcgactcctccaagtcacacgtcggcccagctgagtccaccagcctaaggggaggggacggcccacccagcggcccagctggcgaagaagagactgggccaggactgagcagcccagctggcgaggccgcgcgcggagagagagccaccgctgccacgtgcggagggggagccgcgctctccgcacccgccgcgctctctgcgcctgccatcaccgcgtccaaagagccagcgagcgacgtggaaagcgatgggggaatcaacatgggatccaacgcccaagcatcgcgagaggagacaaaagaagaagcaaaaagagagtggtcaaaaggagaaacggcctcaaaaggagagatggccacagccgcagacgccaggggggcaccaagtcaggtgaagccgtttgaatggtgggccccacagctggacacgctggcagcactgggaaccgcaccgccgcgtcggcagaccccgccgggcacgccgccaacgccggggagcgcgcctccgcgccagcgacctccgcaaggcgcacatcactgagaacgcctgacgagcgccgctgcggagcaccgtcgcgccggctgccatcgcgccgactacccccgtccaaacctcgcgaagaacgagcgccgaggtcgccaccaccatcgttcgcagcgccaccaccatcgttcgcagcgccaccaccctcaccgctagcaccaccgccaccggccgggtcgacatcgccagacgccgagggggccgagaggcagaccaccgagagcacgtggagaaggacccgataccggagaaggcactgggagcccaacgtcggctcgggaatgagaagaagacgagccttgggaatggcggccgggttgtgcgacgagatggtgactcgaagaaaccggtactcgtcggggcgcgccggggtgtccacagagatgagacgaccgggagcgacgagggccgccgccgtggacgcgttccaggcgtgtgccggtacaccctcgaggtccagcgacaccctgaacggcatggagaaggaggtagccatcacaagccgggtccatggtcgtagaatcagctggtaggggggagccgggatcggggaacgcgagagcgcgaggtccatgtcaccggagttagcgaagacgatgaggaagtgatcgggctgcgcgcagtggacggagaagcggcctgcggggaggtgaagagcagccgacagcgccgcggcggcatcgccggccgacagcgccatgtccaggccgctcacccgggcgaagagagcacgccggagccggccctcctcctctatgagctgcggcgagcgctcgaccacacaaagcgactcgtcctctgagcgaatcggcgacgcactgaagcagagaggaggcggagaaggggcaagagccgccaccggcgaacccacaggcgtggaggcctgcgaggccgagggcgtggcgtcagagggcgacgccgcacggcgcggaaggacgcggcggccgccctgccgctccgatggcgagctcgggctgcgaggacgcttgcagtcgcgagcgaggtggttgagacccaagcaacgacggcaacgcaccgggagacggcaggtcgcaatctggtgcgccgacgacaagcagttgaggcaccggtcctacagctccggcggaataccggtgcgcgtctccgtggaggaaggcttgacggaggccccaggacggcgctgccgaggccagcggcggcgccgacgacggcccggcttccagtccccatcctgcgcaggctgccgagcagccactggcggtggcacggccgccgcggcagcaggcgctgcaggcgccgcaggcggcggtgttggggcagcccccaagacgcccttgaagatggaggctggaggaggcgccttggcgcgtcggcgcggcgccctagaacgctggcgggtcggagacgagggagggcgcgcagccgaggcgccgcacagcgaggcctgcgaggccgagggcgacgccgagggcgggcgcgcagctggggcgccgcaccgcccggccgagggcggggcaggccgtcccgacggtgcagcaggggaggcgggccgtcccgccgtcaccacgaccacagccggggaggccggccgcgtcagaggaggccgccgcgcgacatcgaggtaggaagggaggaagaagggagggaagaggaagaagagagggagagagagacttccttgaacagggacggagtcggggagaggtcgacccgcgaggccgggctctccggccgccccgcgtcaccagaggacgtcggaacgacgacgagggagcggagcgtcatcggtttggaatgttattttcaattgggaccttagggctcctttgattcaaaggattggcataggacttttgtaggatttacaatcctatggattttttcctatgtatgtctttgattcataggaaatgaaaggaaacattccttaggattgcattcctttagttcattttcacaggaaaataagaaagaggtctgacctctttggaaactttcctggcgcgaaagaagggcgcgcccacgcgtgcgcacgtcgtcgttggcgccacttttgtgtgtttggcggtaaaccgtggcccttcgcgcttcttccagaaaaaaagagagagagagaaagatgggaacgagaacaccgaggaccacatattagcagccaagaaagccaactgtgatagagatagacagcagcttgagccggccgctgggggtgcaaggcggaggcgaggctcgccggctcagtcgcgtatgcggcttccgctggggacgccggcccaacaactagcaacacgcagcaaccaagcatagcatccatctggcgcgcaggttgggctccgctaggcggaggcgtgcggcaggtccgccatcgagggcagcagccagggccatcgatttggtatttgtctgcacttttgagctttcatacttgacttattattgacttattagtgcttctgtactttggatctatggattagtgaatttttaagctgactacttggaactagtttgtttcattggcactgtaggtgtaaatccctctctgataaggattatgtatttcttttttctttctttttttttggggttaggaaagcaatgccatcgaaaggctcttctcagatgaccatgacaaatcaacgcaatttgtccgatcgacgagcccagcaacctctatcacaggtttatgttgatgttgacagtgagcatgggactgcagagcgtcaagaaataggtaatatttgcaaattcagtttcacttgttgtttgcatcaaaccttttttgtttcatattgctgctgaaactgaaattgttaaatgtttgtcaaatttagggacgacaaagagagccagatggagtcaccagatgaagatgttccttattgagctcctaacagatcatgacgtgccaggttttcgaacacaaaatgcttggagtaaggaagcatggacaaatattgtttgccgcctgaatacaaaattcggtacatcatttacgaccaaccaagtcaagcaaaaggagcaggatttgaagaaagattatcgcagtgttaaagatttgttggatcaaagtggttttgggtgggatagtgacagaatgatggtgagtgcaccacaaagtgtttgggacacttttgctgatcgcaagaacaaagatgcaattcattggcgagataagtcgttcccatattttgatgatttagctccactttatgatggtgagctttatattttttttatcagtggtttgtttgttttgttgaaatgttttaggcaagttatgctgatcgtgaggagaatataattgtgcaggtcgttatgctgaagggagaactcgccatggtatggaccattatgcaaggaagacaaagaatgcaccagctcattcaacacaagaagcaaatgcggttgatacatatcagtcaccatcccctaattcaaatgctccaggtgaatcaggtttgcaatttccttttggtgaagaggttgagacagccaatttggacttttcacagcattcacctacccctgtccatctcacaaaagtcccacctagctcggcacaaacaccttcagaggttcctgaatctcgacctgggaagaaacaaaagatcaaatctgttagtcctgatgatggatttcatgagagatacctaaaacttaaaaaagaagaaatagatcgatttgctgcaattgaggagaagaaattggaggatccttacagcatcaacaagtgtatcacagtgcttgaaggtttacatggtctacaaataggagatatattggtggcagctgatatcttcaaaggtaaggataatagggaagttttcttgtccttttcaagtgatgcattacgcctggcttggattagaaagga

SEQ ID NO: 61451 - DNA, 8062 bp, Oryza sativa
gtagtaggatagtacttttgtgaaatagatggcatgcaaatagaaggatagtacttttgtgaaacaaagggggtacttttgtgaagcagatagtagtaggatatacttttgcttagagggagtgcatgcaagtagttacttcattaagtagaatgtgacaaacttggagtacaagactagtaattgaccttgaatgccatggtggtcaaatgcaatatattatttccttcgtgctacgtaatggttccacatccgttgtgccatgtcatctcgttttctattcccagcttctctagagttgttaaattcttgtacatcaccattatagttctcgtctccatttggcacatcaacaatatgatctggatcaatctctaaacgacaattacttggccacaccaaatctccattatgcaggcgtatgaagttgtgtagagcacaacaggcaaccgaaatatcaacttgtttatgagctgggtggtgtgagccggtctttagtataggaaatctcatttttaatacaccaattgctctctctatatggtttctgagttgtgcatgccgaagattgaataactccttataattttgtggcttttgattagctctgccctgttcctttaaatgatatcttgtcccacgatacggtgctagaaactgtgttgtatttgcataaccagcatctacaagaaaaaatttaccaggaggtacttcaaaaccatggtttagtgcatcttgaagaactcttgcgtctgaagctgatccctcccagccggcatgtacatgtacaaatttcagatcgaagtcgcaagctaccataacattctgagaaattgtttgctttctattccggtatggttcttgctggtctagtggaagtatcattggtacatgtgtcccgtcaatagagccaacacaattctatacaaatacaaatataaccttgattaagtctttttatgtacaatgattggtttaactcaaagtaaaaaaaaatcaaaacatgaatctgttcatacctcaaaaaaggggtgaaattttggtcttctcaagatatgatgggggtgtaggaaaggtggccgtatatatacacatgtaagttgcttaactgcatcaagcacaaccccaaaatacttgcttattgtttgcccgctgtgttgaaactgatcttgcaaggtctcattacttgcattttttgctagtgcatacaagaatatagcaacttgttcttctactgagacatctcttgcatcagcaagtagttgtttctcacgcaacttatcgactaaagctcgaaaaacattaacttccatgcgaaaattccttttgcttaggctctgatgacctgttaagatttcattaacacgacaagcccctgaaagttttgatgtgtgcatcggtttcctactagatgatggttgtgacgaatctccttcgatggtagggagaacaaaaagcatgaactcatcttcattctgtgaccgtcgtcgataacttggatccatgacaatcacaggggaaatcaacaacaaataataaatctgatggtttggtctacaatatatataggagagcagaagcaagcaaataagttgttaatccttacatacataccaaaaagaaaaaaaatcatttatgacttaccaaatgaattgccacgtttgagctcttgtcatgcttggccgatacaatcgaaggtgaggtgagctagttttgttgatgtccagttgcagctacagcaatatatataaggacatgcaacggctagtacttgctttgaacgccaacggctatctgttcaaattcaaaccggaagagaaatcctgtatttttcctatagcactatcaaagggcacctttcattttttcctatgtttttgattcctgcgggattgaagaatcatactacttcaattcctgtgtttttcctattcctgtgtttttcctatcctgcgaatcaaaggggcccttaaggtatgccgttttctgctttttttatcttagtagcaaaccaaataagatgaatacaaatatttatcctatcaaacaatttgtagtatcaaaacttaattacctatgctaattttggcaccaccctagagatatctgaaaataaatgaagcatatataagtttgttttagccacacgtaccgtgcttctcattttcttcccttgctgcagcccgatgtatatgggctacgtagtacgtatatgtttcttcctctttgatctgcagcactcgcgcccgctggtgaccggcccggtcgatgtactgaacaaccaccccttctctctatgttttcagtgctatatatacggcaaatgttgagtagatcgaacgatgtgattaatactatatattagtgaaggatgggatgctagtagacattaattaaagagtaaagtttagaaaaatcaaagtttgcggaaaaccacatgtattataacgtgtgacacataactagagatagcaatgggacccataactcgagactcgatggatttttactctattagaagctaatcatgttctaactcttatagctatgggtctattgacggacggaaactcttacccattggatacgtggtatggttttattctttacccacccgtacccatagcctaaaactatgagcaatataagtctcaatgactactaaatcagcataaaactcatttcacataatcacatcttaagaattgttctagactagttatatatgaaattgttatttgattcgatcgccagcgagtacatacctcctgttagaatatatgattagatgcttaagatcgaatcatacctactgcactatacaattaactgtttggaaaatcagagtatagtatagtacagtaggtatgattagttgttgtttgtgcaatcccttccctaattgtgctgctatcccattttgcttgccttgctagtttgcttataaatctaagattttcaaaaatatctgaaaaatatttggaaatatccgaaaagttcagcttccatacttacttaaaagttttaaacgcctattcaccctcctctaaacaacatcaagatcctttcattgatcctcctccctttcacttccatgtgttcaactttgtgtggaaggtccttcaactactggaaagggcttgtgcatgctcctcgtctcacgaggatgattaagaaagtcacccagttgactcacaagttgcatctcaagactgatgtttcatcaggggctggtccttcctcttcctctgcttatccgagtatagtatagtacagtaggtatgattcgatcgccagcgagtaattaactgtttggaaaattgatgatccactagtgtagtttagttagtatagtacagtagttggagtcgctcttgaccgacagaagaaagtctgaccctttgaccgattaacaacatccacattgccattaattatatattacaatccattggagcttaattactctcaaaataacgtgttcaactaccggaattaggcagcattcatcgcgtatgtaaccatccgaaaatttcacaatttgcccttttttaaaacttatttcaaatttggtccctaccgaaaactatcaccagatttagaccccgagctcagcgccagacccgatggcgctgaggtagaacgcctcagcgccaaccgcatcggcgttgaggtcctaacggccatctaaaagcggtggggcgaaacggcccatgtggcaaaggtcagcgccaaccgcatcggcgctgaccttcgcgacctcagcgccaagccgccaacaggcctggcgctgaggtccccacatatccctcggggccgagccggccccaggccattccttcttcctcctcgcacctcttggttgagaaggcgtggcgccctcctctctctctcctcctctccaaaatcgagcaaatatccacaaaatcttcgtattttggagggaaaatcattgggggacatagtgccaaggtattctcctccgaatcttctcgttatttgtccattttttgcttggatttgctcattgagggatgaaccctagaaacacgatttggggtttattttctctaattagtttgttctctacattgtggttgtagtagttgttggcaatgcaatgattagatgcgcatagaaccgttaaatgtaggactatggtgagggtttaggcatttagggaagaaccctaatttttttctccaaattatagaagaaccgtatttattttattttaatcataatgtgagagttcaaattaggaatggatcctttgaaatggaagtttgtgtatgcttagatattaatggacaatttcattgggggacttagttgtaggttagaaaaggccattgtttttactattgcaaatttagcttttaaataagggcaatatgctgatatgttggttaatgtggttggtgaagattccatatggcatacgatggagatattgtgtgcgtatgtgatgcggtgtcgaatttggaaggagtctaaatttggtatgattggagtttgtaaattttgtttcttgtacgcgaaggtttcctaggtggattagaacttcttgtatgagtttggctcgtggctttaggctgcctacctcaagtataaatagagagggagcgtgaggtttcccggtatcacttttgagagtattgagttgtgagtttagttagggtttcgagtttagtcgagattttcgtgaggagtgctgttattgcactttgtaaacacagagaggagtgctgttctaggatttcactgttatgttggagggcttcctctagtcgcccattcatccttcgccgacatccaattcctctccacttcctctatatctcgggttagtttattttcgaaatgttcctcgttgatgatgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcgaaggcagaggttccggagacctgctctcccgatcgccggtgcacgccggcgagcgggatggagtagtctacgagcgacggcgcagtacagagtaggaagcaaaccctagattgattttgcgtatgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatctttcggaacgtttccaaaacaaaaacgaatccgaatttgcaacaaaacaaaactgcaaaaggaggctgtatctgcgcaagggtgaggagccaatttttcggaccattcgacgcgtacgtcgtgcacgcgcgccgcctgcccggccaggccaggcgagcgagcgcgcgcatgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacctagtgtgaaaacatatccactagtggctttgatctcatccacatcagagatccagttagaatcactataaccctccagtaccgcaggacacccagtatagtgaagcctcaattccacagtacctttcagatagcgcattactcgctcaagcgcacgccagtgatcatctcccggattagaggtaaatcggctcaacttgctcacagcaaaggagatattaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccctcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttaaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccacacaggtttacacccatagagtcgctctgtcacctcccaagttccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtccttgtctcttactccttcgaggagcttcactgacatcctcctcagagacaagttcatgtgtatgttcagtttgttctgg

SEQ ID NO: 61452 - DNA, 31484 bp, Oryza sativa
acggttgtcagccattgggtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacagcggtgaatttatccggcctcagtgcatcggcaaaaccagccatagtaaaatcacagtgcctataataaggtttttggattgttgagattatagacatgtaatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcgaaggcagaggttccggagacctgctctcccgatcgccggtgcacgccggcgagcgggatggagtagtctacgagcgacggcgcagtacagagtaggaagcaaaccctagattgattttgcgtatgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatctttcggaacgtttccaaaacaaaaacgaatccgaatttgcaacaaaacaaaactgcaaaaggaggctgtatctgcgcaagggtgaggagccaatttttcggaccattcgacgcgtacgtcgtgcacgcgcgccgcctgcccggccaggccaggcgagcgagcgcgcgcatgtttcccctcttctctccaccacacatgcttcaagcgactaggagggcatcctcccttttaaggaggtccccctctcctagaataagcaaagtggtactaaactccatatgcatgccatcccatgaggtgggcttttgtgattttccaaagaattaatcttcgagtgggctaaggcccattcattaattccaacagatgatttggatttgctagctccccttagcgagctaaagggattcgacctgggggctgagggcaacatgcactgacgcgcatgctccggcagcgatggctacctcaactacaacatccttatcctccagctgcaccaggttcctcatccagtcatccacttccatgcaactaggctagctgaaagttgcctccattgctgttgtttgtctgttcattgagactgtgcatgtcctctggccgtcttatatgaaatccatcagctgggcagctcccttccctttcacacacacataaaaaaagaatatatattattttgaagattttgcatttatatacatgattttaaaatattatcgaaaatattccctggccacgacttggggatggcatgggaccgttgctatgtggtaccgcggtttacccgtgccgcgacaatgcgcgacccactcccggtcacttaagcgcggcaccaccgtggtcccgcggctcggccatgcgccaccaacaagagccgaccgtgttccgaaatttatgtaatttggatccatttgaatctttcatatctcaattcaaattttaaaacttccatatcgaaattcaaaacattcagctgaatttttttacaaaattaactcacaattcgaattttgagttgaaagtttttaaatcttgagttaaaattctcaaatttgagttgaaagtttacaattcttgacttgaaagtcttcaaatctaagttgatagttttcacatatgagttgaaagttttcaacgagggaaggggaaagagattggataaagtgtgcgctacttttcttgtcatcatgtatgcactaaataggatgggcgagcaaatcgtgaataggaggtggggctaggaggagaggttgtggttgccgtcgtcgttgtcactccggtgtgaccggcaactacctctctctggtttgtatctagtgatgtaccaatgtgagggagggggaaattcaatggtgtattgtaaatgtagaaaacctggcgtcgggtaagttcataaaacttaccgagtggatgctgggtataccaaaggtaaggttataccagagttcacaatcttctttgttttcttgtcggtctgaccgccaagaaaaaaacttttcctcatggctagcagccaagaaaattagatttcccttactctctagacttggtggttcgccaacaaaatatatcgccttggcggtttttttttaacgactcgcacgagacggtgcgaagttctattgatagagcaggaaaaaaaattacaagattgcaaccctggagggtcgtaaccagaaaaaaagaaaaaatataggttttgatgttatccttggcggttttagctgccaagaaaattcaggtttcttatagtgtacgtaggtaaggtttaatcgagatgcatattttagatccaatgatccacatgtttccaaattttcatataggtataggtctcaactacatatttgtctcgtttattacgattcgcaacacaagcaggcaggtactgaggtacatttgtgtctcgcttgttagtgcaaaaatgacaaattaagaaagtgcattaccacgctgatcatcaccatcatcatcatatagtgaaagaagaattgatgttaacccacccttggttttttaccttgtgaatcacccctagcctttggtcggacgggccaattaatttggatcgctactattgatatcaattaaattcttgatgagccgtactagctgtaggcctaatcttttgcattctggagacatcgttgtttaacttttttttctttttaaaactttggagagcatcctcagccgtgcatgtcattactttgcttatgctttgttgtattcgaaaaccctcgcttgagcaaaactctctttatgcccttcttctgcagcacagaatatgagcgcacgatatatgtacacgcactgtccatgctatcactgttctcaatttaatttgaagctagctaccgtgcctgcatcttgtcaatgtgatttcccctgaataatcccacaaaccgcaataggtgtgaaaaaaatccccttcaattcctctctatagagattaaccgaacaagatctaattcaatttggagagaaagacttatctcaattatgtcgattcccggagagacaagattcaagcatagagctagttaggagagatatcagaaggccgcaacttatccttcaggtatatatatccgttcgtatatatataaatatagttgacataggattgtatgcttacatttcaataattaattgccagtaatgctttacttgcaaattaagtatagctaatagtgcatgcatgtattatgtgcatccttatctcctaaataagtaattaattaattaatactcttaagaaaaatgtccattctcaacatttaaaccatttccattttcttaagaaaaatgcatattcattcttctcaagctagaaaagtgagaaagatcaatctgcctattgatcttggaaaggtggtttagatctagcaaacttttgcagtacaatatgttgccactatatattggtagtatatatatgggtaaattaggaattttatagaaaattagaaagttgatgagttaatccggtttaattgggactcgttcatgcatgccaccgccaccgcttggtctcatttgtgcacctatgagagatgatggcacatgttgcgacgacatgattcctggccgattctaatcttaattgaaaatctaaaaagtttacaagtgactaattaccagtcaaataatgtaagttatatcatatatagcatatgtgtgtggaaggccttacacattttaaatcgtgctagctagctaggttaacacattcatacaacctgacgtgaaaccaaatttttttttatctagattagctactttctttttaacaaaaatgaccccgcggaataactgcaagaaagacaaattaacccttcaattttatactatgatctatataaatgaaatatcaaattaaatcgtttatactaattgtaccgtaaaagttctctagatctataacaatgtagggattaattgtattgcatataagaaatacaacattgcaaaaaatgtacggaggtgcacgtgcgcgatatataatcaattgagtaaaatatacggtcggttcttaaatttggaccgatatatgaataagaagaaatgaagaggcctgtgtccgtttgcagttttgtagttcaggtcaagcacaagatttaattttgtcacgcacgaggaattaattaatttcataagctcacccttaattagcgatcgaatgttatcacactgaaagtcaatttttttttattttaaactaaaaaaatgcccgtgcgttgcaacgaatgaaggcaatctttctatcatttatcttcttccatgatatatatataggcatttaaaattagagagtttatttttttgccatcaacaaccacctggttctacgaattgtcatcatcaaatgctagtatcatcacgagctccgttagcccttgtctaaataccaatttacccttgtaaactatagaacctcctctagttatgatagtttactcaaactgttccaattacaataaactctcttttattcattcataaccaaaaataaaatcagcatcatatttttcatcgattactgaatcaaccaaaacatatattatgacattaaaaaaaaaccaatttcaattattctacgatcacatcaggatacagattacaaaaaatggaggaaaaaaaataggactcttttcaaaaaataaaagaagtgggacagcagcgtccatatgtccattcagatttcagaccatttatagctccatacatgatatatacatatacaaaaacaacggctggtaagttgttcaatccttcaaccctttgttgtacgtgcttctctcagattgatactgctttgcaagtcgacataaaaaaaaacaactcaggagaactgatagaaccttggtctgaacaaatttaccaaaatatattccaagatgtttctgatttacaagaacaagtgactgaaaaccaaagcatatataaaagcacaaagaaagcatggattaattctatagaccgagctaaaataacgtaaggccttctatgcatattccatagaacaatagaagtaaataacaaaacctggttgataaaggagaaataaatcaacgatcacatagtcaataatctagttaagggggcaaggtcatcctcatctcatcagctcctactggttgaatctccttaaattatatccgtcgtcccgtccaattatttgattcctcaaaccgttaaaatacagcaaagggtgtgcatgcagatatgaagaaagaatccaataagggcctgtttagttcgcgaaaagaaaatttttggatgtcacatcggatgtttgaccggatgtcggaagaggttttcggacacgaatgaaaaaactaatttcataactcgtctggaaaccacgagacgaatcttttgagcataattaatctgtcattaacacgtgtgggttactgtagcacttatggctaatcatggactaattaggcttaaaaaattcatctcgcgatttccatacaaattgtgcaattagtttttttatctatatttaatgcaatttaagattcgagttgaaagtttcgaatctgggtttaaaattttaaaaatttgactttagatataaatttcattttcaattttttaattaaaaatatcctaactactaccatcatttatatctaactgtaattatactactaatagattactaacagccttagcgcggaaaaggagggtggccgcgtgcgcccctggcgcgcacgtgccgagtaggactcccccgagacgtgaacacaaaatcggacgcgccaatgacgtaccaaacaatactgcaaaatctttaaatcccgcgtcatacagggagggaatcggacaaaaaaaatcaagcgttatacgaggatgacgtactaaatacctggcaataacattttaatctattaactaactagagtaaaatacccgtgcgttgcaacatgtaaactaaaattataccaaatataaaatattatattattagggttgagttttccatgatatgggcctttaagaaaatatctttctagagaaataatgaaagttcaaaaaaaaagaagaaagaaaatgcctctttaaagtttagacccgctggtatgctagggcattcgcacgcgctgcccagcagtgttgcagcccggggagggaggccggcccgacgcgggatcaacctgagccgttcattttcatcgatggctcgaattgattctgatttcatcaaaaccgccaaccctaaccctaattcactatcccctttccttccccactgcgagccgcctcccccctctctctctcggtgccgcctctccccctccgccgctcctcctccccctccccggcggcatcgctccccctccacccaccgacggtgacgctccccctccacccacttgcggcgccgctccatctccctctcttcctcccgaccgtccttcccctcgccctctctctcgcctctcgtgcgatggatccggcaacagcgaccacgggtggatccaaccgtggtggtggcggtcgaggacggattcggtggcggtggctctgtccgacccctctcgcctccctctcgcggcagatctgacagcagtagcagcgtgtggcgacgcggccgggaacgccggtgaactgtaacatcccggcctagggcttaataggattaatagaatactcatatcaacaagttgcaacttcttttccggaagccaatctccaaagaactccagggttaagcgtgcttggcctggagcaatatgggatgggtgacctatgaaagctatcagatgtaagtgggcccggcctggaccgggaaattcttcctgggtgcacaagagtgaggacaaagtgtgctggagcaatatgggatgggtgacctatgaaagctatcagatgtaagtgggcccggcctggaccgggaaattcttcccgggtgcacaagagtgaggacaaagtgtgcagaaaagatatgtgttggtctgtgagggcagtctatgacctatgaaagctatcagatgtaagtgggcccggcctgggggaggcgggacgttacaaaatggtatcagagtcgactctcgcggtttcacgggcgcgtgtgtcgcagttgcgcaggcatggtgcgcatggctggtgtagaccgggagtggttacatagcatggcacatgccactggacacatggacgtggccaagagatgacgttcctggcctagggttgatcgacgggggcgtcgatctctcttaagggggtgagggtgtaacatcccggcctagggcttaataggattaatagaatactcatatcaacaagttgcaacttcttttccgaaagccaatctccaaagaactccagggttaagcgtgcttggcctggagcaatataagatgggtgaccgaccgggaaattcttcccgggtgcacacgagtgaggacaaagtgtgcagaaaagatatgtgttggtctgtgagggcagtctatgacctttgaaagctatcagatgtaagtgggcccggcctgggggaggcgggacgttacatgagctcgggagtgacgatgggctcgagagccggtcgcggcgaaaggcggcgatgcggacaacgttgaaagctatcagatgtaagtgggcccggcctgggggaggcgggacgttacatgaactcgggaatgacgatgggctcgagagccggtcgcggcgaaaggtggcgatgcggacaacggcaacgacgacgacggtggcggcgaccgcgaggagggcggctgcggggaggcggctagggttagggttaggctgaggaagacaatttataaataacttaaattcaaaataaaaaaacaaaatattgaaaacgaatttagagtccttatagaaatacaattagaaataacagattgggagttagaaatgtggaaatattagaagaggagtctacggtccacacacaaaggaatttatagaactaactgaaatttagaaataaaaaaaaataaaagtagagtttagagtccatatagaaatacaatttagaattacaaaaaatgaaaataaaaagctatctattatcttattaaagtaatagaaaaagaagccatcacgtttgctctcacgccctaaaaattcccatattaatcggagaaaaagaaaaagtagagtccatatagcaatacaatttaaaaatagctgaaatttagaattaaaaataaaaaatattgaaagagtagactagagtccatacaagtatacaatttagaattaattaaaattcggaattaaaaataggaaaactaaaagtagaagttagagttcatatagaaatgcaatttaaaattaactaaaattaaatattttttaaaaaagcaagattaggagaagagtatagagtctatataggaatatataggaatacagtttataaataacttaaatttaaaaaaaaacaacatatcaaaaaatgaatttagagtccatatataaatacaattagaaataacatactgagaattagaaaagtagaaatattggaggaggagtctacggtccagacacaggaatttagaaattactaaaagttagaaataaaaaataagaaaattaaaagtagagtttagagtccatataaaaatataatttagaattaaaaaaatcaaaattaaaactaaaacatattgggagaagagtctagcatccatataagaatactatttataaataactgaaattcgaaattaacaaataaggaatattgggaaaaaaattctagcgaccatataggaatacaatttagaaattactgaaattaaaaaaataaatattagaaaaagaagtctagagtcaatataggaatacaatttaccaataattgaaattcaaaattaaaaattaagaaatattgaaagaagagtttagagtccatatagaaatacaatttataaataactaaaattcagaattaataaaaatgaatattgaaagagtagtttagaatccatataggaatataatttatgaacaaaggaaattcgaaatttaaaaaaaaataagggatattaaaagatgattcttgagtccatatagaaatataatttataaataactatcacatatatacaatacaataaaaatatcacacatttgttagttcaaccaagaatttaaaattatgttgtcattttaatatattttaataataaaatgtgaaaatatttaagctattatatgagaaaaaaaatctaatgaggcaagccgcgggccaccatgctagctaacttattaaaggaatagaaaaaagagactccacgttcgctctcacggcctagaaattctcatattaatcggagaaaaaaaaacagagtccatatagaaatacaatttagaaataattgaaattcagaatcgaaaaataaggaatattggaggaggagactagagtcatatagaaatacaatttataaataactgaaattcggaattaaaaaataaagaatattagaagaagagtatagagtccatatagaaatacaattaggaaataatagaaattcagaattaaaataaagagtattagaagaagagtatagagtccatatagaaatataattaagaaataatagaaattcggaattaaaaataaggaatattagaagtagagtatagagtccacataggaatttaaaactaactaaaaatcagaataaacataataaaattaaaagtagagtttagagtccgtataaaaatacaatttacaaatagctaaaattcaaaattaaaaaaaacatgggaagaagagtctaaagttcatataggaatacaaattagaagtaactgaaattcgaaattaaaaattaaagaatattgaaagatgagtttagtccacatagaaatacaattagaaataataaaaatttagaattaaaaatgaataatattggaagaagagcctagagtctatatagaaatacaaatttacagataacaaaaattcagaattaaaaaaaaatattgaaagatgattctagagtccatataggaatataatttacaaataactaaaatttgatattaaaaataattaataactaacacgtatataaaatacaacataaataatacacattagtagtttcgtaaagttagtaaaaagtttaaaattatgttgtcattttaatatatttgtataatacattgagaaaacatatatcctattatataagaaaaatataatgatgctagcgcgcaatctacgcgggtcaccatgctagtttttataataggcaaagatagtcaatctagtctctcaagttttatccaaggcaatttgatccttgaggttttattagcattctcaaattaattagttggatctcaccttgctaaaaaaacttacgaatggaaaagtgtgcacacatacgtacgtacatacaaattatgtgtgtaaattcatgatttgtttgtgtgaatcaactcatatgtaataactaattactgtatgcaaaaaatggacgatcatatgcagggcgggtgcaggctagctagatagatagaagagatggagcaacatgtggaacggaatgcatcaagcgcacaccacctgagagatgtgtggctgagcattggagggacggtggtccgcattgaggtgatggcaatggtggccatctttctcaccttctacgccgtcaccttcggatcctgccgccgctggtctagccgatggatcatccaaaaggttttcctggctgcgaatgcgctgtctgtgtccctaggaacatacagcatagggctgatgcagtcatcgctggtgaagagcaagatgtaccctgtgtggtcggtgtcattgcttgccctctttgctagcattgactccatcaacacattcggcctcgactatagtggccaattcctgaagctgttgtatcagctcttcctctactttgggtatgtgcttgtgatcagcatctccggcaataccaataatggcatggtggccgctgcgattggcatgctttgcagcgtcaccctatgtaagggattccataggctgatggcctatgtgctcccgaccaggctgcggagcatgaacaaagagattgcagatcgtatggaagtggtgaagggggggccaaactttaacgcggccatcatgcaagggtatcaatacctggttgataagacttattatccatccataaccctggaagaattgtggaagcctgacaatggcatggacaaactaggaacagatgctgatgcctacaaggacatatgcctctctttctccctctgtcacctgctacagcgacgcttctttggttttagttgtgctgagtctgaccggccagagacccgtagctttgtgttggaaggcttgcttcaacctgtagcttcaagtagttcatcatcacaaggtactggtggttctcgtggtaactacgagagggccttcaaggtgattgaagctgacctatccttatgtacgactacatctacagcagcaacgccttcgtccattactatgaagctggagcttgcaccgcctgggcaatagcttcaatcctgaccacatgttttctatgtgaggctgttgccctacagcaaaaagaagccattattgcatcatctgcggtcactatgttggactcggaggtaattagcacaacgatgacaccagacattgtcatcacccttgcatactggtgtcccttgcttccctccaagtgttgcagctggtgaactccttgtcgtccaattgggcaagagtctcccttgtctgtcatcttttcaggagaaatgccaacaacctggagccatcgatgggcttgaagctgaggttgttcctttccaggatcaaactattggacaaataccagtggcagaacaagcttgggcagtacgagagctcatcgtggctcaagaaagctctagggtttgtcagcttcaagataggacaatgttgctataagccagtgtttcatttcatgctctactgcgtgcggtgcatgatgcgatggccaaccatttgctgcccatgctatgtggtgtgctctccgctctgcaactgggtgttcaaattgcagcctagttggcagttgctcccaggcccttgttgggtgatatactccgccctctacaagttgtttggcctgcagtacattcaacaggtgctgacagacatgttgggcattagcactgcaagctccattcagctgcccattgaggtgaagagtaccgtgattgatgccctcgttgggatcctcatgcccaggcccaaccatgacagtgtcgtgttgtccagtggatcaacatcgctagccaagaatggcttgcaggacaagttcataaggcagtacgcttcgacaagttaccatggcggtagcgctagtaccattatccccgaatcaaagggcaatcaagccagcatcatcttgacctggcacgctgcgacaggttgctacgacaaagactatgagcaaaggaagaagatgaaggctactacagaatcgccgctacagcacaggcagtatcgtgttgtggccaccgctctatccaagtactgcatgtacttggtagcttatgtgcctcagctgctgcccgggcagcagtcctacacaacatctgtctacaacgattttgtgcgctcgccgtcctacatcttgcagagtggtacccagctgaaagatgagctctgcgaggcggtggtggaagatgaactgaggtggaaggtgctagctgatttctgggtcgagatgttgctctacctcgcgccttctgacaatgtcacggctcacatcgagcaactcgcacaaggtggagagttcatcacccatctctgggctctcctcttccacgccggcatcctgtaccggccgtacaaggaggaggaggagccagctgcagccgggacagtgtgacgaataaccacttaattattaattatcttgtgtttagcagtttgtttccatactttttatgtttgtagatgcatgcaagatgctgatttgcctgcgggaatcccaaaaatattgcaaaaaggaaacggataattaagcaagtttgtagtctcttctgtccactctagcactagcactgaacactgatgagatgtagggatgaatcgtgctgcgtgtcgcccgcggagagggggtggcggacgctccgcgcgggagaccgacttttccgttttttttttctttttctgtgttttccgtttctgttcggttggctgttttttttttctgttcaaattggttttccctttttttttctcttctgtttttttcggttttttagatgtatgaatacaaattttgtattcgtacatatacaaagtttgtatacatgatgcaatttcttgttttttttatttttttaatacgtatatatataaagtttgtatatatcgtacacaaagttcgtatacatcgtatacaaagtttgtatatgtcctaaataaactttgtatacatcgcatataaacttgtatatatgtatatatttttatgcattaaaaaatatttataaatatatatacacacgtgtatatatatatatatatatatatatatatatatatatatatatatatatgtatgtatgtatgtatgtatgtatacgtatgcatatgtagtatatgcataagtatagtagatacagagaagagactagagggggggggcgaactgaccgtgcgcgtgccggggcgcgcggctgattgcgtatcagcgccacccatatatgtctactccaatccatcaaaaatctcacggatggtcgcctggtcggttttctcccacgatgatcagtttgttggagcacacacacacgccactgaaataattgcatgccaaagcagagtaacatcagagaagctcccggtttcagtttgcccctcctccacagccacatcatgggccttttactgttacaagcccatatgtatgtattgattgtttgcaaactcggcccaactagacgggccgcacattcctcaaattgccgttccggcccaactagaccgtgctgttggacaacatatggcaccggcaacaaagcgtttccgggagttttgaattatactagaaaaattacccgtgtattgctatggaaagctaaaattataataaacaattgagtagagttcaattttcatgatccaagtgctttaagaaaatatttttcatgttgcgtgcgaacacaatctcgtgtcaatgtctagacaccaggtttttttttcaaaacaatctatttcacattacaacgggtaaattattttatttgtacaagaccgtggcacaaaaaaattgaatacggacgtactgttacatacagacatgaccttagtggtgcgcaatcatttctcgcaaattgtgttcttcactcgagctgatcttgaagatgaaagcattgtggatattagagatggcggtgtaatcaaacatcgaaacggtacctcggatataggaaggttgttggttattgttgaactagatattcagaaggactagataagaatattggtaagggtttattgcaaagattattatacttaacttacaaagctcgcattcctcgcaacagtaaaatcataatcacaagccgatcagacaagattgcgaggttaggaaccacaccacctctcagattacagctccttccaaaagaagcttactggtacttcttcaaggtgtgcacatttgggagcatggatgcttcagagcatcctgaaattgcatccgtagccatggagctagcaatggagtctgaaaggagcttcatggttgccaatgtctttggtagattactgaggtcgaataccaacacgctttactggagattggttcttgcatccctaagagagttcaagaagaagattcgagttgttctgttaggaggtgctgatcagcctcaaggaagatttgatgcacttggatggaaatcccagatagcacctaactatagctacacgtatagctgtgagatacagaggccaatgtgtattgttagtagataaaccttgtgtgtttgcattttaaatttctgttatgcatgcgcgcgagctccggtttgtggaagccgtgcgaatagctgtcatgccgcgagaatagctcggcgtggcgctagcaacggggagtgcgcgcgtactgcggatccgtggggatggacacgatcaatccgcgacgtgggaacgtttctgaagcccatgtttctttctgttgcatacctatcccctgtattgctctgttcttcattttcggatcagctacagtgcgtttgcaaagtgttcgtccaggtgttcgcgtgtgttccactcgccgattcgttgggattttcctgacatgtatggtcgccaggaagaagaaaatgcagaggaatggcggctgaatggctgaccatcttaggaatttatctgatgcactctagtattgttacatgtaggaattgtgtctttatatgtaacctctaatatgtaaaactttttccgataaccaaagaaaatactccaggcctctacatcccaagtatacatagttgttctcttgtggtggagcctattcatccgagttaaggaattaggtatggtgctcacgtttaaggctattttttttaaagtagtaagtaaagtacccattgacagcaatgcgtctgtgataactttatcaattgtaatatatgttggcccaatatctgaaggtgcttatattgatatggtttgcgtgtgtacatgcatttgtaagcatcggcatttgaactgtactttttattaaaaaaaaaagtataacatatatagctagagctaatattcattttgcatcacattcaaagtgagttttttattatgaatggttattataattgttattttctggaaaaataatattatggttgttttaatgtattctagtactttctcttgatgataaaagaaacttgacataaaatgagtgtcaaagagaaaaaggcacaaacggactacttcctgcatcttaaaataaatcaatctaacataaaatgggagtttacttagtacatgaatatagacagatgtctatctgcattcattattatataggtatttccattctattttaggctcgcttattttgggattgggacggaaggagtagtagagaaagatgggaagcacactgtattgaagtgctagaagatatgattgaggtgagatcttgtagtggtaaaaagtaaattgcagtattggaagaatacacataaagtttagagtcaaaatgttgaacttttaaaaatctatagcgtttcaattctggaactgagaatatttatcttgtttttttctgaatgaaaccagcacaagattgtgcttattcattaaatatagcaggagaaaaatacagcccctaaggaaaaaaggaaagcaagaaccgggaaaagctgtacactattcaaagcgcggaatagttgaggtttgaggttgcggcctccttgtgctcatatatccaccagtttcgctccatccaaatttcccaaacaatgagaatatttatcttgtgaattacacatagcaagaaacaaatgtatttgtttaaaagaatcaagaaacaaacgtacaaaagatattttcagtaataaaattttttaaaaataaaacatgtaggtatgatgtgaccactggcatgactagtctattttggtcaaaaagcttgcaagagaaacatataaagtcaattgaccgacctacattgttgtttctagaaagcgcaacaaaaaactgcacatgaaaatcaaaattacccatccagtagttgactgattcctatacatggaaatcaactttccatataactaactgcattccaagtcattcttccaaatctggctacattaagacggctaattatttcatttaatttgtggcagtcatctgcgcaggggtatacaagactattacactacagcttcgttattcttggattaagataaaaattttaactcggtttgagttagtgcttccgaaattactaaacaatctagacattgcttgataatattagataaatttattttcaaatttaaatttattaatacttaattaattatgtgctaatagttttttttcattttatgtctggagtttgaacgggacaaattaggggcgtgttcggtaatcattcctttacgctgcagtgcttgtgttgtgcggctgcagctgcagaaaataccagccgaataggtcctaagacaccaaaatccagccctgcctaattggattgggcttatcaacacgccaggccttacacggcccattacattgtttggaatgcgtgaactctacttttttttaaaaaaaagaaagaaaaatgatgacaaacaattaattcacttctagcaggagcgtacattttttttaaaaataaacacaatgcaaacatagatgcttaagtgcatctccattctaagcatgatgatcgtacttctgaaaatggtaaaggaaaaatacaatcatccatggtcgtcgtggttttggcattcaccatggacaagagcaccctaaaatattaaatgtgagaggaaacgctattaataatattgttgtgtggtggaattatatatgttgtccataagtgcatttttagttggtactggtagaaagtagaagcggggccagacatgggtcaacttaggcttgagcctcaggcttgactcgaaaaactccatataaatcctttagaaattatatagacatttcaaaaatatataatctctaactaaagttgtcatatttagtcttacaaatattttttgggctccacaaagaccataagtaatactccatatttttatttttttacaaaagagacttatagtgaagaaaatagaaaagtaattaatgggccattcaatctttatcatccatccaaacatctaatccaatacctaaaaacccatcagatctttcaccaaaagatacccaacgcccatctaatccaaccgcacgtacgagagcactaattaacaagttttttttagcatgatcaataattggggtcatcacaacacaatgcacctagccatcaatacatgatggaacatctaaaggtaacacactccaattagacaaatcacattagccccatatcatggaattaattaaaaggcatggcactttgtttttactagtactaaactagaagctactactaccaaaaatgggaggtatgttggtgccaggtggaagacaggtgggcccccaccaacccctgcaaagggcaagcagacatgatgggcctcgaaagcgtagctccatgccagtttgtgggccaggcctcttcttcttcttcttcttcttcttcttcttctccattcgccggcaaaaagaagagaaggcgacttgcaatttcagctccaatccgaaatggagatggccaatcaagaaggttgtggtgggcccagcatgtggcccaaaaggcctaccaagattaagaaaagaagttgtaaaagaaaggaaggaaaaatgaaagagaaagagcttgttcactttgatgaaaaaaaaccttaccgaattttggtattaacttcctttcaaaaaaaaattttggtattaacaaaaaaaccttaccaacttgctaaaattttgacatgatttcttatatagttaccaaaatttggcagcaaactaaatgtagccacttttttggcaactttatcaaaatttggtaaggttgaaaatgacatcaaaatgaaaaggcccgaaatttactcaacagcaaggctaataaagaaaagaagagatttggtttctagagagagaaagagaaagatgtctccatgatctttgctctagatttctgttgtaatatgatctctcttttttaaaagggcaagggtgttggaaaatactagtgattcttttatttcctttttcttgcacttatcaagcagcctgccacgctgacctgagaactaccggaaaacaagtgttgtcaaaattgattgcttcctgcactaaatccatagagactttttaaggtccaacagtactttacggtactaaatcttggtcgttggatctggtccgatccaacggctggtagtgtttggtaccgcgaggtaccaaatatgtccctattgcggtacctctcgcgtagaagagaggtggaagagcaaaaatgtaactttgtgtgcgatagatgggaggaatagacgggcggaaccaattttgtcacattttacatcctcttctgcgttgccgtcgcgtttctcttccccccgccgccgatgtgttcctcttccgccccaccgccgccgtgttcttcttccgctgccgccatgttcctcctccggcgccgcgacttcgatctgggcccttgcgccgaagcgagatcgattgcggcgtgcagggttgtcccctctcttctctgggattcgtggtcctccgccagtcactgcctggattgatgccatcaacgccgccgccgctaccgccgcctagacgccaactccgccgctgccgggatcgaccgccgccgcctcctcctggacgtcaactcggccgccgctgggaacaacgacttggacgccaccaccgccgggaacgacaacttgaacgccgcatccacccttgctcatcttttttctcccgctcctacccatcccagattcaacggttagatatcgatgtgttttggtaccgagcagtaccagtaccgaccggtacaacctgctggactgtaaagacgctcaaatctataacttaaacatcgcgatcagagtctacttagtgagtggacaaacctgttgtcgcagacatatggccacatatataggtggcctttttatttttctctctttttctctattaccttaaaagagggagttttatatgtatccgctacctttccctatccacacgacgcacaacaataatattagattatattagattgtatgggacatgttttgttgtttcatagcaattcataggtagactaattaaatgaaaattaatatttattttttatatggcgcctgccacctggtgagggggagaaggcatgtgttgctttctttttttttttggttttgtctgaactgatgagactataatactcttcatttctatcactggaaatggggagcaatgctctcctagtttaaaaaatatatttttttaagataatggaaatgagttacatatctaacctctgtaagatagggacataaccatagtattcagttttctaataacttgtatagaaagtatttacatgaaaattgctgcgcaactataactatgcagactatatatgcatgcacttccggaaaaaagaacaaatatatgattgatacccatgtatacataatgcatatggtgaaaccgtgaggagtcaaagtactgtcaaacatcagtttctcaaattcctctgaaactgttgagccatctgaatacagaaagagggagagagaaaggacacacagtactaccactgataagggaaaacaaaacagtagattaacgaataagcactgctgatgcaacttctgcaatcatcatgtccagggagctaaaacgaccttactacccttgccactattggccgccatatatcaatcaatccttttctctcttttgtggaagaagaagaagaagattaagatgctggtgttgagtcgtgtggcttttgctactgatcagattgttcagttcggaattcagataagaaactcatctcaggatcagacaaacaatgggtgggtgccagttcagaaagagagaatatatacggcagcaagtcagcaaccatatgcagaaaagagcagcatgctaatgtctttacaggatgcgcataaaatcactctttttcagttcttttctagcctagtaaagattttatgccttggggacagatgagattattattgagatcagaacatcatgctaaggatctcatcttcttctttgagcatccgaaatataagtctaaataagctagattccatattttaggactagcacaaagcttagactatatattcctaggatttcacttctccatgccaagtaaaaagcacataatatatacctcaataatacatctaaaaaaaatatacctatccaacatagtaggatttttctgggcattttacaattctcccatatcagtccagatgttaaccattttttctcttgaattccttcatttcaagctacatgtgcatatataggggaattaatctccctgagttaattttgaagatagtattttgtagtaaaataaatattaagtaataagatatgactatgttcatggcatgatgcagagtttgagatatttttactccattatttatttttgaatgaaccgatatcggcatgtctatttcattaaatatagtaggaaaagaaaaagacatttacaggtgtaaatagaaaaaacatggttacactgtaatatttgccaaaggactaagatatatagaaaggtgactttaccattctttaaaaaagtatcaagatgtatcatattttctagcgtaaaatttagtgcttttggatactaggtaactcgaggttgtaaaatttaggtttctcaataaagaaccgtaaaatttatcaagatagaaactagtcgctttgcgccagccatgcatctttttactccattatttaggatgtcaattattaatagctaagggaatttcactacttgtgtgatgcattcgatctctccattaacaagatggatgtggacctttgatgcctatgcaaacaccatgattgagtgtgtccatcaagtagctagtcggttagctaggtcaatatcttcaagttaaacacgtacaaatcgatctatctagcttcatctctttctttctcttccacagtgtcaaagacaatgtgtcggcatggcagacagctaccgtccgacttgaaagccatatatattactaattgctttcttcttacttaattattctatcctaattaaagtaaagatcgagataataaacagattaaaactattgtcgagatggattatattccctccttgggtaatactattaacatgaaagagaaagagataattaacgatggagatatatatacatacggatacacttgagcatcaacaatataatgcaagttcatgggcaactactacatatatagctgactaataagagcaagttcaatactatagccaactactagctccaattcatctatagccaatctaatagctcattcatacaatagttatatactacactattaatacctagtcccacatgtcatagacacactgcgtcttggagtccgtgctacagctggctataaatctgtagcccgctgctcttttctctcctgatttatcttcttaaaatatgtttgcagctggcttatagcctgctattgtacctgctctaatagtttaaattatttggttttggaggagtgtgtgtttagctttcgttttcccgggacttttgctgcaacagattgcaagggcccccatgcttgaggctgacacgacggctgcaattggccaaattcgagtgtctctctcatggcgcacgcttattagctttgcattgttgcccactaattaattaatctgatccattacatgagtaaaaccaaattacaacttgtgttcaatttatccaagtcgatcgatcattgattaattaacggcttgttcgatcttcatcgatccattttaaatccgctagttgctaattattaataagtttcatatgcttaatatacttttacttagtgcgtgctttttgtttatttgtcttatatatacggagagagttcaagtcgttttcctcattgaagctattttgtatcaacttaaagttttttgtacattctaaatacaaagacatggaatgtaactgatcatcttttaatttaattcttacctaaaagtatctcaatcatcgtaggatacacacaacccccatttgatggaggcactcaacctaattaaaaacaaatcaagatgtatatatatactagaaactaatccatcaatctaccccccatcaagccctaattaacttgtcacttaattgccgttaccgatcaatcaatcaatacaaataaatccatcgtccatgcattgcaatgtattgcatccatatatctcgattgcgagtggctagctcgacgataaagttaattaactggtcgacgccatggcatggcccagcaggtctctcgatcaagatgttgaaatggaagttgaagggcaccatgaacacaataaataaaaatccccaatttgagatgctgaaagagacttcataattagcggtaactatgatagcggcacactatgtccatcgccgtagtttgtttttgacttttcagtgccctattcattaccgtcactatatactagtacgatttaatgatattcccggtgataagaataataaataaattgcatatgattgttaatatatactccctctgtcccataaaaaaaccaacctaatactggatgtgacatattttaatactacgaatctagacatacctctgtccaaattcgttgaactataatatgtcgcattcagtcctagatttttttttggacagagggagtatatgtcaattaacttatatgggaagctcgttgttttcatggatttccaccaaccaaactatttggtgagaaaatgatcattcctaacctcttaacataaatgtgtaagggttcgttttccttccttcctaccttcacctctagtggagatgacgtaatgccaaacatcggtgccttagggttcaaaatgaagagcaagagttagggatcatacataggtgcagattgatatatagtgagattgtatgataatggcactattgaagctatcgacgaggaagctaatagttggtaggctctacaagatctataagaatgagtggttttgaagcgacacctaatggtgccaacagctagacattgctaaataagatgacgaaagggagctagtaaatggaagatgcatgtttgtccgcaatgagagggccaacaccaatagtaattttgtcgaaaatgttcgagtggtttctaggagaggatatatataggtggtcgtggctagaagtaggagagggaatggctagaattgtatagggatggagtggcgggcttgaaccattcgataacacaaattcaatgccccaaaatttaatatagttctttgagaaaatcaaatagctgtaacataaaatccgatatatatatatattttttggtgcacgattaattgatcagttgtcgcagttttggcactattggaaactccaagtagaatggcatagctcacctccttattaaatgcatattactgtgcacaaacatgtggtttaattgtgcaaatcataacacacaccacctgcaacatgctgatggtcaagattctatttcatgtctcagatgattgtgcagttgcacaagtacaacacacctgttgctctgatggccctactaaaactcttgacactgttttgctacatgcatgtaaaacaaacagctgcaagattttaaaattagcttggaacattccatttccactagaacttcgtttacacaaaaggaggaaaaaaaacagaggaacatttcactaaagcatgcaaagacaaccaagatcacaccattaacacaaataattaagccaaacatatatttataaaagtccattggtatattccactgatgtaagtatgaacacatcattaattacaccctcacaaaaaaacagcgaaattacacaaggctcccctcgacaaccctgggccgtcggatgcgtgatctacggtagaattagcatcaaagctaaaactcccttgggtctacgaagatggaggttcccggcggcgccttgctccagtcgccgagcgcgccgtcgccgtagccgtcggccagccgcttgatgcaccagaggtcgtcggcgccgaggcgcggccagtgcggcacgccggcgcggagcggctcgcacgcgcccacctcggtggccaccacgcgcgccccgccgcgccgcgccacgttgtgggcgtgccggaacagcgcccgcgccatgcgcgccgccgcggggccgccgccgccgaggccgtagacgaagtggaggccgaacggctcgaacaggttcgggatggacgggatgcccagccacggcgcggcgcggtcggcggcgcgcgtcgcgcgggcggccgcgcgccacagccgcggcgcgccgcgcacctcgaggcggaacgcgtctttgcagttccacaggctggccaccgcccacgacgccggcggcgaggccaggaacccctccacgccgcgccaccgcgtcccgcgcggcacggccaggaacgtgccgagcgacagggcgttggagagcacggcgtcgatgtcccgcgggaagaactccacggagccgaggcggcggcggtacaacagctcggcctcgcgcgcgtcgaggcggacgacggcggcgcgccgcgacggcgcgaggtcgtggccgaacaccgggtgcacgagcaccgacggcgtgcggaacttggcgtagccgcaggcgccggtgaagaggcgcaccgagggctcgttgtcgcggtcggtggcaacgtaggcgtactcggcgcccatctcccggaaccactcctccatcctctccaccagcctcctcccgatccctcgccgccggtggcgcggcgagacccggaggccgagcaggtacgccaccttggagaagagctggctgcgcccgcacgccacggtcttgacgcagccgcgcacgacgccgacgatctccgtgccgagcgggccacccacagcctccgcgacctgaaaaccacattccaatacccgatccagcaccagtgtgaggtctcgcgatcaacaatggcggacaagcaacgccccccgacgagacgtacgagcatgaggtaggccggcgagtggcggacgcggcagagcgggtcgccgaggaggtcggtgaagaggcagagcttgccgccgctcggacccacctcgcaggcgcgctcaaccagttcgacgccgggacggtcgcggccgccgtcgaactcccgcaccaggaccacctcgccgccgtcctccggcaaacaagccaccgccatccttgctccgatcaatcaatcaatcaaatccccttcttcttcttgatcgatcgagcggtgcgttgcaatttatagcggcgatggagtggcgggagaggagaaggcgcgcgcgatcgatggagatggaggtagtggcgcgagtggaggagtgggggagtgataggatgggggccacgtccccactttcccgccatctgtacacctctctctctgtgtgctccgggtggggcccacaccccaagttaaactgccccttctgctgctccatgctaaaactggatcgacttgctaattatttgtgtgatttaacaatgattagtgttgttggagtactatcatttttggctcatcagattggaggagtaagagagagctagataatgtaagattcgatagatctttgtttgctgctgtccgatcttgtcatgattattagggtaattaattagttgtttggaaattatctcttttctattatcatactcggggggatttaggagaagttattttctttttctatcttaattatattgaatgacctcctctaatcattctcacataagttatctttttttctagaaatataggagtatatgacatgttgaaattttgtagccagtattttggataatctttttccttaaaaatgaaaatgtttcacatcttccaatagacacatgttctaaaagcccaataaaaagaacttttcaattagagccagaaaacctttcaaaacaataggaatacaaaagaaaaatgtatatatcacaataataagagactctcggttatcctctatgtcgtaatactatatatccaactaaatataaactcaccacatgagtacaaaattaaaaccgacggctaatgaagtcagtcaaacacaacagtgcatacaatgactaaattatttggttggttagtctcattctctataatcggctgttatatctaaacgtagtcttgtcgctcgtggagaaagaaaacacatcgctacttttaatattgtcgttgccaatcaaataggaaaatataataattaagacgaatgctttaaaaagcaacaagacgttgcagcggcgatcggtagctaacgcaaaacaaacatttggtctgagttatcttttttggaataataattaaaaaatggttcaaatatttggcctatgctaaataattacccatgttgtaaatgtcaaatagaaaactcttaaggttatgggagttaggaactatctttgacacaatattagaaacatttcaaaataaagaaaaagagagtatcataataattagaaactctcgatgatccaaattatccgactgaatataacctcaccacatagaagcaaaattacacagctatatgcatcacatgatgtagaggctgagatttttatttgactatcttaaatatattgagtacaaaattgcaactatatatggactaacgaagctagtccaacataacaatatatataggtactacatcgtcatttggtcggttaatattctaatcaagcaggtctcactccctataattctatattatatccgagcatatcctcatcgctcgtagagaaagaaaacacatcgatacttttaatgttaccgttgcccatcaaataggaacggataataattaagaggaacaattaaaaaagcaacgatgaggacgacgacgaggaccggcagctaaagcgaaacaagacattcggtcaatcggctgctaatttcctcctgtaggtcgatcgatcatggggaagaagagaactgtgcatcgaccatgacaacaaacctatctaatatcgatcgatcgatcgacaaaattatcggatttatttatactacacatggtggttcgccatttttctgttgatcacacctgcaggtgtagtgtgcacacgtcagcattcgatcgggtggccgcagcaaattaccccgctctctctgtccccttcttccggaagatctcgtccgtccgatcagcagcggacggcccggatgacttgatggagtgagtccgggtggggcccacaagggggtagtggtgggcccgcgagagagagagagcggcggctttggctgcgcggcgacagcggtggggcccaccggagtatcaacggtcgggaacgcgacgacgagagccacttgcggcggcgtacgtggcggcggcggccgccgtcgatttggccgccgtacgtcgccgtcgacgtacggacacgcgtagcgtagatccggcgcatttggcgccataaaattaaatctctctctctcggagagcagtagagagatgatggatatggatggatggattggtcgagaaattgaaacgatcgatatcgatggagttaatgattagtagtgttgatgacgatgattaaaggcgtactagtgattgatcgagatgatggatcgagtgtagtacgggtactggtactagtcaatgtgagagcaagtttaataatatcacccgctgttagctgcaatttctttccatgtcatctgtagccaacatacatactaatatatacaatagggttagctatgtatttatcctccttttactgtagcaaatgatatttaattgcgttgcgccaagcatctcctctcccgcgcaaaacggacgcacttttttcttggagtacgcatatcggcgggcgactatttagtcgccggcctgtactctctctcatctgcgctcccggccaagtcatcaacagaacttacgtggcttgtttatcgccggcttttctacccctattgaacctgctctgatgcaatgcaaaatggtgtgttatatcatttattaattgcaggaatatgatggagcaggacataacgtgtatactccctccgttaaaaaaaaagacacacctagatttccgtgtccagcgtttgatcgtctgtcttgtttggaaaaattataaaaaaaatttaaaaagacaagtcatacataaaatattaatcatgttttatcatctaccaacaataaaaatactaattataaaaggatttcatataagacggacagtcaaacattggagaaacccatagtttgtctttttgtaggacggaggatacgatcaatgaaaagacgctccatcaaacatactagtatacgtatacacgacacgacgggatcggcctgccctacatcattattttgctgctttctcaaatcattataaagacaacttttcatgatgaaaaagaaaatccattttactccactacactatttaaatgatcacttaatcacacttgaactatttttttctcagtttacccttaaactattaaatatggtttactttacatattaataatgtttctcttttcttgctcttcatatacgttgtattttaagtttattttttagagctatagatgacatcattattaaagttcaaaattattttcaaaattttcttggttgtttgcttcaactttgaaattttaatatttaaattaaccttaagtgctttcgaactacataaatagttagacaaatttacaaagatgttcagacataagttccgaatgcatatgcattctaccgaattttcagtgcaaaatatgatttgtacagagtgaaacaaaaaaaaagagaaatagtgttatgggagttaactgaaccgttttcaataccgataaatagtttaggggcttaagtgatttggtggaatagttcggaagagtaaaaataaactttttcctttcatagaactacatagtttcatttctaccagcgggccataaaaaaggttctacctatattttgctttctcaaatcattataaattaaagatggcttttcctgacacgtaggtttaatttctaacatcggaccataaaagaatgattttcgtagcggtgattatttttcttaagtagccatgaaaatttatgaaagggtcatcatgaaaccttatggacgacctctctctctctctctatatatatatatatatatatatatctcttttcttgcttatatagttggtacccactatatcatttattgctataaagtttacaccatgttgtgccacatcattgtttattatgagccgttggattgttctacgaatcctcagatcaacgatatcgctaagttgggccggtattggctcagctcccgttggactttttagcccagcccacatcacgcatgcttctactgtgatggaaaaaaaaaaccaaaacacatctgcatcatcagcgatgcttgcgagggagaaatttgtgatgaaccaggatgagtacggcatgggagtggggacgcgagcgtgcctgttgcatggtccctattggctttccccctcattggcccgattaattggatgtcactccatgtcttgccttagtttatgtctcttctttttccttggaaactgccttaaaaattcaccggatgaaatccgccacctttccctcttcccctctcattttgttaataaaaaaattgataatttattggaggatatacttttagtccaagtagagtgagaaaattttcaaatagatgagaatcgaatgtctctgggcgaccacatgcttctaacatagtgttggaataagaatttaaaaattatgcaactctaaatcttccatcactatcccaaatatgttacttgcatgcattatatttcatcttcactctaatactaagttagaagacatctttggtcttagggatatttttgtcttttaaacaaattcttatccaattaggttgaaaatgacctgtaacaaattatcttttttaggtgtcctttatccgcgacacttttttacaacgtctactagcaaatacataaacttaatttgatcatcctatagcaaaatttacctcactttacgcatgcctaaaataacttatatatgcttgttt

SEQ ID NO: 61453 - DNA, 18023 bp, Oryza sativa
cattagcagtcaatgatatatgaagtatgatccaaagctagactagaggatcattgttgagcatcctaatttggacaaactatgatacacacgcacatgtacacgtagtactaaagcttacgatcatatcaggtccctaactaataattaatctatttgtgctgtttgtccgtacccgtaatatatacactataaccatcatatgctgtttccataaaaaaaaactatatttagttgcgactatgaagaatctctcgtgctaactaaaatgcatgattttttttcattaattatttgttagatgaatcgtataattaccaatacaattaaatagataatagaaaaaccagtacgaattcatgggttaccgatcgagatgggtaaaatttgatctaatcaacaaatgagtgatgacatacccctctgtttcataatatagcaaccgatcgagtacaaatatatcacgtcctatattatattgctatattataaaatggaggtagtatacgcatgtgttggaccatctcactagcaccaactgaattttggttctcagtcaggcagaatcagtacgtatattggcatcgattgagactgtcctaattgaggtttgactggtccaacttccatcttagctagcttgtccctccacgattgatagtactattacatatatgtacatagatcgtttggtacagatcatgcatgcatgtacgtactcacaaattaattgatcgctagcatagctccaactaatttgattgagctagttagctagctaaatagacacacatagctgaaatataattcatttctttttagctcgaggtagcatggaaattgacacgtacacgacttgtatatatttttcttagatatacaatgtatatatatggctcaactcgcatgcatgcatgcatgaatctgcaattcatgtaagttaagttgcatgcatgatgcatggtgctgagattagccaccatattacacatagctaatatatatagtcctctccgtcccacaatattataatttcttgtatctatgtacatagccacaaagttgttacatttgagatgaaggtaggtgcactaacatgtatgtccaacaacgaacaaggacagatccaaatttgatgaggagggggcttattttcttctttctcctacaactccttgttattctttccttccttatgtcctctctatgacgatgatctaacagggtaggaggggcttattactggagatcgtgtggttgtaacgcagaaaatccgaaggtgccaaaaccatgtgagtcatgttctagtagctaataaggctcaaatggagccccttacgaagttctggctatagaaagcaattgtaatttcatcttacaacttgttggtgaggactctttagttaagtaatatacttatgcttttctccacaaaaaagcagggtgggaggggcttgagctccccggcatccatgttcgatccactacccctactgacaaaataggtaaaatagatgttaccagtctcatattaaaacttaaatatgtaactcctccatatctataaaccttaatttcccaagcagcgtaggtatagatttaagtatgggcaaaggatatagccctacttacaagttacaactataattagttatgctaactacccaggtggcgaaggacgacgatgagaatgagatatatacaagcaacaacctatttcctttatgacaaagtattagctagctgctgctgattaatcattacgttttttttatgatatatatacatgcaacaagctaacaagcgaggcaaacgtagacatcgatcgttctgttgcgcttgatttgatcgtgtgagtgtgtactgatctattcttgcccgaaatgggcctaatttgtttgggccctaagactacagataccagatccttgaaaagaaagccttgggccgcttccccttacctctctatattgggccatgaaagcgataccaaagatatttggaaaaagtacaccgaaggtccctcaacttgtcatcgggataaaaaacgtcctcgaaccgtaaaaccagataccgcgggtcccttaactatacaaaaccggtcacgataggtccctcgacggttttgatcccagttttgtcctatgtggccgccgagtcagcgtgggacccacgtgggccccacatgtcattgtgccatgtcagcctaccctctcttttcccctcttctcatttctctcactctctcttcgctcagggtggcgggggaaggagcggaggtcaccggcgagggcggcgtatgctagccgacaggaggggaggaggccgttgggcaaggccggtggggcgcggtcctgagccgccgcccgccgcgcggtccgcgaggcgggccgcgacggcatcgtcgtcgtcgccggccgcgccgtctctgcccagttcgccacggctagcgcggacccgtcctctggcgccgcgacggcggcggggaggcgagtgtatgtgaggaggccggtggggcgaggcaggaccagcgccacggcgcgaagcggcgggtgtgccggagacccagcaggaccagcaggaaggccttccgcacccaccctcccccgccgccgccgcccagctcctcccacggcggctcccagcccgcaccaagctccaccccacctggcgcgcattgctttgcccccgacaaccgtgccctgctccgcaccgtcaagctcaaccacggccacgacatcgccatcgacgccctcgagctcgcccgcgcggcgacgccctccccttctccaacgacgctgcccccgccgacgccgacgtcctcctctttctccgcctctcgggcctcttcgaccccgagacggtgggggaggggagagggcgagaaccgcggcgacggcctcccgcgcctaccctcccccgccgccgccgccacccagctccttccccggtggctgccgcacgcgccaagctccaccccaccggccgtgcactgctccacccccgacagccgcgccctgctccgtccccgacggccgcgctcagatccttccccggcggcactggcggcgtgggaggacggccgcgagaggccgtgcggcaccggcgtggcctccgctcctttcccgccgccctgagagaagagagtgagagagacgagaagagggggaaagagagggtaggctgacatggcacgatgacatgtggggctcacgtggatcccacgccgactcagcagccacgtaggacaaaaccgggatcaaaaccgccgagagacctattgtgaccggttttgtatagttaagggacccgtggtatctggttttgcggttcgaggacgttttcgtatcccgataacaagttgagggacatctggtgtactttttccaagatatttttcttcactattttcagaagtactaacacactacgtttggaatgcaggtaaattccctaagctcctcctaaaagtgaacttttttttactataataataacattataagtacaaaggcggtgctggaccttgcagtcgaacaagcccttgctccccggataatattgattctcacatattatgagaatatatagttttaaaatgagaaatatattaaaagccaaaaactggaaacaatatatgagagattagaggctaggattatatatctcgtttagttgtaaaaaaaaaaggttctactacctattactattaggggttacaatatgaatacatagtgcctacatgtgacaataacagggtgcataaaactcataatatgatcagccaccattcttcttcattttgttcttcctagcggccaaacactttggcctctgtatctcacaactatacatgtagctatagtaaggtgctatctgtgatttccatccaagtgcatcaaatcttccttgaggcctaacacttccaaacagagcatctaccagtgatatcttgggagcttcagcttcagcttcacagtgggaagatgcatgtgagcagattgtttgatagttatcaagaatcacaagaagttcagttgcttcttcacttggttcattcacccgatccaaagctttaatttgatctgcagcatacatgaatgaccaaatatgctggttcttcttcttgaactctctcagggttgcaagaaccaagctccagtaatgactgttggcatttgatctcagcaatctactgaagacattggcacccatgaaacacccttcagtttctattgcaatgtccatggctattgatgccatttcagggtgctctgaagcatccatgctcccaaatgttctcaccttgaagaagtaccagtaggcttccttggataaaagctgtaatctgagaggtggtgtggttcctaacctcgcaatcttgtctgatcggcttgtgactatgattttactatcgcgaggaatgcgagttttgtatatcgagtatagtctttccaataaaaccccatcgatatttttatctagtccttctgaatacctatccccatctagttcaacaatgaccaacacccttcctacacccgaggcacggtttcgatgtttgattacaccgccatctctaagatccacaatgctttcatcttcaagatcggctcgagtgaagaacacaatttgcgagaaatgattgcgcaccctttcatcgttgcaggcatgctcgacaagagtactcttcccaactctccctggaccaataatcggtagaactcctggttctagtgtgctatgattcccaggttgtaggagaaaattgatgagatattccatctccgtctggcgcccaaacatgcactggtccaagatcaagtacatgctatacggctgacgatgaaggcgagggcaactgcttaagaatgcaatgaactcagtagcatcagcaatggtgttctccaggtccccaagaactctctgcagctcacccaaactctgactgctactgtcactgcagaaacggatacgcttggcatgactgaatttagagatggcaaaagatggactcacttcaccatgatgatccttgccttgatgagctctgcacctgaaggtgtccagggtgtagtagcctctgaacatctccttcctcaggatgctcagctgctccagcatggcttggttggtgatgcaccgttcttccgcctcgtcgacgatgatgcgaaaccgcagcagcagcctttgcaggttctccaatctttcatcgtcgcttggagccggcttttgctgattcaggtatttgcttacaaggaaagatatggatctacctgcaagttcagtcaggatgacagaaatggttgcctccatgttggctggagaaaaccttgcagaatggttctgcaatggaatgagttacctctagctagaagtataacttatattatgtgatctgaaacttctgattgtgccaaaacaagtttttgtattatctttcaattaggattaggattaggagtacaagttgtaacaactaacaacaagcaatgagtgatcagaagtcaaaattggcaggggataacaaattacatagaatcaattagttgatgtcagttctcatggtgttctgcatgtcctgacgtcttgcgcatttgacacgttcaagcttcaactaatgaaagataatacgatatgctgacgaattgagtttgatggcctctcataaacagcacatttacataacagattggagtactcattcgctcagacagtcagacagtaggtgaaaatatttaaaaaatgctcagaactattacagtttaagataattacattatacagcagcttctcagataaacaggtgcaaatcttcggaaaacaacaagatggtgttaacaccaaaatttgacacctcgaacataaatagaaaaatatggccgaatttaaaaaggacctggtttcctttatggggctagtatgaccgccaccgtagagccggtcaaaccggtgatgtgggaccggtctgactggtggcatgtggtcggtcagatcgggtgagtctgactccgagttcaatttcgccgggtctcgagttcccttacttgagaaggtattttttgagttctaattggtcactatcctcaataaaacatggaaagggtcttgtaacaggaccgacccctttataagggctatggtcggttcgattctaacccccaaaccacaatccctataatctatcgaattgttcttttacctttacttttcagccatgctttctactttattttctacctaacaatagttcatccatctttgttgatttgcgccacaaatcatccgacttcactgcaagggtgcgatatctctttgtaggtttatcccgtaaaccttccgattcatccacgagacggtaaatcagtctagaggctaattttgatatctaaatcagctccgctagccagtttagttttgtatcaaggtggttggcgaccgcaagatgtttaggtgtcccgatcgtaattgtcttcttgctataagaaagttaccaacacgattttttgtgactatgctaggaaacgtaaaaaaaatttcggctatatatccgaccgaaatcaatccacatacattcactgccgccgtctacgtattacacactggatcaatgtattcggcagccacactgtccggtcatccgcaacagcaatcggattgctctcgatctgctgccaaaaattaaagaaaatcaaatcaaggtgagtttacaggaatagatcaacaccgtgagtgagtccgaggaaagccgccgtcgctgagtatttttcctatatatctgcagccgcgtgacgacgctgcatagatagatacggacatcgatcaattcgtcaaggccatcaggacttcagcgcttgccgtttcgctcttgtgttcctattttggccgatccagaaaaactaggagccgattcaacgtacgttgatcggcatatacaagccaactaggaagcctacccatcagtacgtggttgctctctgttgcgtacatccattgaaacaaaaaacaaaattcaatcaaagccattgcattgtttttgggaatacgcaaggagcgcatcattgtattaagaggaataaagtttatgcacatcggaaacgaaaaagagagggggacgaggtacaggagggtgactagaaaacgctaaatcttattctcgcaaccagttgggcgacctactaggcggagtttgaagaataagagctggcatagctgctctgccattgcattgtatcggctaaccaatattttggaacttttgctacctgcaaacgaggagaacagggaatatcagttagctatcttgtgtacacatctatttccctattcgcctacgacgggtggttaattatctccatatcaatctaaatcattctagaggctaattttgatatctaaatcagctccgctagccggtttagttttacaaaacccatcatggtttagcttcgtctaaatcgaggtggtttgtaaatccatatcaccgcaagacgtttaagtgtcctattcgtgattgtcttcttgtaaaaaaaaaagttgctaacagatggttaagtgcaaagtttgggcaatgccttgagccggacactcgatcaacgatctaaaaatcaggcgcccaccccgccccgccccgccccacccgtgcaccactctgcctttgaatataacttccctctcatcacttctcttattttgttatgcagagttctcttcacatgcatgtcatgtcatgtctagccatgcatgttcatgtaaatttttgatatatcattttgcgcatttttctctcttcttcatttttttctctcctaaaataatggtccgttctacgatccgataataccgttgtattgtttataattaaatctttatagtaagatatcacatgattatattttagtaaaaattcaaatgttgtttcaccccttgaagaaaattgtttcagtagtgttcaagagaaatgcaacatttaaaaataccaactgcaacaccaataaccacctatatagaactaggggtacggaaacggacggaaaccatctttatcgttttccttttcatatttctttttagaatcggaaacctcggatacgaaaacataatcgaatattatcgaaaccgaaaacggagcgaaaacgaaccggcgcgaatacggtaatgaaaatttatcggaataaaaaacccctcaaactgataaatccaattgaataaattatctatgtttaaaagagtaatgttgttgataaattccaatgtagaacaaaaaatattcttatgtaattttagatttgcataacaaatatttaaaaaaaaacaacagccaaacaccatggtattcactatttattgcttaaaaaaagaatccagggtatttcaatcacaaaatttttggtaattccgagaaaatttccagaaattctgagaaaatttccggaaagtttccgaccaattccgagttccgacggaaaccgcccttagcatttccgattccgtttccgagaaaatatttccgaattcgtttccgttttcgaaaaattccgaccgacagattccgttttcgaaaataggtccagaatccgaaaagttttcgtaccgttttcacccctatatggaacattgagtaccaagaagcgaaacaaaaaagtcatatgagagatacaatatatttgaaaaaaatgatattgttgaaatattttgtattattacgaatattaagctgtaactattgaaataatataaaatacttgccaaaactttcctggaacaccgcgtgcaatatttacaaattaactagtgaaatatcatacgaatactagttgaaacatacacataaaacatgtgcaacattgaaaaatatccatcaaaaaagctaaatattcttttcatcgaaatataacaatgtgtggtcttgttctaaatatttaattgcaatgaatttaatagtgcaatcaaattgtagattgaagaagttatttaagagaaaaggatagttcaaatattactaaaaaaaacttataccaactcaactaaccatattttcttttttactaaacgcatgcatgtactagtagtgacttggttaatttctagtaggctttacaggctgcagctacaccatgtctctgtagcagctagctgacagagtgacggaggatgaggcgggtgcccgatttttagctaaaaaatcaggcacccaatccgaagtcgcgtccgcaaagttcccgaggtcgcttatttcttgcaactatatgctgcgacttcagtacctcacagctgaacatgtagtcgtggtaaggtggaaggtgagatctccagccgagaaccttgaattttccttgaggcctaacatttccaaattgaaaatcttcgaaactcaactggggaacttcaacttcactctgagcagagtttgtacaacgatggagcatgtttggaacagaacatgtctgataatcatgaagaatcagaatatattcagaggaaattccgtttaccctcctaacatatgccgattcaaccacctcccaaggaccatcaaaatttgcatagagtgagatattcaacttcctgaattctctgattcttgttagaaccgtgctccaaaaccgagtgttgaaatttgcttttagaagttcattgtagatgcctgaagacatgaagcacccattccattcccttgctatctccatcgctattgattccagctttgggtgctcctctgcatccatgcttccaaacgcgcgcagtttgaagaagtaccagtaagcttcttgagtaaagaactttactcgaagagcttgtgtcgttccaaagcacgcaatcttattagatcggcttgagactataattttactgccatttgcaacacaacatttgcaaactgagtacaaccttctccacacaccctcatcgatgtctctggttagttcgatgatgattaatatcattttgccaccagtggcattgttttgatgcttgattacaccagaatctctaagagtctccatgcttgcatcttcaagatcatcctcactgaaacacacaatttgagagaagtgattacggaccctttcatcatcacaagcatgcgcaatcagggtggtcttcccaactttcccggggccaatgatcggtaggacacctggattttcagcaccgggagtatcctctttgagcaggaagttcatgatgtgctccatctccatttggcgaccgaacaaacacttgtctataagcaagtgcatgctatatggctgccggcacaaacgaggacaaaagttcaagaatatgacaaactcgcgcatatcttcgagggtgacttgtagtctgccaagaacttgctgcagctgatcttgcaaggtctggccaccatcccacaagtatcggatgcgcttggcaggatttaacttggatggtttaaaatagttactcacctcatgatctttggcattgtcttcttcatggccatggcatatgaagttgccgagggtgtaataccctctgtacatctccttccttagcatgttcagttgctgcagcatggcttggtttgtgataagccgtccctctgcctcctccacaatgatacgaacccggagcagcagtcgttgcagtctctcctccacggatggtaatgttggctttgagcacttgttgatcagcaaagatatggatctactggcaagatcactcagaatcacggacaaaaatgtctccatgtctacttctcatatgatcagcaaagatatgatctgaaattttgtaaatcactcaagtggtgaagagctggtacctgagaaaacacaatctgaatgtttatagagggtattgcactggttacatatacaaagaggggatatgatctgaattaaggcagccacgtactctactaactccaagtctccataaagcgaaaggtattgccctgtggttacatatacaaagttacatgtatatctagaatttatttcaaaccatacttttcagtgtgaactgtttggatcctaatttctgttttttctttgcagttccaataatataaccgtacaaggttgactacatagcggagacgattctacaggtttggttcagcgccatggaattctcgtcaagtttcaaaagcacatgcattttagttgaccagttcgcatgctagccaatgctacaacagcgacaggttagaaaaggaataaacattcagaaaatggttttcttcttttgtctcttttgataagggtcaagttttagcttctatttcttttaactagcaaaaaacattcagaaaatgatcccctacagcggttgttatgtccttcaatagctgactatctatgtttcttgaacaataaattatgagcatttttcccatccttgatgaggtactatgaggtaccaatctaatctaaccgttgatttagttggggcatgatggggctaacaaaaataagatctctcttctaggtcagaaatcgccgcatcctctcttccaggtcagaaatcgctgccgccgtcgcgcatcgaggttgccgccgtcgcgcgtcgaggccgccgccgtcgtctcccatcgagcctgccgccgccgccacgcatcgagcccaccgctgctgttgcgtatccagccgccgccgtcgagcgtcgaggccaccgccgtcgtcgagcgtcgaggccgccgccgccgacgattcaccgcactatcccatttgtcctgtccagtcattcagaacattggtgctcgtctcgaatttgtggcaagtttccaaatgacattaaaggtgggtattaaggctctatagaatgacatcacatttgctattgagtcttatttcaccctagcaagataatttccaagatctaaaagcaggggaacaccaaattcccagctcggagcacaggaacgccaaatctgagcagccgaggggaggaagatggtactgacttgccgagcgcgggccccatcttgttggtgagcgtcccgacgatgatcatgcagtcggactgtcgcggggatgggcggaagatgacgcgaaagcggtcgaagtcatagcaggacgcgccggcgtgcatcatctcgacggcgcagtaggccagatcgaccccctccgcgcccagttcatgaggtcgtctaccttggagatcactaactctgcccgaacgacacccgccgccgccgtcgcgtaaccagtagcccgccgccgtcgcgcatcgagcccgccgcgcatctggctgctcctgcctctcgcggtctcgacgccacgccatctctcgcggcctcgacgccacgccatctctcgcggctctcccgagtcccgacgatttttttcttctcgtgaaacaggaaaggacacaaatcacattatagaagtgggagcaggtttcttctcttgttaaaagaagttaattaatgctgacaaattgagtttggcaacctcatgaaaatatcacatttacataggagcttggatgtacacagatgctcatatttatacaacagtttcagacaataacaagatctcgtagcttagatactaaaaggtaccacaacctaacaatatggattactatctgagatggtcaggtgcaaagcttatgagatctcttcttactggtgaccatatgatgtggcctccgtacctcacagttgaaaatgtagttgtagtgaggtggaaggtgagatctccatgcgagaaccttgaattttccttgaggcttaacacttccgaagagaaaatcttgcatactgacctcggggacttcaccttcactctgagcagagtttgtgtaacaatggaccatgtttggaacagagagtgtctgatagtcgtgaagaaccacaagatattcagaggaaattttgtttaccgtccgaacatatgcaggtttaaccgcctcccaaggaccaccaacaagatacgcgttgtatattaagttgttcttcagcttgaattctctgattcttgccagcgccatgctccaaaaccgagcattaaagtttgctttcagaagcacactgtagatgcatgaacccatgaagcactggttcatctccctggcgatatccatggctaatgatgccagctttgggtgctcctctgcatccaagcttccaaatgtgcgcaccttgaaaaagtaccaataagcttcttgagtaaagaaatttactctgagaacttgtgtcgttccaaagcttacaatcttatcagatcggcttgtgactataattttacttccaactgcaacactaattttggaagctgagtacaatcttccccatacaccctcatcaatgtctcccattaattcgataatgattagcatcctgtctccaccaatagaatggtttttatgcttaattacaccacaatctctaagagccaccatgtttgcatgtcctacatcatcgtcgttaaaacacacaatttgagagaagcggttacgcactctttcatcttcgcaggcatgctcaatcagggtgctcttcccaacttttcctgggccaatgatcggcaggacacctagattttcagcactgggaatgtcctctttgagcaggaagttcatgatgtgctccgtttccatttgacgaccgaacaagcacctgtctaaaagcaagtgcatgctatatggctgtcggcataaatgaggacaactgttgaagaacatgagaaactcgcgcatatcttcaagggtgacttgtaggctgccaagaacttgctgcagctgatctcgtaaagtctggccactgcccgtgcagaatcggacacgcttggcaggatttaacttggaaggtgtaaaatagtaactcacctcacgatctttgacattgtcttcttcattgttatggcatctgaagcagatgagtgtgtaataccctctgtacatctccttccttagtatgttcagtttctgcagcatggcttggtttgtgatgaaccgttcatctgcctcctctacgattacacgtgcccggagcagcaactgttgtagtctctcctccacagttggagttgttggttttgagcacttgttgacaaggaaagatatggatctactggtaagatcactcagaattgcagacagaaatgtctccatgtgtaagtatgtagtctgaaattttgtagacctctcaatagatcagcaagaactgggatctgagagaaattatgtagtctgaaaaattttaaaggatcaggtgaagcagagtaggaattaaggctgccacatactcttatactgtggttacaaaaacacactttgaatgctccacatagtccagtatcccaacctagatatgctttttaatgtgaaccgtttggattcaagtatctgttttgtacattttgcaacaatataataaccatacagactgtccacatagcggtgacgatgaaagcagtaaagaaagttctacagattggttcagcaccactggtttctcgtcaagtttcacagtcacatgaatttttagttgaccaattccgcgttctagacactgcaatggccttctatttctacaaatgtgacaaaaagaaaggacctgacgaacatgaacaaaagaaatggcaaacttcttcattatgaaactcaacatgttaaaactgttgaaatttgagaagtgcttgtggtgcagctggcatggatagtccttgttttttttttctctgggtcaaaattcaaggctttgcttctagttaattccaagtcaacttttattttcaacttgtctgactgcaacactagtgaaaatgtcatggacagggaggaaacattcagaaaatgttttcctaccatggttgatggatgtgcaaggaatcagctgacaagctaaccacttttttttttctgaaattccttttggggatcaatacgcttatatggagaattgaagtattctgagaaatatggctacagatccttgaaatttgagttacctggatcgaaagaagcagacagaacgttgctgtcagtcgccgccattgcaggaagaacccgagccgccgctgccgccgacgtctccagatccggccggcgccgcagctgtcgccgccggcttccttggccgctccatcgccggccgcgctcggcttccttctcacttcgtggcggacgtcatcgctgctaggataggggaagtacaaccttgccgccattgctggagagtggggatccatccagtcatccagccaccagcgacttgaacccaaaagctttaaatatcgtaacctttgtccttggtaattaattaacttccttggtagagttaaaaataaagagaaaaaagatttttaaaagatatatttgagaaaataacagtgcctttgccttgatgtttggaaggaccagctacagggcgctttcgacactcttgtgctgctaatctgcgggatggtttggaaggagagagatgcgcgtgtgtttgtaaagaactgttttattcctcttaatgcaaaaatacgcatctagcgtattcccgaaaaagagatgtgcgtgtgttccagagttagagccgagtggcgggcatcctctttgccttgattaaagagtaggtcgtgatctgaaaagaagctgggggtttttaaagatttaggagagtagcgtcttgctgtagcttgtttttcttttcggaagttgcttatgggacaacatcaatcattcacttcagcagtctcttgtctaaatttgaactttgtgaatgtgtacatacctttttattaagtaaatttggtccacctgtttgttttaggctgggctggctaaaaaaaatagtgcccatttgatacggttggatgaatgatagggttaattaaatctcctattacaaatttgtcatattggaaaaatgatattattatttatcaaattggctcagtgtcataagtattttgtaaaatttaaattatgccattatatatgtatgtacgagacgtacttgaaccaatattttgcgtaacgtatttttcctacccacaaccattgcgcgctggtctcctcccagccagattcatacgtggggggtgttacgaaaatagatgcacaacggagacacgaatttttacgtggaaaacccttgcgggaaaaaaccacgggcgccgaccggtaatgatcactatagaggagtttattacaaacgtaggggaataacaatgggaacgtcaccccttcccatacggcttacaagagtatatatacgggataatagaaagacacctaataggactctgttgatagaaaacacagggcctgggagatctgcttaactccagtgcatgtccaaaactcgccttcggatgtatgagcgtgccagttgatttgatcctgcaatcaacaagaaacaaagacaaagaaaccgtaattaaatccataaatgatagccgatcggctaaatgccgatgacatgtcatttatctttgagccgatgtcatatgtaaatcgatcggcaattgttaagaaaacaaatcagaactaaatctactcgatcggctgcaaatatcaatgatacataatccttatatcgatatataattgaatcaagtgattgggatagatcggtcaccttgccgagacagtataaatcacttagatcgaaatatatattaataatgagattatatatatatattcatagcatagctgatcagatagatctagcgtgtatcggctaatactccgatactactttatattaagatattaaagcaaatagaatatactaaacagaaatctaatatacttaaatgcaacaagatcttaacatgaaggacagatctaacatgttaattgagcatgtagaacaaaagcaattggatcagataagatcggctgaaactccgatactaccctaatcggcaaccagtaggcaggctagagattgaaattctaagcacggcttaatagatcaaactcaactgatacagcattaagtatgaaaagaagaacaatatctagacgatcaagccgctggatgtttcatagagtggtggatatctcatataatctaagccaacgtcgttatttaacctaatcggctgccttctggtagcagatgttagccgattgtaggttaaatgacgatattgtcaaggattatgcaagatatatgataatttgacggactacataaacaagattagagtatcataaagatggaagcactaatctcgagaacacaagccgccataacaagtttacctcttgttgaagatcgaaaccgatgcagctcaacccgaaagcaataactcgtcgaaataaaacgaaagcaaaaagagtggcgatgcgccgaaattgtattgaacgtgtgtgttaatcattacatagggctcggggtctatttatacccgagaaatacaagatatgtccatattggacacgactcttatctctaacaaactctaagataccacaagtctttgcggcagacttttgctcacatttatctctaaagaatttacataaaatatcctatttatagatacaattgccttcccaggactctatccatgcgtggcattcattttgaagcacatcaactcgaacccaatgtcgcatacgggtcgtattgtcggaatcggctgtatcacttaaccagtccgactcagacttagccgatcccagtcgtagccgatccggactccagccgattattactctgtttccgaaaaaacccttatcttcgattctacttcgatttcattttcatctccaatactgatattaccaaatttggtcgttaacaggctcctactaggaaactaattcgaatatattgtgggcccaaaattcggatcacatatttaacaatatccaccttgagacgaatttcctcttgtagcataaaaacatcaatcaccaaaaatacctcatgtaggtaaaatcaccgcgcgccaaatagtctctaggactatactgtaacacccaccaagcttgagcaaagctcaaacttagtagcaggaactggctttgtcatcatatcaactgggttatcatgagtacttatcttgcataccttgacatcaccttcagcaatcaca

SEQ ID NO: 61454 - DNA, 5121 bp, Oryza sativa
  unsure (1)..(5121): unsure at all n locations
ttttgggcttatcttttgcaatagaacgttttggagattgatgaacaatagaagaatctgaatcttcaataacaggtgcatcttagttaatagcaacaaattcgttttctggtgcatgtcctgaactgatcaaatgctccacctgcacacttgctttctcctgactctcaacaggaacattagtagaaggtttgtcatgtaacataactgattcatggaagacaacgtttctactaatcacaaccttttttgtttcaggacaccataacttatagccttttacaccagacggataaccaagaaaaatgcacttaatagctctaggctccaatttaccattatcaacatgagcataagcagtacaaccaaatactcttaagtctgaataatttgctggggaaccagaccatacctcaattggagtcttcttatcaatggcataactgggtaatcgattgataagataacaagcagtggaaacggcttccgcctaaaactgtttaggcaaacctgcattagacaacatacaacgggcctttgatataattgtcctgttcatacgctcagctacgccgttttgttgaggtgtgtgaggaacggtgtagtgacgcacaatgccttcagacttgcaatatgatttaaatatcttagaacagaactccatcccattgttagtacgaaggattttcaccttcctttcagtttgtcattcaaccatagttttccactccttaaacacatcaaaagcttgatatttgtgcttcaagaaataaggccaaacttttcgcgaataatcatcaacgatagtcatcatgtaacgagcacctccaaaagatgtcttacgagcaggcccccataaatcagaatgcccataatcaagaataccttcagtagtatgtgtagatgtattgaacttcaccctcttatgcttgccaaatatgcaatgctcataaaatttgagcttcccgatgctttgtccatctagcaatcttcgcttgctcaattctgccaaaccaatttcactcgtatgcccaagacgcatatgccaaagattagtagcatcggaattagataatgaatcagaaactgcagcaacattacctaatatagttgtacctcgcagatggtacaggttggcagatttaatatcagctttcatcacaacaagagagcctttagttaccttcaaaattccgtctccaccggaatatttgtaccctttgccatcaagagtacataaagagatgagacttctcttcaaatttggaatatgccgcacatctgacaatgttctgatacagccatcaaacatcttgatctgaactgttccaatacctgcaacctcgcatggtgtatcatcacccatcaaaacagtaccaccttgaacagcttcataggtggcaaaccaatccctatttgggcacatgtgataggtgcatgcagtattaagaatccactggtcactagtttgtgcacaaccaacataagcaacaagcaattctgcatcagatttctcatcagtaacaactgcggctttaccttcctcttctttcttaccttttggtacatattttccggttctcttgtctttgtcctgtagcttccaacactcagatatatcatgtccatctctcttgcagtatttgcatgacttatacctgcctctggactttgatcttccatggtagctacttgaacttttatctcttgatttgctgtttgtgttcttctcctgttgcctgccccgaacaaccaagccttctgcttgtgaatttgaaccttcaaagggtaccatcttcttcatcttttctttggcatgcaaagcatcataaacttctttcaaagttagagtatcatggctataaagtatagtatccctgaagtttgcatatgagctaggcaatgaacacaatagaataaggcctaaatcctcttcatcatactttacctccatagactcaaggtcagcaacaatttccttgaaagcagagagatggtccattacagacccatcatcttgcaacttgtgtaaaaataacttttgcttcaggtgcatcttactggtcagatccttagtcatgcatatcnntgttccagcttcaacccacnnagcccagcggttgggtctccttccttaagcancctccgtgcaaaatattgttaagatagataaaagatgaatatatgacatagnccttacgatcccttttcttctcatcgttggaccaatcctgagtcctcttgtcaaatccagaaagcgcatcatcgaggtcttgttgtgcaagaacggctcgcatcttcacttgccaaaatgagaatcttgtgtcttggtccaggagcggtagatcatacttcaaactcgccatgggaattaatcctgaatttgctaaaagaaattagggtaaatctagcaaaaaaacgcgaaacccggtacacttctcgtgtgcacgtagcgtagatctgaaacttcctggtacacaagcttgtgtgcgcgtagcaattccacgtgaatagaaaatcacgtgaacaggaacctgatcgcttccctcgttgacttccttttcagcctcgggaaccgtgcgatttagtagatgtattgacgccggctgctactcctggacgtgcgcgtagacggcttgctgctgctgcttgccaatctcctgacgcgtgcgccgattccaggacctgggctgctgctgccctaatttcgcgcgggctgtagggatgacgccgatcagatcgatccggcgactcgacgatccggcgcctcgacgaaccggcggcggctgcgtgacgtgtagatcgatctccaaagctctgataccacttgttatgaaaatagatgcacaacggagacacgaatttttacgtggaaaaccctcgcgggaaaaaaccacgggcgccgaccggcaatgatcactatagaggagttgattacaaacgtaggggaataacaatgggaacgtcaccccttcccgtacggcttacaagagtatatataagggataatagaaagacacctaataggactcctactaggaaactaatccgaatatattgtgggcccaaaattcggatcacatatttaataggggggagtggaggtgggcaagtggcctatgcccatgggcagtggcaaggtgtagaggttttagcacatgtgccgaatacctgtacaccatcactacgctcctcctcatcctcagcgcccatccttgcgatcatcacattcctcaccactcctcagtcggatcccaccagagaacacatataaaccatccgcgtcgatggagctcctatctcgccacttcgctattgcagggagtggaatctaatccggggatgtccctttgtatattttttctttcaagttcatgtaaatggttatacaaaatgtaaataataatttgacaatgtagagtacagtaacatctatcgctccaccaataatcaacttcaaacttgatctatacattgaaaaaaaacaaattatgggatgaataatactatattgttcatatgttgaatttgcccttttcatttctcaatgtgtgagttgagtttaagtttaaattttattttaaagtgatatatgtatgtcatatgaatgttattttttgagatttttttaataactatttgagtggtgtttgagcaaatgagaggacatcccctcaagagtttaaaagtgtttcctgctattatgctattatggtcgctcaacatttagtctataatcgagtttgccgttattcattccacatccacaattgtttgctagctcacgtgtcttgcatgtgcgtcgtgggcaacgttgaggaaagcctcttgaaagcagcacattttacataggagcttgaagtaaacacatttgctcatgcactgggtgaaaaacaattgaaaatttctcagatttagattcagattcagataattacatcatacatcaacatctgagatagtcaggtgcaaagcttctgaggtctctcctccctggtgatcagatgatgtgaagtccatacctcacagttaagtatgtagttgtagtgaggtggaagatgagatcttgacgcgagaaccttgaattttccttgaggtctaacacttccaaacagaaaatcttgcaaactcaccatgggaactgcagcttcactctgaggaaagtttgtgtgataatctaccatgtcctgaacagaacatgtctgatagtcgccaagaaccacaagatattcagaggaaacattgtttatcatcctaatgtatgtgggttcaaccgggtgccaaggacagtcaatattggcaccgtatcctaagagattcttctgcttgaattctctgattcctgccagagccatgctccaaaacctaacattgaaatttgctttcagaagtacactgtacatgcttgaacccatgaagcacccattcatctccctggccatatccatggctatcgatgccaactttgggtgctcctctgcatctatgcttccaaatgtgcgaaccttgaaaaagtaccagtaagcttcttgagttaagtattttactctaagagcttgggttgttccaaacctcgcaatcttatcagatcggcttgcgactataatcttactgccttttgcaacacaccttttggaagctgagtacaatctactccatgcagcctcatcgatgtccctgctcaattcgataataatcagtagtctttcttcaccagtaccacggttttgatgcttgattacaccacaatctctcagagtcaccatatttgcatcctcaagatcatcgtcactgaaatgcacaatctgaaaaaagcggttacgcaccctttcatcggcacaggcatgctcaatcagggtgctcttaccaaccctccacgggccaatgataggcagaactcctgtattttcatcaccaggaatatcttctttgagcaggaagttcatgatgtgctccatttccatttggcgacccaacaagcacttgtctagaagcaagtgcatgctatatggctgacggcacaaacggggacaactgttcaagaacatgacaacctcacccatatcttcaatggtgacctcaaggctgccaaaaacttgctgcagctgctcttctaaactc

SEQ ID NO: 61455 - DNA, 1936 bp, Oryza sativa
gatcaaatttcccatgaggttcaactctccttgacaagatatcttgtataccaatttttggagccttctgatcttctgcatgagcaagctctactcggcaatgttcaaagatttcacagtagtagttcacatttccatctgtcctaggaataaccacacacttgctcttcatcccaaaatcacctgaacctttgttaggcagtaactggctctttgattccttggtcctgaagcgctcacgcaggctaagccagtcgccattgtaaatactagcttgaatgaaggtagccatgttgttcagatcaatgaatggtccaatgaaagtattgtacatctcacgatcaaagtatccattaaacatcgccattgataccgatgccacctcggggtaatctttaggatctgagcttccgaatgcgagaaccttgaagaagtaccagtaagcttctcgagacaagaattttaggcgaagaggttgtgttgttccaagctttgcaatcttctctgatcggcttgtgattatgattttacttccagctgaaatgcaacttcgagaagaggagtacatccttctccattcgtcatcggaaacatcttcagttagctcaacaacaaccaataatctttctcctccacttgaagctaatgatgagttgtgtttatgccttatcactcctgaatctcttaggataagcaatgatttttgctcgctcaaatcgctatcactaagaaagatgatgcgagagaagtggttgcgcaccctctcatcattgcaaacatgctcaacaagtgtgctcttcccaactttggcaggaccaatgattgataggacatcaaatatgtcactatatggagtttctggatgtaacaagaatttgatgatatgttccatctccatttggcgcccaaacatgcacttgtccatgaacatgtaggtgttgtatggttgacgatgcatggaaggatagttgttcagaagcataacaaactcagccatgccagccatggtgatctctatgatgtcaaccatctgatcgaactctctcatatctccatgtcgtctagtaccagtaaggactcgagctcgcttgatagagttgaatttagacaaagataaggtgttgtaactcacttcattgtcatcgtcgtcgttcatgtcctcctcctggtgtttctgaattctgaaggtgtcaagagcatagtagcctttgtgcatatcttgtctcagcatgttgacctgacgaagcatggcttggtttgtgatgtgcttcccctctgcctcttcgatggcggtggcgagccggagcagcatcctttcagtctctgaatcttctcctccatgaacgtcgccgccataggcggcgatgacggcttcgaggagcatctgtctatcaagaaggagacggatctactggtgagttctcctaggattgcagagaagagagtctccatttgggaaatggaactttccttctccccttgcaagatggttcagacaacaatttgatgaatggatcaacaaccagaataagaggaatcctgcaatcgtataatggcaagtgctctagcttgtctgagtagcatttttttgatgccaacttgtttgactagtaattaaaatgacatcgattgatggtgaacaaaattttgtggatgcagtggttctatagaaaagtatgcaatcaatcaacaccaattattctttttggggttgagagttgagagatttgcttaagagttctgtttgatgactcaagtactgaatctactataaagcgagactttcgttgtgcatgatattttttcttgtattttctgaccagtgttgaccaaatacagggagactacacctttctatagacttttacatatttcgtcaataactaattcctccaagcaattattgacctatacagatttaattaacttgttgtaa

SEQ ID NO: 61456 - DNA, 6993 bp, Oryza sativa
ttgtgtacatctgtttggatgtggaggctggtttaatccattatctaaaaaaaatgtactttcattcacggcacgggggttcagagaaatttcagaaatcttgggaattttcagaacgaaacaatttgaaatttaaacaattttgactaaatttggaccaaattcacaaaaaatgaaaaaaaaaagggaagaaattttccgaccaaattggaaatatcagacctatgttatgtgatcttaaacgtctgatcgtgccaatacgtgtttgtactgtatttcgttaaggattaggatgctttcttgcaagttgcaacaaggaatcgatggtcagaggtcaacagtggcaggtaatacggagtagcaattaacataggatcaatcagttgctgtcagttgtcatcgacttctgaactaatatccttgcgtcttagcatgttgacatcttcaaacttcaaatagcagaaaattattagatgctgactagttcagtttggcaacctcttacaaatagcacatcttacataggatcttggatgacatactcgctcagatactaggtaaaaacatttcacaaatgatcagttttacattacagcataagataattacattatatacaacacatggtcagcaggagcacagcttcagaaaacaaccagattgtcagctgcaaagttccagagatctcttctttttggcgaccacatgatgtttcctctgtacctcacagttgaacatgtggttgtagtaaggcggaaggtgagacttccacgcaagaaccttgaattttccttgaggtctaacacttccaaagagaaaatcttgcatgctcaacatgggaacttcagcttcactccgagtaaagtttgtgcgacaaagaaccatgttctgaacagaacatgtgtgatactcatcatgaatcacaaggtattcggaggaaattttgtttactgtcctaacatatggaggttcagacgcctgccatggattctcaaaatatgtaccgtatactaggagattcgtctgcttgtattctctgatgcttgccagagccatgttccaaaaccgagcattgaaatttgctttcaaaagtccactgtagatgcttgcacccatgaagcacccttgcaactccctggccatttccatggccattgatgccatctttgggtgctcctgtgcatccatgcttccgaatgtgcgcaccttgaaaaagtaccagtatgcttcttcagtaaataattctactctaagagcttgtgttgttccaaatcttgcaatcttatcagattggcttgcgacgataattttactgccatttggaacataactcttggaagctgagtacaatcttgtccatacaacctcatcgatgtctctgattagctcagataacgatcaatattctttctccaccagtgcattggtttccattcttgattgaaccacaatgtctaagagttaccatgtctgcatctttaagatcatcgtcactgaaacacacaatttgagagaagtggttacgcaccctttcatcgttacaggcatgctcgatcaaggtgctcttcccagctttccgtcgaccaatgatcggcaggacacccggattttcagaacctggagaatccactttgagcaggaagttcatgatgcgctcgatctccatttggcgaccaaacaaacatttgtctagaagcaagtgcatgctatatggctgacggcacaaatggggacaactgttcaagaacatgacaaaaacgctcatatcttcaagggtgacttctatgctgccaacaacttgctgcaactgctcttgtaaactatggccactgatcctgaagaaccggacactcttagcaggattgaacttggattgcgcgaaagagttactcacctggtgatcttttgcatcatcttcttcatggccacggcatctgaatctgtcaagagcgtaataccctctgaacatctccttcctcagtatattcagttgcagcagcatgcgttggtttgtgatgagccggtcctctgcctcctccacgatgatctgggcacggagcagcagccgttgcagtctctcctccatgtttgatgctgtcggtttcgagcacttgttgatcaggaaagatatggatttagtggcaagatcactcagaatcacagacaaaaatgtctccataagtgaagtatgtaatctgaagttctgtagatcactcaatggatcaacaagaactgggagctgagagaaaactatgtagcctggaaatttttcagtgtgaactgttttgagttcaaagtgtcagtttctctctacagtttgcattaatataacggtacgaggctgaccacgtggtggagacaacgaaagcaagagaattgtacagattcagttgatcagtcagcaccatctacaatggagacaaacaaaaatctgatgatcttgttgtcgcttgtagcacactagcaccatgttatcactctgccaagctatttgctgatttaggccccctttgattcaaaagaaattcatagcaattttagaggatcccattcctataggaatttttcctatatagtcctttgaatcaaagaaatggatcttatagaatcctatgaaattcctatgaaatgcctaataccatgcaagttttggaggaattttcatggaaacttttctttgagtatttatctctcctctaattcctgtgttttgcctgtggtccaatcaaacggccatttatgtgttttgcaatcatctgttttgcacttacattcctatcaaaatcctatgtttttcctattcctacattttctcaatcctgcgattcaaagaggccggaaaagtgacattcagcaaattgtttttccaactccggttgttatctccttaaacagtttactaggtactacatttcttcaacaatagatttatggctaaccatttgagcggaagccaacttttctgaaattcaattcgttgatcaatacacttatctgggacaataaaaagttcatgttatgctacatatccttgaaaaataagtacctggatcaagagcagacacagacagcaaggaggcatcgccatccggtgccaacattgttggaagaaccctagctgacgttgccaccaacgtgttatccatagctggtatagcttctgatactgctacaaagtgtttgcattgtcttctattaaggattaggatactttgtgtatcttgcaaattacaacaagcactgaatggtcagaagtcaacaagcaattaatttatatcctacttaatataacaccagcaaatgcagtcttcggtttcaaaaaaaaaaaaaaaaggtcagaagtcaacagcagcacttgatactttgtgtatcttttattaagataggagcagttagttcatgccagaagcaatgaatgtattttcatctcacgaatgttgacatgttcagatttcaaatatagaatgttagtagatgctgatagacttcagtttgacaatctcttacaaatagcacattttacatacgagtttggactacgcatttgctcagacagtaggtcaaactatttcacaaatgctcagatttatattaaaatttaagataattacattatgcatcagtttcagagaacaatgagatggtcaggtacagagcttctgagatctcttctttctggtgaccatatgatgtaacctctttacctcacagttgaacacgtaactgtagtgaggtggaaggtgagatctccaggcgagaaccttgaattttccttgaggtttaacatttccaaatagaaaatctttcacattcaccatgggaacttcatcttcactgtgagcagagtttttgtgacaatgaatcatgttcggagcagaacatatttgatagtcgtcaagaacaagaagatattccgagttaattttgtttacggtcctaatatatgatggttcaactgcctgccaaggatcatcaaaaaaatatgcaccgtagagtaagagattgagcttcttgaattctctgattatggccagagccctcctccaaaactgaaagttgatatttgctttcagaagtccactgtagatgcttgcacccatgaagcaaccattcaattccctggcaatatccatggctactgatgccagctttgggtgctccactgcgtttatgctcccaaatgtgcgaaccttgaaaaagtaccagtaagcttcttgagtaaagaattttactctaagagcttgtgtggttccaaagcttgcaatcttttcagatcggcttgcgactataattttgctaccacttgcaacatgactttttgaagctgagtacaatcttctccatgcaccctcattgatatctctggttagttcaataatgattagtatcctttttccaccagtggcatggttttgatgcttgattacaccagaatctctaagagtcaatatgtttgcatcttcaagatcgtcgtcattgaaaagcacaatttgagagaagtggttacgcaccctttcgtcgtcacaggcatgttcaatcagggtgctcttcccaacttttcctggacctatgatcggcaggacacctggattttcagtaccggtggtatcctctttcagcaggaagttcatgatgtgctccatctccatttggcgactgaacaagcactcgtctaaaagcaagtgcatgctatatggctgacggcaaaagcgtggataactattcaggaacataacaaattcactcatatcttcaatggtgacttcaagtctgccaaaaacttgttgcagcagatgctcttgtacactctggccagtgaccctgcagaaccggacacgcttggcaggattgaacatcgatggtgcaaaagagctactcacctcaagatctttgggattatattcttgatgaccatggcatctgaagctgtcgagggtataataacctctgtacatctccttccttagtatgttcagttgctgcagcatggcttggtttatgatgagccgttcatctgactcctccacgatgaaacatgcctggagcagcagccgttgcagtttctcctccacggttagcactgtcggtttcgagcacttgttgatcaggaatgatatggatctactggcaagatcacccagaatggcagacagaaatatctccatgtgaaactgtgtagtctctaactttgtggattactcaacggatcaacaagatctgggacctgagagaaactttgtagtctgaaaatctgtaataggaatagagattaaggcagcgtcaaactcgagtagctccacgtctccataaagagagatgcatttcagaacatagatataccgtataccttttaatgtgtctgaacctagatatgcttttgaatgtaaactgtttgaattcaagtttgtatttttccctgcggtttggattaatataaccgtcgaagattgaccacatagctgagacgacgacagcagcaaaggaaattctacaagtttagttcagcaccatagatctctggtcaagtttcacaagcacgtgtatttttagttgaacagtctgcatactagacaaaatgacctgacaaacatgaggaaaatacatgtttaaaccattttattatgaaagccagcatgttaaaactgataaaaatggaaactgctgatagcacagctggcaaagatagcagtagtgatgcctattggtctgcatttgagtattgccagaagcagtcatattccttcattgttttgacgtaataggaacgaatatattgatgcttcttcttaaaaccattggtaccaaccaattttcccaactgttgaaaatttcccatcctattccaagccaggatcatcagataatgttgtctagtagtagtagcacaactgttatgcccaaatacaaaatacatttttgttttgttggcttgaccaatagtttttcgaactgcggttgctgtctcatccttaatcagctgattagctacattttttttttgactgaaaaaggtagagagcttttttttttttagctacatttcttcaacgaattatggtagccgcaattctgaaattccttttggagatcaatagttgactgctatgggaaaaataaaatattcagaatatgctataaatccttgaaaattaagtaacctttggatcgccaattagacgagcaggacggaggagtggcatcgccgtccggcgccgccattgttgccgacgtctccagatccagccagggctattgcggccacttgccaccgccggccgagctcggcttcatggcggacggcatcaatcgctgccaaatcaggggagttggaggcagagcactagcctactagggcgcccaccaccggagcgccgccgccgtccgccgcccgccgacgagcagctcgccaacgccggcgaagtgggaaggagggcccgctggtagatgggctggtccgaacggagtttgcgcgtggtccttttcctatgagaaagtccattgctcatccctcatcgatgggccgagtcttattatctctctctttttttttttttttgccgggtcagccaaagaccggtgaccgaatttcattaagatttgaggggagaaaaagaaaagccgagtcggggggcatcggacggcacgggcttgtcgcggaggacgtgatgagtcttattctcatctctctcaactacaaaactaggtatataacctctctttaacatttaaaattggctcgtttttccttcctagacgatttcagtgacggttttattgtacgtgatgcctacatggcacgttggcatggtattgatacatatgttaactcagggtaatcttcaggatttgaggttccgaatgcaagcaccttgaagaagtaccaataagcctctcgtgacagaaacttcacatgaagagatcgagtttgttccaagctttgcgatcttgtctgatgggcttgtgattatgattttgcttccagctgaaatgcaa

SEQ ID NO: 61457 - DNA, 2338 bp, Oryza sativa
tgtgctatagattcttacaattaagtacctcgatcacgagcgagaacaccttacaatctggaagccactggcccctccccgctgtcgctacttcctctggtttggtcgcagcgaatagatgctaggctactgatcgtcttcgccatcggggccggggctcccccaccctgtccactgtgttctttgcaatcaacatgaacagagtatagatcatatcttggttgattgcccataatcccgctagctctggcggtgggttctcagggtgattaatcagccagattgcctccccttgcatgaggcctccttccattagtggctttgccttagcaggaaaaaagtcgcgaaagatcgtcatcagggatttgataccattgtggcactagtagcttggatgatctggaaggagagaaacaactaggtcttcaacctccaacagtggccatgggtggaagtagtgaaaacaatggctgcggaggcggagttatggcgcctagcaaaggtggtagtaccggcacttggtctctatttttatgagtccctaggtcatcttaattggttgtgagattgtagtttaagtcctttgttccgctccggtatcccgtccccttcaaaatttatgtttgatttgtaaatagcttttattcctcttaatacaaagatatgctcctagcgtattcctgaaaaaaagagagaacaccttagaaaggttagagattgtaacaccctgacttttgtttagcagctaaaagttattttaattaaaaagcataattttaaaactttgattctttgtgtgtatcaacgaattagtggcaagatatcaattaaatcattcctagtaaacccaaaattttgatccaaaacattctatcttaacaaaaatctcagaactcgaattttggaatttacatctcccttgtaaaaccattacaaaattaattaaaatatccccattcactgaaataggacatatactaatccaaataactccttattcttaacactgtgtggacatcaaattataaatttgaattcaaatattcattgatatctccctaaaatttcatcttgttttatgttctcctcaaaatttatttaaattcatccaacatacaaactcccttgcattcctagaaactttttgaattcaaatttcaagcttgaattcaatatgtcaagtcaaatcatccaaacaaccatcaaatcaattttatggaaaatacataacttctagtgtataactgttcattcaggccgcgtcctataggatcaatcagtagctatcaattctcagcatgttgaaatcttcaaacttcaaacagtacaaaattaatagatgctgatgaattgagtttgacaacctcttacaaatagtaatcttacataggagcttggactacgccctcgctcatatagtttttttagataatggaaactttatttagactcagttaattacatcaagatgatacaatcaaaccgagtcacccccggcctctgcataaaatgcacacagccaaaaaagaagaaagaaacaactagaacatctcccaagcacaaaagtttaacagaaacatatatcttagtggctattatagtaggtgaaaatatttcacaaactcagttttagatgacatcttcagataattgcattatacagcaggttctgacatggtcagttacaaagcttcagaaaacaatcaaactgtcaggtgcaaagttcctgcgatctcttctttttggcgaccatacgatatttcctctgtacctcacagctgagcatgtagttgtagtgaggtggaaggtgagatgtccatgcaagaaccttgaattttccttgaggtataacactcgcaaagagaaaatcttgaatattcacctcaggaacttcagcttcactctgagcagggtttgtgatttggatgggacatgtctgatagtcgtcaagaatcacaaggtattcagaggaaattctgtttaccgtcctaacatatgtcggttcagacgtctgccaaggattgtcaatatatgcgccgtatactaggaggttcgtttgcttgaattctttgatgcttgccagagccatgttccaaaaccgagcgttgaaatttgctttcagaagtacactgtagatgcttgcacccatgaaacacccatccaactccctggccatatccatggctattgatgccagctttgggtgctcctgttcatccatgcttccgactgtgcacaccttgaaaaagtaccagtatgcttcttcagtaaacaattctactctaagagcttgtgttgttccaaagctcgcaatcttatcagattggcttgcgacaat

SEQ ID NO: 61458 - DNA, 3830 bp, Oryza sativa
  unsure (1)..(3830): unsure at all n locations
acatttatatttgccctttaggactagatcaatgttactgttgaaatccccaaatctatctcttagatcaattttctgcaactgctcttgtaaactatggccactgacccagaagaaccgaacacgcttggcaggattgaacttggattttgagaaagagttactcaccttgttatctttgctattgtcttgttcatgggcatggtatctgaatctgtcaagggtgtaataccctctgctcgacatacccaaagagttcgactcagtgcgatgggactacttgctagctatgcttcagcattatggcttcccacagaaatggagagactgggtctcatctattctttccacctccacctcacaagtgctcctcaatggaatcccggggggcaaaatatagcatggcagaggtctaaggcaaggcgacccgctatcaccgctcctctttatcctggcgattgatcccctacaatggctgctttcaaaagcaacggagcttaatgccatcacaaagctacggggaagagcagcccgcctaagaatctccatgtacgccgacaatgcagtggtcttcatcaatcctgtcaggaaggatgtccagaccttcactgacatacttacacgcttcaggcatgcggctgggctggtcacaaatatgcagaaatctcaggtggcagtaatcagatgtcaaaacatagacctcgacaccattcttgacggtgtaccagctgtgcgagcacacttcccgataaaatacctaggtctgccgctagtcctagggaggatgaggaaggcggatattcaaccactttttgacaagattgcaaagcgaacggctggatggagggggaaaaacatgggaccagcaggacggtcaaccttggttaaatcggtgctgacagcgcaacccatctaccttctcactgcactcaaggtaaccaaagaagctctaggccaactcgatgcgaagagaagaaggctcctttggcaagggacgggagacataagatcaattgggagaggacatgcctcccaaccgcgcaaggggggctcggagttctaaacttggaaaagttcagaagggcccttcatctgagatggctctggcatgaatgaaaagatcccactaagccatgggtaggcctcgaaacaccgtgtgatgaaactgataaaaggctttttgctacggccactaaaataacgatcggggatggcaacacaattcgattttgggactctgcctggttggagggacagagaccaaaagacgccatgccactagcctatgcgatatccaaaaaagaggaaaaacactgagggaaggcattgagaacggctcttggatcgatgacctggacctcagcggcaccattcctcccactgtggacctgattagccagctcgtctccctatgggaagcaacccagtacattattctcaatcaaagcgagcccgatcaaatcacctggaagctttcaaaccatggagaatactcagcctcgtcgacatacaaagcgcaatgcctgggaaccactggcaccaacttcaacgccttaatttggagagcctgggccccaccaaaatgtaaattctacgcgtggcttgtgatccaaaacagggtgtggacttcagaccggctagcagctagaggatggccaaacaacgggacgtgccccctctgtcgcgtgacaagtgagtcagcaagccaccttcttgtccattgtagatatactagaaggatctggagcctgactgccgcctgggtggcttaccagcaactggactcgtgccactgggctccatgccagagtgtccaaaattggtgggaaatgctagccaatacaaaggaggtgcccaaaaaaggccttcggaccctaattcttttaatagtttgggagatctagaaggaaagaaatcggcgggttttcgaacacaaggaaactgcggcccctagtcttatggcaaaaataaaagaggaggcaagaacttggaccatggcgggagcaaggaggctacgggattttctatcaaattgtgtataggccttctcagttttgtacagtttctcctttttttacccctaggggttgtactttgttccctctattttcaaaaaaaaaaagtaataccctctgtacatctccttcctcagtatgttcagttgcagcagcatgccttggtttgtgattagccggtcctttgcctcctccatgataatccggatcctcagcagcagccgttgcagtctctcctccatgtttgatgctgtcggctttgagcacttgttgatcaggaaagatatggatttactggcaaaatcactcagaaacacagttaaaaatgtctccatatgtaaagtgtgtaatctgaagttttgtacataactcaacggatcaacaagagctgggacctgacagaagctatgtagactgaaaatttagaggatctggtgaagcagagtagaaattaggcaaccacatactcaagtagctccaggaaaatgcattgtgctgtggtttacacaaacagtgttccatgcgtacttggaatatatttttcagagtgaactgttttgaattcaagtgtctgtttttctctacagttagcgttaacatgactgtacaagactgaccacatggcgcagacaatgaaagcaacaaaaagaattgtacagattcagttcatcagtcagtaccatctacttctaccactgttattgacagaaaaagaaaggatctgaacttcttgtcactaccgctgttattgctaataatcaatccaacgtatccattcctcaggatgatgccaaaaaggccccaatacacaaatccagtcttgtttctctttttcttttcctgccaggacaaatttcaagtttattgctatttcttttatttagatttaagtcttggcttctacttgtctgtctggaacagtagagaaaatggcatgaacggagaaaacgagatcagcaaatgttatccttaaacagtagaattatggttaatcacttctctgaaattcctctctctgggatcagtacacttttccctctggacagggttgaagaagctagtcagaaatatcttcttttctttctttttttttgttgagagttagtgctgatgctagtactgaacctctaactgaagctggtgtaattagtgtgatcataatgccatggagtgtttgtattaggatgctttccgtatgttgcaagctgcaacaagcaatgaatgttcagaaacagtaaacacaggatcaatatattagttgctgtcaattatcattgacttctggacaagtgtctttgtgcctcacgcatggtgacatgatcaaacttcaaatacagaatgttaatagattctgacgacttgagttcaacaacctcttaaaatagcacatacacatgagcttggactacaaatggcgcagccgctcagacagtaggtgaaagcatttcaacaaatgctcagattcagattacagttcgacataattacattatacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 61459 - DNA, 1306 bp, Oryza sativa
cttctaactaatttgcaatatattaacaaataattcggaggtgtaaataatcataactctcaagttggagttattttgttatttaaaaattagatcatgcgaccgtctaactacaaatgtctaggtctgatggttacctataaagcgctcttaagtcatcacaatgaactctaataaattaaaaaattctataaatatgagtgataaaataaaacatttaaccatcgattttcacttaaatcgatggaccttatatggttagatctatctttaagaaaaatcgcaaaccaacctccttccctcccccgtaccacccatcctcccgttcctctctccctgcccttccttctttgtttttttcactccacaacaacctctctccatgacctttcttctttgtttttttcactctacaacaactaaaataaaaattatctttacgggcaaataaactcacaaatggacctatacctaacacatctagcgggctctccctctattacgtgattttcctctctttctcctctacctatagcacggctctccctctatcacgtgattttcttctctttctcctctagctgcactgtagaaacaacacaaattagactttaaaataatcataattctttaaatcatatatacaatttatgacatgtataaactactgtaaattttaattaaatcaataatttaacatgcgtattaacttacattgtggaacatatccaccttcaggcctccactaaataaataaaatactaaaatttctcactaaaaattaaaatatcccaccttttttaaataaactggtcaacctattatttataccctactagacatctaatgactttctaccaactctttccatttcagattataagtcattttaaatttggtcaatgtcaaactcttaacttagtttataaaaatacatagtacattttcaacgcaaaacaaacatattataaaaatatattcaattctgaatttaatgaaaactaatttggtgtcgtaaaaaatgatatattttttccgaaacagaggaagcaattaatttctcttaacatgcatataggggctatttacttatacttgatcttagatgtgcttttgtgaataaattatcttttaggagataaataaatgttcctaagatgatcatagcatataaattatacataagatatatggtgtcactaatagattagagaaaaagcttttgattatatattttttagtcgtaacgtgtaccctgtgtagggtctatttgtcatatatatagataacagattgaaaataacca

SEQ ID NO: 61460 - DNA, 6515 bp, Oryza sativa
cttaggggctgttcactttgacgccattttcaaccataccgtttttttttggcaaagttgccaaaagaaatcctaccaaaatttgataatattgtcaacatttatttacaaaatttgataaggtttattttgacatcaaaagtgaacagccccttactttaagtgaattaagtgggtgatgatgtgacacatctactttaagtggagttgtgtattataataatgtagtatacttctctatgtatgtatggtgactcagagaagattaattaattgatggcatgcatgctgactgcagcttcaatattcttatgaaacggttgagattcgttatgaaggcagcagtgacttcttcacctcggcctggtcaaatgcgatgggcttgttgaagagcccgaggggaacggtgatccgtattgaggttcttgtggtgttggctgcttgtatgcttatattcctcgccgtgtttgggtttctccgacggcgatgcacaaatcccttgttccagacggctgtcatgggctcctatgtcctgtcctcctccctggtaacatacacgcttggttcaatgcagtcttctgctgccaagagtggcatgtaccccatttgggccttgtcactctttatcctttctgggtgcgccgattcagtcacggcatatagcctcgaagacaacaatcagatacagagacagacatacaatgcttgcctctaccatgcttacgtcctcctgatatctgcgaccatcatcacgcaaggtgccggcgcaggactacttattcatccacaggattattgcatctcagctggcaagcgtgtcgtggaacctgaacaagatggttgccgattacatgcatgaggagcacgccaatcatccaatacgggagtacgacgcaggcagcatgaagggttaccgttacctagtctactggcgattggacaagacgtccaagattgaagctgcgacatcatatgcagcacgcgtaacaacaacagatgatgatgcccagatcatttgcatcgacgacatatggctccgcagcgacaagtcactgagcacggacctgaaggatgcctgtctctccttctctctattccatttgttgcggaggcgcttctttgggttcacatgtgctgaatctgcacaccccaagactagtgatttcgtcttcaagggcctgctgcagttgaagaatggcagcacaggcactgtagactacatcagagctttcaaggtcatcgaggttgagttggcttttatgtatgacttcttcttcacaaagtatgctctcatctactacagttcaacctctgctgcagtttggtcattggtttcagctgccttcacagttttaactgcatattccacaaccaaactccattggcttcagggtggatccactgttgtggttcagggtggacccactgttgtgggcgacaacaaagctgacatttttatcaccatgctcctgcttgtatctattgctttgctagagctgcttcagccactgctttactggaccaccatttggggcagagtatcttttgtttgtcagtatatcagacaacaacagccattgcggcatggcttcagctgctgcatgatgagagttaaggagcttctcaccaagatcggtctgcgtgtgtcgtcaaatgggagctactggcaggacatgcttgggcaatactcgttgcttgcatcagtcagccgcaataaaccgattaagcagctggggagaaaacgtagtagatttattaagtgtatgaatcttttggactacagggcacttaatttttatccagcgattgcctccttcaagaagaagaaccctgtagacaaacctatcaagttgtccccacaagtgaaggaggcagttgccaagtccctgctgcaacatgctgctgctggtcatggtaatctgacgaacggagtgtcatcattgaagtccaatggagctcatcacctcttatgggcttgtgacccagacccagctgcacgcatcttgcagaatcagacgccctctattttgatatggcacatcgcgacatgctgctgcgagaagaaaccgcccaactaccagcatgaagaagagctgaaaaatttccaggtcgccactgcgctgtccagatactgtgcgtaccacagcttcttcctgggcaccactatgacacagcgtgtgtgctgcatgcggtcggagaggaatccgtgcagtttcttcgtgaacgtggaaaaaaggagttcgacgccatggccctgcaaggctatgagccaccaccggagggcgagccaactaagggcatattcgagagtggcttgaagctggggaagcagctggaggagatgccagagaagatgcgttggaaggtcctggccgacttctggcctgagatgttgctctacatctcgccgtcagacaatgtcaaagagcacatccagcggctcgccaagggaggcgagttcatcacccatctctgggctttgctctcgcacgccggcatccttgagcgtccgaagcaggagcatcaccccggaagcagcgtatgaccgagtaatataattaccactccctgctctgcatatgtatcgctccctccgtttcgtattataaatcgttctgacttttctcttaatcaaacttaattttttaagttaatttgaccaattttaacaatattttcagcacaaaacaaacatattatcaaaaattttggtgttttggattgctatttttttttactaatttgatgaaacttaaaggtgttttggatgttgctaatttttttttacatattcgatgaaacttaaagaaatttgattaagaaaaaagtcaaaatgatttataatatgagaggttatcaaacggagggagtaaattgcatctcttgtcaccttcttgcttggaccattgcatatatgtatatatgctgatgttccatcgccatgcattctggaatattttctgcatacctgtgttggcttgttccggtggtatatttgtttgtgcttcaatgtttatttacctcttatgacgttcaatgtttcatatataatatattgtgtgaataatcaaagaaaagggtcaatatcaggatactggtatcattggtatctatagatcatatatcatgaatatatgtctttgattcagtatttatttacgccacgtccatgtttatatatatctctgtatgtaaatgtgaactccatgaatgtttcctggattaatttcgtataccattggtttgcctgtaatataatgtgctggatattgtgtcatgccttcattggattgtttttgcatgcaaggtgtgtttagttcacaccaaaattggaagtttggttgaaattggaatgatgtgacggaaaagttggaaagttttgatgtgatggaaaagttggaagtttgaagaaaaagtttggaactaaactaggccgcagtttcataacaagaagggcttttctttgtaatataagttctaatttgtttgtggaccttgctttgccaagctggcatcccagagaggagtgatgtgaaactggaatggaaatataatgtgccacagtcccagagtcatgaggaatgcctgcaacttttcattgagttttgcagaagaaaattttaacaagcattgagcttcgcagagaaaattatgcacataattctgtcagaagtaagtgataagggaaaaaaatacttgaggaactgcaacgttttcaattacaagggaaatggggggtctcagttttggaaggggttgcaggcttgtaaaagttggctctctaggatggtaacaaaaaagatccatgatggtagggatgtgagtttctggaatgatgtatggtatggggatgtggctttgaaagttaagtttcctgagctttttgagttaagctacaatcaaaacattttctgtccaggaagtggttgaattgagcaattgggacatggagtttagaaggcatttagatgaacacagacaaaatgatttgggggagttaaaaggtttggtgggggatattcagttggaagaagggagggataaaagttgctggccttatactaaggattctttgttcaccacaaagtctatgtacagaatgcttacttttggtggaattaaggatctggcaatgaagggtattggatagtataggaggagaggaatacaatgtaacgtggattgattgtattgagcctcaggggaccggtatatataagattgcattggaaggagataaagaaggattacagatatgaaaggagtccatacaaatcaatcctatcctaatatgactctaactaccatatactctaacacaggggttatggaaaagcaaaatacccttgaagattaaacactttttgtatctagttgggcgtgggagattgccttgtgctgagcagttagtgaaaaggaagtggagaggaggggatgatctatgtaaactctgtaaaaaaaactgaaactactaatcatataatcttcaggtgttctctggctgtgtttttttggtgtgttttgaagaaagcttttcagcttcagtctatacctagagatctttgagagtgtatcaatcttgtcaagggaaagggagtttccataatttgggtttttctttctgcttgtctctgttgggctttatggatgactagaaatgattgggttttcaatgatgtcctggtgaaattacctttgcaagttgtttacagagctttgtctttttcgcagaagtggagcgtgttgctaaaagaggaagaacgcacaattctaacagagtggcgtgatgctgtgctggacaagctaaagcaagtgaaggctcaaaatctacctaactcaatctagctttgctgtcatctggttttgataggcgtctcttagttcttagactggttttgctggctgattgctttacagcagcttttggtcctgatcttgtaagctggtcggccccagcatttgcttatgtgtgcctgttgtttttgcgtttcagtataatactcagtatgtttaactttggctttctccccaaagccgggtcaatgcaattgatatgttctaaaaaaaatatctgtcagaagtttaatgccaaaatgtctcctttttttttctttggactcatgtatattcttatcagttattttggtcgttggccgtacatcagtcatcttccttgtaaacccaataactctaaagtctgaaagcaccttgcaaactgtcatccaacctcagctacatttagttaaagatcagtatggatactctgaactagaaacgcttttagccctctttaggtcgctcagctgaatcatttgcccttgtaggctactgtacttcacctgtttcaacaagattattggaagaaatgagttttcctacagagcatatacatatcagaactgaatcaaatcaagctatattatgtcctacttacgtgcatcagtgctagtgtggacagcaactctctgcactgcgccattagaacctgttcttgtctggtaattatggacagctgagacaccaacacatttgtcctggctagctacagaaagaagcagatgacttcaggataactcacataattaaggtgtagagtagtttataatgttcacttttacatatcatcacttcagtagatctcaatgccattatgtagatttgatttgtgctttcaagggtaaaaggaaacacatgaatgattcggagagaacggcaccttaggcagtagataactcattgagtttctcattgtctgcatgacatcaactgcagagccaacagcatttttgacagactgaaaatctgcctgcaaagtatgagattgcaatgccaaacatcagatataatcaaacttgtatgaaacatggaggaaataggatcagtgttttgtcaggtttcaaaccactgctccatcagagacaggaaggcgaagaacggtagcattcagagcttccactgttcctgacagcgaattagcatacttgttctccagtaaggaccactcttccagatatgccatctgtatagtcagtgtaatgcttaattatcagaatttcatttgagttaccattcataatggctgatctatctaatgatctgggacaaatcatgacctttcaactagtctgcctagtacacgtgtacagcttcattagtccatatattaggtgtaactactgttgaaatcaagtgataaagagatgattattttcagctttacaactaggcttaaccacaaaccatgtgcttaccatttggacaggcaagtaaatctgcatgtaaatggcacggagcaactactcacagtcctgtaactacctgaaagaaaagtgttctggtgcagactgctgagactaccagactactaccgatattgttcaaatctcaaaaaatgcattttcttagagaaaaacatgacgaatcacaatagatgaattccactgaaacataaaacagagggtgaaaattttgccaaatagatgaattccactgaaacataaaacagagggtgaaaa

SEQ ID NO: 61461 - DNA, 1385 bp, Oryza sativa
tggagagatcgttgatcaacatagtgaatcatataagcaatcacgtaagtgccttatagcttctaccttgtttataacctgatgtatgtaaaatcgaagcagctgtcttctgcaattacattctcagggttactctgattaacgttgggtacaaaaccttcgtgtatatcttgatctttaaaagatagtgtaaataattgtggtgtttgcaggtatggcaatgaggttgtggaactatgtggcaaacttttcaagtatgtccggggagcaattgcacgacctctatttaaaacttagtcaggaccaaatggaagctggagtaggtccgtcacatggtgggaattttgcatcagtccctcccaacagggggcctaaatcaaatcagctccatccttccagaaaccaaaggtcaacaaggtctgtccagtacgtctctgagtctttcaacaatggtgaaaacactgggaattctgaagcctggaagcgacggagaagatctgagcctgataatcaatttgataaccaacctttgtatcaggctcctccaatcatgacaaatggaaacaggttacaggaatctagcagttctgctggtattcttggttgggctccggttgaaatgagacgatacggcaatgaaagaccaaaaagaggtgttcatcccagtcgttttccacccgggcatgggcctttgctgtagttgttcaagtgaacaatgttgtcacttaaagcagcatcgctccaaggaaatatcagcttctagcatgccgcacatgtaaaaatgggggaagaccgttcaattgaaattctttttgaagaaaaaaaaataatgaagtgctggaacctgatgtggaccacagttttgaatccgagtctaaaagaaatgccaggggttgctgaggagatgctggcacctttagcagatgtacacacacaagattcttctgacattgaaaaaaaaacttgaggcaagaggaagagtctagaaaattttgtcggtcagttttgtgatctaatagaagaatatttcagttgggatgttttaagaaagttcatctcagcaatgatctatatagttcaacatcaatacatgtatgatctttttaagttgcaatataatgaattatggtttagttgcccatttttactacccgcctctctcatctgtgcaacatatattgtcttgatgtaacaaagcaaatgaaatgtaactcagcagcaggatgccgtgggcataggacagtattgaaacacttgtttgacatgatttttctgtaaatagaggtggaatcataacttggcgattgggccacagatgggtgatggttgtgtgcttgtgtggtaaccttcccccccccccccccccctagtgctttttggtgagt

SEQ ID NO: 61462 - DNA, 3707 bp, Oryza sativa
tgatcaaatttaaagcagtcaaaacgtcttataacctgaaatggaggtagtatcatggtgtaattgaggatttcggcacaacaatgacatgtatgctgagattcagacgagattccctgtgatgtttttatacacgtgttcttatgaccagttcagaattcgttgtagaattatctgatctaatctaattctgaaatcgaagcaatcacatcaatactaccagcgataaaaacgaaaactagagggctttacgtttgacttcaacatatggcagagatacaaaaactcgtaaaggataagaattcagaagtgccaaattccttgatggttaacgttataatcacattaaaacagcacggaactcggcgagatatttttgctcactgattgaaaggtgaaagggatgtatgatgtttgataggtttataactttgtacctttgctacaactatcttcaacccctgcaattccttatccccccttctgcttagagctatgtgagatccaaatttccaggtactccataaaaatggccaaagttctacactactaaagcaacaagagcaagggcacttcccaattatccccaacgtaaggctctctaccctgttgaattctctgctttattttgcttagtctgttagtttttctgtttcattttgctgcaaaataaattttttttaaaaaaactctcgcttagaatttggagcactgtatatcagcttctcctagcttgtgctggtatcagatggaaatgatcataagctaacgattttctgttcttccctagttcgtttctagctctttttggtgtgatttgatggtgctttggagggtggaggtgttcgtgttggagatggtgtgggtgatgctcagcggctggctctcctcctgcctcgccgtcgccgactacgtcgccacggcgctcaggcagagtggtgacgacgtctccggctagaatttctttggacgaactggatataaatcatcttccatgcctgcatttgttgtttggtttctttgtgtgtttgtgagcatttatacacattgcaattgtgtatatatccgaatgttattttaatttttttttgtacgacatgatttgaggcaaattaaaatagattgcaatggatatttctcaaattatctcaactggtcggtcagtagaagactagattacttccaaagagctaagaatatagatatgtcatcgtcttcttgatttcttcaaggaccttgatctactggaaacaggagcctcctccacctcttcctcatcatcttccatccttctacgcatcctcttgtggtaaccactctcgttcattgtctaacagaatcaaagattcaaaaaatgatactccagttaatatcaatccagggaagaaaaacataatataaacaaatgagagttgtcgattaaaacaaggaaactgatactgttgaacggtgaacatccgtacagaattttatatcaccaaaagtgatcagaagcctaacaaagtagcagctacaatttggggtgaggtagaaaattagtacttcctccgtctcataatataagactttctagcattgtccatattcatatataatatgagcaatgctagaaagtcttatattataaaacggaggaagtatgtaccttcaatgcgattctctttgagtcgtatatgcgctcatgaagtatcattatttcatctgcatcaaccttgcgagccgggatttcttcacctgcccaaatacagaaagtatgtttcgaaatggccttatttacgtgctggcactggcagtatgcagtaaaagtactcaaaaagaaaaattgttacccccaaggaactgctcggttagcttgaaaaattcgccctcaaattgattcaccaaagacacagcatatcctgattgccctgcacgtgcagtcctgcccacccgatgaatgtaatcctgcattttggtgcagcattaggatttaaaccacaacaagtatgaaaaaggaaatcctaaatgcatcatctcggtgcagcatatgggaaaaatattcgcgttttgcaatgatcaggtaagaacactgaaattataaagttggaaccttagagttcagtgggaaatcgtaattgatgaccacatcaactccttgaatatcgagaccacggcttgctacatccgtgcaaacaaggatattgcaatctctggtcctaaacctgtttaaagcacctagtctcttatcctggccacaaagttatgacttagaaaaataaatttaagggatcatttctgcctcctaaaccaactaaaatgaaagaatcaagcacttttgaatatctgagtgagtaaacctgactcatttggccgctgatagaaatagctttaaatcgaaggtttctgagcataagagcaaggagccttgttgactcgcaggtccggacaaagaccatgatcatgctccctggcatcttgttcagaacatgaataagataacaatcctgaaatttgcatacaacagaaaaggtgaaacagcaatgaaagataaaatgatttgaacaatgaaacataatttgtgacattatttattaaagttgcatggactgtaaaatcatgtatgcagcatgtaatagcaacatcaaacatataggcacagtatagatcaaataagaggtgcaagtgaccttgtactttgcaggaacaacatataagtcctgtctaagtgtgtccaccaaggaatatttggaggctacttcaacctgattaaaaaaaaagctcaaggcccattaataaataataagatagcactttcctttaatattatttcaaataaatgctcttgagacaaagaaggaaccaccttaacaggattctttaggcaagcacgtcgcagttttttcacctgcaggaccgaaaaaaatttgtcacacgaccagtagtagctaaaagggttatatagatatgacatttaagtagtcctagaaaatttataagagcacaaaatcaatccaatatggtattctcactatctcaggaatgtctaagtacgtgtgattaataatcactccaagcagtgacccacgtcattctgataaatgatggacaaccagcaatgtttaatcttttggttcacattcagaggaagcataaaatcagtatttccatcacaaacgtccataacttttttatatggtcttaacagaaaagcagagctcctgctaataacataaataaataaagctcctatctgccaaccttttcagtcatcgtggctgaaaagaggaaagttctccgttctttaggaataacattaaggatatcatcgacggctttctgaaagtccactttaagtaaatcatcagcttcatccagtacctagcaaaaccaaaagatatgcataaaggtgataaaaaatagtgggttatattgcgatggcccaacaggcatatgtgttacatatatagtacaaggattggacacatccaaatcctcgattacaaatattaataccaggaatactactgcaccgtctcaacaaaatattcctaactataaatatccaacagaaaagaccaaattctgaaaaatacttaccaagtacttcaatttattaaaactgaaaccttttgtattggtcaaatggtccaaaaggcgcccaggagttccaacctaggaaacataatcaagcttagttgagatgaagaaatattacatgatatcagatt

SEQ ID NO: 61463 - DNA, 2892 bp, Oryza sativa
ggaccaaggggaaaaaaaaaggaaacaaactaaaactaaaatgaaacgttactcctatattgaaggagggtggtggcggagtccccactacactcccaacaggcccccaaaaagcgccgcgctagcggctgactacatacagccttccagcaaaatgggctacagaaccactgaaaccgacaagagagagtaatcgaacaccctcgagttccgctccttccagagctgccaagagtcgaagcccttgcgaagatgctcaggcaggcaggccctagaagaccgccaccaaacctgaagtgattggtaaatttgttaaactatactcaccacaacatgtggacgttttgcaagggatatggtttggcttgtccgaggaattccaccaatcagctgaggaaagaaaaatcatcaatagaaaagtgattatagcaagaagtaatagatactctctttgaagagagtaagagactctctttgatcagcactagcatgtctgttgatcaccaaaggaacatcatataatgcatctaataactgaaattctttgaacttttactgagcaagacaacctgctgctgcgctaagtgttttttttccacaacatttaaacacgttgtcaaaaaaacactagtaagtcagagaagcaagagcatccataaatttacaatgctgggttagctacgggaactaaaaattagtagtgattagacgatacggcaatataccactgaacattgcaagctgatcgctgatccgagcgcctcaaactgcttcgcaatctgaatcgccagctccctgaagaaccaccaaagccgcagtccagaatcacacacacattcacaataacagagcaatcaaatcgtcccaggaaagggaaaaaaaaaagaagcagagatagaaaaatttagcaaacctcgtgggcgcaagcacgcaggcgaagaagcacgggcggtgctcgtgctcgagcagcgcctggatgatcggcagcgcgaacgccgccgtcttccccgaccccgtctgccccacgccgatcacgtccctccctacacatccaatcaatcaaccagtaaggatttagccagcaaactagtactcaccgtcgatctccattgcccaattcgctgcaaaccttggagggcgaaggggatgacctccgcctggatcctcgtgggcgccttccaccccatggcgtcgcacgcctcaccagcaccgggcaaaccccgagctccgcgaacgtcgtcggcgcctccgactccacctccacctcctctcccatggcttcacgacgctcctccacctcttcccccatggcttcgcgcgaggcaatctccacctccacgcgcgcgcgggcggcgaagcggctgggtttagggcgagaaaaaaaaaagagaaaaaaagaagaagaagaaagtagtaattgagaaagatctcgctgcagcctgcagggttgcatgatgaacttggaagatggaggcccacttcacaggaaggctcatcaagtaatgggcctcaagagaaacaaagctgataatttttttagattgttttacagatttttaattttttttctaatataaaaagagtgttaattggatccataccattacaaatttgcccatctaaaaaaataccattactatttgttgctctactattttaaaattggaactgtgtcattctgtcacagtttctgtcaacacatgacggagtggtacagttccaattttataagagtagagtggcatccgactgatttgacgaatagaaatattatttttctaaataagtgaatttgtaatggcatgtgtctaattaaccctaaaaagaaataagccaatcttgagatatattttaatgtttaaataactaccaatgattatgttggggttttttttagaaaatacaaaaaattatcaaattatgatttccctattttagaatttttgtgttgaaatgtttttatatgccatgctcatgagctaatcatgttattatcggagatggatatctggtatctacctcaacttcacatatcacaagtacaatggaccataatctcttcaagatccagcttatccaagtcctaatccttcttgtatcattgctgctgtctacttgccttccatgaatgatcctttgttgctgtgaacgagctagatagctacataccatctttctggttagttatcgtctacttgtcttagaatatcgcaacaccaatcatacctctgctcctgttgcttacttcttggatcatcatgttgtccccgtttaaaatctccatctcacaattgcagtaatgaaaaccgagagtagtttacggatcagaacaaggagaagtgtatggattaagggtcgctgaagcagcatcaagcagagaaatcggtatcaggtaacataatgacactgatgacagatgagctgaatgaagttcatgttgctactaaacgaataatgagaaggcatggaacaccatgatgttgtgtacagtttgatgagagctatgtgaaaattagcctagttcagttgattgattgatcatttgatgcgcctggctaattaacattcagaaagttggactgaactgaactctgaacaagctggctgacttcagccatgcatgcatttcttggcaaattttctctgcaatttatccccgttatgtgagctgtaattagatcatggccagagaccggacaatgataacagatagctcatctttctctgaagaaccagcagcagattggatctccttatcagactgtctttcagaattggttagccttgcagatgtactaaatgacttgctgggacatgttgaattgtttatgagcagcatatttatatgcatgattgcattgcatcagagacctcacatcacttggtagttgg

SEQ ID NO: 61464 - DNA, 4474 bp, Oryza sativa
cttagctgcatctttcggttcctgtggctttacttacaaggcatgactctggtttgttccaaacctgtggcttactcttttcacaagtcaaaatgtttttccccctgtaagatgtatgttttgccttcttacattgatcacttctgggttagatggatatgttatattcagagaaaacatgtgctccctctggtttttaattttgacaatgtttacttttaaacatatgtttgacaattcgtcttattcaaaaatattgtgcaagtatataaatcatgcttaaaatactttcaataataacataaatgataattacatatttttttaataagatgaatgtaactatgtatgtccaaaaatcaacgacgtcaaacatttaaaaccagagggagtacaaggtttccacaaaagtatctaagggattttcctttcttattgacaaatatgtttgtgctatacgttgttcaacatagtacttttagtcttttagataagggtaattttattatcttgaagaaggtaccaagatgtaccacattttctagtgtaaaaatttgataacttcaggtactaaagttttagcgtaaaatttaggtaattcaaggtactttctcaagaactataaaatttctctttagataatggaagagttgttctttctagtgtttttgagcttggtaaaatggatcattttttaacgacttctattctatctctataatttataagaaattgccaataaagatcacaatgttaaatatatttgatgtttccaatctaaaaatgaattgttctaatctccagggagataatactaagataatggttgaagaatactctcaactctcaacgccacaaaacctgaaacggacagttaacattagcttacgtcatgggatataatatgctcttgttccggcttttggaaaaaagtctaacgaacgcaaccgcgtgaaatgaccaaataaacttgttcaacagaaacaacaaaacagcaggcgaggcatttgctgcagtttttctcttgtttttattttaggtgtagtagtatcagtttggtaggcatcgttgacgcctttagatcttccagctatttctgaatcatcacaccctgcacgttaaaagttcagatattttctttctccctttcatatattctttggagctcctgcaactgaactcaacgaatttcaaaaaccataaattcagtttggatcaaactctagtaattaaacgaaataccaaatcagaaagttgtccggcgaaaaaaaaacaaatcaagaaagttctctgaatttgaatttgcccgaagaacaaagagtaccattctcaaattatatccgtactccagctgccatgtgccaactattcaccatcgatcttaatacaaaagatacgcgctttgcaaattcgcgaaaaaaactattcaccgttaaatctataaaatgataaaattagcaactcatcaattcgatcgatctatcatcattcagtagcatttataaagaccagctcagatgccagtaagataaggggcccaaaaagaagaattatgggagtttgatgctatccttctttggtccatgtccatagttcagtaaaccaaactgcatgatttgcattcagttcttcagctttccatgtcccctacttgagctcattttcctccattctttgccactgtgtgggatctcatgttcctcaaactgcagacatgaagtacttcgaaactttatgcacgtgatctgaacagtgttctgccatggataattcagggtttcagaacatagatttccatgccctgtctgtacaattctacagtctttcagtgaagttataattgtccttgattggaaatggaacagtttttttttcgcgaagaaatggagcagtagtcgtgctatgcttttactccctccgtcctataatataacaatctagaaccggatgagagatatgtccagattcgttgtactataaaatgtcttatccgattctagattaccatattatgggtcagagggagtatgttgtttaacaaagattatggataaaaagaaagaatcattttcagtcatctattggtcaaatattaaattgcttggattctccttcgaagcatctgattggttgaaaatactaaaattctcaagcataaaattagtgtctagaaatgcttatattgcgtataaaatttgaatcctaaatgtttgagagtggagatagcaccgtttgcttagcaacctatgaatagaatatggttcacataaaaaagaaagataaaaagcggaggaaatatggtagaggaggaaaatgacagcctctcgttcaggttgaccatgacacgttcaggaaccttctttccggttgtacaaaccagtctattcacagccaacaaaactaacaaaatgaacaaacaaattcttcagaattaagaaaagaaacggcaaaaatgttactattccagctcaaaacaggctaaacagaattgagtacctactccctctgaacctgtaataactgattaactgagaattgttaattaccaagaattaccagtcctaaagctactatacaactcaacatcaagcaggaaaaaaaataacaacctctgaaaaaggaaaaaagaaacaagaacaagaaaactgtcaaaagttcagcttaatcagaagaaaatatatatacgcatccactaaacccccacgttcacggctaattccattctcgctttcccccaattcgctttcttttccccctttcctcgcctctccgcaaccgccattgccaagaacctcacctcgtcttctcctccttcttcttcttcggcggcggcgatggaggacggctgcagcaaggttgtgagcggtggtgggagcgggagctgcggcggcggcgccaagaagccgttccacttcgcgcggtcgctgacataccaccaccaccaggggcaccgggtgctgccgccggcggcgaagtggaggcggcaccagctcgccgacgagccgcgagcgcggcccaaggacgtggtgctgtacacgacgtcgctgcgcggggtgcggcgcacgttcgcggactgctcctcggtgcgcgccatcctgcgggggttccgcgtcgccgtcgacgagcgcgacgtgtccatggacgccgcgttccgccgcgagctgcggtccctgctcgacgcgcgcggccgcgccttctcgctcccgcagctgctggtcggcggccggctcgtgggcggcgccgacgaggtcaagcagctccacgagagcggccagctgcggcgcctcctcgacggcgccgccggccaggacccggcctacgtctgcgacggctgcggcggcgtccgcttcgtcccctgcaccgcctgcggcggcggccgcaaggtgttcgtcgaggaggaggatcgcgtgcagcgctgcggcgattgcaacgagaacggattggtacgctgccctaattgctgttcttgatcgccaaaaaacacatgatctttccaattcaattcgagctgctaattactaaaggattagaggctttagaatcaagaacagaggcgcctttcggtttctgggtgtgatttgtgttcatccgattcatttggggaatctggatttgctgctcatggatgagagaacgaatcgttcttgactccttgatgcaaaaattgccatgaggtgtggcgattgaaaaaaaattaataagagccgatggctgcatgtatgtattgtatgtaatatatatgggagattgtcactgatattaacatgtaaatacatgagtttgggttgtgtatagttcttgattatcctcatctttttccttgcctgaactcatcctatgacctgtgagttgtgacttgttcttattgaatttcttactgaatagatgactctacaattcaaaacaatgcgttatggaaatgatccaactgtactaacttaaagctccttagttgtaatcatgttctcctttggctattctctaaattggagtttaacttttcgactttttgtttctttattgaagtgcactgtatttgaatttggctttgaaccagtagaccccactcccatccccacatagtttttgagaagttttggggagttcttttatctattcatcgattgcattcagaagaactttttagtgatgcaactagaagctctttggggtcaatacattggtgttactcgccaattgaaatcttaagcctaattgtagagcagataatgcttggactacagaattaggtagtagcaagatgcatacatgttggtttgtttctgtttctgcactcgcacatggatggaagaaggatcaaagccaaaaataaatgcacgaagagatacttcttgtttttctcactgcataaaatttcctcttttttgtccattcatttattgatgaagtgtattacctgagtagttcttgggtcaagttatttgactagcaaggatgttttatgttggagcat

SEQ ID NO: 61465 - DNA, 3806 bp, Oryza sativa
attcatcgatagtgtggttttgtgaaattaaactaccaaaatatatgtacttaagtgccaagtgtcaaaatatgtgtggttttctgcaacttaaaccataaaatatgtagttttgtgaaatttactcaataaaaaatcagaataactgtcactagcaagaaaatgtagaaatgctgctctcagtatcactgtgtttgtcagtctcatgagatatcatccaccctccatcactgtgatctgttaccaatttcctggacgaatctgtccagtgatttggaatctgaatctgaatctgaattgctcggggattctgctgacatcaccggcaaacaatggtagcctgacatagattggagtctcataccgaggtggtagctgcaccatggacatcagatcaaaggtttcccttgccatttggggagggattaccgctacctgaaggtatcatagttatcgcggtaacctcccaattatctaaaaatcaagagggttaacgtgcgaggttaccactaaccaacgagttcagagcaaagcaaacaagagatttgtctggaactgtacaatctaccactgcgtacaccagtacaggggctttcagcgagatgatcatccatacaaaaattacaggaagagtggcaggctggcagctgctagctagattagtgtcagagcaattcgtttatgaatgcattacaatcatttcgtactggagagattcatacagcgttcatgggtactgaaactgaaacaagcagccgcactgagatgtttgctccttccaaatctcaaaacatttccttcgttgaaataatccaactgaactaacttaaagctccttaactgtaatcaaagtgcactaaacctgcaaatgtagctctgtaaccaacagtcatcacaaaagtgcactagtaaatatgttctttataacaattattcaagggcatgaacgaattaattatatattagaaagttgatttaaaaggttctttaagaaatgtcaatggaaaaaatttacaaaaaaaaaacatacatttaggagcttaggaagcatgcagttccactagactgcaagataaggactgcacatgatgttggtcatctatttttcctatggagggtttagatttaaagctacagtcagtaaaagtgaagattttttttggcttggataataacttggatgatctgaccgttgaattttcatcggatggtcctagtgtgcactagggactgcaggtgaaccgaatccatgcccgtgacaatccataatccataagcagaaaaggatgacttctcgttcagaaaaaaaaaaagatggatgaaactattatatgttccttgcattgatcatccagcacgtcgtcgtcctgagcaagctgccttcattttccaggacatgggtgcggaagctcggcgattctgctggcatccgagctcgcacggttgcacaaataaactcttcattgttcacgtgcccctcttgctgtacatgttgacaatttggcatggcgcacaagttgaccaatttgctcgccattgtcaggctcgatgcaatctcgaattcaaatgttcatcaaatccctcctcaaccagtttacggcatatgcagtgtccacaaatcaacatacatgcacgaatttcagagaaaaggtgttcaaatttacagctgaacatgtagtagtaggagcaaatgcaggtttggcaggggtacatttccggcaaaacaatggtggcctgacatagatttgaatcatacaaaggggagagctacatcatttacatttggcagagtcaccatcagaagattcgccagattggctaattcttggagaagttaagagcaaagaagagatttgccttcaattctactacatcagtgccacgagacaatcatccatacaaaatgttcctgaaccactagaagaagaatggcagctggtagctaagacagtctacaatcttacaaggtcctgcctagctagttccgggagcaattcgcttacgcattatcccatttcaccctggaattcaagaatcaagatccatgtcgcaatcaaactaacagtcgcaacgagaagttagagatgttgtgattcactgctccttccaaatccttccggtgacacgcagtttgagctccttcttgtcgccaccggagaagaacaaggccatgttccgctggatgataaggccgtcgtagctgtcccgaactttcctgtgactgtctctgatgcttcgggggacgccttgccaggtcatcttccgaccactgcctccgacctccaggctgtagctatagttcttggcttctgcatcatctcccatgaaccgtaggaaggcgatgtagacaggtgccatgcccaactggaatgcctcaaagtgcaggcaaaagtactggccgaaacagctgaaaacctggatagagaatccacatttagttatagcatacttatcaccgtggagaataaaagagaagttaaaagattcaaaacagttgtacaatcatgttctaaccaggaaatgatgaattgaagatagcaacttggcagtttgccagtgttgcaatatccaatttaaccaagctagtaagcatgcacttatcgaacaaacagaaattcatattttacgtttacgaaaaaaatatctaacacgagaactttgcagaattcatggagtgtaaacaacagttggaaagcattgacatactaactagtatacatgtcaatcaaatttgtatgtgcaacctagtaacatgaacattgtgaggtgttcttttcataaattacagagcactgagaaaattaccgtgagcatccaggtagcattctcaacttcatgaggatttgatttgacataacggtgattgaaggtgcttccgttgtgcatgtcaaccttatgatcatctttcaagtgacttactagatactgaatgtcaccagcaacagtgcattcagatccagcatatgggcaagtatagggcctgtattggcactgtgactcatgcttcagcttgcagtaataaggatatatgcccaagcacccaaagttctgatatttgcatggaagctctagtgatgcagctaccttttccagagcaaggcatcttatgttacccaattcatgtctgcaagttgggcagcggttgtgaaccctgggcttgcatccggaacatagagtatgaccattggagcactacacacagtgatggaaatattgttaaggaatgtgcttacatattcaatttgctcttcagggttaatgaatgtacagttttcagaacacttgggcttcataaaaatatcgaactgaaacctatgttagctcaacctaaattaaagctaaaataacatttttactccaagtccctaggcagtgtttggcaaatgtctaatggaaatgatttcccacccatctttaaatcctaaccattcattctcccccatccatttaatcctaacccttcattcatttcccaatcccaatcccacctctcatttcccattatccaaacacacccctactgtataccagatacaagcatgccaaaagcctataactatgctagcataatgtcactggatggttcagataaatgtaatgtaagtgtagttaagagtttggtaacaaggtgtacctgatgaattggaggatacatggcatttagacacacagggcattccagtagctcacgcacattgccagagaccatcgcattcggttttggtgaatgctgggtgtgatcatcaacaagttcagtaacatccagcatctcctcgttctttggaggatcgataacttcagaatgg

SEQ ID NO: 61466 - DNA, 1442 bp, Oryza sativa
tatacatcactgatggggaaaaccatttacttgaccgaataagcacacctcgacatgaataaatcccatccgctccaaagcatcaaaccccccaaaatcccaaaagaaaaccgaccaaaaaccctaatcgacagcaaccaagggcacctagacacacacattcgcgatctcaccaccgcattttcaccatacccgaaccaagaacggcaggagcgcctcaaaaccccccgaaaatccaatctttcctttcaaaaaaacaatccaaaaggaagcgagcgaaatgcgctacctcaaaacggaaggccaaaccagcgggtttgatttgatctgggatgctttgggtccagcttgaatgatgctactgcagtgaagggctcgagaggaagaggaaccgaggaggagtcaggagcattcgaaataaagctcctcctctctctctgtctcctctctatcagaggaagttttttatggtctcttgtggttttccttccccatctcctcggggtttggaaaggattatttcgatgttactgttcattcagtgggggcctgtctgtttggtgcaggtcatcaacggtaaaaacgaattactgctactccattctctgtagttcgaattctttaatgatgagcagtagatgcacaactgatgcttccaacagtgtagagtgacaatgaagaacttcatttttttccttttggaaacttcaggtgtccaaatgaatcttcctacagtatatgaaggaaaaattatgggaaaactgtcggaggaatctttttgaacttcttgtagtttgtactcattggctttgtttgagaggcttatcacagctgtggattctttcagaatctctaccttcagaaacaatccaaatttccacttacgccgtgttcagttccaaaatatttcttcaaacttccaactttttcgtcacatcaaaactttcctacacacataaacttccaatttttccgtcacatagttccaatttcaatcaaactttcaattttgacgtgaactaaagacagccttactattagattttgagaaaccctactattagctatgtttagttctcactaaaattggaagtttggttgaaattggaacgatgtgatggaaaagttagaagtttgtgtgtgtaggaaagttttgatgtgatgaaaaaaattgaaagtttgaagaattattttggatctaaacacggcgtagtactccagtagtatttgcactgtacttgcccaaccaaagttatccagattccagagcaccccaagctgatggcttcatcagaaataaaggaaacctgaaagttcagacttggatttctttttaataatgaaactgtaaagtgggaacagcctttgtcattttctgaaaaagaaaaaacaacgagccagctttaacagaatgaacattcaggccaagggagagaggaaac

SEQ ID NO: 61467 - DNA, 9442 bp, Oryza sativa
actaccctcgtccacaaatatagtcgtcaaaaatattatatttgtagacgaatgtagtaaattgcaattgcttcagacattgaaaaaaagagtgatctgtatcattttccttcccaagaaaaactgagaaaatcaccaccaaatagacaagttcagaactgcaagatcaatacaaactccatcgaacgcatgattaacagaatgtcagtcatccaaatggaaaaatagcagtccaaatgcatccttgtctgattgctcgcttccacaagaacaatcacgtttacaacaggtagaagttaatttagcagtcagtgtcagatagggtccccgccttgtcctttgttcaaattaacgacaataggacgtgaagatcactacaaacggccaatcaataacctgtgctgccgatccaagaattagggtaaatttgatctgtgacagctaagtttatgaaattatcaaactttatgcagttaacttgtaactagtgtccctgttgatccaaatagaaaatatttatcatatgttacaacaaacaggaggcagacaatgccaagagttgatactggataggatacatggccatggccttacaggtttacatgaattcctacctttctcctacttcgaaccagaagaaaacagaactgcgagaatagatagcccgcacatgttgcagcgccagtgttccattagtcctgacggccttcgcacccccctcaatgcgggtgcgaacaacagttacaccatgtccttgctccttgagtgatgagaacgaatcatactcaatcgctgtgctaattatagggaaggacaaataatccagaggattttgctcgcactggagcaagcactcctcaatagttaatctaccacttcgatgaagcaaacaacacccaagctctgctctaatagtgagatttgcaatcttgcaggtggaatggaactccaacgcactgctcagacaggcaagtggaaggtattaaaatcattgccgctttgacgaaacattagaaagaacaaaaaaccattgccacagaagaaaaatgcatacttgtcagagccacgcgaacatgttaacactgtgtcgtcaggaagctcacccccgccaatctgacagtaagcaaatgacaagcgtaagctcaaagttgcatcaacaacaaaaaagaattgctgtgtaatgcaagaagcatttcatcagaataccagatcaaactttcactcttgagatataacaaacatgaatggaaaaacttacaatgcagagaggcttctttatttggatattacgtgcaacatgtgtgccaccagcagcaattagaatagtatccccaggcctttaaaacaacgcaaataaaggtcatccataagaccataaccccctctataacataatgaacattgaacagtcagatagaacacggacctagctgcagaaacagcagactcaagatttggatagactcctggctctattgtatttctgattggcctctcaacacgcaaccacagtcgaggatggcatgcaaggaagcgccatctgtggcaaacgagggcggtgttatacctatctgcaggttcaaaaatgaaatgctaaaaaaagctcatttaaagtacataaacagcgtcacattatcaggcaataaatggtagcagggacaaaatcaagcacgccaacagtgagctaaaggtttgatatacctagaaatagggacaagattgaacatccaaacttaccaggtggagtgttgctaactctaggggtctaccgatcccacagtgaaggcagatatacaacaaaattatttgttttcatataaaacctatttcatcaatagagatgtaaatagcaatatttagcatgaaatttcggtcgaataaagcttctaaaactcaaaagatgcaccttgtagcgacgttcatgcaatttatatgatttgttcacccattttggcaattgttgctattgtagcgatgttcaccagttcatgtgatttgttgtctactggatgagatggcaataactcacatgaacatttgctccaatagcagcaatgccgaaatggatcaaccatcagtttctcaccctagaacctagaacaacacatcagctggaccattatggtattgcggttccacgatctcactgtgtaaagttgtaaatccaagagtaatcaaaccatgaattcgcaattgcgagcacttaagcaaaccctacgaatcatcccctggagaaggtgcttagtgacatcttcatctattagacaaaattaaatttcactacaattacataatagaccccatactagaacaatccagcaaaactccaatcgagctaaagcctaaagcaggtctaaacccccaattttggcccgttcccatttcccctccgtcccaaatcctcgaacattttacattccccaaagcctacgccaccaaccgttcgcagcaatttaccaatcggcctcaaattctcccataacaagattagggtaatcgtaagactacgaacgaatcgaacctgggattgggctgaggaagctgaagatgtgcatgaggcagccgtcgtccaggctgttgaccggcgcctcccccgacggccccgccgccgaccgctgccgcttcggaggcatctctccgaatccctctcccccccagtacggcgtgcggcgccggcggcgagcggcggcgcggtggcctgcggcgagcgcgaggtcggcaacggcagctgcacgcgcggcacgggggatatctcgccgcctcgacggatccacgattttttccgccatcgcgggccccacctgtcagatggcggttggtcgggcctgtccacgtggctgcctccgctgcgtcggatgggcttggactagaattaagccaggcccatattgggccataaaagtggacgaattacagtctttaggcccagttaactgtttgggtttttaatccttttctttttttggctgattaaaatgcagatttcacatagatttctgtcggtatattttttaaattgttgaattttctgcaaaagtattttttataaaaaaatttattcgcacgtgtcaaacaaacgcatgtgaatgcacggtgttttcgactgaaaaacatacttcttccgtttcacaatgtaagtcattctagcatttctcacattcatattgatgttaatgaatctagatgtagattcattaatatcaatataaatatggaaaatgctataatgacttacattgtgaaacggagggagtatatagtatacttcgtacgattgtgtgtgagtgcgaaaaatgtggttacggaaagctttactccccttttgtgttgctcccccacttgcatttgttgtgatccgattatttgtaattaatcatgcttgtgagatgcttgtgcaaagtgcaaataccatctttgcggactaatgtgataatcagcatatgtgcattggtgcgattattctactgcccttgctttacaaactcgatacacgtacaggttgattctttgctattgtcgcgaagaattagagtatgttttatatataaaagctttgctaaagcttgggacaaaacaatagtaatgcagatcacgagttcttgaatgaaattttgtaggaaagcttaatgcctaaggaagttagctgtgcagcacatatattcatcagtgatttgtcatttgtgcaaagtgctgcaaatgtgcccataactttgcaagtttttctccagctctttcgaaaaatccctgctctttataattcctagtactagcttgactgtccatttgtccgtgtaatctcgtgtcgtgtgttcgccaccattgccactcagagcgcagagaagagatcgatcgatcatgtccatcaatgccgtcccgagccccgtcccgtccgcctccgacgacgccgagagcctcaggaaggcgcttcaaggtgcgtgctctcacatcgccattcatccatggcagctgcgttgcgtgtcgtcatctagagtcaatggtttatagctatacagctgttcgtgaactttggttgaaaattagaattcaataatttttatgatcttattataccgtgggagtttttattagtttttgtgtgtttttttgtttattcgtatgtgaggtttttattgaattgatgtaataattggctgtggatatttgagtaaaggccagaactatattccattatatgaaaaaatccatggcaacttcctctctggattcttcgactcttcgtgttgttcttgctgttgtcgtacagtgcgacatggacgcatggtgacgacgcgtgttgcatccgcaggatggagagcggacaagggcgccctgacccggatcctgtgccggcgaacggcggcgcagcgggcggcgatacgccgcgcctacgccttcctctaccgggagcccctcctcaactgcttccgctacaagctctcccgccattgcctcctctccctcgatttctgggtactactaagctttgcctgatcttccataaacttctctcttctgaattctccaaatgctgtatatatttttttttctcaatcttgagatttcttggttcagaaagccatgatcctgtggacgatggacccggcagaacgggacgcgaacctagtgcacgaagcactgaagaagaagcagagagacgagacctactacatgtccgtgctgatcgaggtgtcgtgcgcttgcaccccggatcacctcgtcgccgtcaggcgcgcctacctcgccctcttcggctgctccgtcgaggaggacgtcgcggcgtcgccggcgatccaagaacctctgaagaaggcaagccaagatcacactgcaactcacaatctcatatcatgttcagataagttcagagaattcagacaaggagacttctttttttttccctaatcgatcgttgctggtgtgtttctgatctgcagatgctggtgaggctggtgagctcgtaccgctacgagggagatgagtgcgtcgtcgacatggacgtggtgaggatggaggcgtctcagctggcagaagccatcaagaagaagaagcagccgcgcggggaagacgaggtcgttcggattgtgaccactcggagcaagtcccagctcagggcaacgtttcagagatacagagaggatcatggttcagacatagctgaggtatatgataactttgataagattaccaagcaaatcaacagcatcatcatgccaaacttgataagattaccaagcaaatcaacagcatcatcatgccacaagataagcaaaaaaagatgaagaaaacgtgtgatcttcattgctgtcttgttctttcaggatattgacagccattgcatcggccagtttggcaggatgctgaagaccgccgtgtggtgcttaacatcacctgaaaaacactttgcagaggtgaattaacacctaaaaacccaactcagattagcatcgggccatctttgtaatcacagtgataattaacctgttctgttcttgcacatgctggttcaggtgatcaggcactcgatcttgggattggggacgtacgaggacatgctcaccagagtaatcgtgtcgcgtgctgagatcgacatgagacacatcagggaggagtacaaggtcaggtacaagaccaccgtcactcgcgacgtcgtcggcgacacatcgttcggttacaagggcttcttgctggcgttggtcgggagggaggactgaagaacaacgaaagaagtgttccaatgcattggtatatgggaatgacatgtggggtccagacccacatgtcaatgtgacatacgatggtatttcgactttgtgatttttgagatgtaccaggcaaattgggacaaataaaggttgtgatttaataagttgttggtcactgatttgcaaaaaagacagagaatggatttcacaaaaaccttttaagacactcaaaacgcaaaacctaaagtttcaaaaaacctcagggtttgggggtgaaatgttacaagaaacccaaatgtttaagcttacaatgtcatttttgctagtatatttatgcgtaataattaaaaagaatatatgagatattcctagcctcattttaacgagcattattacggtattatgattaatgtttgtccatataagtaaccggtcaatatgtcattattagtatgattgtgttgtatttttttcaatcatataatgcaaaagtaagaaaaaaagacgaagtaaatgtgatgggtatgtattttgagcctactaatgtaaacatatccaaaaatattatatttaataatggaattatgagtacgtgacataaacatgcgtttcttgaaacactatgatacctcaaaacctggggttctttgaatcaaatcataatatgtgttgttttgtgttacatgtgcttcaaaccctggggttttctgaaatttaaggatcagtaaaatttagctagaaagattttgcaaatagtaacaagggatccatttgcaaagaaaatatatgggagtaaagtggtacagtgaaaattcatgagttttcgttctgtaagctcgtctggatgggcctatacatcagtggcccggcaatgaggcccatccaatgcaggcccaccatcgagtgtcaggagtcaggaccgctgctgggtcccacattaaacaagcggctccaaactggcatctccgccatgagtccatgacacgtgggccccaccctttaccgacagagagcagcaaagctcacgaaattttacgcctcccgctctccgtttcgaaacgctccccattcccccatccttctctctctccacctaaggctcgaatcgaagccgacctcctcctccgctcgccgccgccgccggcgtcgtccgcggcgagatggcgccgcccttcgtcttcccctcgaccctccgggacctggagcgggacggagacggcggcggcgacgacgagccggccctccgcccgcagaaccccgtcgccgtcggcgcactccgcgccgccgacctcgaggagttcgtcaaaggtataaaacccgctccccaccacctccgcttcctctcgaaatcactccatcgcttgccgtaaatcgatggtttggttgtggcgtgcggtggagctgagattgtttctcctgtatcgttcgcttcgtattggtggttgtaaagtgtaaaccctagttcccgttaatttggcctcccgcgctctactcctagtttggttcttgcatgtatttaagacccaattaaagtcaaatccctgtgattctgtggaataagagttgtggactgttgatagacatttttggcgcaagattttgctgcatttagcctgtagagtcatttcaaagctaactattgcaaggcatatcctttttagaattttttttcatcttgctccttggccattttcatcgaagtggattgtttatttgttttgcttttagaatctgcagctttggatatgacagggtttagctagctcatgtgtagtaatggaactaacaattgagtgttcttgcttttgacaaaaggttcggcctctatttgtgtcccacaaaaaaaagttttttcttctacatgttaaaattcgttagaccagggagctttgtggcatgtagggaaattaatgcacatgtttgtaagaaaaacatgcacattcatctgtgcatctgtaaatatttcaaactgtgaaatgataccatccttacctagctctgggctatgaatgccttttgtaagtttcatctccattcctcttcctggaaaagtttgtttttattttaggcattcacatcaccaaaactgacgattcattcaaggacatcagacaaaaagttttagtcccattcatctattcatccaaacttacaaagcttttactgggctaaaatttctcaatgtgcattttgtcacaaactagtgcatattaagcttaatgtaagctgcatgtggtttgttcagcaaagtattcaatttatctcacaatcaaagtactaactcttattgaatcaattttgtaatattccaccctgtttgaatgagcgtgcagctgtgcattttacatcgtgtatcttttgaaccaaaggttttctctgaacgagctaattctttctttcattttttttcttaaattataggcacatcgtttgacctgtctgacaaggaactcttctgcatcgaggagcaggacgtgtttgaccgcgtctattccctcgtgcgtgacttcacttgcttgccccctgccctcaagttcaaccttgttgagaccttgcgctccaatcttagtgttctcctcccaaacatagactccctttcacgagcttccatgtcatccccttctgatgggatcccagtaactgatcgcattgcttcgcatcggaatgcccttaagatctactccttcttcctcctctccattgttgttgctgaagaatcgggagctgatagttgcaatggccctaaggtaatacctgtgcaaaagttacaatttatttggactctttgtacccttctaattttaactgaacttattatgccatgtggacttaggtggcagtacatggtcggaagaagaatgctgtatatgcttggaattgggaagcacaaagaggccgcatcatgaatcttattgctaattcacttgaagttgacctatcactattgtttggtccaggcggtgctgatgaacaatatctctcttttgtttcaaagtaaattcaagaaactagctgtgttatgctttctgtattcattccttatagagttatagtgatgttgctttggatgaatatgtgtaggtgtacttttgttctctgtgagaaccagaacgtgctgaaagatgaggaaataagaaatggcttgtgccgaataattggtgcaattgctacgaagcatcaaagagtatctcaaacaagtgcatctgtcttgcatttgattcataaatttgatttcactgtcgtgcttctagcggaatcagttgctgctgcagagaaaaggtttggtgatggaagccttgcgattttgctgataagggaaataggtcggactgacccaaaagattatgtaagagatagtgccggtgctgacaatgccgggagattcctagtagaacttgcagatcgcttgccaaagctcatgtcaaccaatattggtgttctgatacctcattttggtggggaatcatacaagattagaaattctcttgttggggtcttgggcaagctggctgcaaaggccttcaaagatgttgaaggcgatagtgacgcccattctttaaggctccgaagtaagcatgctatgctggaaattttgcttgaacgttgtcgagatgtgtctgcatacacgaggagtcgtgtgcttcaggtatgggcagagctgtgtgaagaaaatgctatttcaattggcctgtggaatgaagtggcatcagttgcttcgggcagatggaggacaagagtgc

SEQ ID NO: 61468 - DNA, 1223 bp, Oryza sativa
taatgccaactcttgtccagttgttggcatcgtcttcagccactgatgttgagaacacaattcttctattaatgagatgcagacaatttcagattgaaggttcggaagaagccctccggaaaatgttacctctggtaatgcctccctggaagtgtaggttgtttgtgaatatgagttagaatgtacacttcgtcacttccttatcttcataaattttgcaggtattttctcaggataagtcaatatatgaagctgtggagagtgcattcatcactatatacacaaagaaaagtcccacggaaacagccaaaagtttattaaaccttaccattgaatgcagcattggtgaccttgctgcccttgaaagcttagttagttcattggtatcaaaaggagaaatttcatccaacacggtgcactcttgtttcccttcaaagtttgctcatagcaacctttcaaatgctattttttacagtttagttacagtaatgctaagtactccccccattccaaaatatagggcacaacgattttttcccctaatgttgcataatacgaggttcgcatgcatgcgtgcatgctattgactagcacctccccctcctctaagttctatttttaaagcctctaccctcaagatctctgatctctaatcccattgggtgcatgcattttatttattgggatgatccaaattagaaggtgataataattttttcttggtttttgcgtaagagatagttgctcattatattttggaatgtaggggagtactcatttattctagcacaccaatctcctgtgcaccaaaagtgattctgcacatagattgagaatgcaaggtagtactaacttgcaattaagtgagtgcattaattgctgaatatgcataaattaagaacttaagatgcatgcaaagaatattgctcccagtttctccactttctgatgtgaacttcccttatctagatcctacagtgggaacttttttctgttcatcttgaagtatcttttgttagctgctcatcaaaataatttatattgcctataacataacttataccattttgtcgaatgttatttatctaacttcagtgacacctattatcttttgttggggaagttcacacttgttaaatcccattgtcttttgcagataacagccctgtgggattatttttgctttcacatcaatggtgtgaaaccagtgcaaagccgtggag

SEQ ID NO: 61469 - DNA, 3182 bp, Oryza sativa
  unsure (1)..(3182): unsure at all n locations
ttcatcaatgtccatgctttcaagcttcttcttggtctcttcatcagtcttatcttctttgaataactcttctgctccaaatctcaatatcgctgaaagttcattctggcaaaatgtatagctcacatcagaagagcaaaacagaaaatacaagtgaggtgacaagccagattctatttaatgcatttctctcagaattttaattatcagtaaatgctcttgtgttgtagagagaattatagcttgggtatcttgaaagaaggctggtctagtcacatgagcatatatataccacactagacttacagcctgtatcactaacaatcgcttagttgataagttactggtagttttaacaatcttttgtaatacaattatacaatagatagatttcaaatatacaaatctatcttatatacaaaagattgttaaaactacctaagtaatattgttgtaccaaaccaatatgacatccaaatcaacccaaatacctaagtaaactaaataactggtgcagaaacttaccttgtcaaacatggaaccacctttttttgattctttcttctcgagcctgccctcagcatttagcttctgaatcactaggtgatcaagaacctgacatatatagaaaaagaacaagtcagaggttattcgtttatatttattaaaacaatatatgaaacaaatcaggctcatcaccatttttttctttgcacgttccaatatatccttcttcaacacttttgcatgtcacgaaacgatatatgttaacagtttcttgttgcccaatcctgtgtgccctactcattgcctagcatgacatcacacattcaaaaacccgaaatatgagaaactctttcaagacaaaaattgaaaacccatatatgagagagagagagagagaggggaacctgtaaatcattttgcggattccagtctgaatcaaaaatgatcacggtatctgctgttgcaagattaataccaagcccaccagcacgtgtagacagaagaaaacagaagtcatcacttccaggagcattaaaatgctccatggcctggtgacgaagatctgctctcgtactgccatcaagcctctgaaactggaatcctcggagggatagatactcagcaaggatgtccaacatcctaaccatctgcaacaatttgattcagaaagcacttatataagttatctaaggtgcaaatgctttcaagcgacatataatatattcgttgtccgatatattgatgttggtgtaaaatacaaatgtggctctagtaacacaattgctttcaaaatgcagggaaaccataattgtgttgtaaaaaatataaatacatttaccaactaacaaaagcaaccaattgaataagcttgttctgtcagattaaatatcataaaaaacactgtaaagtgggaaaacaaatacactgagccagctcttcctatcatccctgaagagaagtttcattctgcaaacaaaacactaaccaactatgcaaccaactaaccacgttgttaacttgactcaccatactaatttctcaaattgaagcaaatttctgcacgtatgcaacatattgctaatggattgtagaaaataagtttagacaatgtattggatactattagttcgactaatatagactgcaacacaatgggcatcaaatggcaagtaaaccaaacatacaaacctgagagaagataagcacacgatgattagtctcccgcagtcttaccaacagcttgtccaataacactaatttcccactactcataacaatgcgttcaactttattgcgatcaccaatgctatctccaccataaccatgatcagcactttcaaataaaaatgggtggttgcagcactttttcaactcaacaacgatatttaaaagcgagacctgcatatgcaataatcaagttagctagaataatttaaataaccagacatttaaatgtgcctgcagaagaatctgtgttttgttaatgctattttctttgtgtgtatattatgaagaatcacctagaaaaaacaaaatggaatcataaaaaattgaaaacacgaagaactgcagattagctcaggaaaaatagccctcgattggaaaaagaactgctacatatgcactgctcatttctcaaatacaatatacaggatattccatgaaggacaatcagcattacacaagcattgtgaacagcctaattataaatagttgtgaagttaaagataagtggtggttgtcaaaaaataataatgcatcgagtaaatcaggcaataaaggtttgcatatataaaagtagtacaccgtcatagcgactacgtaggaacagaagaatagaagaaatcattactaaaataaaatagtgctcaagatttatcaacacctgattcccacgaactcctttgttgagattctggaaattccgctccaaaatccatttgtaatacctaataattaattaggaaaaatgattttatctcaatgatgaataaaaggaacataaacttacattagtacaaagtatttactgcttctgtagaggagacatatcaacacgaagaatccgctcaattttcggaggtaaagatttctccacatcttttataactcgtcttagaatatgaggcctcaattccttgtgaagatttgcaagctataaaaataaatcaagcaaagttatggatgtccaatgctgacagaatagtctaggtcaagagaaaagtacattttgaaagagaaaaatatttacctcagtttcattgaaggaactcaaatttttgtatctctcaacaaatatatccttgctgttgaatttagatggatcaaggaaatgaagtaacgccctgcagattttaaaatacactcagcaaaaatgggacaaagaataataaaggtaaaacaaaaatatatatagaggcaaaatgcaacagctatgaacatgttgcagtctctagtcacctattcacaataagaatatgaacttccaaccataaatctacataaaatcgcataccagagctcttcaacgctgttttgcaatggggtcccggtgatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 61470 - DNA, 7794 bp, Oryza sativa
  unsure (1)..(7794): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgcccctgtcactctcacacgctcacttactccttaagcctgagcattctggtgcatttgcatatttgcattgcaccatccagctagcttccttgggctagtttagaaaatctttctgatcgctagcgcagcttcttccaaaatcaaaaactttcttaaacagttcagtattttctaaattcaaaaaaatattgtagaattcataaagtaaactaaaagtcagaattttgctttcttagcttattcgaaattatcactagatggatttccatcaggcgtttctcagaatctaaagcgactgacccaaagaaactcttggtctctatctaccctgcttggtgtgtgttgatggcctaaccatcaagacatgaaccaaccccgtgacactaaccaaccctggtctttgataatccctacattgattaacaacaattgattgatcaccttaggtgacatgacgacgaaaaatgatgtttatttgtatgggttagtaagcatcaactgctcctggggtttaactaatcaaggtgatcgcttcaccggcactctggtgacatcacaatatcgcatgatatgattttcagtgaaaagaagtcgtttttatgtcatctctatctatactttgcatttttttccaataaaaatcagttgttttccgttaagattgtactctgtacgactctatagaaattttgtgcgctagggcccatatggattatggcaatggagattttcatgattttatttgtccaaaatgaaccacaagtacgaagaagatgtatcgtgaacacgtggatatttatattgagtcttgtagtataagtggcttgtatttgctcccttctcaaataaatgtagttagtcaaatctcaaaaccttaaataattaactaatataaaaatattaggattttacatggtaaaatgatttgcatagatttattatgaaaacgattttaatatagtaatattcttaatagtttttatctaaaaaaataaatatatagttataaaaggtaataatgaaacacttgtattggatactatgtcaatgtctaaatcgacaagtaaaacggaacgggtagtagtagcagttatggtgaaatcacgtcacttgcttagataatccagaatttgactcctacttttatttctacgcgtttgtatttaattttgaatttgaactcatgacctgtgaactgtaaacctcaataggaatataggatgacctagtaggcagaactaagtcagcatttttgtttttttaaccacaaatactgactaacattaaccggcgttttttttttgtgaagctatatagggatcataactttaagatcgcccaaagcttaaattagttggatctgacaaaagtggcacggattgctacttcgtttgtcagcttcgtaggatccattgattaattagcctgcgtcagaaagttagctcacgaaaagtgtactccattagctaactttcctttctccaaaagctcgcattacaggacacttaccaagtgctcacaaagtagacaaaaaatttgttggtgtttcgttttttttcctctctcctttttggtgtacctagtttcaaacaggagtaacataattaatttcaaacagaaggaacatattattcagcatacgtgtacacggcatttagtagatacagtcatacagagtactacttggttgagattagtctagttggtatcgtacctgaagaatttggtaccggcaaaacttggattgaactgatgtgtatcttccatccttctgaaagtgtattatcttcaagaagagaattaagattgcttagtggtactgattaagctcgttcttaaagcattatgctgtccaggtacaatgtgttttattatagggatgctaatgtgatgttacataggatccgacttctgcattactgctagctgtgcatgcatgcagctcaaaccatggtctgaaagtctgaaagactgaaactattcaacgagtgaatgcatccatcgtatctcctcttatttcttctgtttttgaatggaccctagttctttttgccgtcatggtgttggttttgagaagatgcaattggtgggttgcttggtcaaatcgaactgagatggcttggaaacccctcaaaaaataatgtacacatggacccatccccaatgctgaaaccaccttccagcctagcattgccaactcaaactaggaactccccaacctcacaaaccaaaggctatgcccacacaacactagtactagaatgcaacaaacaatactagctcaaggatagactaacatattcctcttttccatttttttttgcgaggaattgataaactgacttcactctcattatatttcgtcaatattattggtattcaaaccagcctttacaaaaccacgtggttacctcatgatttaccgtggtaaccatgcacgaccggttttttaaaacctcacattttttttcttggttatctcccgataaacacatggttaccgcattaactgggataccatcaattagcggtgaccctactaaatttgcaagaaaacttgatacaaacttataaaaagtgtatttcgtcaataaccatcatatgcgtggcttgaaactaaatggtcttcaatcagttacacaatataatttcttaccaaccgatatagatagggacatgaatgtaaattaggcttctccagaaacacggagatgataacacacgatatatgattccgaccgctaaaaagacatatagcactaaacagttatataacaaaaccatatggacagatttttcacattttgatgctctctaccgatcgatggtcccaccaaatatgctggaagatgttccatcatcagtgatgcttcttgctggccgggttgctctagcatagctcaacctctaaccgccactagttttttatactcttctctatagccatttaagctctctccctgcagcttctcacaatccaaaaccccaaaaccttctcattttttttgtagaccaagccaagctacagccaaagccaagcatggtgcaacaacagcagcagcagcagcacagaatctacatcctacagttcaggaagggcgagcaggatcaggaggtcgcatgcaaggtctcgacgccgcccaaggccggcaccggccgccgtgtcatgtactactaccacgactacggcggcggcggcgccggcaagaacggcaaggcggcgcagcctagggcgttcagcatgcgccgcttctttgggctgctgctgctgtcgttcgtctcggttgggacgctgttcgtggcgcccgtgtcgttcttctccttcgtgcactccgacgagggtggcggtggcgcggccgcggcggcgcggcgtgcggtggaggtcgccgcggcgccgtgctctggcatggggaatgatagcctttgctgtgaccggacgtcgacgcgggcggacatctgcttcgcgcgcggcgacgtgcggatgcactcggcgagcgcgtcgttccagctcgtgtcgtcgtcgtccgggaacgcgacggcggcggcggtggaggaggagaggatacggccgtacacgcgcaagtgggaggcgaacgtcatggcgacgatcgacgaggtgcggctccgtcgcgtgcccgccggcggcgcggcgcggtgcgacgtcgtgcacgacgtgcccgccgtggtgttctccacgggcgggtacacgggcaacgtgtaccacgagttcaacgacgggatcctgccgctgttcgtgacgtcgaaccacctccgccgccgcgtggtgttcgtcatcctcgagtaccacgactggtggatgaccaagtacggcgacgtcgtgtcccgcctctcggcgttcccgccgatcgacttcaccgccgaccgccgcgtgcactgcttcccggaggtgatcgccggcctgcgcatccacggcgagctcaccgtcgatcccgagaagacgccggagggcaagagcatccgccacttccggacgctcctcgacgacgcctaccgcggccgcatccagtacctcgagcggctcgagcgccgcgccgctcgcagccgcaagcgccgcgccgccgcggccaagcccaccaccacctccatcgccctgccgatcatggcgcctccggcgaagcaggcctcgccgtcgccgccggacaggcctcgtctggtgatcgtgtcgcgcacggggtcccgcgtgatcgagaacgaggcggacgtcgccgcgctcgccgcggacgtcggcttcgacgtgcgcgtggtccgccccgagcgcaccaccgagctgtgcaagatataccgggagctcaacgccagcgacgccatggtgggcgtgcacggcgccgccatgacccacttcctcttcatgcgcccgggcaaggtgttcgtccaggtcgtgccgctcggcaccgactgggccgccggcgcctactacggcgagccggcggcgcgcctcggcctccgctacgtcggctacaagatcctccccgaggagagctccctctcccgcgagtaccccaccggcgaccccgtgctcaccgaccccgccggcgtcggcaagcgcggctgggacgtcaccaagaaggtctacctcgatcgccagaacgtccgcctcgacctgccacgcttcagggaggtgctcgtcggagctcaccggcacttggtcgccggcaagcggcggcgccggcaaagagagagccagtgatcgagcaatcaatcgattgatcgtttgcttgatttgacccggtttggttaaccaaattaactactcccatatgctgctctagctctctctctctctctctctacacaatttttttttgctttttttttcttttcttgttgttactcaaacactgacttgacctgacaattctttgcattagattgtgaattgatgtactttgtggttttacacgtttcagttctatgaacttgatgtgaatatatactcaataaagatatcaaattacactgcatctgtacttaacaatatctgaggtgtgcaaattttttttgcaatcttctgtggtgatatctcagatggtttttagcatgcaaattgcagagacaagttgatgcttgcaggacaagaactttgaacagcttgctgacataggaggatctatctgaaactcatgcacggatcactacaaatttttggaactttggcaggttcaggcgcgctgggatagagatggatgctaatccccgtgtttcttatcctaatttccagcctggattgggtttccggttggttgaaacatactaatcagcttttgtttagcgtcaataaagactgctaattagtggccataaagctatctacctctacctaagtacccatcacacacttggacagctgcaacacgacgccactacacagtgagatttagtgatcgatagatatatccatcgatgcatgatgaacaccttcacctacaagttctactccaagaaacggctagctttgatctaattgcgaatacactcatcaaccaccaatgttttttcaactctggatgcaaagttgaacggaatatttttcttttttttacttgcaagttagcaacaaccatacctagaattctacaaagctaataataaattaaaagaagtgagatgggatatagatagtggtggcaacggtcagtggaatctcaccatcagatagataattccaagttgcaggcttgcagttggcgatcactgttccttatcctcctcgttctggaggcgaaaaaaggctatcatgcgtgctcaattaccttaccactatctagttcaaatacactagcactagtgaaaatttagctgaaatgataattccaaagtgtgaggttgcccaaatgacatggacgtcgagacagggaatatggtcactttgggggtacacgcacgtacgctgagccgctgacttgaggttgaaggtagcatctgctacgtctgattcgagccttcggttgtgtggctcgatttgttgctgtgaagacgacgacgtacgtgcggtatgtgcagtttcactttcagttaccctcgcaagaatgcctttacttctactgtaccactacttgtgctacgtttgttgtgaaaccttaactagggccgtgtttagtttttaaaattgaagagaagtttgaggaaagttggtagtttggaaaaaaaagttgggagtttacgtgagtaggaaagttttggatgtgatataatgtgatggaaagttgggagtttgggggaagtttggtgttaactaaacatggcctaggaagagtattactccctacgtcccataatataagggattttgagtttttgcttacacactttgaccactcgtcttattcaaaaaatttatgcaaatataaaaaacgaaaagttgtgcttaaagtactttgaaaagtaagtcacaaaaaataaacagtaattccaaaattttttgaataagacgagtagtcaaacagtgcaaacaaaaactcaaaatcccttatattatggaacggagggagtactacatactccttccgtcccataaaaaaccaaactaatatcagatgtgacatattctagtactaaaatcctggatatacctatgttcaaatttattatactagaatgtgtcatatcagtcctggtttttttttttggacggaggaagtaggtttaagatgtctaaaaatttattaatttgtagtcgcctaaaattgaagtgctgtgtgatgtggaattttagttcattctatatggttttacattattttatgtaagttctatttttttaatgcaagtttgtaaatttctatgaggcataaatttcatttaatgtacttttgaaaatttttacatgttagaagaatttattttcaacaaccgggaagtggtatttaatactcctactaggggaatgatgaaaaccattagattgatatcaatcttttaaaaattaggtgcttttttttttgaaacaaggtgcctaaaatgtaaacagacaataaacgtgtgaaaactggaaaagaaaagaaaaggaagaaaaagataatgggctaaaagcccacgagcgctcacttgtagagacggatggaagacccagtgcattaggcccacaatgctcgcaaagtattttcccctcccgctccgctcgtcaagcacctcgcaatacgggaaaaatatgtagagtaaaatacattttaaattttaatggtagtttttagattttatttttgactagaaaaaatgctcgtgtgttgctcactggcgctattgacgatggtggtgatttcaactcttggagggtgttgacggcttcggtgcaagaaagaagaccacctcagcttgttgtgatgactaacatgcctgtgagcggacgcaatgttgacagtgggaatgccttcacattggtagatcggtagagaccatggcgaaatccgggacggcgacacctgtgggcgccgttctcttcttggagacgtcttattgcgctttcccgt

SEQ ID NO: 61471 - DNA, 2818 bp, Oryza sativa
gaagtcgaatctgctacgcgtttgcgagctcggcaacaatgactcatgtaagatttcgtcttttgcgtttcgctatggtgtggggttttaagcttttcgatctacacggtttgtcagtctagcttgcccttgtctcaatgagtctagtggtcgtaacgtaagagctgccgtgttgacggggcgcgacgtgtggcaacgatgatatgagcctagttgagttgtgcggcgcggttttgattgttgccctaaccctggtgtttcctggtgaagttggagttgcccaatcggtgttggtgtgatgacgacaacaccatagctgtgtcagtgtgtgggggccgtatgtttgtctagtttgtgccttgttagcagctttggttgggtgttgagttctgctgtcctgttctcattgtcgtggtagcttagattagttggtggtgttgtgtgacagttacggtttttctcaattttccctaattaactgtgtattgtaaggtttggtcccgttctctttaaaatggagcacaatcttctttatataaaacgtcggcaaaggcttgacaattaaaaaaaaaattgcatggatctcccatccacctagaaactggtgagttcagccttcagcccaaattttcttcagtatccatttaggcccacaaacgcatgagtatttgcctcaggcccaaaattttatgagaattggccttgcggtcagaaacacgttaaaataactgatttgtccaatatttcttgataataaaccttggacataaacgacgcacacattttagatcaggcaaaaaaacatcaattttaaccaaaggcaaaaaattataccaaaagggcgtgtatgttagccttccacacaagaaaatcatggtttatcctttattccagaagatccagaaattttgccattatagcagaaacagatgagtattagccttggctcaaaaaatttcaagaccagtgagcattccatcctaaatttcgtgaccattagccttggggtcaatacattagatttctgctcaagatttattgattattaatcttgttgtgcacttgtgctaaaaatgcacaaatttagactcggtataaaacatgatattttttcctttggcctaaactttttggtgctaacctagagcctaaacatgcataaattgtagcctcttacgcagaatttcatgattattaacgttggggtaaaaattgcatggatctgccatcagcctagaaacaggtgagcgttggcgttcaaaccaaattttacattcggcacaaaaattcattagaagcctttgatgcatattaacataggcactctgtccaatttttcatgattattcaccttgtacataaaaatagataaatttggactctgccgaaaacacatggattttaaccatcagccaaaattttagcccccaaaaacgcatgtactttctctgtttcatattataaatcgctttaactttttcttagcatgtacttcctttgtttcatattataaatcgctttaactttttcttagttaagctttaagttcataaaaaaaatatatagtaacatttttaatacaaaacaatcatatttaatgttacaactaatgaaattaatttagtattgtagaggttgctaaaattttctataaaacgacagaggtagaattgcccttctgcacaagaaaaccatggttcgtccaccattaagaaaacacaaatgccaccccaagcacatggccctgttcttttctccaacaaaagttggattaaattttgaatactcgtggcacgcttttcaaactgctaaacgttacgttttgtgcgaaaactttatatatgaaagttgttctaaaatatcatattattctatttttcaagtttgaaataactaaaactcaattaatcacgtgttattataatcttattttacgtaaaatatttaatctttatcttcgtctttcagcacattcatgctacctttgttggcgaccctggtacgataaaagcggctcataaacggcgcattcattagggacagacaggtggagtaggagaaagaaagggggccatacaccacaccacagctcaaaagccaagtcctcctcggctcgccgctcgcggcgcctccctctccttttccgtctcctactccactccaatccctctccggactcggtctctctcccccactctttttcagtttttccccaccaaactcgcctcgccctcctctcttccttcttcttcttcctcctccgagtaccagagcgcacgaaacccctctcgaattctccgctctcctcccgccggtgaccccatccgaccgatcgcaagccatggccgccgccgccgccgactccgccgatcccgtcatcaccaccgccacctgcgcgcactggtaaccttccggtctcccgctaccagtagtaatctgtcatctgccattctgctgactgctgcttgtttgtttgctgcgtgctgggtagaggagctatgtagcaatcccctaggacttggctttcttcttctatagggcatttttttttcaggctatggtttacagctacagctactatgggagaaggcagtgtttagggttcttggttaccaagctggtatttttactgtataagtgacatctctagtctgtacctgatatcatggttgctttgcattctcagtaaggcctttgtctaattctctaatgatccgggaaggaaaactggaaaaccccctgacagtcaatttcatgtacatcagcccggcgaaaaaaaaaaaaaacgattacatgtacattggcccgggtgaaaaaa

SEQ ID NO: 61472 - DNA, 10744 bp, Oryza sativa
ttaatctatactgtcatattatgaatgcagatgatttgctcactttgccaaaaaactgtacaacgtgagctatgggatcttcataaaggcttacaatgcccacaaaggatgcttgcatgccaatattgtgactttgaactacctgcagctgatatttatgagcatcaggtatagttgtgtttcgcatcagaagttactattctgcaaaccaaacaaccatccatcttctttagaacatcactttctaattatactagtcacttggtacaggacgtgtgtgggaatcgaacagaatattgtcagccttgcaggaagtatgtcagactgcgggaacagattggacacgacatccagttccattcccaacccattgttgcttcagaatcttcaaggtaaaagcatgcttctaaattatgcattctattcatttaagttgacatggttcaatataactttcagttagattagcattctttaccagcaaaattagtcactgatacttcgtttgtagaaactggtagatatagtaaggaagtttagcttaccttgtgatagtttaaatttcagtgacagaagcacgctggaagaagaagagagttatccagcagaagaacaaccagtacgacccaagcacactcatggcttacaacgcaagcaatttcttgtcacaattgtgatagctggaatttcaattctggttggatcagttctgctaaaaaaggggtggttatcatgatatttccaacataaacatgaatttgccttcttaatgtgcaaattccttcgtagcctatgggcagggcagagatccttgaactacagtttgaagtcattgtaggaatgacctgactgatatgtttttttttaccagaaggtatttctacatgctggcagctggtaatctatgtaaaaatgttatttacaagtacgaggcttacttttacaagggatcaatgccatctgttttgttgttgtcttgttgatatgtttgttacagagatgctagttatttgattgtggattgtaacaacttacctttcaactgctataatatttgaacgtctccaatggaaggggtagtgcatggaagcgaaacaagtgcttattgcacatatgatttttattcaataagcgtagcaaaatatacggtgcccatgctagaatgggatgctatgtcatcctacaaacagagctaatttaggggagatacaaaccaagttttctggatgtatctagcagttaacgttaaataatgtcaatcctaatatagtagagacaagtggcagctataaacaaccacaatatatatttatctttcttgttggaatgaaacatgtttgcctgcattttcagctattgacagttgcttttcttcaatttacttgcggtgaatagtctgtagttgattggttccatatcactgattataccgaactgcttgttgtagaagccccatagctcgcacctgtttcatcaaggaattttgtcagcatatcagacacatgtcaacctaaataccacggtgtatcagaaaggacgtaccagtatgccaagaactgaaacggggcatacttgccgtagatattatccaattccttctgaacagaactgatggtgcttgctctcttgtgaaactgcagcaaatttcaggcaatacatgaacatgacatattgaaacctatcaaccttagaaatctcaaagcaagatactaggagaaaatatacctgctttaaatgcctaattgtctcagtgtcagctgggatcatgtggaaaaatcccatacacatgagcacattggcacgagtgaaagggccaaatccggatattgtggataactcttcattcagtctatcataggtggatggggtagttgataggccttctacagttggtacagacattttgcgtatttcttcaagcttttgtaggcatatctttccttctacaatgcttcgtgcaagcattacaattcgtctggctcgatatccaagattacaacgcttcgccaaaaagtcctcatcaaggtttgccaattcttccggtgtaggaaaatctccaccacaatcttccaagcaaagttcatatcgcaatttaagctctgaatgatccaatgagacctcagatgtgttgcctgtttcatttgcagatgaaggcaagctaaataagttttcgtttgctgtgttagttgctagatttggatcctccaggcataccatcttatcctcgttaaattttgtttctagcttcacacggacattccgcttattgctgcgcttccttttacattccctgattggaggcgtccttgactgaaaattttcggtgctagatgaagatcttagctccaactgaagctcacacagtgcagtagacattgacaaggtccttgtccatctgcagttgaacagcacggttgaatgcagctacaaatactagaaaacaatgcacttctgatgcatcaaatttcatcaatgttctttacaattcttaaacagtccagctatacccactcattcatttgcacagcacttatttcggaactcttcttatcctatcttctttttatctaagaaatgtttcaggcaaatagtagtagcaaatattcctagcgaagcaaaacatgaggctgataaccagttcttatcaactgtgaacacgatataaattagtgactgcattgcaacaataccaccgtataggatctgttaatttttaatctaattgtcagcacacatgaaagatagcaatccctaaatatcgcgacatgtttgtatcagaatttcgcatagatgtactagcaagggaaggcaaggggagaggaagactgaactggcaattgcagaggaggatgcacttgatcatgtcctcgaagagcgtgggcgagcggaagatgcgcccgaaccccacctccctcgccacggcgtgcatcgcctggaactccgccacggccctcccgtcctcctcatccagccgcagcatccgccgcacttgctcctgccaaccaaaccaacgaatcaatcaatcacaatcagcagggcgcgaacacgaaaaacggatgctaaacccataccaaacacttacgaggatggaggtctggtcgagcggggagagggcgtcgtcgtcgggcgcgccgaggacggagacgaggagggcgtcggaggggcgcgcggggtggcgggagacgcggacggcgacggaggcggcgcggtcggaggcgaggcggagcgggcgcaccagcgcgcgcgacgcggggtcccagcggttgggcgccatcatgaacagcccgtggctgcacaccgccgcctccaggtcgaacggggcggcgccggggtagggcggcgcgccgcctagcgggagctccagctccagctccacggccacgcggcgcgcggcggcggggtcgccgccttccggggacggcatgggcggtgattggggaggtggggatcggggcgtggtcgagtgatcgaggcagcaacgggggttcgcatcgtctgactactgtagcgatcaatcctgtgcattcgcgtttgatccaacggctggaaatgaagaatggcggagagtgctgtagctctctgccattctagttgccatggcagagtatacgttcccagcaacgggcgggtcgctgtttcgctcttgtgaagaagctaatgggaaaccattttatgagcagtagcaggattgattgggcaatgtgcagtgcggttgaaggcggtttgggcttttggtttttggatatacatctatttgtgtctagttctgtagttcacgctaaaattagaagtttggttgaaattggaacgatgtgatagaaaagttgaaagtttatgtgtataggaaagttttgatgtgatggaaaagttggaagtttgaaaaaaaagtttggaactaaacaaaggcttagagatttggctgagctttcttgaatatgttgaattggagatatttgggttgaaatgtactactaagtagtttgtatgtgaaattaaagtaaactagtgttgtgtttagttccatccaaagtttggattttggttgaaattggaaatgatgtgactgaaaagttgtgtgtgtatgacaggttgatgtgatgggaaaatgcaaagtttggaggcaaactttggatctaaacacaccctagattgagttattttgaaataaataatgaaactgatgtcatctgatatttaacttatacatccgtttgtaaaattcttatagtatcgtcttgtaacttaaacaagtctgttttgtatagttttaactttatcttcatctctcctagagttggagtttaaccaaatagttttggtttcactcaaaaagggagtagagcaggtcgaagttttctcatagaataaattatgaatgtgaagtgaggttcacggtactctataattttactctagattcaactcttggcattaaatttagaaactatattctatatcgttattggagttaaatttagaagttaaagcatgctaaacaggccatagaaagcaccaatgcttttataattagaagattcataataatagaatttcctacacatataatgtttacggaatcgttatacttctgttgacagaaaatacatccccaaatcttgcagattttggaccactagatgtgcttcacgattcgtgctccagttgcatcttctccaactccggcgacttcttcttcttcggcgatggcgacaacccaaactccggcaaagggccgacgaattagggtcccggggtgggggtgggaggaagagggaggagttcgccggctttagagggatggccgtgggaggcggtggatcgggcaggcggcaaggcggctgtaccgctgccgaagcgcggggtcgagagcgggcggtgggcaggggcaagcggaaagagtgttagaaggaggcagccggtggtggcgccccaccgctggcgacggggaagacggcggcacgggatagctcgtcgccaccggcttgtggaaaaggagaggagagggagagggggccggctgggggggcctcgccggcgccgttgacacctttcagccagtcggcgaggccgggtggcggcacggtggggcggcagcggcggcggtgtaggaggcgcgcggtgctgagaggaggggagcgctcgagtgacttgtgtggtggcagggaggaaaaaggaaaactggttagggttttgtggacattgcacgaatctcaaatcaatccaatgttctgaaattcacaagatattaggagggattttctgtcaaatgaggaatagacagttggtttattattccaaacacaaaaaagaaatttacagttactagtagggtgcccgtgcgttgctacaggaaattttgatcacgggaaaaaaaaatctggcaatccaaaagaaactacgagttgcggcggccggttgtgtgcgggccggcgggtgggcggcgattttcgcgtattttttaaattttttttgctcttcgattaaatcttcattgcccaatcatttttcaaagaaatccagtgatgggatgcaatcttcgaacttacattttttagcacagcagatcaatattgacaaggcaggaagaaagtgactcaaattttgagctatcattgtgttgttatattttgatagtatctgtccagccagatggtttatatcgggaacaaagatcttcctattaaactttgaggaaaaactttttaagaaattttgcgattaacaactaacaaacgctcaaattctattattttgcagaatctgcctctagttgagctggtctccggcagacatacaatctcaaggcaataagtatacatgttgtaaattaaaattaaaatttctaggtgtaacaaaattatcacccttttgtatcctgaggtttattcacatgcaaagcaccggagttcaataaaccatgaagatgcttctttttttactttagaagttgtttctaacctagctattaagttcaatatgtcactatggtcctaaactgatcagtcctgaagttgttctttacactccagcaatgcttatagatgtctagttgattacaacttgatttttactccacaaatttggcatccatgaaaatgtcctctctaattgagctatattaattgatcatttgtagttggggatagaaactttagaaaagttgattgaatacccagaatttgtggggactacacccacatgctttgcaaatcaattctatctgctatagtgtttccaaacatgtattgtatatttccaaagtaccaatagaacagtaccaatcagaccaaatgacaaaatgaaccgtgaaaaaactgatactaaaactaatttacatagaaaggcttcttagttttcaatcacagaaaatgaatgcctgtcttagtaatgcaaactccctaatcatctaatttcactgaaaggtagttggcattgaagtggcatatggcacaaaaggccaatcaggatcatcagaggatggcctcctgattaccttgtttgcatcccaacagtataccaaaggcatagaacatatggatctctgtctataggcaaatccccctatgttatccctgtcagctgcttcaaataaaacagctatatcagtcctgtattatgtgccatttttgcacatgatttagctgattttggagttctccagacagtaaaatttataaacttgacaaagtaagaaaccccaggcatctgaaactaaaactaaattatataccattattaagaaaggaggaatgtgatcacaaaacaaaacacagaacaaggaggaatgcgatcagtttacctagagcagcaggctaagttagtgtcagatgcgatgcaaagggcaaagttgagaatttttttttaaaagtaaaacagcaagagcactttatgtgtcaccttgctttatatggcttcgtctgaactttggttacctaaattgcaccgcatatgcacttttctacacaattaggttgagcaaaagctttcagacctaaacaaatcagaaactacacaagtattcacaagcagagttcagttgttcagtaatctatctccaagagtcagttgttcaggtgttgcagtccaaaccttttgcaatgatgagaaatttgattagttgcatacattatgatatagttattgtacttaaagtcaaccattctcctcaaatttcatgcactttcacagctattacctggcaacttgacagtccttctgagagagaagctcgcaacctgcaatctataataagcatcagaaaatgggattgcaatttggcatttcaaagttcacacttatagtatatatatactccccccatctatctttgatcagaatataactttgtgaccagttgtattgcctgtgatttctgaaggatgcaacagagcactatatcaccctcaatggaatttttggagcagagaatacagtctgccaaaaagagaagaacaaagacaaattagaagaaaggatgcaacagagcactatatcaccttcaatgggattttaggataatacagtctgccaaaaagagaagaacaaagacaaattagaagaaaggatgcaacagagcactatatcaccttcaatgggatttttggagcagagaatacagtctgccaaaaagaaaagaacaaagacaaattagaacaagattgaatccccaagccaacacaatacacgtgaactcttggtagatgaagaaaccgctaaaagtggaaattgtatctcgtcgatgcagccatatccagggggagctcacgaatcctacggtggcggcgtcgagaggcgaggcggcaggatgaggaggcgacacaatgggggagtgatggctgaacaaatgcataatagccattgataatttaatatcaggattatttacattatgctggagacggcaatcgaatgagaagtccatttatataataaattttgcgtcacacatgcacataatctgatttcaattatctcactgatgtatgctattagtgggagagaggaaaattaagctgcaagtatatataagcaaaaagaaaactgctcaccgagtccaggcagacttgtcgtaggccatgtgtgtaggcagatcgagtagtcgatcaggggaaagggcggcgaggccttcccggcgttcggctgtggaggctgaatgttttgcctctagcttcttatcaaaaattacaacgaagatcccgatcgaccggcgtaggggaaggcgatgtgggaggagaccgatggctggtgatttgggaagtcgcccagaagctggcgtcggcgatctggaggcggaaatcggcggccgcacgatgacgacctcaatggcgatacgaggcggcgcgatgacaggtcgccgccggcgtcgcgagtcgatctagtggcggagatcgaaggcggcgtcgacggcgttgcgagccgcgggcgacgatggcgatctcgaggagtagtagtcgccgacggaggtgggtgggcagcgcgcgtggcaggtgtgcagaggagtcggcgtcggcggcggggaggagaaggagtaggagtagacccgtcggcgtgatctggagcggagtcgacggcggcggcgttggcggcggttgcgggtgggcagcggcagcgtcgccggctggggcgattgggcgaggtgaggaggcgacgtagggaggagggcgaaggacgcggatccgagagaggagcgagcgtgggaggagatcggtcgttggatacttgatatgcaaattggatggttgagattacgcgtgtctgtcagatgcgtctgctatgtcaggaatcaagaccaccactacggattttttaagtagtagagatatattaaactctatcacatatcgggagatacgacaagttatggcagatcataggtataacaagttactagtccatacatcaggattcctaaaattatatgaatttatgagaaattacgtaatgctattctcaaccatgcaacctggaaattcttgaccgaagaatgagacaggtcgatgaaagctcaacgcctgaagggacaacggtgaggtgggggcacaaccaaagggttggaaacgggagaaccaaccacctctcgcccagccgcgacaccgcaccccgctcgcactcgcacgtacgcgaaggaaggaagaacccacactacccaccccctatccacccacccatcctctccctctcctctactccacaccctccgcttctccactcctccctcgcgatggcggtcacgcgcctcgccgtggccgccgccctctcggccgcgccgccgtcctcccgccgccgcagggccttcttccatcactcctgccgcccgctcccttcgtcggcggcggcggcggccaaggcgttgcgcgcgtcggctgcccccgccgtcgacgaggaggcccccgcatccccgcctccatcaggtgctcgcgccctcgctctctattgctccagatttttttttagattggactgttccgagtgttcagtccgcgccgtgcgagctcgcttgcatttgatctgatgctgtccatggagctgaagacgatgatttgctgttcgtgcagatcttggcaagggagtggagaacttggtgatcataggctctggcccggcggggtacactgccgcgatttacgccgctcgggcgaacctcaagcccgtcgtgttcgaaggctaccaggttggtggcgttcctggtgggcagctgatgaccaccaccgaggtggagaatttccctgggtttccggatggcgtcactgggcctgatctcatggacaagtaaacattgctcatttcttcgcatgtttttgagtttatctgttgttaatgttgtgttcacttgctcatatcgggccatggattaaatcagaatgcggaagcaagcggagcggtggggtgctgagcttcaccaggaggatgttgagtttgtgaatgtgaagagcagaccgtttgttattcgtagcagtgatcgtgaggttagcatcattgtgctcttcctccttttcgagttatgaactttccacttttcacaaggtgtcattgttggtttatggtaatacaatgttcttgacaatagcgattttcacaatgttcttgacaaaagtattagtatgatttaaacaaaactatcatccatttaattaagaatataacaaaggagagctggtcaagttgtgtcgggaaagcatatcagtatacaatttttatatggtttacttaattagctcttacaatatttgcctagtcatgtgctttagttctttagttgtgctgtaacttctctttctataagtataatgaccagtttgatatagcatatagcagtcgtctgttataattaatagtgcacagaactactttggacaaatgtttttgctgcgctcatcccagtgagtgtcctatacaggtgaaatgccatagtgtaatcattgctactggtgctgctgctaagcgccttcgattacctcgtgaagatgaattttggagtagaggtatcagtgcatgtgcaatatgtgatggagcatccccactatttaagggtcaagttcttgcagttgttggaggtggtgatacagctacagaggaagctatatatttgaccaaatatgcacgtcacgttcatttacttgttcgaaaggatcagctacgagcatccaaagctatgcaggaccggtaaggaactttcaagtcctatccctagtaaatgtatatatttaccttcaagtgactactctgttcatgtaaatatcttgcc

SEQ ID NO: 61473 - DNA, 19632 bp, Oryza sativa
  unsure (1)..(19632): unsure at all n locations
cagcaatcccaaaggccagatgtctggtattcaactgaagagaaccgacacgggagaggaatcagttcttgaggtgaaaggtctattctatggcataggacacactccaaacagtcagttgttacaaggtcaaattgatcttgacgatgctggttatattttggttgaagaaggcacagcaaaaacatcagttgatggtgtatttgctgctggtgatgtgcaggtaactccatccttcacttcatgtatataacttctacatggctgtaatgtgtttcattcttgaaatttgaatataaccctgccacagttcatatgtgccataatcattagcatgtcatgtcttggtggtcttgtagcacaccagcacatcacgtcttcttttattgaacactagctggattggaatacaaatatgagtattctagttttaatgccttttcaatgtttatctgcaggatcatgaatggaggcaagccgttactgcagctggatccggatgtgtagccgctttgtcggtggaaagatacttagttgccaacgaccttcttgttgaatttcaccaggtactatcttgtctgcagcatatatttctttatggtgactgatgcttctgcgaacattatctagctcaatatttgttgttccatggaggctagctgttccactgtcaaattttgtgcctatgattactggtacaccagacactgcagcaatttctgctgttgatctttttcctctaattttagggtttctagttgccatatacagcaattctgtgcagaccatgttgtgcttttatttcatgtataaaatttgaggttggaccttgtcagcatgtattggtattgttatgtgtaatcgagaatatatttattctagaaatgtgaaaggatgaaactaaatctatttgtcattgtatatgtatcgatcaatgcacatttagcatttttaattgaccatctctagcaaccggtcaggcttacaagatacacttcatctttttattaaattacagcctgttcgcgaagaaaaggagaaggagattacagatagagatgtcgagatgggctttgacatttctcacacaaagcataggggacaggtacctaacacatttgcttgtactgtggcttcatattggtgcaaacatttatgtgaaaactgatttgagcttgcttcctttgcagtatgcactccgcaaagtatatcatgaaagtccaaggcttgtctgtgttctatatacttctccaacatgtggtccttgcagaaccttaaagccaattctaagcaaggtttgttcttgaaattgaaattgggctctagtcgtcacaagtcatcactctagacaaataaaatgccttgatatacagctatctgattggccctccagtccatcgatcattatgcattcatattgacaggccatgttaacgttcatttctctgatctaccaatatgaccaatcaagttcatttctctgatctacaatatcgaatcattaaagaaaatccatttcaaggtgctaactttgtgatgttcttgtggtctggacaacacaggttttcagtgcttcttgataaaccttgtagaactgatatttatagttgcttgactaacatttgattgccgcaccattctacagaagttccgttctgttagtcatgcttgtgttagttttgttgttaacgttgctagttgctacttggcacttgctaatattgatatctttttcaggttatagatgagtacaacgaacacgttcattttgtcgaaattgacatcgaggaggatcctgaaatagcagaagctgcaggcatcatgggaacaccatgtgttcaattttttaaaaataaagaaatgctcaggttggctatcttggatttgtttatctgctactagtctatataaacatcagtcacttcattgctgcctaattaatatgatgcaatggaatcccttctgatcgtttttaaccttggactatgcaggactgtctctggtgttaaaatgaagaaggaatatagggagtttatcgagtcaaacaaatgagctgaacccaacatacgattcaaattttaaagtgtaatagtcttcttttgcccatactgactatttctagctgccaccgtggtggccaatttttggtcaaaaattttcagatgggccgggtgtagtgcggttcaagaggaaattagccggtcgctcctattgaattcaatcaatgtaacagaatatattcttttgctgtacaacaacgtattggtcgttgtcttgacaccgtgcaaactcctccctgacaatatatacgtcttaaagattttggacagtgtgtgatctatatgctgaacataatattcatatgcttatagtgagcttgctggaaagataccctgacataaaactattaaggcattgtttttggaacagggaaattttacattaaatttatagaaaatggataggttcatgtgaaaatccaatgaaattaatatgtttgaaacgagccttttctttgcgtagcagagcagaggatggttgtttgggaaagcttctgtggcattgcagtttctttcaaaatctataactcttcttaaacagtcactgttcactatattctcagaatcagaatctactacagaatctaaaaatgaccagctcaaaaaactataatttgaagataaagctaaagactccagaaaataagtccgcagggccggccgaacactcaggagaacaccacgtttttccagtctcatctcatccttacgcgccgaccgggcggccgactccgccgccgccgccgctccaaaccggcaaccaaaaacgagcggcgcacggcaaaagcaatcacaaattcacaattcacagctcacctcggcgaggcgccaagccaagacgagacgacgagtcacgccaccacgcgtcacccttccgccgcgccggtgcctcctccagaatcctcctccgttttatccccacccaaaaccggcgaaccacccgcccgcccaatccccgcctcaaataaccccccctcgccgtggcccccatccccaacaaactaccaaaaacgaaaaaaaacgtaacaaatccgcacagccacacgccacgccacgccacggccaccgccgccgcgcgacgcgacgcgaacccggagaaaacgggggcgaaggaatccgccaccgcaatggaggccgcggcctccccgtcgccgcccccttccagggcgtcgccgctgcggctcaacccggccgcgttcctcctccgcaccaccaccaccaccaccaccgtccagccgaccacatctgccgacgcgcccccgcccccgccgccgacgcggcagacggccggggtcgaccggctcatctcgttcctctcctccctaatcccccgccgcgggcagcgggcgaagcagccgaccagcccccctcccaccgcggcggcggcggcggcgatgcggagggcggcggagagggaggcagaggcggagcggcagctggtgggtgcgcggtgccgctgttccggccgtacgtggcgcagctgccgtggcacggcggcgcgcgggcgtggctgtcgcggatgttcccgcggtacgggcactactgcggccccaactggtcgagcgggaaggaggccgggtccgtgctctgggaccgccgccccgccgaccacctcgacttctgctgctactgccacgacatggcctacgacacccacgaccaggcccagctcctccgcgccgacctcgccttcctccgctgcctccagagcagtcgccagacccccgcccgcgacggcatcgccgccgccgccatctaccgctccatgtgcatcttcggtcagtcaccaatccaatccaccccttcttgtttttcttccccatttctctgttgttcttcgcccaaatcatgcgaagaatgcatcgcattgcgtttacgaatgtgagatggatcgatggatgattgtgcagggctcaagacgatactgataccgtaccgtacgaacctggtgcggctgcaaaccgggccgaattacgccgacgccttcgccgatttcgtcaagagggtcgcctcgtcgtcggggaggccgaccggtggcaacaagcagagaatgtgagagcatttgtgatcacaatggcgcaggatgaatccaactaattggaattggatattcagccattcaggtcgtcgtagtagttgtgtatagctcaagttttgattcgaacccggcgaggcggcgtcgcggcgaggggattgtttgtatcctgttctaatgggtattagttgatgagaatcttgggatcttcactgtgaatatagcttagcacatgatttattatatcaaaatgtagcctcccttgatatcaaaattcagaatcaatggatgcaagtttctatttctgaaccaaaatggatgcaagttctatttctgaaccaaaatggatgcaagtatgcaacagcaaagatggtggtatgttaaggatttagcctaaattagagagcatataggcataggaatgttgtactagtatctgccaaggaaagacatccaggcatccagcattccggaagatctaactaactttagagaattagagttttgtcccgatgggcttcagaaatttacatcatttcagtttcagtcctacatatgacatcctgaatcatcgtaagttcgtaactaagaaggctttcagcgatgtataaatatgcttgctgctatgcgaagaacgcatgttggttacagaacaaaggctatgttaaagctcttcgtatttcatttgatcgaagcattgttccgatgggcttcataactcagcccaatttccagggatcgctaatctatcagactatacatgaagacatttcgtactagtaagggtatatataaatggcatgcacttattcatacagtttgcacgtatgagttaggatctaatttctcacataagcatgtggaaacaatctggggaagtaagtttgctttgccttgacaatcgaccaatacagaaagaagcaagggatatgaacaatggccatggcgaggtacctgcagaaaaattaatggtgttgtcaggacagcaaagttccatggatggtatggatgaacagatgagaaaacataccatagaggagcccctgacgatgaaaggtcaagaaatgggtatggccacctgaagaatatggaaacatgattacaacgtttagaggtaaactcaaaaaacattttcttgtggcgtgcaacaacacacgagcggcactaaatcttaatacaaagatacgcaagtaagtattccccaaaaaaacaacacatgagccgttgtttcaaactcgcactcaatatgcacatatcagtatgctagaatagaaatataagggttctttttgttatgactcaactttaccaattagagcacaacagctttcatctctttaataaaaattacccctaaacttgatcagaaggtggttcatatatgtacaaaatgtcccaagagatgcaataaatttcgctgagaagtaggcagggtcggtgcagtctatagatatcctgggttaattgccacatggtcacatgttcagaatgcacatgtccatactccatatctcttggataaactatgtcatatgggcatgctcatgtacagctcattgcagcattctataaaaacctctccactttttgttgtattttttgtaaacgaatattatagtgtgagttcccccttttcttaaagtaaagtatcaaataggatttgaatacataaatgacgctctaacttttgtatttttcttagtgtatacttaataaaatggcacaatgaaggggaccaagacattccattacattgctttagtgtaaacggcaggggagaacctaccaggatatagctccacaagcatgaaggacccattggaaggttacataggagcagctccaaaatacaaagaaagccaggcggtaccaggggaagggctgaaaagagtgaaagcaaccaggtgtaaaataatcacaccaaggtaaaagaaagaacagagtgattttgtcttaccatattgttgagaaatgtgtctatcagtaaaagaacagcattaagagaatgcatgccatcagtgatctgcatgaaattttaaagaacaagatcagccaaaaataagattacatcaccaattctttatttgaccagctacaaacacctgtgctgtttattactgttagattgcctatgcttactactactatcatcttaaatgtttagcacatactagatttggatttacactatgattcttacagctcagtataacaagtaattgtttatatgccactagaatataataggggagaaaagccaaggtaggagttatttcttttattgaatagaattgatttgccaacgataggcatttggttggggggatgaacagctgaggctatacacatcctgaaatttttacataccaaggaaagtccaaacttatcacggtaaaagaatggcacaagtagtccccaaaatgtgatatcagtcagcattgttgcacctgcactagtctgtaaaatagattacaattagttggcgatagaatcacacaatttgatagcaggcatgaactcagtatccgtggtacaggtgaggagattatttttttactaggccaaagaaattgatgctagtttgtgttgagtgctaaataacatggagaacataaaatgtagctatggtagtagtttgagttgcatagccccaagcaatcagctgatgaacttgctctaacttagcacatgcactgaatatcaatatgacgtagtaagaaaacataagtgttagtattgtatctatattccttaaagcagtatcatttggatttagatttgacagtattgagtatcgtaaataaagcacatagcatgtccataattacaattctagaatgacaggtgagttcaaacctggtaaatgatttgcatgcaacgtccccataatccagctcttttctcatttgctatttgttcatgatagtttgttatcttctcctcatcccttttcatctcgccagaagaagtggaaaactcacgattttccacatcgtcactaagaaattcatgggattcatcagctttcttcaagtttttctttgagtaaacccaacatccgtgagctgatatagcagttgcaaactaagaataacacactcaattagtgaaggcatcaaatgataggcaagctagaaaagaaagaaacgataaaatagcacatatgcagattcaaaaagataaaaggtggacagacaacttgggaacaaagaacataccgcaaaatatatggtgactaataaaaaggtccacctgcaaagataattcaggagagaattaattaaagtcaaaagagcagttaggttcatctaaggaaaagggaggaaataataaaatcaagagtcaagactgcaaacaactacaagggggctgatcagctgcatgccttctaaagcaacaactaccagaatatttaaaacatttgccagatccatctatctgacacggggcaattagttcagtgtggccaaactaaaagcagaaagctccaaatctacatagcagtacagagatactgtaaacagccaaaagtcaatggatcaatgtgtggatcacttcgaatgctactatccagctatgtcaaatcactccgaacaattctcgctggtaaacgctaatttctacaccacattatagaacagctagacgctcgcgtatgcttgtatggacgatgtgtacgatgtttgtcttagattattcgaggcaatcaagcttgctcagatagtggaggaggaggacggaggaggccgtactgggtgtagaagaagaagacgtcgatgccatggccgacgaggaggcggacgaggagggcgacggcggcggcgagggcgaaggcgcggtagccgaggagccagccggggtggagacgcgcccagcaggggacccacaggtcggtcccgcggaggggcgcggccgccctgcgcagccgcgggagcagcgccgccgcggcggccgtcggcagcacgatgagggcgccgcagacgaacacctgccaccgcagccagtacgccgcctcgccgtcctccgccgccgccgacgacgacatcacccccccggcgacgcgcggttgacctttgcttgagcctcgcgtcgcgtagcggcaatggaggtgcggcgcgggggaattttggggtagttggggttgggttgttgacggtgtgcgacgctgcgactgcgagtccgaccgcgactcggcgagcgaggcggtgaagttgcggaagtagacgcggagacggagattggagggaaaggttagcattcggccacggattggctcgctttccgggcccgggtgcggttggaacgcgttaaaacggcaccgagccgtggtcgttttctcctcactcgctgctcccctgctctgcttcagttgcttcgcgcgctacgccgatggatcgggattgatcgggtggggcgtttgagtttggtggtgtgacttggggctagataactttgctaccattttttttcgataaagttacttaaaaaagtagttatatttagtttgttgctaaattttagtaagtatatatgaaatcttgccaaaattttgacaaacttatcaaaatttgacaatgacaaaacttgataaggttgaaaatggtagcaaagtgaacgagcccttgatttacgtagaaatttcataaaattcaaatcttactaaaaattttttctttaaccatttgatataaaatattggagcttttcaaatcatatgaaataactcattgcatctagattttagaggaaacttcgcaagattttcttcctacaattttcttcatgtctttctatttcattcgatttctatgtttttcccttcaggccaattaaacgatcatttttgtgttttgtcctccatttttcaattcctttgtcctgtttttctttctccgttttttcattccatcggccttgtctcgtctatgaaacttatcatgccaagcttaaccagcgtttttttggcaatttcatgctgttggtttgaagagcaaatcaggcgccaatttctattgggagaattcaaacagcaaatcaggcgccaatttctattgggagaattcaaatctaaaggtatgtttggtagagctccaactcctagatttaactctatgagttgagtctagagtggagttgtggagctgcccaaacccagctccacctctctagttcattttgtaagagagctccactcccgctttaggtggagctgaaactgtttggctgagctctagctccaaaaaagatggagctgtaccaaacagaccataactttgatgcaagtttagagtagtctcaagtctaaacaaatgactggatgaacttgcgtagatttgctgttcatctggattgagcttatgtgttctgctccaatttggagatcaccataatcaaccatgcaatgctaatccagtagatcgatgataaatacgataacatcaaggcatcgactatcgagaagctcgagggtttgtaatattgataacttacagtctcgcccatagctttcatgaacaaggtggtggattgctcagagagaagcacaatgacatctcacgtttggaaaatattccatttggtcttattactgcttacagagttggacgcataacttctcatttaccatagtcagagagcatgcacagacatacatggaggaaaaatgtggcagcagctgatatacaggcatacagccatgccatcccagcaaaacagaaataacttctgggagctagacaacgaattccatcggtagcccagcccattttaatgacagcttataacaatgtatcttctgcatcttaattaggtcaaatgatttttttttccctgggatcagtttgctgtgtcaattgtcaacattaaagaaaaccagaatgcttgtgtctcattatgcccattatcggtaaaggctggaatatatgagtatagagctcaaaaggaccttccgaaaatatcagtccaactgcaaatacagaacgccatgaccagaaaaaaaacaagagcaggtacctgccaaaaaaaagtaattttatacttactgaagagaagatgataaaaaggatacatcttcccataaaatagaaaaatatacccctattccttaatattggctcagtttaatttccatctctcaactacaaaaccgaatgaaaaacatccattaactctcatgttaagagtgaggctacaagttgaacatacaacaaacagtaggcctacatgacgaacggtgacaactataccaatagttaatcttagatgaccaaccatgactcactaggacacaagcagacacattgtctgcgggtccaaaccacctaaaacagggtaggttggaggaacaggttttaccaggttttgagaatagaggggcagattttacttgattttgtaaatgccagacaaaaactaagccgagtcaagaatcgaacgccaggaatagatattttcattaagaaaaaagaggcccaagaaaaagcagaacttacctgttaccgtttgacccattggaagctctttcttgcttttgcctttccaggctttttcctttcaacaacccgtgagtctcttgtcaaatatccagctgtttggtttaagtatgaagacataattagaagtgttggaagataatatagaaatgagaaagaatagcaaggcaacaagacaacaacattcgctgaaatagaagtcattttggatggttgctcatagggaaaataatgctcaaacaatctcaatgttcaaatgtgaactgccaatcatcatctagaggagtaagagtcatctcctttacctgctttgagatttgggcgtagtcctggttcccaattctgcaaggccctgctgatccctagccggatagctccaacttgtcctgcacttgcaaaaaagaaattcaatcagggagaatgtttttgtagcctatctaaaaatcaactagtagaaacgtgcagcgtctaatagcaaatgtgtatgagttagaaaattacactgaataaaacatattaactaaagactcaatgaatccaggcactggcattgaggtatgatactaaagctggaatccgtggagcattgaaagataaagcgtgcaaaattatgcgtgaatgaatgcctcatgtgaacgtgaaatatgacatatattccatatctcataatttacaatacagaacccaagaatttatatgtgcatagttaatgcaaaacactttcgtatagaaccagaagcaatttatcatgtctatctccagaaaattatttatcatgtcaaaagaaataaatactaacctgagacaccaccacctttcacagtacaagtaacatcccaacgccccaaagttttggtcacggtaaatgggcgaagaagatcagcccgatgatccagaattgggaagtaagaatcaaattgtttgtcattgacaatgaacttcccatcaccaggctgaatccaaacacgggcaatgctgcatttccttttccctgttccataagcccttcctttctcatcgacttgtcttacacgtgctttagcaatttcctcttgcttttggcgttctacatcagctctgcttgatgttgcattcattttttcgatagtttcatcttctatttctcttaggggaggtaatccaggaacacccctaacatcctttaagaggatcaaactagcaatcatatcctctgtaatcccagaggcctcaatgagatcaccaaatgcacgatttggacctgcaaccacaaaaaaactactttacgacatgctacaaacatatgtatgcactatggattattcctgcataagatcctacttaatagcagaaagaaaaactttgtatattattagaatcaactagggcataataaataattaaatcagtcatgaggttgcagaagcacgcagaacaaaaatcacaatgatcatgagtgaaattatctacccgattcaatgataccttattgcaattgatggtaaatgacatgaatgagtggcatcacatgaaacaaatgctggtggtgagtggagaccaacaggcacattccaacttctgcattgaagcaaattgctcctaaaacacctaccggatatttgtgatacctcaaaataattagctactgatcaagtatacaaacctggcaagctcgtcctgatacagcattgtaagtaaacaacatctaacacttacttggaataccatttcagagatttattatgtctgcgggtatgatcctatagctccaaactacgccaattcaatcagttgcataatactaattatacacacataacagcaaccgtactatgacaaattatgttactgcataaagatagatttacctttgagtgtctccattagttcttgctccctcgcccttctctctagccgttttcgctcttcctcctcctcgtcttcccccgcatcggcctcatcaatcgcagcgccatcacctccgatcccctcaagcccacccccgagcacggcctccgcgaaaggatccttctcatcctccccactcagcgtccacagctcgtcggcgcctgcccccggagccttctctccagaagcgacggcggcggtggcagcctcttccttgaagatctcctcgaacacgtcccccttctcgctgccctccgcgcggaaatccttcgcccacgggtcctcgccggcggcgctcaatcctagtggatcctcgccggcgggagcttcgacgccctcaccggcggcgaagggatccggatcgccggattccggcgtgaacgcccatggcttgttggggtcgtcgtcgcggccggacgtggagaggagccgcggccagaggaggctggaggcggggaggggacgacgaaatggaaggggagcggagacgggagaggacgaggcagcggcggcggtggctgcgctcgccggagttagggtttggaggcggtggccgaggcggcgggaggagtggaggaggcggcggagcagcatggtggcggccggaggagggaggcgaccactccgtggaatgctagggttttagcggcttaactcgtctcggtttcctctttccgcttcctccgctaattttacgtgttgcgaacgggaaagcgtattaaccagttgcttggtttcagctggagaggcgtatttcttaaaattccgtatcctagcttcgaacacgtattttgtacaatcagcttggattttgtactaatctcgacttctcgagtacgaagatctgtgtactggtatatggccgtgcgatccaaatccacgcgatacactggcttagttaattactgatctcaccgtagaaaatgcagtgagtaagacagtaagtatatattgcaaatctaaggtcaagtccgtcctgttctacccgattaatggcttgcattgatgactttaactaaccatttcgccgtcactaaagcccttacccgtactacgagtgtactacaaatatcataaattgaagattcagcaaaccaaactcggcagctttgatgtcagtatacttgtgtgtattattgtctttaaaacatggtcttaacgtgcattttgcaatggaagaggtgtaaataagatgtgagcagggttcatgttaggacagaaacgggtaaaaaagaaacgctatgcacacgtgtattgtgggcgcatgaatttgtactgtacacaaagtaagatgttctaacgtgtttgtgaaatttgaaaacatatttttagtcaaagctcaaatggttttcaagaaattgaaatttaaaacggtaaattcgagcaaaatctcgtgaaaagatgcgactatgtgagttactacaaagttgtcacacgaattttacacctgcatgaaagtagcacgaatactagctttactgatgaagagaggtaagtacaagtagtaagcatataaggaagtttacagttaacccaggtttgattggcttttacctcatgctgcggcaagatcttggtgtcactctctcacactgacatcgagaaaaatgtctgaaagctttggttccttacggatttttctgcaaaggctcgcgtcgctgctacctgaataggctgaaaagcgacaagattgaggcatccagaccatcggcatgtgaatgtactgcctcccctgctcaattgcaaaaggctaaaagcctagaaagcgatcctttttacacccaaaaaaaaattccatacacgagaagaggtggtgttgtagtaagtacagtatactagtagaacattttagcgtagttcaacgcgatgatgtgaagaatgattgcagcatatgaactgccactcatttgcgatcatattgtagatgaccaaactacagtgagaacaacttatttgcaatcatatataaattgacaagtttacaagttacctttcatcaaacaaagattctctactttgtatgtatctctttggctctttggcctttacaagcatattttaacttcaaatttcaggagaaattgaattgttttctacgatacacgcctaaagtttcagatacagattttatcctgatatgcttaaaaattcagaacaggaaagaatattcatagcagattcttcaccagcctgtcagatagtagaaatccccaaacaaaattaaccccccaattagttgtacaccagccaaaaactaaagctctcctccaaacagtggtccagcacaagcaaaatttgggccaaacctgaaaggacccctcctccaacccgacactgtagcaggtacatgatgagaaaaacaaacaaaaacaatgagagagagagagaaaagcaaattaaaattgcaaacaagaacaggtagccagcttgccaacaccactaagaaaacagtaacagcaatccttttcatctaattggtcccaaagcttttaagattttttttactgtaatcacgcacctaatcttcctcatggagtcataccttctctctctgcctgaacctctcgcctagcaacacgcaaacaagtcttgggaaacgtatttgccacactttacacttcatgctgctgtgtttagctaccaaatttaatgacccatattgatctgtctcatgtgcggctgcagtgcgatttcgcctaacttattcccaagttggctaaccccactgtcacaccatgaacagacttggttagttatttttttttctctccacagcaaagttgacaaatactagcgtaaaaccaccaaggctgtgtttagttccacgctaaaaatcgaaatttgactaaaattaaaagtttgaagaaaaaaaggttaaaagtttatgtgtgtactaaagtttttgatgtgatgaaaaagttagaagtttgaagaaaaagttgtgaactataccagacccaaatccccttttaaattcacacataatttacaccgattcacacatactaatgcgtgtagttttgcaactgagttgttttaaccctaggtaaaccctccgttacaaaatataacaaagttatgtatttgataggttaatatatataactaaaagttaatagtatattttaggatggatatattgtattttccctatttctacttatgtactccctccatcccaaaatgtttgacgctgttgactttttaaaaaatgtttgaccgttcgtcttattcaaaaaattaagtaatttttaattcttttttctattatttaatttattgttaaatatatttttacatatacatatagttttacacatttcataaaattttttgaataagacgatatttgaaaagtcaacggcgtcaaatatatttagagaatgagaaagtaagtaagtaaaaaaaaatcgtcctcttctccttccctccctcgtctatcccacctacaccatcctaaagagtactctttaaagaagggtttatctacaaaacggatcgaaaagttgatcgtattttccatatcaaattaaaccacgttcgttcgatcccgtcgtaacgcgtgagcatgtaactagtttttttttttttgaaacatggaaatgtcgttttcgttttccatcgcccgatgacaaaatctggacaggttaacatttccaaaacaaacaaggggacgagattttaaggcaaatccagagacaaaaaattggttaattaagcccagagccgggagggacagctcagcgctgtagcgtcgttgcgcctgagaagaatccgagaagctttcgttgcaagctccatcccaaggagtccttgatctcatatggctccaaactctccaactctgtagcgcgtaattgccagagctannctactattacagcaagagagagaggaggaggaggaagaagatgcagtgggtgtgagctgcggcttgcgggcgagggagtaatctcgctgtcgctttcgctgggcgacgangttgnngaggagagacacgaccattcgtccggcccccaacgcgcccacngcccaccaccaccaccacctccatgactgcatcctcctccaaaaacccaaggcacaaatcctaaccaccggacgcgagccgacgcgacgcgacgcgagtccccatccacatcgctcgcggcccttccaccgcacgccagatcggtggcggcggcggctgctcggggttggatccaatgcgagcggtgattgatagctgttgatgcgaaggacgacgatctgaggtggtggtggagttggggggatggctgcggcgacggcgccggtggcgggtgcggcggagcggcagcagcaacagcagcagcagcagcgcggcggggcggcgtcggcgagcggcaacgcggtgagttttggggtggtcccttcgccttctgctctccgattcctcgcttgcgcttggtgcctctcttcggtggtgtgctgtggctgtgtctgtctgctggattttcgttccggtttggtatctgatgctgcgttgccgccgagtttctcgccggagtggtgctttgctttggcgtgtggatggatgggtgttccactgttttggtggtggtggaatttttggttgagctgcaaggccagatggcgcggataagccaatgcagtttggttcggtggagttggtggtgtgatgaatgggtttcgtttgagaaaatcaccgtactaagcgaggagtgaggttgcagtagttgctaatgttcctgttttatttgggtttggattggatttggtggtcttagtattggaggtgttatccagatgttttagtctgagagtgaccagcggattgcatggtggatgatacttggcttggattagagttgtttaccacaggaatgcgaatcgaaatgtttgagagagtatcaatttgtcatggcgtaaggatggagggattctacagtgtcatctgcacgctgaaactggacattggatgtgtgagatgctttgcaggctgactggtgttggatcgttgtggtgccctgtgaatgatgggcttcagatatgaggtgcagggagagtgggaatccagatgagggaagtgaggaatttactggagtttttccccgttgaattcatctgtccttttacgttcatagatgaacagtctgtatattcagtggttatttggagaggcgtggtttgatttgttcactcttgctggatctctgatacataggtcccgaattgcatgtctgctagcccgagtacaagacttctgaatgttctcgttaaaacagaactttcgattgggacctgatgttgcatttttttgctattacatatttaccattataatcacagtatttctgacattgtaattctctctaactaggtatttaagagtggccctctcttcatatcatccaaaggtaaactatttgggttatgcatcagttatttccacctgtgcatatcagagcatcaccattaattttcagctatgatttttaaggaattggatggaaatcatggaaaaagcgttggttcatcctcactcgaacatcacttgttttcttcaagagcgaccctgtaagtattttattctggtccacaacctaagtaattgctatattgaaaatctcaagttatgtagacccatcagtccagaaatagtactttggtttggcttgttgatatgacggttcacacctatctagtatctacatagcactttcatcgtctctcttgatcatggccaatatgtagtagtgtgatatacatttgttttatgttgatttcatgacaatgcatgtgtagatcacaattaaacatgagtacagtatttttagagtttggcactgaatggcagaatgactaatttgctcttttcagtccaccaaatatatgagtagcatcattatattttgtagcttccttgttctggtggttacatgtgttcctttgcttcaaatatccaactggcagtgcttgatccttggtaactgcttattcatgttcttgtccatgttacacgagagtccaggtaggtgtttagtgtatccactattttagtcattgcatggtcatcagaattggcattccgggccacaggttgctgattattatttagtctagaactgaagggaagagggaggaggggaggggagaaggaaatctaaccttcataccaaatgctgctgtatgccaaagcagcagcagttgctcatggccatattagagggaggaaggaaaattctgttggggatgttggactgatagagatgcgaaatgtgatcgttggggcgctgggacgccttgtgtagcccactcagcccaccttttttattctcctttatcttttttctccaactagggccaatgggatcactcagtgcatttgaaaaacaccacctccccatcaactcacatttctagtaatctgcaaccccatcccttggcccagattcctggtgactacagtcattgccatatatttcgtttcatttattgtccagcttatgagctacaccaatagaatttgtttcttacttcttgacaagtacctttcatgccattgtagaataccttgccccagagaggtggtgaagtgaatgttactttggggggaattgacttgaacaattctgggaggtttgtatctttcattattatttatttatttgcagttttattcaaagtttactttattagatttttatcaaatttgctgcatacttcttagacaaatgatttagggcactgcttcctttttggtttaactgcataataatgttaaactaacaatttatctcattcacagtgtagtggtcagggaagacaagaaattgttaactgtcctttttccagatggtcgtgacggccgtgcttttaccttgaaggtatacaatttccctttaactttaacagcttgaccccttagaaaatacaagatgttgaattataagtgttgtgttttttaagtcttttaaatgcccttcaaagttcactagaagtgcctgctattcccaatacaggcagagacatcggaagatttgtttgagtggaaaacagcattggaagaagctcttgcacaggccccaaatgcagctcttgtgatgggacataatgggatatttcgtaatgacacaacagatccatatgaaggagctgttccaaactgttggttcct

SEQ ID NO: 61474 - DNA, 754 bp, Oryza sativa
cctgcagccggttattaaatacccacgaatttaatttatatttgtaaagttacacaaatatttttcaacacaaataccaggtacaaatgtacaatcagcacatagacttgctatctcaagcacaaacatacttaggttccacaaggagaaaagaacaaaagagatgattgtttaggagaacagtaggggagttcccaattgaaggaaaagaaagaacagatgttcaagatcgatggaacaaagtctgagggattcttactgctggtgtctcaagaccgtttcattgtccatagcaacagatgactggaagttgacaggctttattgaacgtgtactttgctgcaaccaggatccataggggttcgctgaagccacacttttcttcacttctgtgttttcaagcacctaagatgattcatgaggtttagcacatatatttgaattgtctggaatactcaaagcaagaaaggaaaatggttatttcatttctattctaacctggccagtttgtaggtcaaccgttatcatcattccaggacccaatcttcctttcattactacctttgactcatccattggtataacaccaacctgtagattgtcataaaaaaaaaagctagtgatcagtaagaaccatacaatatagaactttggggactcccacagggcatttaagaaagtgatccaaagtaactccatcaagtgttgcagtatggtggcacaaggttaatattttattgtcatgattttaaat

SEQ ID NO: 61475 - DNA, 1373 bp, Oryza sativa
tccattttcacttgtgaagcagatgtcattgtgagttttataaaataattgtccctttgaagggatgaaaattttagcacacaagaaactgaaaatgcatttgttataggttatagttgtagatacaaataaatgatatttactttctaaaatttcatgcaagggataatagtgagtcagaaaagggtcaaggtgtcatgggatatgaagtatggcagcatgaaaactcccaaataaaacataccgaaacaggtggcaacaagatatgcattgcgaacataaatgttatgatccatacgaacacaggaaatattgcactttgaaagcaagaaatgctcggtaatgtgggcagaaaattgaggtaagcataagaaacactctaccagctttggcttcttccatagaattctcgtcttgtggaagaaagaccattccgacacctgtatttgttctgtccaggggagcaagcccttgcttgttggcccagtcattgaacaagtcccatgggataccactcatcagtcctgaaccgtcaccggagtcattgtccgctccacacccaccacggtgctccatgcagccaagagccacaagggcatcccggacaatattgaatgaaggctcatttttcaagtttgcgacaaatccaacaccacaagcaccacgttctgataagatttcattcaaatctgcagcctgataaatagaaaggaaatactgatatcaacaagagcaaaacacactgcttgatttacagcatcataattgcgactcagaatacaatcttgcattcaagacattccagaagagccatggaaagtacattacagcctttttcaccaatgcattacacaatgtggtactcctggaattcgatcgcgatcagtacctaccaccacagctgtcatgtatccgttccttaccaaataattgtttatcgcacctgcatttgttgtagtttgttcacttactaccctactgttttaaaaaaatccacaaaaggaacagcgcaacagcgacaacttgcagtgaacaaggatcaactagagattaaaaaaagcttgcacatgcaagtagcttttgcatcaggacaaaagcctatccaataacagtgatcaggaggcgttaaataatctgaatcatcagttccatgaaccacctctaccgcagcttactctgatttccaatgtattcggggcgaccgcaaatccactagaagcatgtatagagagaaaaataaaccaaaatggcctcaaaactagggatgaatccatgaaaacacgtatgggctcatagcttcataaaccaatctaatcagtaatcaccacaaccaaacatgcaaaaccccaaaacaccgacccattcaagcgcca

SEQ ID NO: 61476 - DNA, 2846 bp, Oryza sativa
gatatttgtggctcaagttcagctgttcaagtcaacgttggttatctctgtacgggattaaagaaaaaatgaacgagaagaaatctgcctcaccttgccctctgaatattctgtcctgtcaggctgttcggtgcacttaataattcatggaaaaagtccggagatattgtcttagcttgagatgaaagatggagtacgtcagaatgaagttatgactgaatatcacagaaaaaatatgcgtcagaacaaatcattatctggattgttcatgcccggcaacaatattgtttgttgccactggcaactagctccaatagtaggtgacaaagagcttttctggaagagttctagttgacaaaaccaagtcatttgattcaaccattctcaagcatcagtactattttttattttaccaattcatgtcaggactattatgcaagagaagatagtgtttccacatataatccaaatattaaaagcattagctaaaattacctttttctgaatgtgcttatgtttgattgctgataaaatatctttttctaaatgtgcttttgtttgattgccgatcccacttgtctttgaaatcatgaagagtaggtgcacaactttcatcatctcttctgtgtttttctagtgaaattgtttccgttgccagtggagcacccaaaatggcagaactggtagtactaatctacagggacaaacattgccatgatggtctttcagcttcgtgctctctgaacgaacggaaagggagatcttcagagttgaaacacttgctgtgctgtctagtacaagtacagtttctgccaatcaagctgatgtagttgtaggatacaattgaaaacaatgtcgccactaatcactattaagtagtactcctaacttgtgtcctcttcaaaaaagaaaaagaaggctctcataacttatggagctccatgagtgcgacaactttgtccacggttcggatggagtcatggggagatgagtttacctgaagaaacaaaacatgtgcgaattggagtaagctgaagtgtaaagcagttgccggtgcaggcaccaaaactgaatactagctctgaatagctcgatccctgtgtgtccttcagctgacagtgaatgctacatgagaaagttggtagcacagagtgattgattcagactgtctgctggcccatcagaggtgctaataacagcgtatccgctttctagcatgcactgaagctgaagcctgaatgctccgttgcaaagctcaagtttatgggctgctcactttcactgctcagttagcttggctgtagtgttagctgcaccatgaatccatgattggtaatagtaacttggaaggtaccatgcacatatcgtggctatctaaaactctgaatttgattgcattgtacgctaaaaaacacttaattttcagattagttgatgtattaaatttccgtttagaaattcaattaatatacagatccaaatgataatacatgaaaatagttctagaagtagctgaataaaattcggcccatttactagactcctagattcggccttgtttggatgggctcgagatgaatcctgggctaaccaccatggatgggtcggaatagaggagggaaaagtacacgcaaggtccctcaacttgtcatcgagatacaaaatcgtccctaaaccgcaaaaccggacatccggcatcccccaacttacaaaaccggtcataaaaagtccctcggcggttttcacccggttttgtcccacgtggcggctgactcagcgtgggacccacgtgggccccacatgtcatggagaccacgtcagcctcctctctctcttctctttcccttcctctcccttcctcatctctctctctcacttatctgcaaagctagccggggcgagcaggagaggaggagggcggcgccacgacggcggcggcggcggccgtagtggggaagcacggcggaggcgcggggagcccggaaccctgccgacgacggcgagcccgtagcccttgagcccgacgaactttgctacctgggcgccgatgccgtactcgcgggagtcgacagcgaggccgagctcgacgttggcctggacggtgtcgtggccgtcgtccaggaggttgtaggcgcggtggccgtgcgaccaggggagcaaggtgtcggcggcgacgacgcgggagcaggggagcaaggcggcggcgacgggcgcggccttgacctcgccacggtgcgcaatctcaacggcgtccgcgtggccgacgagatcctgcggcttgtcccggacgccgccgcgttccacaccacgctgcggtgcgtgaaggaatcgacaagctgctcagaggattcgacggcgccgcgccgtcgcatcatccgtcgtcgtcttgcagccagcaaggagccgcggctgcagcggcagcaggagcaggaggccatctccgccgcggccacctcgacgccgaggatctccgggcggcgcggccgacggggaaggagcggcggagaggatatcgaccggccggctccccacccggcgaacgcgagcgcgagcgtgaggttcgtgctgggcggtgacgcggcggcggagacatgggacagcaagctcggcggcggcaggcgagcgcggctgcggatggggagcggtggcgccgacgactccgcaccgctcggcctcatcgctgtcggcggctccgggcgcgggcggaggtctcctctgataggcgatagtggccacggtcaccgtgccactgtacgcggcgggggcgtcgcaccgcctgcttctcgtcgctcgtccgccatcaccgaccgcacgaggggacgaggaggccggcgagctcgcgccgc

SEQ ID NO: 61477 - DNA, 7954 bp, Oryza sativa
gacctgtggggcccacgtgggtcccacgctgagccagccgccacgtgggacaaaactggagtcaaaaccgcctagggaccttttgtaaccggttttgtaagttgggggacgccggatgtccggttttgcggttcgaggacgattttgtatctcgctgacaagttgagggaccttgcgtgtacttttcccaatagaggaccatccaaatgaggcctttgtcgtgttggcagagaagcccatgcctacgccttgctgcggcctcacgggtaagcggtagaactcgacctgtctagtgttctgctttggatgccattgccatgtgagcatgtaatgtgattatgtgagtgactccgtttgaagatgaagattacggatagaaaaacattaacgtattattaattattaattgaactttatttctttaacttggaaaaaaaagacttatctaatatttttaagtaatttttatatgaagatactaaatacgctgtttaacagattgaaaaacgtattaattaacgaaaatcgtggtaaatttgtatcttaacaagaagagccacatgtgagacggtacggtgcagccacccctctccaaaatacaatggaccatagcaagcaaagcaagcacaggcacgcaggagaaccgactagacgctagaaacatgagacaggacgggcactggcctcaatagtccaatagcatacctggcgatgccgcgatgctcggaacaaccacaagaagacatcgcctgagccccaagcccaatagggtacacggtgaagctgacgaactggtttaataattctaaccttctgactcacatagcctttcacagtttcactcgtgactggccttgcgtgcagtccttcacaccttcaccgacatgcatgcattgatgcatcatacatactctaacttcagaagagatgcggagccgagattcaatcaaactacttcagcttcaccaaaaagtgaaacagagtggaataaagtgatacaaaataaacgaactacagataacctacttggaggagcttcaaatcctaagaaacacttgattggttggcagtttttgagaatctgaaaaaaaaaaacagagtatacaactataagaatctaaataaacaccgggctatttgaggagtttctaattcgaagagaagcaaacaggtccaaaagtatgatttgggtcactctaaacttcgttttaaaagttagatttaatagttagaatcctgccaaatatgaccagttaaccgggctcaaatcttttggcaggatatgcggcaatgccatggcctacctgcagtcggcgtttgtgtcaactgcatatgcggtgcggcgacgactgcatatgctcttgcttggacttgaaagtcatattcatattgcggttgcgggtctacttctgtctctaaacgcggctgttactgcgcgtcgccgttctcaatcacggcatctctctcccacgtacggcagagaatatcacgcgtacttacccaaaaccccaaactgcaacccactattttagctgatttttaaccgaccattatacggttcatgaaccagatccacaacctcacgtgtactcactcagtaaaaaaaaaacaatctagacaaggataatataaggttgtgtttagttcacacaaaaattaaaagtttggttgaaattgaaacgatgtgacggaaaagtcgaaaatttgtgtgtgcaggaaagtttttgatgtggtagaaaagttggaagttttgaagaattgttttgtaactaaacacggcgctagtacaataaatatgaagacgagcattctcagattcgttacagtaggctatatctcattcttacctagcttgtatttttatggagggcctacatctcatctgacagatagccttttagagcaggtacgttagtagactataagccaattataaacatattttgagaagatagatagggagagagacgagcagcgggctacagatttgtagccagctatagcataaattctaagatgcaatctatatatgataggtggcatcagataactattgtatgaattggccattaaaatgactacatataatttagagttagcagttggctatagcccatgagctgcatgccaggatttagttcacacatgccatatgggcacctccatgcaaagacatttttctcctctccttcagctgtccatgcaaaaattctcatcggatttcgagggattcgagtgacgacacgcgcgcaggggtacgtggtgctcgcccattggccggaccgccgcctccgatcacgagctcggtccccggccagcgtcgccatgcatggcgcagaggcagccgaggcccccgccgtcctctgcccgatacgtccaatggcgaggcctcacgggcgggccagggcgcggccgctcgccgtgtcgtttcccgccatggctcacgtgctcccccgctatatagctcgctcggccacctcgccgcaccaccgtgtcacccgccattgctggtctttgccttgctgtggtgagagagatcgatggcgctgagaatgagcatcgcggcgatgtcggtgttggcggtggcggcggtgctcgttgtggccggcacggcggcggcggcggcggcgtcgtgcccggcgacgccgccggacgcgggggcgacgctgcaggtgtcgcacgcgttcgggccgtgctcgccgctgggggcggagtcggcggcgccgtcgtgggcggggttcctggcggaccaggcggcgcgcgacgcgtcgaggctgctgtacctcgactcgctggcggtgaaggggcgcgcgtacgcgccgacgcgtcggggaggcagctgctgcagacgccgacgtacgtggtgcgcgcccgcctcggcacgcccgcgcagcagctgctcctcgccgtcgacaccagcaacgacgccgcctggatcccctgctccggctgcgcgggctgccccacctcgtcgccgttcaacccggccgcctccgcctcctaccgcccggtgccgtgcggctcgccgcagtgcgtgctggcgcccaacccgtcgtgctcccccaacgccaagtcctgcggcttcagcctctcctacgccgactcctcgctccaggccgcgctgtcgcaggacaccctcgccgtcgccggcgacgtcgtgaaggcctacaccttcggctgcttgcagagggccaccggcacggcggcgccgccgcagggcctcctcgggctcggccgtggcccgctctccttcctgtctcagaccaaggacatgtacggggccacgttctcctactgcctcccgagcttcaagtcgctcaacttctccggcacgctccggctcggccggaacgggcagccgcggcggatcaagacgacgccgctgctcgccaacccgcaccgctcgtcgctctactacgtcaacatgaccggcatccgcgtggggaaaaaggtggtgtcgatcccggcgtccgcgctggcgttcgacccggcgacgggcgccggcacggtgctcgactcggggacgatgttcacgcgcctggtggcgccggtgtacctggcgctccgcgacgaggtccgccgccgcgtcggcgccggcgccgccgccgtgtcctccctcggcgggttcgacacgtgctacaacaccacggtggcgtggccgccggtgacgctgctgttcgacggcatgcaggtgacgctgccggaggagaacgtggtgatccacaccacgtacggcaccaccagctgcctggccatggcggcggcgcccgacggcgtcaacacggtgctcaacgtcatcgccagcatgcagcagcagaaccaccgcgtcctcttcgacgtgcccaacggccgcgtcggcttcgcccgcgagagctgcaccgccgcctagtcgccgtcgccgtcgccgtcgccgccgccgccgtctcactttcgctgctgcttcaattctttgtagcttagtgagctagcttctcaggtgaagaatgtttcagtggtttatttagtctgggtttggttcgttgattagatcctgatgataagtgaagtgaaatgtgcacgtttgtgatgtttaattaggtgctggattaattcagctaatcccttgctttaatgtagtaacatgatgttttaagagaagttgggccgttgtttgaaaatacagaagttattgggccgtcattgcatgcccactatctgcaaatgggctttgaactcactggaggtatgtgtgtcatatcgagcccactatctgcagaaattcagatgaaaccctcagctggaccggcccatttccttcttattaggccgaaaaatagttcgtgccattccattctcttccacgtgttcttcacgtgaatgcgacgagtgaaatgaaagcacccgtgacgttgcattagccatcaggcaaagcatccagtaaacatccgtaccatgtgctcacgtccatcatctgtacgtgtgccacaattattgtccccctctactaatgaggaaggcgtattggccagcaatttctcctacatatggtggcgtttgtttccgatgaaaataaagaaagacagagcacacaaaataagaaagccactaataagttgttataaacttaaaaaataatttatttgatattttaaagcaatatttatataaaaagttttcatacgaaacataccgtttagcgtatcaaaaacgtgctctaatgaaaagttgagaaaaaaaacacacatattttgacaatttgaccctttaaaaaaaaactaattttacaaatgaactgcggccaaaacttagggctgttttggtttgatgacaaaatttgccctacaaaatagttggcactttagatagtaccttgttgatgtttggattgatgccaaaatttaccaaatataatacaactcctacaaaccaattctaccaaaatattgatttggcactaccaatgatttggtagggcaccaaaccaaatgagcccttatttcagaaatgatcattttgttcagcgccaaatcgtatggcgctgaatttagacacctcagcgtcacgtcaactggcgctgaatgccatgccactgcgaatggaaggctgagttggcatgccaacatgcattcagcgccgtgctatttggcgctgaggtgtttggcgctgaacaaaagggttatttttaaaataagttttagccatggttcatttgtaaaaattagtttttgtaaagaggcatattgttaaaatttgtgaaaaaaaacatatcttaattagaaaagaatatggccatatataatccaatgttccgttcgtatgcatgcttattgcactgcgatgaggaaggctatgtcagaagcaaactagagggactcttgtttagaaatattttgagaagcagtcactgagcatccaaccattgaaaatgtagagaagttcgaattttaacaaaaaaatctaaactatctgagacgctgaaaattaggaaaatacccacaactgctagaaaccaagggcggatccagcatagagacggaggggtcttaaccctcactactgacgtgaatactataagagcccctacgaaaatcgcactaaaatattttaccatgtgtagatgggagaggggctataacactatctaatttgctcagattcactgttatttttttctgatccgtcactactagaaactcccctcaactttcaagcacctctcgagccatgacatgaacaaacgtttgtactactactagtgaaaactcaaaagcaccaggggattcaactttcgctcaattgcgagccttgtgcctcctcggattttcgccccccccttgtcaaacctgcaatcatctttgcatctttgtagatgcaaaagcttccatcggcattgcccgaggcggcgttgcctgactttgctacagtgttgtactacctgcgttttcagtgttgctctcttctgaagccacgagcacattcagtttcactttgccatgcgaccccaaccaatgcagttcgtgatggtactgtaacttttttttttttttttttttttggctttgaggaccagcacagttttggcctcggggacgacgaaaaaagcagcagaagcagctgcagatgcatgcagtgccatgcactgctccggcttgacggcagagtcgagatgatgggtaccgagtcaaaaaagcaacaaccaaaaaaagtttcttgctattgctacttccgccattatattttaagagcaggtataatagcaggctataagctagctgtaaacatattttaaaaagataaatgaggagagagaagagcagcgggctacagatttatagtcagctatagcacggactccaagacaccgtgtgtctatgacagctgggaccatgtattaataatatagtatgtaactaatgtataaatgagctattaaattggctatagatgaattggagctagtagttggctatactattaaacttgctttaagtgtagccatgagtgtttggtattcaacgtttgatcatccgttttgtttaaaaattatttatgattaatatttttattgttacaggatgataaaatataaatagtattttatgcgtgatttatttcttaaattttttaaataaacgaacgatcaaacattgaacacaaaaatttataactgcatttaaatgggatggagggagttgtatatagtatacggtataattaactgtgaagctgcagcggccatacggaaggtataaaatgtcgctttttagcgatttcgtcgtacgtaggctagtctcccaaatctgggccagcattgttgtgacattgtgtgatctgaattccatttcacgcattgttcagtacgtcattagagacagagacatggatctaaccagatcattaataattatgcaatctgtttctccctttcagtttccaacagacaaaaaaaaaacccttataatcagagttgcaaaacattgcagctttgtgtggctatctgaaaaacggcagtcgcatcgcatgcatgtcacagctctcacgaagtcggcagagatgcgtacttgaggtctaattgcatgcaattggagagaaacgccagaagagatttttttctttttttgtttgtgcaagacaggatcatcatcaggatggcgtctcaatttcttcagaagttcacgacagcttccgttatctagggagtgttctggaccaccactaataaatggcgtttttgtttctctcttgcttggcctaatgacctgccttttggtagcaatcgttaggcacaaaaccttgagctgttctactgatgacaaatggagaggaacagcaaagacacagctaaatgatagctattgaaaatgttcactccttgttgattgttcttcttgaaaagaaaaaaaaaaaaggaacagccttgcactacgcagaggagaacttaaaataactatagatgagactagtctaagttaattccagttaactaaggcacaatgatattgtgatacacacagagtataaaattggctgtggagagaacatgcatgcaacacaatgatcatcgccgattcttgaagatatatctatacaaaatacgtgtacaatcatgtagcatgttcatggctcataaagaaattgggtgaagtctttagccttcagattagtttttttgccattgcagtctctactccttggatgccattttgtgtgatatcagactatcagtagctttctgatgctttctccttttggttttcgtataatagaatccttggtgtccaatcagcgttgccccagcgtataagagaaggttctgcactgatagttgccggccacaactgctcatcaacgcataaacaattcgggacacataactgtctgatcttttgagctctttgctcaatttttctatggaacttgtgttgccatgttggatagtagtagaataatataaaatggtatagtcatgttgggc

SEQ ID NO: 61478 - DNA, 977 bp, Oryza sativa
taattctgtattcggtgtcttaggaactgattgcatgtcaaatgaaaatgaaactcagaatggttccatgctgtcatcgacaccagccacaaatctgggcagatttcttttcattattagtcatatagcactgaatcatttggtttacattgagacttctgttaagaaaattcagaaacagaaacggaagaatgacaaatcagagcctactgccgaggatcttcaggcagatgcctccaaaaattcggaggtattttatttcttagtttgctttgtggcctaatcgattttgggttaccattctttcgtctgagtgtgtattgcacttctcttttactgtgtgatgctggcaggcacaaggtataaatgctgagttgggaattggtgcatctgtagatattgcaatagagtccctcgctgaaaaggcagaaagggagattgtgtccaattctgaaaagaatcttattggatactgtgcaccatttctcgcaaaactctgcaggaacctggctttgcttcaaaaggtcctaatttgtattgagcttcctttattttcttaatgttttgactctactactctctgttttttgttccttacttttttgttaatgcagtttccagggttacaggcctctgcaatgcttgctctttgcaagctaatgattattgatgcagaattctggtaagtatatatttatattccagctgtttcaccttttcaatatgatgtgctccagatatttatattccatcaaatgctcaactttcagtgaagcaaatcttcagatcctatttactgctgctgagagcgcgccttctgaagttgtccgatcaaactgcactatagctcttggtgatttagtggttcgctttccaaacctcttagaaccttggacagagcacatatatgcacgcttacgtgatccttcggcatctgtgaggaagaacactgtgcttgtcatttcacatcttatatt

SEQ ID NO: 61479 - DNA, 3400 bp, Oryza sativa
aatggtactatgcatataccttgcatctatattcgttcgagctttcccatctaaggctaatcaactaccattgcttctgtattcaagataccatgacataaataatattacttcctccgtttcatattataagattttctagcattgcccgtattcatatagatgttaatgaatctaaacatatatatgtgtctagattcattaatatctatacgaatgtagacaatgctagaaagtcttataacctgaaacggaggtagtaaatgagtggcaatgatatttacatggaaaatgtgagcacacatcagaaacggaatgttgtgatgcagcattcttgttctttgttgcaaccttgtagtggagtggcttttgcataagctagcaatatgggaagctagtgagccaatttgatttattttcactcctttcattttaatcctgtcttgagatttctgaattttcacatgcaatatttcaacatttatgaatgattgaattgttgtgatcccattttcagatccttgacctttctttttgttgtgtttcagatgttagacagtgggagtatatatcctattgcctttctcagctgactttcacagagaagggtttgaaaaaactagttgataatttcaagatatttgagcatgcattatctgaagattctgtaatgaaccacttcagaactgtgatagcaaaggttggtgctcagtagcctaggctgaatggatgcatatgttattatgttaaatacagcagggctgaatttgtgaactcttcaatgtttttttaatctatggtaattcctcctatcagtgcaagaagtttgccaagccagatctcaaagtttgcattgaggaatttgatgagaaactcagcaaggttcatcaggaaaagaaagagcaagaggccacgaccaggaatgccgaggcacacaaacaaagaattggttcacttgacaaactcatggtaactaagagaactgggaaggataagggaaaatctgctgaaggtacaattttttttctctgaatctccttatcatctatatcatttaagttaatctccacatgatcatccatcatgtattgactatgaactcaaacattagattagaataaggttacgctgtaaatctgtgtctataatctatacaccagaaaaattgatgcttaccttaaactgaggttcatttctttctgtctgtcagtggcagaggaaactagtgaggtagttgatccatcaacggagagcaattctgaagataaggagaacatgccagaatgcagtgacaatatttgttcggaaaagagtcatacatcatccacgtttacagaatcagacggtgacagcacagaggttcaatcagcgagaacttcttgcaaaggtaacagatggttgcactgctgatattcgcatgacacatccagtttctcaaggaatctgttccatgcattatgcaggcgtgtcgcgttcaaggataaataaaatgagagaaccggaagactcagaagacagtgctccaatgagacgtgtgtctcgcagaaggtgtttacactcactaccttacaacaatcttacttcatagtagtagtatttgtttcacgtccactaattttaaatctttctggatcattgctttgttcatactactaagcagtgctattagactcgtccttaattcctactcatgaattactaagaaatgcatttgcttacaaactttgcagaccagttaggtgatgccgaactgtaatatggaccaggtggcaacaactcctctctgggaagatctcgccttgagatcttggagttctgaagcaactggtctccctggcgcttgtcccaccagaaactctatctaacgccgatatatttgttgaatcataatgtttataagcctgcgttgacctgctaaatcttggtcagctccacacggaacggtttgctggatgctgatatttcatctagtaggttgcctctgattgataatccgtaattggagttcggtatctagtctccttgccccgtatgttgaattttttgttcgttacgatttgcgctgcttgaacaaatctatactcgcttggtcgaatccagaacttggtactactagagagatgtacctgtatgttgtctgtagactgtactgcctccattctcagtattggagtacatgttttaggtgtatgcaggtaaactttggatatatatgtattcctaaatgtattactagcatttgtcgtgtgaaaaaaaatactagtggattcctcatgaaaaagtactttatactattagtagttatgaacatatagctaaaaaaatataaattcattgatagtcgaagttttaaaattttgattgaattttatctgaaatatcatatactttttaaccagatggagtaataggaattacatatgcttattggagagctggggccctggaaagcccaggctaaatcatccatggcctcacttaacaaagcaacaggcagcagctcatttgcgttgtccagggacaaggcaaaggcatgttgcgccacttgtgcaatccagttctttttttcgctgtctgcctcgaatctgggttgctcacatccacatgtcatccatttctcctcaaagaatttgatcacgaaattcagccgcgacgttgacggattccaccagccgcggtcctcctcatgctccatggctgatttggaccactgatttgagtggcagatgatttatctgagatttaattcagtgctgaaacaataacagttcactagtatgaaaaagtattagtcggtcatatgcttcgtcgcttgcatactttttccatgcagtaactgcaaccggtgcatatttctccacggtgaaaaagacattgtcacactagacatgtttatgtagaaatatgagcaggtgttttactttgaatcattaagattaagatgtagattttacttcggtttctataagcacactttccaaagtgtatttcttataaaaactttatatacagaagttaccctaaaatattaaataaatctattttttaagtttataataattacaactcaattattcatgcgctaatggattttttgttttgtgttgcgtaatttcattttcatcttaatctatctcaaacaccacctgatcagtcatactatttgtcctctaaagatttcgatgcttatttgtggttatacaatgtaagcaatgtcaactgccaagctcataagctagatatattcgcatactccttctgttccaaaacagtataagcatttccgaaacttaaaatatgtattccattataaacatttttctatcaactttcccatcttcaccaatcacaactatgtctccctggacgtcagtttctattaaaactcttaaaagtgctt

SEQ ID NO: 61480 - DNA, 1454 bp, Oryza sativa
acactttcttttgacttaccatactacctttgataagctggccgggctgtgcggtttgtgcgtccccgggaagttggagccgtgcgtgcgtgcgcttcccgggccctgtcgcgtgatccgtgtggccgcgcggcgcgtggagatcgaacgagccggccggcacgcgaggcgagcgtacgtcccgtgcgcgagcgcgcggctaaaccgctaaagaacccgggaattcgatcggaatggcgttaacgtacgtgctaacgtgtcgggtacgtacgtgacatcgcggcggctggcgtggcgtaacttgatcgatcgggatgccatgccgttcaacccaagcgtcgagaaatattctgcatgggcactaacgtggccaaaacccccaaaacccaatccaatctcctctcgcggaaactggtgcgtgattgttcgatcgattgatgatcacgtatattattgttcctgatgaattaataattaatcaggaaaataactccaaagttttagtgctgctgtgtgataaccagatttattgccccgtgcattagaagcttggaatggaagacctgatcatgtaaaataataataagaacaagatgaatcgctgagtaagcagctgatgttctacgagccattttcttctccctaatgcgtcatgcgtgtaaactccaacagaatggaccaaagattcggtgggtacgttcgtacgaatcaatgggcacaggccaataaaacaccgaattaaccactaaaaccaccgtggcagcgtccctaattaaactaatcgtgatagctttgctttggcgatccatcaccaacgctacgggacatccacgtatgtacaaaacgaccaaacggacatgagaaaccattggctctgtggcgactgattgaggctttacctgaataaaaacggtcagggtcgtcttagcttagtcaagtgtgattgtttatgattggaacatacctaaggaaaaaggtgattaggtgaaatgatttcttaaactaacatgggtgcacattcggttccaaccagtatcatcattaccaaaagcaagttgcagttgagtagacatgcaaaccaactttaatcctactctctgttaacctcccctgagcagctgagccgaaagttcaggtttcagactgcttacctagcagtcattgtaaattttaagttgagctatattactaccataaaacgctattgcatcaagatgcttaaatcaactaacatgatattttttccttgattggtgtatgctttgaaggcctgccaaataccaatgcaaatgtacaaggtagtagtaataccacaactgttgtaaataaaaaagagtaaattttactttaagtcaccttttattatcaatgtttctctttggatcacccttcaaccaatgttttcattttagattagataattttatctttgtgacattttaaaccatcctcaa

SEQ ID NO: 61481 - DNA, 3757 bp, Oryza sativa
atgcacagattaaacggacatacattaaaatgaacgaatagtccagccaattagtctacctaattagcattctcaaattaactcttaaccgttagatctaactgaactacagtaaagaaaatgtaaatttactcaatgttttgttagcaagaaaaactttatatgtaaacttttttttcccatttggagccccctgtttgtactgaatttgccatttgtagccagtcctctcatcctctcctcctcgaaacggctaagcacaaaaacagaaaaccgaaaccgagggagaaggagcaaccaaccaaaccaacggacgccatcgccaccaccatcctcgccgtcgcctctccaactcaccactcctcctcctcctataaaccaacgaagaacacaaactcaaactcctccttcacacacacgcacgcgacaccggtcaagaagcgcgcgcgcgcgcaccactgcaccgcgcgagcggcaacggcggaggaggagaggctgtgagtggtgggcaatggccgtggcggcgcggctgaggtcggcgggggcaaggctcgtggtcgggccggcggcgatggcggtgggacgtggtggtggtggggaggggaggtggatggggacggccacggcggatgcggccgcggggatcgcgaggtgggagccgatgggggcgcgggagtactacgactaccggagggccatctacggcgacatcacccacaaggccatcctagttgacgccgccgggacgctcctcgcccccaccgagcccatggcgcaggtccgctcgcctcctcccccatctgcatgtcgcatctctctctctctctctctctctctctctctctctctgtgtgtgtgtgtgtgtgtgtgtgtgtgtgtgtgtgatgcggccgcctccattccgcgggatgccaatagttcagtgtttctaggcggattttgatcttacacaccactcattatttatattcattaagtgtgacgaatcgacaatctctgtggtcatgtgcgcgattaaacagtgcatcgatctgatctgttgcagtgttgatgttctatccgatccaagtctatggatcgatttggattgtgtcagacttagtgagatctatttgtgtgttcttcaagtttgtcatttgggtggatttgttccgtacataatgggctggcaacaaaaaaagctctctttttgcgatgctgggatatgtgtgcgcaattatgcatatggaatatgtcttcttcatgtggcttactcctgatgtcctggtgtttgttcaggtatacagaacaattggcgaaaagtatggagtcaactactcagaggatgagatcttgatgagatacaggagggcttatgcgcagccatggggtagatcgcggctgaggtacatcatataatttgcttttactgttctgcatcactactgtaactgtgaggtttggatttagtttttgcagtgtcttggatggccttgtgattttattgttcctgtgattttgatgatttgatttttagaatagcgtctggttgtgggacattatgctatcactgtcgagtgcattatagtgtgtcaaatccttactcaaatggttgttgacgtgtcgtatattaatgctttttgtgcgatttaaacaaggtttgtgtcatgcagaagcagcgcggctgccaacttaatatttgtcactcagtcagcacaagttggtcttttcaaactatcaacatgatattccctgactccctctatctactccgtaacagagaatttgctcttgtgggcacatgcaaatttgatcttcaagtggtacgaactcatgaaagatgaaaaatatgagcatccaacaggcatacaagcatgaaagattttaaatagagtgaatcgttcaacaatatgataaattgcgggatagaaaacttccatcttgtttctgacgaaaaaattctatcaaaactgaacctcaactgaagaaaattgttaccgtgatgccaaacagaacctttcaagaactgttgttttataattctatgaacaatcaatgtttcagattgatattcaggaactaaccaattttcgggaatgagttatatcttggtgacagaagaggggaaatgaattttcatcttacgtttataggcagtattcagatcaaatacagataatttttctctgtgtgtgtggtttagagtttagacactatacggttgactagtgaaactcttgacctggttttatgttgcaaagcacacataagtatggacaatcatctgcatctaattcttcttgacatatttggttgatggtgataggcagtacaagtgcatttattctttcttatggaccttttatctaaccagtgcattcacgtgcctccttgaactctgattgttgcgttaccaaaatagaatagagatataaccatggtagagttgcagccttccagatatgtgattgtgttgttcacattctagattcatatttcaaccatatttacctttcttatccttcaaatttatctgagctgcatggactaaaatgcttcaatatatccaggtatgtggatgatggtaggcccttctggcagcatatagttagctcttcaactggatgctcagatttacagtactttgaggaactttatcagtactatacaactgcaaaggtgagataaactatgcaatcataatcgtttcaatttttgcttttacatgctatatataccttatgaagttcttcatgtttgctaggcttggcagctctgcgaccctgacgctaaatatgtttttgaagcattgagaaaggctggtgtaaaaacagctgttgtatccaactttgacacacgtcttcggccacttttacaggccctgaattgtgatcactggtttgatgcagttgctgtatctgctgaggtgggtttccattttcagatgaaccggttagcttggcccaatgtccaagccctggctggtccttgacttactgttcttgtctctggatcctatatcaacaggttgctgcggaaaagccaaacccaacaatattcttgaaggcttgcgagtttttaggtgtgaagcctgaagaagctgtgcatattggtgatgaccgcaggaatgatctctggggagccagggatgcaggctgtgatgcctggctctggggcagtgatgtttactctttcaaggaggtacaaactacataccttaaattttcagatgctccaacactgcaagatacaaacaaaccaatcatagttctcttcttgttttagtccatttaatgccaaagttgctgttctattacttgtctctctttgttcagaaccaagctcacatcatcaaatctggattgctatgcaggtcgcagaaaggatcggagttaaggtgtaaggagtcgttcgtccgctgggtcacctgaaataagaaggccgggaggtgttgcatttttgtacatagcggcaacccttgttgctccactgatgtacatatttttccagagaataaccgatggcagtgtagtatatatctgtatgactgcatttgcatttgagactttgagcgctcaatttacgttacccctgctggtgtctgaaactctgaatgtctccttgtgttagctgaacctgaaaacgttaacctgaaggcgattagcatcaacatccacattgggtcgccggcccaggtgaccaggcctgcattatgcttaccagttctgggcagcgcacacttcttttccattttaacagcacttccatacaaaacttt

SEQ ID NO: 61482 - DNA, 7871 bp, Oryza sativa
gtcgggggcgcaccagtaaggtcctaaggtcagtggtgaaatcgtgggtccatgactccaccatccaaggtttaaattctattacctacgaatattacgtttatacaagtgtacttttaataagattttagtaagatcaagaatgtactgttgtttttcatctcttgataaggatatcgttgtttttcatctttttgagcttgtgttaaggggcagattcatggagatgtgagcaaggtgttggtaagatcatgaatgtaccgctaattttaggggcggatccaccgtatagcaaggttgtcaggatcgggatactaggtagtatcgttttgctcaaagtaatatcgtatcgtagtattgggatgctatgagattttcttttttaaaatttaattaatacttatattaattatatatagccattctatataaaaaatatagtaatgatatatgtcatgtaaatagagacatttatcaagagaaaccacgttggttttgatatatttaactgatttttatataaatttgagcatatttagttacactattttcaaaccatgttattttaaataatattttgtagtatcgtagggatcgtagaattgggataccacctaagatttcatatgatcatgtagtaatgaatagtaggatcgatatactatgaaaattaggatactaggtgggatcggtatcgtttcggtttggtaagatcgtagtatcgtaagatactagaatacgtatcgggatactgataacattgccgtatagttaatatttttgctaattacactactaaatatgcttggaactaataaatcattcttagaattaagcatttgcaccatggtaggtgaagagtgaccccaatgatttttttttctagctttgctcctggctggtttcatctctttgagcttatgttaggagaagtattcacggaggtgtaagcaaggtgttgcatgtgtagtggtgtgtgtgcgtgtgtctgccgtgtaatcgaaaaaaaaatcaccaagcatgtcgctgtgagcagtaaacctttttttttaaaaaaatgaaaggaagtgagcagtacaaacttgcttggcaactttgacatgaaaatccaacaaaagaagctaatcggaaaacttgtcaaaatggaacaaccccatgcaaaagtcccaataagttttgagttgcacgccaaaataagataaattcaaattttgtaacaacttcagctcatgtcaattagcatatattgtcagaagatgtacacaagacgtgctagttcatgcaatctgtttgccatttgacggtaaatcatttaccttacttacaaacagagatcggtctggatgtacaaaattcttgtagaaacaaacaagagatacccatccaaaacatatgtacatctaatccaaatttccaaccaaaaatcgcttcaatcttcaaagcaaaactagcagcagccaattagaagagaggattagacgaaaattttcatgcatgtctacttgattcccttgtccaacccgagcaacctcaccggagacagcctgccggtggggctgacgacgacgtcgaccaccctccgccgcccattccgctccttgatcgtctccagccgcggcgaccacggccgccccctcgccgcgcccaccagctgctcgtagtgcttcctcagctccggcgtgctgcacagcgccgccgccccatgcgcgtcctccccctcgccgccgccgccagccggtggccgcctccccgtgacggccttgacgatgaactcctccgtgaccttgatcaccgtccgtccgccgtcgtccttgacgtactcgaacgggctcttcgcgccaccggccagcagcggggcgccggcggccctgtcgtaggtgagcgcggcgagcgaggcggcggtgacgacgtcgcggccctgggggaggcggtcgacggggaggacgaggtaggtggcgcaagcgtcgaggcggtcctcgatggcgagcacgggggccgcgcggccgaggcagaacccgtcggcgcggcacaccacgaggcgccccgcgtgctccatcatcacctccccggccatcctcccggccgccgccgcccgcctctcccctccccacagcaccagccgcgcccctcgccgccgccgccgccgccccggcacgacgacgcacagccaccccagcaacccattcttccccatcgccatgtctagctagtcccagcaaccaacacgagcttagcgttactatatattgcggagcacgaaggggttgacatgcatgtacatgtacgagccgcgagccgatccgtgcgaggcgcgcgcgaggttgacatcgcgtcggtggtcaaaagtccgcgggcgtttgttcgactagcgcgcgcgcgattcgccggtggaacggttcacgcggggacacgacgggatacagtgaaatctcgcgcaacttgggcgtttttttgggcagttttggtggtggtcgctgcaggcgcgtcgcgtatcgcgcgcgggggcggcacgggcgggcgggcgggcggcgcggctgcatctgtgctggtgcagtttgccgtggcggtgagggcgcagcatgtgtgcgtgggtgagtgagaggacgagattgtggtggagatcgtgctagcagggggcgacgtaacctagtcggcaaggcaacgggggtatactggcctgattctagctagcgatcgattgatctcacatgttacaccttacacgtacatgctggaaaacttctctttttttttgatatatttcttccaaaaaaacctagacaacggtatcccgttccagggatacccttctatggatacctgatacctgtcgtggtaccagctgcatggtatccgatacctgtgatacctgttacccggtacatgtgatacctaggatctgacacatatgatactcgtgaaagagaatagttaatatacctatcccattgcaacgggatcccgttttgtagcagccctctatttcttttgagtagttttaaaaaatgatgggataaatcagtgtacgatatgtcaccccttcaaactttcaacttttccgtcatatcaaatgtttgacatatgcatggagcattaaatgtggacgaaaaaaaattaattgcacagtttgtatgtaaattgcgagacgaatcttttaagcctaattacgccatgatttgacaatgtggtgctacagtaaacatttgctaatgacggattaattagccttaatagattcgtctcgcagtttacaggcggaatatgtaatttgttttgttattagtctacgtttaatacttcaaatgtgtgtccgtatatgttactttttttttatcaaaacaactaaacacggccaaaattcaaattagatcgacacttattacgacaaaaagtgcacggaagctggtggctggtagttagagtcgttattagtagttcaaacggtgagattgtgaaaattcctctggatcgggtgggtttctacttttcagagatgaactggttctgtcaactgcctattgttttcgcaggatcaagctaagggtgaaacttggaaggaaggtttcagcaggatcaagctgggtcagccgcgtactctgcaggctccactccaatacggatctactgatcagtcgtcgcagcactgcagcagtcgagagatgtgtatcatttctgagaccaaattgtattattttactattataacgtgcgcaataatttatactagtagtataactatgcacctaagcattatgaaatgccttgctataaattcagtgaaagatacgtcagtggcgacgacgttttgggcaagtactcttgctgctgttgtgtttgacatcttcctccaatcctcctctcgattgtcccatgaccggatcctaatctaaccaattgaatcatttctctattattaaatggaattcgccacgacagacttactcttcatttcgcactgcttacaacatttacatattaattaaagtagaacaacacatagcatcttcaagctagacacatactcctaatcctaaaatatagtacatttacatagcatctgcaaaggtgcatgcaagcaaggttcaccaaacggttttcaaaccaaaaaaaaaaaacgaaggtcagcggtttcctcggttttcgtgaaaaccatttgaaagttaacgataaaatcctatcaaattttatcgaatatagaaaatctagcttgctttattttttttttcaaaacttacctttcgttttatggaccaggaccaatttcatctcagaccaaactttaaaaaccaagaggtttgtgttttcgagctagtcctgcggctttcgactgtttggtaagccctgcaggcaagtcccatggtcatgcaggcattacattgcgcagaaaatgcgctgcgtagtgacgacgtgagactttgtcgacgacattatcgatctctctccaactgcagaagaataatttcatagaaaaattgcggcgcctgtggtgcgcagcttgctaattaaccagtaaattataaacaaaagcgtattttgaacaagtcctctatgtgacatgcatgcatgttagtatattgttatgtctagagagagatcctaatccaggtatgcactagcttgttttggcaggtcagctgagacttgtaaactgtcacaacacttgtagtaatttaatttgaaattctgttcttgcctctgacgaagctgtccatatagtaataaagttcaaaagaaatattcaggagttaatgcagggttagatcatgggttgacaaatgagttcgagaaaatcccatgtatattgaaaggtgttttattgcaccctttttttgaaagtcaagagccacaatttacgttttaggtaatggaagtgttataactttgggtctatgcaccaactgttttgaaagattgctatgaagggaaaataacatcttttggcatgaaaatattgacatctctactctttagacatgcttgtatagttatataggcaacattcttacattcaagagttgtttttaagttcttgcagaggttttagttgagccagtctatccatgattctcagaaaaattgcgcttaactttggtctaattttcatttcttaatcttcattcatccaagattccaagcagggctaaatgaaaagcaaaaaggaaaatgttctcaagaaagcctggaatctttcgggtccagcctaattaaagcccacatactgaactgggccggcccactagcccaaatacccgcttggtactgacatgtagggacagccaaaccgcagttctacacatctcctcagctccaggcggcggcggcggcggcgatgggcgcggaatcggagcaaccaacggcggcggcggcgaccgccgagcaggcgcaggatctcatcgacgtaagccctgaaccctcccacgcggcctcctcgccggccggcttctgctcccctttcagctccttacgcgttgctgtagtgtgtagtactgagatggatgcttcttcgcttgggttaatcgcgcgccgccgtgtcgcttctcgtgcaggccgctaggtacgatgacctggaggacgtcgtcgcgctgttcaccgccggtgtttccctagactccgcggattcgcaaggacgaacgggttggtttggttccccgaactctcatgctgcctggattgatcttagccttttgttataattattggtctcgacatgctagtatgatgttggaatatgctatagagatgttgcatggtacttggatataactgaatatttaccatgacttttaattgaagcagagtagaggtagctccatgattggggggcggatgaataatgagtctatgtgtctttttatttgtcttgtagatgactaactatggagagtgatatagctatcattttccctttgctgtttcaattgtcttactacatgtttagctgcatatatcataaattcaactgtatgcgctaatatatctgaaaactgattagttttctagtttattggaaggacctaagcaccctgagtgatctgctgtttaatcatgcaaacttccttgtagaatgttgactaattattcgatcagcagctacctaaccatttttcctatttctgtcagcacttcatatggcctctgccaatggacatctcgctgtggtgcagtacttgatccaaaatggagcggtaagaaaattactagtatttcatagtgtttttcctgtattgggcatcagttcatgttatagcgagaagggcagtttatgaatgtgtgtttgatatacagaatgttaatgctacaaactcagagaagaacacacccctccattgggcatgcctcaatggacatatcgaggtatttgtgttgccctctgctatagccatcttttgatttttcttgcactgaaataaatagctgatggcacctctgcttgtgaaaataactttctcaggtaattaaagcgttgatatgcgctggggctagtgtcagtgcactgaacaggtatgtgaaatgtaaatgaccgcatctgaacaagcaatgatgtatcagcaaaatagaattgcatggacctagtattagactttcatctgtaatgagtttgtttaagcaatgatttggtatttctgcagccatttagttagtaatgagttagaattgtctgtaccctgtctttagacattcgttaaaaatgagtttgtttatgaatgaaagttttgatgtttctgcagccatgagaaaacccctatggatgaagcagtgacgaagggcaagatggaggtgatcgatgcaatcggtgcagcagtagctcaagcagaactcgatggtgtcactgtctcctaaaaggacttggtactccttctgaacggtcctctccttgacaatggatgacatataaccttgttcttatcttttctggtactgtgtattactgtctgtgtcacttgtgatgctgatatgctagtatcttgggcaatgggagaacttgaaccattacttaatattatcaattctgtcggcaatcagctattacaatcaatgacctaaaacgatggacatggatatatactgttataggctatttgtgcaccagtcgaagtcgcctggactgatcttctggtttcagacttgtagtggactggaactttgcatttgccgtgttagtaacatagtcatgcccactcatggaagtaagtgtagtttgcttgttataacagatgttattggcctgagctttgcagcttgtaagctgggttaatctgtgagctgttacccatctgggtatttcgcgttgtacagctgatttttcatgtgggctatgtttctgaattctgaactgtatgtacttgggcctgcatgggagtatcaaggcacagtgcaacgtccacttctaaccaagttagtatggcccatgaactgaccttaattttcttttgtggaatactataccgaaatgaactgttgctgatgatttgattgattgattaatttgcctatcctgctgcccaatccagaggcgccagatgctatctgactagtatgcaagttcagcaaatcacagttttggctgtgttcggttcccttcaaacttacaactttttcatcacatcaaatatttggacacatgcatgtagcattaaatgtggacgaaaaaaaaccaattgcacagtttgcatgtaaattgctagacgaatcttttgagcctaaatacgccataatttgataatgttgtgctacagtaaacatttcctaatgacagattaattagacttaatagattcgactcgcattgtactggcggaatctgtaatttgttttgttattagtttacgtttaatacttcaaatgtgtgtccgtatacgtcaatttttttt

SEQ ID NO: 61483 - DNA, 2529 bp, Oryza sativa
aatgaattccgcggatggctcgtgaatcgcgatgccttgtcacgcatactgttgtatgttcttgatttgcatactcaaatgtgcccatagttctgttatgtgcatactcaatgacaaaaaaaattaattttattttaggacgaacaaagtaacgtagatatgccctttctgggtaataatttctgggtgtagctagcgccaacacaaatttagacaatttgacacttcgcaaaaactatttttacaaataatcactgccaaaacttattttgaccttttgttcagcgtcaaatagcatgacgctgaatgtatgataacatgctaacttaacctcccatctgtggtgacacggtattcagcgtcagttgacgtggcgctgaggcgtctaaattcagtgccacatgatttggcgttgaaaaaaaaaggtcattttcaaataagttttggcgacgattcatttgtaaaattagttttttcaaagaatcaaattgtcaaaatttgtgtagcgccggcgcctcttcttttcaatgcttatctggagcgtcacctgggacacgtaaatgctgcgatgtagaagctgtgtaactgtactctgtattgctgctacttatgttcctttagtagtagtatttacgtcgtgtttagttccaaagtttttcttcgaactttcaatttttccatcacatcaaaactttcctacacacataaattttcaactttttcgttacattgttccaaatttacaccaaacttctaattttggtatgaactaaacacgggctttagttctagaaatttttcttcaaacttcaaacttttttatcacatcaaaacttttctacacacataaacttctaactttttcatcacatcatttcaatttcaaccaaactttcaattttggtatgaactaaacacacccttagtatacacccttagtatagtggatgcagcgaggagctcctgatcgatctggtgcattgacatttcgatccatctcatctgcatccacatgtcggcgtccggctgcattgaagcgtttcacataaataggcacaggaaatttacccaaccagtgaccacacggaggtatcgttagaaagaagcgtgcatattcagatcgtacatatagcagcatttgttgctaggatctgtacgagcatgagcattcatttcactctctatttactggtagtactattacattaattttacctcactagtcaatactacccgagttatataacttgtggccagcacaacttgttgatgttgtggttaacaattttattggctacaaagtgtgtggcatgctacattttgctaaatattttgtggcgaagtgatcgatcgatggtgtcatccaaacaggctcatgttagctctgctctcgagtagatcagaccactgtactgtgttgggcgagtgtgtttagtcgacggagcctcggagaagaaagcttcttcgcccaggcggccgatctgaatccctagtgcgcccgagaatgattagttcttgatagaatcatgtataggtacaacagtagtactacctccgtccaaaggtaaatgcagccgtgagtttctgtgtccaacgtttgaccgtccgttttatttagaaaaattataaaaatatttaaaaaatagtcacacataaatttctattcatgttttatcatctaatcacaataaaatattaatcataaaatttttttaaataagacgaacgatccgccgttagatataaaccgtgcaaaactatacttttttgaaacgtactccaggagaatacatgcaggtattccgtcgtgatcgtcgaagcagcaggccggcattggtcgatctcgtcgagaacaatggatcacaattcacatgcacacacagaagagacacccgcaatccctcatctgacgtcgaattatatcatactgcagccaagtcaagggagttgcagttgccagctgcctggcatatactagaacagtcggcacaggcaagcagcagcagcatacaactagtacatgtcaggtcgggttgacgccggcggcgcgcgatggctgcctcgtgagagcgaggcatatatcacagtagcagcatcacgagccacacgtacgtgctagcaaagctagctcggccacgctgcatgcatgcagctagtgcgtgctcccccgttacaaaataatttagcttacaatcgttatgatttatcccagaacaatcaatttaaataaaatcaagcttgtttcgatttgtgtttctttctttttcgtgaacgcgtaaaaaaatacgcgtcagtatattagaaaaagatataatttttagttccacaacgtaacataacagaccaaacataagtcattgttgagttacatgaaaaaagaccgcaagaggtaaaaaaaagaaagaaagaaaagcgaaagctgctgttcctatatagagggagagagatggtggggaacccctatgcttccaacaagtgctcaaacaaaggggcactagctaaagaccagaaacgaccccttctaaagga

SEQ ID NO: 61484 - DNA, 3948 bp, Oryza sativa
aattagttttttcattcgtgtcaaaaaccccttccgacatccgctcaaacatccgatatgacatctaaaaaatttcatttcaccagctaaacacgcccaaagattaggacctctttggtgctcctttgttaattgggagtttgggaccaatgattcctacgacaattcaatggatttatattttgatgttctagggtagccttataactgcacggatctagatcagggcaagataattaatatttctcttgtttctcttaattttggcaatatcctgatgtccccaatagtgcctaaacaggatttatctgatcttaggcgtgaggtcggtcgtcgtcgtatctaggattactgtttgtacatgtggtttgtgctcatgcgagtgaagatatatctgtctctggtgtgaactgtgatgaaaggaagggtccctcagtacttacagtgatacaagcctatgctagcaaacagtgtagaccttaagtacactagcttaagctttgccctttcatcatttaacacatgtccgtgcattctctgcatgcctctcctaattatcacatccatatgatccactccaacctcccaacctttctacacagcattattgctacttttgcctgtagtgttacctttacagcatcatccatttaacacatcacatcccccacaacagtagcgaagaagacacggctattaaaaaagaaactcctaactcaaatttatagtaatacatatatatgtcccaaaaatatatatataataacctcgatatagattagacttttcatattactatgaatttgaataaggctctgtctaaatttattgtactagaatgtctacgtataagagattttagttggatgaaacgtatactaatacaattaatctggatagggagcatattcatattcatattattagaatacgtcacatccacacaaatataatcttttatattttggggcggagggggtatatttgaagatggagggagtagcgaagaagacacggagtgtatatttctgtgtagattttgtctttaagtcaaatatatctacttttaactactagtttttaaaactcacgtagtaacaacatataaattataactacacatttttttagaaacaatttgtaaaaatacaaacgttcaatttaggacatagttagaacgatatataagtaattgaaacggatggagtaaaaatgacatctaggattacattaacctactagtacatatatatggtatacatacgtacatatccttgtgacttgtgagtgaaacactgagggaacagccaaaaaaaaaacagtttccaattgttgcaacaagtccatttcagaacttctagaaacaaattaagtgaagcttagcttgagcaagaagattggtgagacaatgttcgtgtcgagtggtcatttgtttacggcagtaatcacaatgtgtcttagtcttgccggccgctattgactgcttatgtgtgggatccataaccgaggctatagctatcaatataatgtaatttactactagtagtaacttagaaaacaatatgaattatttagtgtttagtggatacacacagaaaagcttgccacctttgtgtatgtctttcttgtttatccctacattctttgattatgacattagactatttgacatttatgcttctagcattcaaataacagtaaataataataaagcctatgcaaaatctgcacaataatataacccaaacgagtagtctgataaaaaagaacggacaatttacttgtttatttaatgtgttttccttggatagaggttccctatgtcaaggtggattgtttgctcttcggtttcgcaaccaaaagttaaattttaaattttaatcttagagtttactttgacttttttatctaggtttattttttagcattggtttttaagtccctcagaacatatgtataaaagattaatttactttcaaattaatttctatcgctaataaacattacgacttataattaattacagacgaaacgataaatcgatgacaatactttaatttttttcttcattagttgtgtcaatcataattcgaacccagacttctggttctgatgccatactttacaagttggtggctttgctaggcaaatgtagggagaatgtcagctggcctcagcacaaatcctactcccacaaattagccccagcttaattagccccacaagagctagcaatcaaccaacaaacatagggtagcatcatcttaattagcctcccatcattttcatcactaatttaattgcgattgttggggcaatgacatccacaacaagactgatgacccaatgaagtgatcgatcagctccaaactaaagagtcattaaattactaaacctcaatccttttccgctaagttggttaccatgatgaccctagtgtggttttgttggccattagcgcagtcactgggcccaccagccaccataatcccaaaactgttaaattcctatacacttagcctttcctctttccccatgatatcattttactacgacccaaagttaaatcccttaaaaggggaggggaaaaaaaccaaaactttagtcacaagtggagaaaatgtttgatcacttatctggatatatattagagggacaaaagtgtgaacaatatgatttgacagcattattaattaaggaccacaagatctcatcaagaattgctttccactccattatctaaagagttggccgtggctagctggagttggagttaggctaaggcaatataccaattccatcacatgcggctaatataattccctatggattgagaaccctactaccaagtactccctccatccctaaatatttgacgtcattgacttttttaaacatgtttaacagtttgtcttattaaaaaattaagtaattattatttttattattatttaatttattgttaaatataattttatgtatacatatagttttacatatgttataaaagtttttgaataagacgaacgataaaaacatatttaaaaacatatttaaatatttagggacggagggagcagtgctactatcaattctctgtggcaattctcggtgcacaccaactcgaccgatcgaccgattgatcgatcaccaagtggagtcccggaaaagcaggcaatgcaaaaaaaaaaaatttcatggatgttaacatggtactcgtcacctgactgacgtaacagttgtgtaatgaccgtacgtaggtagccgacaaggccaaggcactgccatttggcaaattgaattgccaggtttgatacgtacgcagcaccggctcatcgatcatcgatgatttcacgggtaggtagtcaaagttagtactagtacactgtgtaacccgtacagttgcaactgtacatgagactacgaggtttaaattctggtgttcacgattacatatggatacacgcttacatgaatttagtatgttagaggattaccgcgcctccagtggcggagccaggatttcaaagttgggtattcccgtctaagcgctgagccgctggccgcccctgcccctcgcagccgccggcaaccaacaggcctgaccgcctgagcttggcggagtgtcgggcgccggccaccgcccgccgcagcaatggcctccccctccgcggtagcacggttcagctcctgccgccggttgccgcctcaccatgccgctacctagggtttgcaaataggaagcggcgcgagggagccgagccagggagggatggatcacggagggagagcgagagggggctgtctagaagagttgtggctaagagcaggtacaataacaacttaataagctagctatacacatattttaatgggataaaagaggagagatagagtagcgggctacagatttgtagccagctgcagcacagacttcaagatgcatgt

SEQ ID NO: 61485 - DNA, 1271 bp, Oryza sativa
tatatatatatatatatatatatatatatatatatatatatatatatatatatacatatatatatatacacacacacacacactagaagtatacttgttttttgataaaaaaaaagttgggtattcctaggaataccagggaatcatgtagctccgcccctgcgcgcttccagctttttatcacgtggtaaaggaacacactcattgatcattttctttgtaatcgtaaaaaattagacatgttttatattggtttttgttgtgctgatagtagaatcaatctaagcttttttttctcctaatttaatactctctctgcttcattatgttataagttattttgaattttttctagtaaaaccttttaagtttaattaaatttattaaaaatattttcaacacaaaacaagcatattattaaaaaatatattcaatctacatttaatgatactatttgatgttgtagtattgctaattttttttaaacttggtcaaatctaaagaagtttaacccgaaaaaaaaatcaaaacaacttatagtttgaaacggaggaagtagatcgtacctctacggttcttaagaaagtatcttgagatatctaaattttaaactaaactttttggtaccttgaggtacttagttactagagataccaaatctattatattattaaaggaatagaaaaaggagcctccacgttcgctctcatagcctagaaattctcacattaatcggagaaaaagaaaaacagagtccatatagaaatacaatttagaaatagctaaattcggaattaaaaaataaggaatattaaaagaggagactagagtccatatagaaatacaatttagaaatagttgaaattcggaattaaaaaataaggaatattagaagaggagactagagtccatatagaaatacaattagaaaataactgaaattcagaattaaaaataaggaatattagaagtagagtataaaaataaggaatattagaagtagagtatagagttcatatagaaatacaattaggaaataatagaaatttagaattaaaaataaggaatattagaagaggagactagagtccatatagaaatacaatttagaaatagttgaaattcggaattaaaaataaggaatattagaagaggagattagagtccatatagaaatacaattaggaaataactgaaattcggaattaaaaataaggaatataagaagtagagtatagaatccatatagaaatacaattaggaaataatag

SEQ ID NO: 61486 - DNA, 1052 bp, Oryza sativa
tttcatttcctgcttgcaaagtgtatttatgtaaagtcaaaaacatttctgcagcatgttctacgtgaactaccatcttctccagtacctgcttcctgctgcacagccttattggaagcttttcgtaagtgctctgctttgttcatgttagcttaaatatcgtcattcacgatccttgataaactttataatgaattcaataaaatacaaacaaattcactaaactacctaatattagaagaagctgcaatattttttagttactaaaactaatcatagatacagccgatgtaagttctaagctttgactgctttgcttacctgtaggatacactcataccccttctggtgtctgttaccaagtactagattattttaaggagcaaacctatacagattcaaaatcagactataaccttttatggaagttgattaaagttatacacttatacatactacagttcaactggtagataatgactgtaacatacaatgctattttttgaaaaaaaatatttacagaaactaaaacagttagtgttaccatatactttagcttaggtttttgtaatttgtttattttcagttatttgcttccatatttcgttccttggcattcttttcatttccttcatacttttccaggtctggagagcaaggaatctcggataaattctatgcgtgcggcaatatctgagacatttcctgagcctaataggcggctgctacagaggtcagtgtacttctattttatgtggatatcttatctgccgagttggctttgcctgctggcatatcagcctgaatattgcattatcactaaagcctgataccttctgagatcagggtttttgtcaatgtttttgtattgattaaaattatgtgtttgatataggagtaacaaaacacattcagctctgtactaatagtgtaaaaattgctagtgatgttatgttatcatttagatagtttatcaacaactggccaaattcttaacaagcttgtaaaaccattttttggcagaattttgagaatgatgcacactgttgctt

SEQ ID NO: 61487 - DNA, 1791 bp, Oryza sativa
atgttttctattcggttctcagttacattaacttcactagtgactgatttgtgaatagtcagccaaagtaatccttgactctgctacttggtcagcttgaaaccaggacgaacgatgtccttaattgtagtttaaagctaactgtttagttgtatcttgcttaatggtgcagcattacttatatatattctattttgcagatatccgatgcgattgagaatgagaaggaggtttccaagacatttcaaatttacaatgttgacagggctgtctgtggtcgagtagcaggtgtcattgccaagaagtatggtgacacaggatttgcaggccagctcaacattacgtatgttaaccgttttctttttttttttaattcgatttctcttatgaaaaggtaggaacataatgattttttgcccttcaggtttactggaagcgcagggcagtcctttggatgtttcctaactcctggaatgaatattcggctagttggagaggccaacgattatgtgggaaaggtatctaatgcaaacaggcatgcagcgctattgaaaattgtgcctgaccagatttataataccttttctttttttaaaaaaaatgcagggtatggctggtggagagctggttgtagttcctgtagaaaaaacaggatttgttcctgaggatgctgctatagttggtaacacttgtctgtatggagctactggtggtcaggtatttgtgagaggcaaaacaggtgaaagatttgcagttagaaactcccttggtcaagcagtggttgagggcactggagatcattgctgcgagtacatgactggtggctgtgtagttgtacttggcaagtaagtaccacatgcaggattctcatattgagaatcgccttcttttgtcctgatatatggatatttctcaatcgacagagttgggaggaatgttgcagctggaatgacgggtggccttgcctatattctagatgaggatgatacactcgtcccaaaggtttcataaccttgaaacttctggttttactagcttgataacatgcacgtatatacgccagttaggacttgttctttttaatatcattttccatatttctgtctagttgcatgctcggcttaggacaacctcagactaacatgttttacatgattctacgtcgtcaggccttttatctaaaaaaacatgattctacgcaagtacagggaatgatgattagaaaggcctacatgttctgatataatattacaatcttatcatctctaataactttcgttgcctatttcatcactttgcatgagtaaattgttcatgtatgaaggtcattgtcaaggtaaagaattgacaattagttgtgtttccttaggttaacaaggagattgtgaagatgcagagagtgaatgctccagccgggcagatgcagctgaagggcttgattgaggcttacgttgtaagtgaagttcacttcggaaagtttagcaccgactactcgttcatttcccatttcgctaacactgaacgttgcttttacaggaaaaaacaggcagcgagaaaggtgccacgattttgagagaatgggaggcatatctgccactcttctggcaactggtaccaccaagtgaagaagactctcctgaagcttgtgccgagtttgaacgagtacttgccaagcaagcaacaacagtacaatcggcgaagtgatctactgcaattcccaagtgatcagattagacaacaggaaggtgttctttggtactttccaggtgattttttcctgggaccgcatca

SEQ ID NO: 61488 - DNA, 1577 bp, Oryza sativa
cacccaaaagaggctgccgcatgcaacaacaaaacaaaaacaaatggaagacgaacaggaaagggatatacattcattctcactagcagcttctacgaaagaaaacgagaggattctttaccaagaatatacaaacagaatgtcgcaaaaaaaaagaagtctcctcctaccttggactgttccaaggtgacgaagacttgtatgggaaaccatgattagctgatccatttcctaaatccaggctgtggagttgctccattaattgtgaccgccgttctttgaagaaatctagcctggtcgtcagttcgaccagagtggacgatgccacgggagcttgcctcccgtactcgacgccctgtgatagtgatacaagagaattgaatactcgtattgaatgagaagcggtgtggtctttatttcgacactaccgcacccttcagttcggaagcagtggtttttcctttacctcggttgccttcgggatgttcacggacatggaattgccatccgctggcatgctcgttgatgcctccctcgaatcactcgacgaggcgtccatggagtgcttccgggagaagggccttgaagaaccatgaggtagcacgtgctgcttgatgcttctccaatgcgatgcacctgcggggccctgctgtcacacagaacgttgttgtgccatcagtggacgaaatgggatttttttacattgcaagtagacaattactcatcggtgcctttgcttttctataaacctgcaggcccataagacgctgagaactagaggtgcaacgagagaaggctagtgggcgaacgtcccccttaagtggttgtttgacccacctgacctggatggctttgggggtataaattggtggttgggcccatagtcacaaagttcctgggtcaatgggatcgaggaacgggatcgaggaacgtgatacgctacttgcgagaggtttttacaaggtggggacgaaaatgaccccgtgttttcgggacagggacggcgttcccgggtcgaggatcgctgccaccgccgtttcctgtgactatggttgggccaaacaattgtgatgcatggatattaaattttggcataatctactaggagtttgtatcattcgagctatacctagcaattgaaacattggatgagcacagtcaaccatatggaaaggttggaaatatagcacaaaaaataattggggcattttacaccttaagcacaccataatgatagcgcaatgagaaaatgagctaacatcagctaattggttggttctgtattttccaacttctgttgtcgtaaatttaagcatagaagattaagggaaaatctttagctaacctcattcctttgcttcttctcctgattacagaaagcaaggttcatatcaaaacctgattgaacaaagttcctgttggcaacaaaatattcgcatagttaatgtattgcaatttcaaaggacaactagagtatatataacacattgaactgttaaacatatatggtttgagcagatatagtaagccagcagttgacagcagaaacatcatgtttttgttactaaaatgtgtag

SEQ ID NO: 61489 - DNA, 999 bp, Oryza sativa
tcttcaactctatccttttacatgaaacaatcatttaaacacgaaaatggaatggggacttactcttcttcacccgatgaatcagccaattctgactgttgactttttcttccctgcataaaccgaatgtgtaaatcacttgaaacaactttatacactgatagtgtcctaaggagtgcatatctcctaatgttttcccagaggaaaccataatgttctttaaagaatatcacagaaccataagtcagtggtcacaattctacttcccttcaagtaacatgaactttctgaggagatacagtaaaggacaaaagttctcacttacattgttccgtccccaaaagttggagcgcttcacatgcatctgagttccattggatttgatggactgcctgtctacagaatattcaggtccaggaccaggtaaggaaattccagcatccaaagaagaaagaatatctcccatcgacaacggggaatcctgactggacaccatatttggtggatctttttcattcggtgatctctggacattcactgaaacattttcagctaaatgactatgctgggcatcatttacatccacctttgtttccaaagccttatcttctgtagaaggttcaccgtctgaatcatcatcagctacctgtcgttcatgttgcaatgagaacaaaagcataagccacatcatgatttttgacagatgaacttgctaatcaaataaaaattaaaagccaagttggtttctgattaagctactcagaatgcttcatatcatgaaccaccaaaaatatgtaaggataggcgcgataagattatgctactatatagtgaaaagaactactgcatgtgcaaagggaagaaaaaaaacttctcatcagtggaattggaatcttaaacctttttccgtgtatatatgattgacttgaaaatattcgaactgtatatatgattgtattagatcaaacttactaccgattaaaaattttaagactgcaa

SEQ ID NO: 61490 - DNA, 7818 bp, Oryza sativa
agttcaagcagctctaccaccaagatcacttccactgaagctgccatccattttcatacatacaattgacagcacacaagtagagtgcccaactgcattttgcatggtgtgacagcctgatctttctttggacagtttaaagttcatctacacctggaggcagaggtttcttgagcttcaacacattttcagctatctagcctgtcttcttgaaatgctttgtatataaaatctttaaaacgtctagagtactgccttgggtccaccgctgatattgaggttgggtcatactggaaagatttgtatgcatgctcgagctttttgctgatatcataatcttgaagtatgtctattatcccaaaatataatatagcatcataatactccccagttggctctccaataagctgtggttccaaatcattcttccgagcagtcagttcagctcttgcaggcatgtttgctccgagcttgattttaggccacctgttcattcataatattcagatgtaagtcacaggaaatagtgaaaagcaaactggaagtgtattttcatgggaaataattattaattctatgagtatctgtagccctatcttggttatgtggttatttaccaccttctgtccaactagttgatagtacatataaccacatcgcaaacagctagcaggcaaattatggaaaggaaggaactgctaaggtcctatgcaaaacaatgccctagagtagccatgaaccaagtggacacattccagattttgaatttttttttattagatagtgattccagattttgaataggtcatatgagaatgattacatggttttatatttaatagataatgtctttattaggtcaattgcttcttcagaaagaagcatgaatatcacgcaatatgtgatgatttgctggtgtgattgtgaagctagcccgtcacgacataaggtcaagacaagcaaacatcacataagtatgaattttccatatataatattaggtcacatttcattaccacatttgtaaacgatacaacagatattaaatgtttggcttacctgtttggatcagtgagacactgatccacatttcctcttgaaagacgaggagtagatattttgttgatatcgtaatcggtggaaccttcaaccaaacaaaaggccttgtaagggataaaatgagcatgcccaagaactcaagttttattcatgacaaactttgcctgtttttaagtttttttttttttaaccaaccttcgctcagaagcttctctctattgcctctaaaatgtacacccaccagaagactgtaatccatgatcttctcctgctcaaggaaatcgcaatccctgtccacttgcctgcttcaacacatttaattctatattaatgttttgaaggaaaaaaaatgattacatgcccaaaactagagtatgagacaatatgtttttgcacctttggaactcatggaaccattgcttcttcagtctaaatatgaaattcagatcaagatccttcagagttgtatactgatcaatctcagtttgtggcttgtcagttgttcggccaagagacgagccttttagatcaaaacgcctatggatggaatgatcagagcagaacagatttcccatgatgacaaagcgaacctgggcggtaatataatggtaaagagtcagggaacacatccgacaatgtatacgacaaagaaagcgctaaggatggatatgaaatactgaaatatacagtgagattcgtctctaacctttttctggtttgccccagctaatttaacacaatgtagaccaaaaaatttggtaactagagtgttctcgaatgaacggacatgattatagtaagcaggaagcatcttaagcagcatctgtaatgtaaacaaattttttttccttaattcagaataagcttaggaagattggaaaatggaaagcctagatagtcagcggatcacaaggacaaacctttacttccgatttcttcattgtctttatcatgtatcgatcatcatttgtaaggtaaaagaagcttccacttttaccaggagaagagagctcacgcagagcctcacttccacaaagggataacatataatcagcagcatccaccttgaacaacttgcgcagcgtcctttgattcagttcagaacaaatgttgatcagcattatgacaccagaacaagggtaaagcatacaattttaacatgggagtgatgaccaaccggaacacctgagggcagtaatccttccatttgaaatcacaagaattgtgcggaggggtgtattttgagccttctggagggaactttgtccatactttttcctttgggtcaaaagccgaggatttcagatcaagcgtaactggaccttgcttcccgactgcatgcctgtgccaacaagccatcgatacacacatggatttaatcatgggaaaaagttgataaaaatatgatctataggctagcgtggagttcaatcgatttcgagccataaaggaaaatgccatcttaatgctggaaaatataacatacactgcaaatcataatctgattaacaacccaagaatatcacaaagcaaaaattttatcgaattacttataaatattccccaattaaaagcaatcgcaaaacaaaatttcacatcattcataacatacaggggcaaaaaggaggagctcacgcacctgatcccgagctgcaagttgagcatgagctcgtaattcttgtgacccttggcgatggtctcgccctgccgcttcgcctcccgcggtggcacccacttggcgatgcgcggcgccggcgacggcggcgcgaggaccagcccatcaccggcggcggccgccttgatgctcctcctggggcccaccgcctcgtcggccaacgcggcgccgtcgacaatgtcgcaggtgatgtccccgtcggactcccaaatgcaaatcttgtcgacttcctgtcgccgccggagctgttgctcagccccgacgcggagctcgaccgcgcattgcccgccgccgccgcggcgccgcctctgttgccggagtgattcagcgacctgtgcggcagagacgcggccggctcggcggctccgcccatgaagcccgggaggtccctcgcgaacacgtcgcgggggtcgcgcgccgtcggggaggacgccgccggggacgggtagtagacgcccttctgctggacaatgccggtggcggcgtcgcgcgtccagtagccgacgtagacgctgccgtcggcccatcggaaggtgccctgcccgcgggggcacccgtcctcccacccgccatcgtagcggttgccgttcgaccagacgagcgcgccgcggccatggatgaggcggccgcgccactgccccgtgtactcggtgccattgcgccagatgtagcggccggcgccgtcctggagcccggagcgccactcgccgtcgtagtggtcgccgttggcgtagctcttcttgccgtggccgtgcttgaggttcatggaccacgagccccggtacgtgtccccggcggcgccggtgtacgtcccggcgccgtccatgaacccgtccctgaactccccctcgtacgtggcgcccgacggccacgagaacctgcccctccccgtcgccttcccgtgccgccactcgccctcgtacatgcacccgtccgtccacagatacttcccggcgccgtgcggcgcgccgccgcgccactggcccgtgtagaagtcaccgttggggaggccgcgctcgacgtacccgccgtcgtcgccgccgccggccgtggacgccgacgacgaggacgccgtctcggggtcgtcggcggccagcatcggggacacgcggcgcctgctgcccccaggctgcggctgcggctgctgctgctgcaccaccttgcgcaccgtcgcctcccacgccctggcgcggatgtgctcgtgcatttgccgcgcccgcctgtcccggccacacccgtttcttgatatatccccacacctccggcgccgccgccgccggcgcccgagctccctgtggcgtggatctagcaccgccggaggccgcggtggctccacggcggcattgctggggggagagcgagctcgcgagatggggagtaatggcgagaggaagggatgcacgcaacgcaagcgaggaggaatggaagggggagaaggaaaaagggaaggaaagcaaagtgttttggggtggagaggttggggaagagagggagggaggatggaatgaaagcaagagggagggaggtggaaggggtgttttacctttaatttgtttttttttcttctttatcttttgatattttaacatgaattcatgaatgagttgatttttttaaggttatttatggatataaaatataaattatatatattaaagagtttaaaaaatattttagaaaaatattcgaacaatttttaatataaatttaggaagcgtgcaaacgaaaattaatccaaaatcgagaataaaagatagagaacatttgtgtcatactccagcattcctaggagaatatgatatttttggtttttttccttttattctttaggccggtcttttgtaaaacttttaaaggactccaatatttgtgaactattgaataaaccgataaaaaccaatagtacaatacagattactcctttccgaaaaaaaaaggggctggagatcggtagttgtgttggtggtttttagttgttggtggcagtgtttgtctaccaattaaagtgtcaaaaggctacagatttcggttctgctgttgtctccatgcttaattagcagtggtaagtacttaccaactaaacaatcgatcctcggcttaatttagggctctgtctgtttgtgagatggtgggctcctattctttctccgagcttgcacaacaccagatgtgagatatttaactatttacagcaccgctcttataaatgataattaaaaatttaccgttttatttatatgtcacagacacataaaaatcaagatgtctcatattacgagtggtaaatttttaattgtcacatcttaaaagtgataaatagttaaacgactcatttgtcatgtacatgcttatttaattattaaatgtatgattttcttaaaaaaatacttcaaaattgtattataataatttattttctagtttttaagctaaaatttaattaatcataccacctcgttttcgggaaaaaagtttccaacacttactatcaaacacacccaaaacagaagagtgaagagaagctatcagttcaaaactacaccatctcttctccaatttagcctctcgtggtctgagtgttgtcttaggcctggtttagttaccaactttttcttcaaacttttaactttttcatcgcatcaaaactctttctgagtgttgtcttagacctggtttagttcccaactttttcttcaaacttctaactttttcatcgcatcaaaactttcctacacacaaaattccaacttttccatcacatcgttccaatttcaatcaactttcaattgtaacgtgaactaaacacacccttactatcaatttagcctctcgtggtccgaatgttgtcttactatccataattaaaatttaaaattataattaagatttttagttgattttgctttgtttttatcatgatttatttttgagcattagctttttaacccgctaagatcacagtatttaaattttttacttactgcaatattgttattacttaggacacctgtgatgtagaaaaaaatatgggacacattgaaggttccaatcctatataggaacactaagaagcgcctttaaacaaatgatgaaatactatccttgaaaatcctatgaaatgcataatagagattttaaagacaagttagcaagagctctaactttttggaaattttctttggagtccatctcatcttaatcttacgtttttttgcggtctactcaaatgaccgttcatgtattttcatgtgttttgcaattctctattttgcatttatattttagttaaaattatgtgtttttcatatttctttttttttcaattcggtgtttctctattttgtttctttttcccacggtttatcggctgtagaccaaacatcaaagcattaattactaaccaatcggcctagccttcttaagctcttcctacctgtgtagcctccatttggtttgtgtttggtgtcttgtccctgttcctctgatacctgcaggaccatggattcagctgcaaatattcagtaacccttgtcatgatatatagcctggtcctaatcttttgacttgtaggtctacccagctgtttggttaaaaggctgctactaatgaccggcttctgatgttgctttatttagctaatccagcactaatgaagctgatcaatctcatagggagaagaaaagaaaggcgatacactaataaagcaggggtatttattagtcaggattcagagacaggaatcccaatcttccatgaaagcgaatcaatcgccttgttagttgttcttctgtcatgtaaggcatgtacctcctgtcctccagctttatcatttattttaaaaaatggagattagtatttttctttgagcttcttctgacttttggccagcacacctcatccaagatttgattttggagtataattttacaccaaacgtacagtgtgtactggtttttgttagaagagaagaagaagaaaaaagaggacccaacaaaacccagaaaatatggcacgttgtcacatttgacatcctcgttcgctttcccaagaaagttgcaataagattaccaaacaagtttgatttctttggtacaagtatcagtggtagcgtctctcttgactttatatctgtgttcatcagcagacaccatttctcatgcgtttttgctgattgctgacttgctgaaacggtgataccgaactctcaaaactgcaaattaattgttgcagctgatgaaagatgcttctctgatgatgcaatttcaactcaatttaccagcaactagctgctgcttggccctgggtctctatctctccaagacatcaacacaatgcatgccaaacttgtgcattggaggatcctcaggtctcctagtaattatcagtaccacagagccagcagtactgttgaaattaatttccatcagagatcacataaactaatggtgagatcgcattagtcgtgcgtccaaataagtggtcagatcttgatccatttcttaattaaagtctcgtccttgcctgcaggtaggtagcctaagcctggtctcagttctgagcaaaaaataaggtaggttgccagtggaaaaatatgcttgactggttctcttctccctgataattgataaactgaaccaccagttcttcccattcatccaacgaacaaaccgacagatagatatggctagcaattaacagaaaccaaggtccaagtgtgaggtcaacaatattgtccttgcattggctcacacacaaactgtaaagttgttattgttctgcttgtctttagaagggcagaagtgcagacactgtagctgtaatgcaatgttactcagaccaaacagggatcagttaagtgtacagccaaacacaaggtgaaaagcatatactatctccatcgtagtccgactatatgtatggacaaagccaaaacgaagtctatgtgggatggagagagcgagagagactaaaaaatgttcggtaacataaattatttaagcaattgactagagcatttttatactacatttcatcggttttgctgttcatttcagatatatattgatccaacaggttggagtaga

SEQ ID NO: 61491 - DNA, 1123 bp, Oryza sativa
ttgataattaatttttgaaatgtgtgtagtttaataacatatgaattatatattatgaaaatatttttatgatgaataaaaatataagtcttatcatgttaaactatatgagtttatagagattgatggtcaaatattaaaatatttgacctaaaggcctgtttggtaaagctctgacttctaaatttatttttaggagatgggtttaaagtggtgctgtggatcagtctaaacctaactccatcttctatttcattttgtgagaacgcttcactcaactctagtcctatttaagatgaagctggaactttttgattagacgctttagaataggtgaagttgaaactggacttacgctaaacatacctttatattctaacgtcccaatcgtccaatcgatcgtatctcaaaaaagcacgaaaaaaaacataaaaaagagcagaggcaaccgataaaaaaaaaggatgcgagataggtttgcgctgtactccctccatttcaaaatatttgacaccgttgactttttagtgcatgtttgaccattcgtcttattaaaaaatttaagcaattatttattcttttcatatcatttgattcattgttaaatatactttcatgtacacatatagtttacatatttcacaaaaaaaaatttaataagacgaatggtcaaatatgtgctaaaaagtctaacgatgtcaaacattttgaaacggagggagtatcttccaaatctggctcttttccaaggacgcaacacgtacgtacgagcccacgctcaccgcgccgcgcgcgccgcgacggcgaccgcggcgaggccaccactcgcacacgcgcgcgccgcggcgagcgctgacccccgccgtcgacgacccgaccgcgagtggagaacaccggcgagaaatcgccgtcaagctagctactttggctgggaaaggtgcaggtgcacgtgatttgctggtaatccgagacaaaaacccgcaccaattggacagctagcgaacgcagcgtgggtgtgtacttgtgaccgtgataatttcgcgttggatcgcgttcgtttagtagtcatcagtctcgtctcagtaccagccaatgcaaagtcaaatccccagctggaatgccc

SEQ ID NO: 61492 - DNA, 868 bp, Oryza sativa
cttgaaaatcattgacaggaagaaaaatatattcaagctttcacagggagaatatgttgcagtagaaaatctcgagaatgtgtacggggttctccaagagatagattcggtaactactatactaactactcactttttcaggggatcgtctcaaattttatgtttctatctgatatgagcctttttttccctattatatttcccatatgttttttatgtttgttgaaacaattgatgaatgtatacagcacctgatctgaaaaattagatgaagttaaagtgtccctgagtgggaaaaaaggtctttatagcataatctgctgatatcacaatatggttttaaaagcaccagtttaattttttttagccctttagcgttttgattaaaatgcatatcaaacagtaaattcttatgagcatctaactgaaccatgtcatggcacctggcttacatgctcaatagcactaaaactacacaaaaatggaaataatggcttcgcctcaaaattgtttactgtttggtagtgtctcatgctcatttggttctaaccattttagaggctatatagtgcatgtttgtttggaaatgtgatgcacctgactacccaatgcatgaataattgaatcttttttttgggcaacgttttgtttgtagatgtcttgtttttcattgtatcttctaatctatttcagatatggatttacggaaatagttttgaatctttccttgttgctgtcataaatcccaaccaacaagttcttgagcattgggctgaacaaaatggtatctctggaagtttatctgaattatgtgaaaattcaagagctaaagaatatattctttcagaactcacgaagattgcaaagg

SEQ ID NO: 61493 - DNA, 11375 bp, Oryza sativa
tgcatccattgaaagcttaaatagaaacaaggagtatccataaatcataccccacgccaaaatccaatttttgatccgtgtgaaatgaataattcttcaaagattctatcaaagatatgagccagtggaagatacgatatataaacatcatcatgatcaaactgcaaaagagcaatggagggcaaataaaatgagttgcatgattcattcaagatagtacatagcaatggttattacagaatacaaatatattctacactcacaggttcgccaatagacctggtcacgcaatcagcaccagtgatgttaacaagaaggctttcatttgatatcataacacctttagggtctccagttgtcccgcttgtgtacattattgtgcagatgtcagatttcttcttttcaggaagatcaaaatgatgatcacctccctataagcataaaagtcagacaagttcatttgtaaatttgtaatggttcggtagcatgtcatataactggtaaataacacattattagtcagacaagtttaattcttcaatataatcttgaattataccaatataaaggactaagtaagttgaaacaatttataaattaccatgatcaggaattcctcccatgagaatatggacatcccatgatttttagcctcctctttttggtcatttgtcacacctccaaagctgatgattgctaaataaagataagaaaataaaagttaattcatatactccagtgattgggaatcgactaattgatataattatgggtataaaatgaacttactcttcaaatactttgatgtggcatgacaagttttcaagagctgccatcattaaaaccattaacaagaattaggatactttcaagtttaaagcaaccatagtaagcactgccacatacagatttctccctaatcaaattacccaaaacacccatctgcatctcacgctatttggtcaattggactcaactatttcctcattcgagacacaatcgagagctcgagagctctcagtagttcagcactacataaatttctaacgaatactgcatcagcttagcatgtggtctcttaatgattacaaacactctctgcatatgcgtctactcagtaatctcaaataacagatacatgagaataatattctgtatcacagtttttttttcaataatggaataaaatcctgtatttgcttcaacgaattacatgattcgctcaacagggagcacgtacaatccaggaactaaacgatgcaaagactaatactccaacactaaaggagtaacgagaataatattctgtatcacagatacaaactaatattctgtatcacagatacacactaagcgaatcggaattcgcccaaaaaaggtagagcagagcagattaaccagaggaactagccatcccaaattcccaatcatttgctataaattcgatgagtacggatcatctcgactcgcgcaaaaaaaaaaagagcaaaaccaaaacctgcagaattcatcgcgctgcgcggatttgccgatcgggaggacgcgcgctgccgaacgcggggcaacgcggcggccaggaccaccaccatagcccatccccatccccccccacccctctcgcggggcaaaccgctacgagcgccgccacctgcggagagcgcgccggcctatcgccggagcacggcgaggcatagctccggcgtgcgcggatgcgcggggcaactgcggcgtggccgtgctaggccggagtcgccggaaatgccaccggcgcttcgccgtccgtcggcccggcgaaacggcctatgctcgagatcttattgggccgggccgagacaagactaaataaagcgggccaaatgtagatcgactatatgggccaaattgggattatatgggccgtagatgaagaaaggccagcccaaattacattttctcccccttccaaatcagcctatctcttctctatctctactattataaaaattgaagatgtttttgccgatattttggtacgtcatccgtgtataagtcgttttttaagtttgtttgcttttggaaatacatttccacatttgagttagtttttaagatcgttcacttttggtaatacataaggaattacataagaaatctatttaaaaaaacttgagacgatcagactcctaactgcagctcatgattttctaataatatactctctccggttccatattaattgacgttttggacaaaattgaggtcaaacttttataactttgaccatcaataactttaaaaatattcagtctaaagaaactagaacaacatatacatattttgtcttttaaagtactataataaaagtaaacatgcatttattttattatatatattataatagaaaagtaagatcaaagatgtatcttgtagaccgtgtcattgtccaaaacgtcaattaaaatagaaccggaggagtatatatccaagcgaactcacacagtgaatttcatcttaactaaactatatagcaataataatattaaaatagactttacccgttgcaactcacatgcattttttctagttaaaaaaaactggaaaagctgtcgaattacctctgcgatttttctctcttccacaaaagcaatctggatttcagcatggcacacgataaactccactgcaccagcacctagaacagaaacacaaaaaaaatatattaaaaaatagaagaaaaggaagagctaatcttaattcttgagctctttttactacccttgaggtagatgtactttgaagtgttaatttatggttatcggtatcttgaactcttcaagaatggttaaaagaattctcatcaattatagaattgcacatgcgtttatgtgcttaccaagactatcatagagaggcacgcatgaaaccccaagtgcattgcaagcctgaaaatggtcagatcagagtaacagattaaggttaatggttaaaactgttcatgcaacttaatggttaaaactggtcatgtgcatgagtgatgagtaatttatggttgaagtaaacctccatgctgatgatccattcagggcagtttgcgccgtagatgccacagctttcaccctgaaatttggtaatttattcagtttgataacatttgaattgtaaaatctaaaatgattgaactagtcaactgttcccatccaataacatagtactactcatcagcaaatgagaggattcttcagtcaattacttttcaaacaaactgaatgttttctgaattgtggaatatgatatccaaagagattgaactgaaagatgccaggttatactagtacatgacaatggagctatccaaattctagaacatgatcaattcaactctcctggaggtaatgaattgttcagacttcagactttttaaccttggaagattcaaacagtggacttttgctcacaacctgccaaagttatggttgtgagtgcctctgtcatcatcctgatgacaacaagagtggaactcttcatctctggtggtaaatcttgtttcagcaatgtcaagttactgtgttttaagattaaattaattaagttatgcttataacgaatcaaaataaataagcctttcctgatgcttaatggttaatttactaccaagtcaactcacatatctgaaataatccaatcttgtttgattgatgcacaacctgcgcagtttattttaaaaactatcaagattttgtaagatccaaaattcatggtaagcatgcatatgcatccacaatctcatgaattgctcacattatattaaatttggcagctggctcaggtttgcagctaaccaactgctggtgatcaagacgtgcacaaatggccattgatgatgatctaaatatatatatccaatgaacctgagccataaactattgccaattattcatttactactatgtatctttggaatcaagatctgcttaacaaatatttccattcagttaaatgttactgaatgcattacgttttttttttataaaaaaaacaaagttactgccggcaaaagttttaaggaggtaatcttcatctgggaagttgattaccttgctgattcctgacttgctaatggaggcagcaagtttcatcacaacgtcataaacctccttgtaagtcatccaaacatattcacctgcctgcaaatgaactatacagattagagaactaattaaaccgaaaaaaaaaataagttttactccacatgtgtatccgaaataataaagtggtgcttggaatgatcaaagtagcaatacattttgtagaagtagaaggcagaagagagaattatagctacaagctagagcagaaaccaatgtgaaataatgaaagattattcttgttcaaacgaagggaaaagaaatattgaattaatcaccttgccgtcgtcgacgactctccggcgaccgagcatcgggctgtccgggtacttctccaccgaattgctgcaaaattatccgaagacgattcaagaaaccgatcgaatcaggctatgaatgacaaaaacaaatggagctgcatgtctccggccatccgccggcgatcgccggagctgagaaatgaagaccgcgcgatcacctaccggaagacgtcccagcagctctcgacccccggcggcggccgcagaagcccggcgtccttggccagcacgttccggtacgtcggcccggcattctccgccgccttctccgactccaccaagtgcttcatcatctccggcgacggcggcgacgacacgacgacgagagaggaagaaagagagaggagctttcaagattgatgccttgcaagctgggagagattggtaaagatatatagggaaaatgtctttggttgactgagaccatgcaagcacatgaccaaaagatttttcttttcaacttctcattccacccatggatttcttttttttcaggagggtggattttgaagtccaaattaactttgcaaattcttttcaaaaccaagcaaaattagctttgtaactttggaataacaacagtcaggtttatgcatatgttgggtagagaatcatattccaattctctatatgtctgaacatggttttatactagtaattattaccagtatgctgtaagaatggaagagagatcgattactccctcccttttctttatgtttgatgacatttaaacatgttttaccattcgtcttaatcaaaatacgtatgcaaatgtgtaaaaatataagtcatatagataatatttttataagatgaatagtcaaacttatatctaaaattcaacggtatcaaatatttttaaaaaataagtacttgtcaaaattttcttgggcagtgccaaattaaggtacaccttacaaaagtaaacattgagtattggacatatatccaacaaacaaagttaatccgtagagttctctatcggagcaagtaccaatcttaatcagagcaatcacctgctcaattaattattatcaacaggtgagcacaaagtactactactgctgcttatcactatagttccccagtaatctgggaaaaataacgttcattaaataataattttgactaactgttcctaacgacaaattttatccatggaacaggtcagacagaagcagaaaattgacctgtacaacattggctgctgtatatcttgatgaatttgggccgaaggaagttcagaattacgcaaccataatgctggaagaccatttctgtacgtaaactgtacggactacggaaccatatatttaggacctgttcactttgataaaaaaaaaccttactaaatttttggcattaccaaaattttggcatagttgcctgatatgatttcttatatagttaccaaaatttggcagcaaactaaatgtagccacttttttttttaactttaccaaaatttagtaaggttgaaaatggcatcaaagtgaacagacccttatttcataatgaagtttgatttctgcggtttcttgcaactttgcaagaaaaaaatagtttgaagaaaaatgattagaaaaggacgcaacttgatgaggtctaagtaatcatttgggccaggtttaatcggcacgtgaggcccagatagcatctgggcttaatgggccgaacttgttaggcccagtgaaggtttgtgcaagtgtaatgtcaatttccaggtgacgcgtgtattgggttaggacaaaccaagctcaaaactgcatcattaatgcttgagaattcacgaaagcaaagctgcactagccaaagccgaaagagactgatgaactgaagattgagaatgtattgcttataatattcttaagatgaaacacaaacaatggtgaaacttaagaacaatgtaaagcttgaaggttgcaatggttttcaaattgtaactcctccatgtgttgatgctttgttcattcttcaacgaaccctgcaaaagaatttgaaaacaaaatcagctcatatgaagaaaaaagaattctaaaatgtttttattttttgaagcgtaatggggagttcttgtaatttacctgaagcagttgaagtttgggctggtcgggatgaagccgactcggacgttgcaggcggcggggaggccggcggcgcggccggagtcgaccctgccgtcgccagcggcgagcatctccgacaggatgcacgcgcacacggcccggcgctccgcggcggtggcggcgaggtccctgatgtcgccgagggcacggcagcagcggcgcgacaccgcgggctcccctccggcgacgtacgccgtgcactcgccgaacgccgtctccgcgaggccgcacaggtccgacgtccccgccgccgcgagcccggcgccgccggcgacgacgaggagcgccacggcgaccgccgccgccgtcgacgtcatggaaatggacattgttgggtgagagcagtgcacgctggtcgagacgaatttggatcaaatgcgacttatttatagggagaaatgggaaattgaagatggaatcatctgcgttgatacgcaacgcgtgcatggatgttatcatgttagcatcaatcatctgacaggtcagggttatttacccgaaagttttttgatattttgtccagggatttcaattgtttgcattgcatggtgcatgcatgctactgcatttttggaaaaaaaaatgcaagtaaagatcttgtggtcaatggaaagcaatgattttgaggcaatcctgtagggatttgcagcagacagggatatgctactgcactgctcctctggtgacagatgacactagatagtagacaggcttcttcatgggctgtagctgtgaaatcagaatcatgacatcgacgcgaagttattcgaatagtttcctttttgaattattcaaatttgagcgatcaaaattcgttggagcccccttggtaaacgtaccggcgaacgaatgatttgcatctcagttactctccgacgttatcttccgcttcggttcgatgtcagcgaccaccgacggccatgtgaacgaaactcaattggcataaatatttgatgccttgagaaatacaaggattacgtacaactcgcaagccgttgcagaaacaatggttacacacttcctcaccaacaatagatggaagtttcaaatagtgttttctctgtttttaggtggtgttctaagtagttttcatgtgttttgtcaaagttgtgattttgtaagttgaagaccagcaattggatttaatttcttgaagcaaagtccggaatggattctattatctaaaagtatcagcacaaagacaaagggggaaccggggtgctcagatcagttctcaagaggaaaacgtgatgaactgatgatcatggtgaacaatatcaagtgcatattctgatggttcaaggttactgatctactgcagtttcagattggaaccatcctgggagcatggctgcatcaggctaaaatgcagagggtactgcagctgcactttcagggaatgttgaaaaccgaaatgcaagctgaacaatcaagaacagcaagcgaaactttttcggcgtccccttgatggattagaatctgacttcagaacagcaaatgatttttccacataccttgttgaatcgacaagcttgcaacttgcaatttttctgtgtcgacctagcaacagcaacaaggtatgtggtgctactggaattctggaaaacatagaagatgaaacagtagctgaccaagatacagattacagacaacttcagcatggaggaactcttgggataaattataatttataagtgctcacaggtttgcactgaatttacagaacaagcaattcctcatcacagagctcaagcaattcatcaattcatcaaacgacataagaaaatttgagattaccatggtaagattcatgagcattagtgctctgaaactctgaaacattcagaaattcagaatcatggcctgcataacaacttcaatttattcataattcaagaagaaaggggagcacagattgcgatagataaaactacaccatatcttctacatgtcttgacagatcacgccatgccggtgtgaagggagcttccatcgtcgcggcgtgagctggtcagaagtcggagcagcggccgccgcgctcccagtcgccgtaccgcgtcggctcgggcccgcgcgggccgccgatctcgccggtgtccttgttcacgtactcaccgccgccgccgccgccgtcttccccttccttcctcgcgtcaccagcgtcgcctcccttcttcttctcctcctcctcctctcccgccgccgctcccttcccggccccgcccgcagcagcctcccccttcttcgccgccgccgccgcctgatccggggatgcggaggtggacaagaacgcgaggcgggagaggaagggggcagggtgggcccggcggtgggaaagcgcgggcgcgaaggcgcggcggaggtggctcgtcgccgccatggcctggctcctcgccgaggtcgccggtgctttcgctgctcgcttctcttctccggccctcgcgccgccgcgtgtgcgagctcaagccgccgcctccgcctcagcgtggaggactggaggtcacctacccgtaactgggccgggccgatcggatggcccaccgccacagcccaaatcggcccaataatccaccactccatagcccaactcgggcctattaatccaccactatccggcccatgacgtgacgggccggcccaatatttgtgtataattatgcgggccgaggcaaaaccgtggcggcgagagggatattcttgtcagtacaacgcaggggtgggggcggacctacatttgtagatggggctgctcaagaacctggttcagagatactatatttttttaagctatattttatctatttttatcatatatatatatatatgtattttgttagtataaatttagacacccgtatcaaattaaactcgatttaaagaagagtaaaacaagtgagggaaaccacattctactttgttttagctccgtcccccgtacaatgtatacatagttagctattccctccatcccaaaatgcccacttttgctaggtctacatttaaacttagagcctaatcttgtggtttatgcttatgtttataagccaaaatttgaattttcaactttaaatttggagttgattttggggtttttccatcgtcatttatttttcagccttttgcttttagattgttaagaacacgtatataaaagttttatttataaattattttctgcttacaaatattccgtttctcttgttctatcgataagcgaaacgatggagtccttagaattgaccttttttggaatgtacggtgtagggtctagcatggatcgtagtagatacaatatttctttctcggtgttgtttttctcgtgcttcggcaacagcactcgatcacatcgatcgatcgatctcaaaaggataacaaaagcaatgagatcgatcgatgatctgattctgccataatggcctagcagctagggctaatggcgccggttcttcgttttgtctctagctagactaaatcatcataatcagtagtgttttggtgttcatattgtgttagatatgtatggcgatgacctcatgacgatcgacctgcgtacaatcgaacgattgatggaccttcaattcagccgtttgtctgattctgatgcccctagctacctagctagttactaattaaagtgatgattacatattgatctaaaaattactactccctctattctatatctattctatattataagtttgtttcgacttttttctagttaaatattaataagtttgactaatttgatcgaaaaaattagcaacatccatcacatcaaattaattttattagatataacattgaatatatttttataatatttttgttttgtgtgaaaaatgctactacatttttctataaatttgatcaaaattttaaaaaatttaactagaaaaaaaaatcaaaacgtagtttcgtatttatgacataattaatagatcaacctcagccatgcttaattaactaaataaggttgaggccatctattaattagttgcagtggtcacacattgcgatcagttaccactacacatttgcattgattatcaggtacaaagtactacctccgtttcatattacaaatccgtttcatattataaagaaaaatttagcaacacctaaactgtcaaactagttttattaagtatatcattgaatatattttaataatatatttattttgtgttaaaattattattatatttttctataaacttggtcaaacttaaaaatatttaactaagaaaaaagtcaaacgacttataatatgaaaagaagaatgacttttttaagtcaaactttgtcaagtttgacaacatctaaaatataaaattatttttattaatctaatattgaatatagtttgataatatgtttgttttatgttgaaaatattactatatttttttataaatttagttaaacttaaagaagtttgagcagtaattgctcaaagatgccaattgtagctatactacctccattgtcaaaaagatgaggcgtagaacacgtgtagtcaaataaaaaaaatctgaaaatattaagtaattaatatataaatgcaaaagtatcaggatttatttaaaatgtgaaaattatgagtagacactttcttatgaaaaactctttcttgcatatagactatagatctatagtattttaaatatttttgtaaaatatattgttttgaaatataatgataaaacatgtgtgtattgacgactactatcgatgtatacaatgtcagaataaaaaataacagagacaattatatccctgcaacagcattggctgaatgc

SEQ ID NO: 61494 - DNA, 1624 bp, Oryza sativa
tatatattgcaaatatacacaaggttctactccctctttttcataatatggtatggtcaaacttggcatgtacggtctacaaaactaattttttatttataatttctaatatactataaagtttgtagtaacaaaattataaccatatgaaagtatattgaaatatcaatccaataatattatttctatcaaataaaattcaatttatattatacaaatcgttagtcaaatgttttgaaagttgaatcttgaaatgagtgtgcaacctacattatagaatggagagagagtattgctttaggaatttgccatggaattgaaaaggacattttaatgattttgtgctttgttccccatggaattcccatcgaatcatcccgtcactatcttgagtgagctagccctcccgatccgatcccttcagtgttgtgttggcgaattagagtgtggtgccatcgatggggacatggtatgttgcagaatccaagcccaagccgacatatcatggcagctggctgatcgaggcgtgtgatcgtggactcacagcggcaagtgatggcgtggattgctcgcggtgtggctaactgtggtgctggtggcacgactacctgcagggtgcgtggactcatggcggttgtcggtgcctcgttgtggtggtgaacttgttaaaaattatttggaggagcgtatccttctccaaatcacttttttttttgtggtggtgaaggatgatggggaattaatgcggcaaactgggggctcgcgagtgagggaaaatgctcaacaactcactgccccctgcccccccccccccaaacaatagtatggaaagacaatttacctctgttagttttatactgcaatgtatttaagtgggaaatcaaatcaatctaaaccatttgatcgtttaatactgaccaaatgacgctgcagtagtaccaggaatatcagtgaccaacctgtggacaaacaaattaagatgatcaacccatcatgcagtcaagatgtggttatgtatgtaaatcagctagcagtgattattttgatcattgcatgaaaacaagtgcgctagcttaacattagtgtgcttaccaatgtagatactccctaaggttagggtcacttgggcttggtgcatctgggtctaccatcaccttcaggtacacaccacaaaaaaccatgacaaacatcaaattaatgcattttaaagtcatcttgggttaagtaccaaacaaatttttctataatataataatgaaagaaagtataacttctggtctctgcaccaactacgacacatggtagagctcacatacaagggtgtagaatgtcctcatgtcattgccgccgacctcgaccctaggctggtgggtgaccatggacggcttgagctcgcagccattggacacggtcttggagccataggtgaccttgaggttggtgctccggacgaacgcgtccagcacatcacccacaaccctaccaaccacaagagggtccctgtccctgccacttccggccatcgatcttgcaaaaaaccctgaaggtttatagttttgcttactagctgcagctgctagctattgcagcagcagcaagttgcagggagcaaatatactgtgat

SEQ ID NO: 61495 - DNA, 1618 bp, Oryza sativa
tttgttctctccaaggcctaagtttttgcctcttattttatttttaccatcaagcttgttgcaaagagcttttgtgcttgaagactcgctggttctgctctttccaaatttcccaagcagctaagagggttaggcttctcaattcaacccttctttctgtacttacgggatggaggccagatccaaccaccaaccatagattgttgtaaggttgctctagttcattgggttgatctcttcatggcaggtccatgctgcaattattccccatatccacctcttgtatctgcatctcaccaattaagaatctgaaccacatggttcattaaagaacaaaaaaaattggccaaaaccacggtgagtttcattagttttctttgttgtttctctcttactaatacattatgtctttgttgtctatactttatgtgtcgcaatgaaattacggtggaatagaaaaattcttagaaaattttagggcaaatttcaaatttcaagaaatttatttacaaaaactacaaatgggggaagttcttaatcttggatctctctaacgtcgagtcgacatataagaatgaaacgccgacgatattcttattgagatgaggggagagagccacgttacaaaggaaccaaacaaagttgttgaggtaactgcctcaggctggtagtcacagaactagctaggatgagtttgattcagcttttcggtttcgctactacctcattatttttgtaaacacacttttcgatcaaactgttataaacaacacgcttttatgcaaaactttatatataagttttttttttaaaaagaaacatatctatttttaagtttgtaatagttaatacttaattttagtcgtgctctaatgattctttgtgttttgcgtgaaaaaaagcatggccattttgctgtatcgaactaggcctaataaggacctgcacaatttttttttgaatgccaggacctgcacaaattaatcttggatcgatctcttttctctctccccactgctgcacgcaaagagaatcgggcatggatggtagaaaaaattgacatggaacattggagatgccttagtgatatacatagatttatagtggaatatagtgacagcgctcagcaacgagtttcttacatagacatcctttcgaattttcattgtctgctttagagattagatactcgtatatccaattggtatatctatctatcttgtggacaagcatatatacttgccgatcgatagaattattattgagaatttttcaatcgttgaggaagctagctagatgagatgactttagcgttggtcgagggtgaaaaatgttcaacagtaactttctagctagtttctatatactgttgtgatagagaaactagctaagccttttcttttgtatatatgtgtgtttttcttgatagctctttattaattccaagggaaatagtattggtaccgtcataaaatgttacagcatttgactatcttccaataggtcaattgatatgtagctcaatatgtcttctatattacatttcaaggcattgaaagctttgcatgcggataagaatactagtacttaattaaatacccaaatgaaggccagaata

SEQ ID NO: 61496 - DNA, 6744 bp, Oryza sativa
aggcttgcatccagactcaaaaagaaaattccgagattcgccactgaacaagatgatcgctaactagtatttttttctttttttttgcgaggattgctagtatatattttctcatgctttatgctctcaacttttctttttataaatcatgaaaaaggtatagagggcccctctcgtttccttaaaaaatatatgtatagaccacgcgcactgcataaagctaacaatgtgctataagatactacctccgttcataaatacaaggaagccaacatacaacaacattaatccattatatttgtggataggggtatgtagtactaacgtatataatggtagtgtgttacacaaaaaacttgtgcaataacaagcaacttaattatagccttaagaaaaaaaaagatgccacacaggcacaatattttcatgcattccatgaaaaaggaaaaacagaacaaaagaatgcacggagccgtgttgatcatcatgaacaaaaggcatttcccttttcccgtaactttaaattgacagcatgcacgtatatacatcaggtttgaccaattttacttatcccttcctttttggctgctggctggacatgtggtatattatccatcatcaattcattacttcgtgacttcatcaacacacctactccgtcactcctactgaataaagcgcaatcagacttgaaatgtaaaactaatataactttaaatttctcatataccatgtttgtagcaataaaaccataataatataaaaagaaatccaaatgtcaatataacgatactaattttatcaaataagatttaatttataataaataattaattattggtcaaatattttaagtgttgaatatgagcgtctagctactaagctcggcatgccaccaatgcaccaatatgcgtctgaggaataaattaacgttgatgtatcttatctttgtctccaaaaagaatccggccggactctcaaataacaggtcaaatcggcacaaaatgcatctacagctgaaaaacagcataaggcatgtatttcatcccttcacgcatgtcttgctccctctttttccagatgtgatatatgatctacaacgtaagtgttacgtagctgactgcaatcggtgtgtgttgttttgatggaaagggatttgagatcaagagatatatatggcctcactaatttcttatacatgtggtacgaattaatagttaaaaaatatttatagaaacacccttttaacgtttatattttttgtgaccagatatatcaaagttaaccaatttaataacctttttaggtattgtagagggctactaatcagcgcgtctacgctaggagctgagctggcgcgcaatcctcccttcgcacacgtcccgaataatgtgagctaataacgtttagcattaacgatagtataaaataattttttaaataaaaaataataaataaacatcaaggtgaaagtttttaaaaatcagtcgaaagtcgaactttaggagttcgaaatttcaaatcttgacttgaaatttaaattttttaaatttgtcgagaagttttttaaagtttgagttgaaagtttcaaaatttgtatcaaaagttttcaaatttgagttggaagtttcttaattttgagttgaacattttaaacttgatttgaaagttttcaaatcttgacttgaaagtttttaatctgagttaaaagtttactaatttgagttggaagtctttaaattggtgttgaaagtttatgatttgggatataaagtttagaatttttgggttgtgtttttactttttaattgaaagccttaaaattatatacgagaagtttttaaaaaatgcaactgtatgtagggcctgttcagattgatgacatttttaaccataccattatttggtaaattggtgattatgtggctacgtttagtttgttatcaaatattggcaatgtgtatagagttttggcaacattatgaaaccaattctaccaaaattttggcaacgttgtaaaattgccaaaattttggcattgccaaattttggtaaggtttattttggcaccaatctgaacaggctcgtagatacaaactaattactcaggaaaagaaaaaaaatataactaatcacgctaatcttcactaaatatagtgctaatcacgtacatattttggtttccggtttagatggcactgctcgcgctaccgatatgccaaaatttgaattcaaaacgatacaaaatattcattctcatctaaaatcctctccctgaaaagttatcagaggaaactattcatgttgaacttcactccatcccttttccatgtccccggcccagttccggcccagtcgctcactcccttcctctccaacctttttttaagcccaacactgctagcccaggtcccctcctctctttcccttctaaatccagggcggcccaattctttccaattcagctcggcctgctattcttctccacttctagcccatatggttctctcctccccttgctttggaccagcctacgtctgcgtgcgtggacgcgctccgggcccacctgtcggaagcgtcgtcttcctccagccacggcatcgatcggttcctgacttccttccacctgacgaaccctagccttgaattgccttgaatcgatggcttttcatctccggcgaatcgacgccattaactccggccaccaagcttcccggcatcgatcgatccgccctctcgttgttctccgagcgtctttgtcacgatccaacatattctccatcgaatcaacacaaatcacagcagaacaaccacaattctagagccaaatcacagcagtaatcactcgattacttggatacatgtagcagaatggaatccgagacaacgctggcgtcacgccaagcagaatctgaatccaggagtagaaatcagagttgggggtgggagaactctagagaggaggaagaagacacagagaaggaggaggaggaggaggaggccgcaaccattggttcaaaataattcattgccccctttctcttgttggagtgtgtacttatactctggatgacttgctcctgggccaagccccctttcctatgacaacccacatccggcccactgtgaagtccatgtccagcacatgacattcctctccccttgaaaatcagcttgccctcaagctggtgcaaatgaggcacaaaattcatgcccccaggatcccatggcaactccattcttccaaaactgcagtcaggtagcttgatactcatgcaaagcgtaggtttgatagtctcaagatccccaagccatgtcatcttcatctctgtggagatagtgaactggaataggctctgatcttgactgcacttgcacaattcatgaacttgatttagtacttgatctccccatcttccagaagcaggccaagagtatagtttaattaactttgtcattaaagccatgatctgcagcaatggtttcatgtccgccctcacactatcaggaaaggcattttgcagtggttgtagttgtggttgttgcctgtccttcctaacatgcaagagagtgtccaggttactgcctccagggtcccagggtgcgtgcaggtgattagcaaaggccattctaaccaccaaaggagagtacttcaggccaacaacagtgacaacatttgcacttgcttggaatgtctgcatatccacctgtccgaaattggaatcaagcaaattgattcttgccagcaaccttgtcattgtagagacgtcaaacataggagagatgtcataatctgtgtctcgtttggcagcaacatgatcccaagacttcattattgcctcattagaaaacataactttctgaattgcaaatgtttgcttgaacacaagttggacacaccaagctgacttccaaaagtcagcgttgaattgaagagatgatgcccttttgctcaccacgcacagactcagattctgctcaaggcgattctcttcattatgcgccatcaaggccatatgttctgtcagcaagagcttgcagtgactttgtgttaactcccaagcattatcacaactgaaccaagactcattccatctgtcaggtgaaagtctgggttgtaggagattcaccacaacgcctctgttatcttgttttatttgaggatcatgccacggttctagctgccgttcaacaatagaacctttgctcttggcttgtagagggggtggccatggttggagaggctgaaataccaccacacttccgttgcctgaatacaaccatggatcaggccatggcgagggccgagaacctgaaaagacctgatcgctgtaccatggaactgccactctccaaagtggtactggtggtgagctagctctacatactgagcccaatacaaagcaatggtaaggcacttccaatgtagatggaaccaacgagagattgttaacaccaaggtcatggctcagacacccaatcaagatcctggaaggaattgcattgagggctaaccatggatctctgaagcataaattcacagaagtaaacttggtatccacttcaatgagctcagttctctcatcgttagccatgtctttgccatcatcatcaaccaactgattctttcccttcattgaacactcgatggttgttcccatgccaagcttggctaagtcaacatggttagttgggccagcctcagcactgacctccaatgcaatggtagttggactagtgttggcgctcaactctgccacatctctagtggaatccttgttctcggataaatccaccttggtgtcgtgaaatgcctccaaaatccgatcgatcctggtgcacaggtcttgaatggccttgcctgcgttctccaccaccttgtccatgctagcctcagcctccatggcctcggtgagtgaaaccgacgttgttgtgactgctgatttggccgcagatagactcatggtggccggaaacacgtgttccagagtagtaggagtgctctcggtatctgattttgtggtggcacatcctggtacttgcatcaaacacttggtgggcgcagtgtcggctctgtcttcgagcgaggtcggcacatgttgcacatccaacacgcagcccccgtcgtagatattgcggccgtggagttcatcctgagcccactctgcgtcgcaggtcgtccgaaaccaaacaattgcctccacacgccatgcatcgaccgcaagcatctgcaccgccactgctccataggggttgaagacttgatgcatcacattggtagacacagggtagatgaggtggttcacttggacatggagtgcagcacctgcagcacttcctaaccggcttggcatttcatcgaacacctggcgggcgcctctgacagtgtcacctccatggctcaaatcctggccccaacagtcgtcactgcccccatgtgtcgtccactgcatctcccggatcggaatcccatgaatcgactgctctgataccatattgtcacgatccaacatattctccatcgaatcaacacaaatcacagcagaacaaccacaattctagagccaaatcacagcagtaatcactcgattacttggatacatgtagcagaatggaatccgagacaacgctggcgtcacgccaagcagaatctgaatccaggagtagaaatcagagttgggggtgggagaactctagagaggaggaagaagacacagagaaggaggaggaggaggaggaggaggaggaggaggaggaggccgcagccattggttcaaaataattcatcgccccctttctcttgttggagtgtgtacttatactctggatgacttgctcctgggccaagccccctttcctatgacaacccacatccggcccactgtgaagtccatgtccagcacatgacagtcttctcatggttgtgtatctgattttgatcactagcatactagttgtaccatgcatagtactgaagtgaattataccttattggttttttctactccctcattttcaaattacttttcattctgatagctttgtcccaagtttaacatttctatggccatcgatttctgaaaattctcacaatttaaaaatgtgtaagttattttctcatgttgattataaaaaaatatatatattatgatgttcaatatataaatttttaaaaattaatggtaaaagagaaaaaaatgtttggctagcttatgagaaaactagaataattaattgtatcaatatatatagtaaaagtttcagttgcaataataattcatttgttatattagcatagaggagagataatatgataacttgatacatcgatcgatctagctaatgcatgaacgctagcatctttatatttttataattttataatagtagatatacatttatttatttatatatacacacttaagagcctgcatgcatatacagctaggcaggtctcagcttagctatagctgctgcatgcatggaggccgggtggcatgcgtagctagctaggggtagaccctcctgccgccggagccggcctcgcgctggcagttgaagtagacggtggcgaccggcgagccgaggttgtagagctcggcgaagttcctggtgctgaagttctggcgccaccccggtgcgtacaccgtctgacgccccagctgctggaacagcacgaacaccagccggtggatccccatggttggccttgggctctcgtagcacatcacctcttgccctgca

SEQ ID NO: 61497 - DNA, 13776 bp, Oryza sativa
cagccctatccttcaaatctgacgaaaatttttgacaaaatagatactccctccgtattttaatgtatgacgacattgactttttaacaaacgtttgactttttgtcttattcaaaaaaattatgtaattatcatttattttattgtgacttgatttatcatcaaatgttctttaagcatgacataagtatttttgtatttgcataaaaaatttaaataagacgaatggtcaaatgttggttaaaaagtcaacggcgtcatacattaaaatacggagggagtataattttgtcattatgcaatttttgaagtatatatatggggtaggaccaaggtaataaaaattcatggaactgccacatatgttgctgttacatcgaaattgatatgagtactatatatatatactagtttactgaccaaatgttgctccagtggtaccaggaatatcggtgaccagcctacagacagacaaagagaatcaacgcgaatgattgagaatccggtccaaattctttatattctaggacgaatgtatacaattagctagctaacatatctgatcggtgcctaccagtgtagatactccctaaggttagggttgcttgggctcggagcatccgggtctaccatcacctgtaggtaattagattagtacgtaagccacacaaaattaacatgcatccatgtaaaaaatataatttatagtctagttttatgataattaatgaaagtaattaaataacttctggtgggtctctgcatccaagatatgatccgtacgagtgtgtagaacgtcctcatgtcattgccaccgaccacgaccctgggctgttgggtcaccatggacggcttgagctcgcagccattggagacgatccttgcaccatagctgacactgaggttagtgatccggacgaatggatccagcacatcacccacaatcctgccaaccacaagaggatcgtccctgccgctgccggccatgtcaaattaataacctctaactaaaaacgttaggatatctaatatcaaataaataaaaggattagactttgaatctaggtcagctaacccactaacttatgaagctagccggaaaaactctaggcatttctcagtaacctttaactgaacatgtaaacaaacagatcgatagagattgctagctagcttaggtatctcctgccgttcaatccagaggatagatgtcaggaaggttaagctagccaaacagtgacagggatgcactagttgtgcaagcttctctgcatctgtacagtttatatagctagccggcccctttaggcagtaccaacccaagacactacacggtagttttcataaacttcacatcatcaataaactagtattagacactactttttcaatacaaacaccactttttcatgcttaaattaaatttatctcacatgatgtcttcaatgttgtgtagaaaccatgtctcatcaagaccttgttttcttctctttcctcatttactcacttgccacatcatttttcatattaggtagcagcttatttaatgctatggacaccatcctagttattgagctgagaatagccttactatgatgtgcccagtagaatcttttctttatgcatttacacactttgttgtgcccggtagaatcttctctttctcacacactctctctcgcatggccctttctatcttcttcatgtcgatagaagtgctgaaactgaccccatttacagaggcgatttcgagacagatacatatgtactaaccccgtccaaaataaatgaagctagcagtaaaataatgaagctaactatgggcatgtttggcagagttaagaacagctgtttggtaaccaggctctgagagtttggaaaagctggttacctagcttctggcttttagttcttttataaattctataactatagctttttagaatctggaccaacagctgaactattttgagagcttttgattctgggagaagttgatgcagctagaagctcccccaaacaggccctatagctactaatattgttgtgcacaattaaattacatactctagggtacaatgtagattctattgttacgatagaatcagatggtactgtagctgatctggcatggcaaaacttatagctggcctaacgttttacaagcttcatctctcattaatttttcaccatacctattctacaattcgcggtgtgttcggtatatttccgattccaaaactcatacaatgtttggttaagcttttaaaaattctgagatcgataacttttgaaacttctcaaaatgcttagattaaaaaaaataagaaaaaaagatagtacatatccatagatttgtcttgaaaggtgtggtggccaggccagagaagcaaagcatgcatgcatatgtggaggagaactagcttccagatcgacttgcagatatgcaaaatgcatgatgcaatacaaacagaaaggctagacattattcccggccggcggcagaaaagctaaacacaacaaaataaatgaatatttatatatattattatatatgtaaagtataagttgagattatattttgtttgatgataaaataagtaacaacaaaatactccctacgtttttattatattataagatttgacttttttccttagtcaaacttttctttaaacttgatcaagtttaaagataaatatagtaatattttaaatagaaaacaaacatattatcaaagtatatacagtgttaaatttaataaaactagtttggtatcataaatgttgctaattttttctataaacttggttaaacataattaaaaaagtttaactaagaaaaaaaacgacttataatatgaaacagagagagtaaatgatatttatatatatatttaataagacaaatggtcaaacgttatgcgaaaaattaatggtgtcgtacattttgaaatgcaaactttcaaaaaggaatatatactagatgaattgataaaggaattttcttgatggatgcatggctaagcattattggacagggatggccaccaggacagagcaagactgggtgcgagaatatcagattgcattcgcgatagccgaccggccagccaaatgttattcctgtctttttagatgatgaaaaggctagtactcattattcattatgatgtatattcactatgatgtagagcggcttgggttgatttctgttattgaaaaactaattgtttgaatgtggattaattgcatatatagccagaggagaattcataccagttacgcccaccgaatcactagcttcattgactccacaattgaatacattttagtgtagtttgtttcgagtgaaaaatgtacttcctcaaagaatgtacttcctctccaaattataagaatgtacttcctctaaaaaatattttatttgatctcaaagaatgtacttcctctctgtcccaaattataagaactatattttacacgatctcaaatgatatactttgactattaatttacttcatgttacgttaccaacgaatatgatattagcatcacataaaaatactttaaaatataaatctagtgatacaacatgcataatatttagggagtaaaactagaggggagggagtacatccaatcgcatatggctagctagcttcctattagcagtctagcagaatactccttcctgaatctctaggttacataagtatgactaacatggcatccaggctcttttagcatggaactgggtaacagaaaaggtaatgcagacgtgacaccccacgtgggctacaccaatatctaccaatagagaaatggtatcgcacggaaaagcatagtgctttctttctcgatggtttcgatttacactaaaatatgtcctatgaagagtactttatttttggattctttatattccagaaagactttacgtttaaagcaatcaatctattaaagtttgaaaataatgtgaataacattctagtctttttaggcccctttgaatcacatgattcaaaaaatgtacaaataaaaaaaagaaatatgatagaaaatcatatgcaaaacagagaattgagaacacatagatactataggaatgattatttgattggtgcataggaaaacataggaatgtgttgagtattaagtttatagtaaatcaaaatttgaatggttttgctagggtaaaccatatcttccaagggtgctttgcctcgatactatgcataggaaaagaaaaatgagctctaaggttgatgttgattttcctatcgaattctgttgaaatcatggtcgaacttttttcaatgctttttctccgttcaattcctacaattcaaagggacgaatagtaccaatccccatagaattcttgtacatatgttttttctccattattcctattaatcaaaggaggccagttttctattggtacatgtacgaatggttaaaaataaattctttttgggacagagatattagtatcaatattcggtagaaatagttcaaattattgatttataaattctattaattatgattttcttacacctcagtagaaagatattttattgttggtagtaggggtgaaaacggtacggaaacggacggaaacaacctttatcgttttcgtttccatatttttttcggaatcggaaaccccaaaaacgaaaacggaaacgaatattatcgaaaccgaaaacagagcgaaaacgaaccggcgcggatacggtaacgaaaatttatcggaatacaaaaacccctcaaactgagcttcaaacttttgtcaagttcaattctcaagtcttaacagtctacaattcatcataaaacacaattatatgaagtctaattgttaagtctcaacagcaaaatatattcttctataacttcgtataatttgcataacaaatattctaaaaaaaattacagcaaaataccatggtataaggtataaagtatacactattagcccgcagcccgcagcctctctcttcctccacgggccggcttccccttcccctcctccctcttcgggccgccggcccagcccttttgctcctccctcgccgagaagtctataatgcctccttcctctcaattcaaatattttttagggtagtaaatgatttcaaatgaaaaaaatgtcaataacaaagttgtataacttatcaagatcaacaacttttgttttggtcattttgctgtatgactttgtttcaataatttgaatttgaatttcaaattatgacaacttcaaacaacattttcaaatactaaatgatttcaaatgaaaaagtcatcaacaacaaagttgtataactcatcaatatctataacttttgttttgatcattttgctatatgactttgtttctataatttgaatttgaatttcaaataatgataacttcagacaatattttcaagtactaaatgatttcaactgaaaaggtcatcaacaataaagttgtataactcatcaatatctataacttttattttggtcattccttcatccgataaagtgatagtaacattgttcacaaaatttacatatatctcctatagtttataaactatataagagatatatacattttgtgaacgatcttataaatcactttatcggaggtccctaaactctcataaaccgttcaccggaggtccctcggcaatatttttgcccggttttgcggacgtggcatcctagtcagcaaaaaaattataaaaagtacatggggcccacatgtcagctgcacatcttttttccttctcttctcttttctccacgtcgggccggccagacagtatccagaagaaccaggtcaacgccgacgacgggcgagggcggcggctggcccgcgcggtagcggagcggcgccgggctgcaggcgaagcggaggcgggcattgaagtagagcatgggcgagtggacgcgggagggcgccgggctgcgggcagagcgcggtgggcgagctccaggtcgctccgtgcgcgccgcatcaccaggggtgcgacgactggtgggtgtgggcagccgccctcctcaggctttgccccctactccccgcacaaaaaaaacagtttgggacatcaatgcagttcaaaagtattcggatgctagcagttcaaagatcttgccgaatactctgcaaatcagcaaccatccaagaaacaggaaccagacgctcatccaagaactaaataattcaaggaatctgagggaaatctatgtgataacccgaggtggcggggagctgtctgaagaaatgactgggaggtgaacgagtatgcagaatgaagaggaatccacgcagaaaaacccaaaggggctacacatgaaagcacatcaacacaaaactgaacaagcaatccaagcaactgaagttgcatttatccccctagtgggttttggtgattaatgacgaataaggttaagggactaatgattttattgagttatgtgattagtcccaaggtgaacttaggagatcaagagatgcttggagaccccccacaacaatcattcaagcggatttgaagctcgaaggacaataggatagtttaataattgaaattgagttctaggaaaaaccgtggctctgggatataaaaagtgctcttagtgagatccaagtggtagaatatttttaggagctatttttggaaatggctctggcccggacagagaaggctgaccggaagttctggtccctagacccggaacttccggaccttgtgagttgaaaattttcccaagtgttgtccggaagttccagaccccttccagttcaaaaatgtgagtaacggctagatgatgtcacctagccgttatatatatccagatcgcacccagctcactttttggccatttcacttcagttctttcatgccctaggtttttctagcctctcccaagatccctttgcttcctccactcaaatctagagctattcttgtgagattgagagtgtaggagtgatttggagaaggtttgaagagtaggtttgattgagtactttggatatcttgtgggttgtcacttgggcttattactcttagagatcctctcctagatggttaggtgtcgcctgtgagcttacaaagatcttgtggatctagaaaatgacctaggggtgttgagttgaaggccttggactttttctgggatctttgcacaagtgaggcaaggggttaattgagacccagctctttggagcacctcaacggagagtaggattgcaagatctgaacttcaggaaaaaatcacccttgtcctctctgtgatgattctgtgcatgttgctgtgattgtatatatgctctttcatccagtagtttatttcgtgcaatttagttcaagtccctgttaaggtcttcaggtttttctgttgcccggaagttccggacagtctgagcagaccggaagttctagtgttctacatccggaggttccggtcctgctgaatttaaagctgcaaatttgtttgtaattttaaggaaagcctattcacccccctcctctatactacatctttgcgcgttcagcaatgaaaatgagcagttacctctcaaaacatcaggacaaatccccaatactaacgcctcctaatcatgaggactgggcgggcgtggactggccggccgcctctcccgccgacgcccccacctctcgtgtcggcgcgcctcctctcctcctctcctgccacctccgtcgcgtcgaccgcctccgcttgccgttgcaaccgcactcgccgatgcccgccctcgcagccacgctcgctcgccgcttgccctcgcagccgctcccgccgacaccgccgctccgcctgcctccgcccgtgcccggagagaaaaagagaacaatagaaaaatgagggtcacttacatgtgggctccgcatatttatttttattatttgtactgactaggatgtcacgttagcgaaaccagcccactatactgtcttgggacctcttttgaacggttttgtatagtttaggggtgaagatttctggttttgtggttaagggacctccggtgaacttattccttacttagacgtggttgtttctgataatctctatggccgtgtgtgccattcgatttgttctacacgtgatcgagaagtccaagccacgtggacgtgctctgtacggacggcctgcgcatgcatccagaggaaatccgaccgtacgtcgctatccacgtacgcattgctgtcagcagtaccaactccagcttgcactgcaaccagcgcggatctacgatgttagcgtcggtgttaaatgacactgatgactttcgacaaaacctataattaaactgcttatccatatattatgacacaatattctaattataatgagcatattagacaccgatatacatatcatgacttcaagtcaccaacgaatcaattttctagatccgtcactgactgcaaccaacggtttcgactttaaagaggaaaaaacaaacgaaatcgaataaaaaatactcctatatgctttgacgcatggatcgatcacttgatacgctaattaatctcgatctgcaaagatttcaccggagacgacgacgacgaccattcctgtccatagacaattccctccctgttcttcattcaacgtacggccggttcagtttgcctcagcttcttcttcttcctcctcgtcttcgtcttcctcgcgcacgcgcgcagcgaccattcttggttgattcctctcgctcttagctggctctcttttgagatctagcggaatcactggtaattaatcatgccggctagctatatataaaatcttaattagtacggatgatgagtagagtagcagtgtagatcgtcgcagtatttagctaagctagctagttcgcgtcaccgttgatgggaatccgaccagatcaaggcggcggcgagttgggggcggcggcggcgacgagaaagaggaggcgggaggaggtgaaggtgacgcacatcgtgacggcgagggtgagcgcggacgaggcgagcttcagggacgtggtgcagcggctcaccgggggcgccgccggcaatggcctcctcctcgtcggtggcgatgcggcgggggtgctcccgtcgtcggaggaggagatgaagcggtggtgggccgccggcccatgagtattcactgatcgatgggccttgatttgggccggttgcaatgcgtgcacgcatgcacacggacattgcacaccatcatagcttttgtattattatcgatttcttgtcatgttttttctctctagatatatatgaatttattttttaaaaaaaatgtgtttgcgtaatgttttggttgcgtggtcgctcttgcttgagtggtagcggaggcttggccgcttggatatggttagtaagggtggacttaggatgacatatgggtcccacttgctgactcagctagtcaatcatgatcaatgtgccacgtcagccgaacgcaccttccaaaccacttgaggagtttatttgcactggtttctagagatgcgggaggtgttatacatggttttacggttgagtgatgcgattcgattaaggcaaagatatgagggaggaaaaatagacttattctgcacctaaatgagcttcgatacccaggcctaggtggactaggcctggtctatccctgatgattagtcttgaacctttagaggtagcagaggatccctaatggtttaaaatcatgaattgttatgcttaaaatctgtaacagatcaatacaaatatatgataaattggggaaaagtccaaattacaccactgcattattgggtgagtacgaattacccccttaggtctgaaaaccagacatcgcacccacagcaggtggagcccataagaaagaagaattgctgattggagtgccacgtaggaccaaaaccactccggtttaagtgaggggggtaattcgttcgatattaatagttgatggtgaaaaatgtctgattttcgggtctgagggggtagttcatactgacctaatagttcagggatgttattcgaacttttccctaataaactgtcacatagcaggtacgacaattgtttaaaaaaatgcttaaagcgagatcatgaacagttttttatatgatattataggttaaatagtactattaaacggttagtaaccttaagtgattaaccattaggtaatgcttcctaaccaccttgccattcctctaaactagcccaccatccctaatgggtggtgtttctttagcctagttcaaacagggcatgttgtacaagctggtttaactaaagctgtcataaaagttgtaagcatacaacccaaaagactgggtcaattgttctatctgatatgagactgccatgtgatttttatttaattgaagctctagagtatatatgttgatataacgaaacaaaaggaaaaaaaaacacttcaatattttgtaggtcatgaacgggctcaccttgtattaagtgtggctaccaaatttgtgtttttaaattatccattatcatgctctgcccctccactatttaatctgttgtaaaatattcagccacttcttcgagtttgatagcacaaccagagaattctcttcttgcataatgttggcaatagttttctttttcctccacaaattttgagtgcatgttcggttggtccaacaaatattaattaattaattaattaatcccctgcctaactagctaagccaatcatcctatggttttggaggcggtggcgatctaggttaggtagactcacaaatgaaacaaaattgtttgttggcctagctagcctcctattatgttcttgttcttgtgttagttcagcattagcaggggcttaggcttggttgcaaacaagtcactctcacagccctcgtacttctgaatttcttggagataaggctctgaagatgtgccatgtagacttggatgtcagcccactaggctggcgtggccacattttaattacgtcatgtgcacatttttcagttagaaatagacatccaaaattgaaagaaatttcagagtaatgaaaaaaaaattatcatcatctgagatgtcatgaactcgggaccacgacaagtttggagtttaggatcagttttagaatatcgtctgttttggactatttgtagattaggtgctttcaatcaactggagtatgggcgccatcctagcctccctccttcggtccttccccttctctagcgtccttgttgacgaggaggggaaggggataggtagtttttcgttgttgtgtgtgttcggaacttcacttcccaacccatttttctcattttctgcgtgcacgctttttaaattgtcaaacggttcgttttttttaaaagtttatataagaaagttgttttaaaaaatcaaaataatctatttttttaaaaaaatagctaatacttaattaatcacgtgctaatggactgctccgtttttcgtgcggggagatgggttcccaaccttcaagtaacgaacgcctaagtatgtttaggatttgttctaaacaaaattgagttttagtctattatgatgtttatggagttaggtcaatttatttagattcttttgcctttttacttttgctattgttttcacgggttcttcaatggagatcttgaaagacattgatcaggttgcagattatccaatcgacagtgtcggttttaggtgggtcactgatttgtttggtgatgccgttttagagatttgccaaatgatcaaagatggtggtcgatagaaagacttttgtgcggtccagagttgattagtgttatggctgtgcttgtgtacttgtatctcttgtggcattttaagatgtatgtagatcctctttgttctgtatcggtaccttatttctcatgtactagaactatcaaggttgtgatgatttcttatatttaatataaccaccattgtttccataaaaagaagtcaactggagtgataatccaaaagcagcctagctagttcctacaaatgagaggggaaacaaatgacacatcagaataaggaacatcgtcatcagacttaatcaagaacatgacaggttcagaatttatgtgatgcaagcctagcctagtttgctgatagatgcgagttagtaaattccatagaaatatatacatatccagggccccatccttttgtacatatcgatgtggtttaatagaaacccatacgatcgatggcgaaatcaagaggtagtctcaccatgatcaaagttggttgactcataatttgtgacctgaaatcgataaatttatgaatatatatattaattatcatccaccaatgcgatggaagatgagacactgttcgactgtcgattacctgtccccgatttaagaatcgaaatctccgtttgatcattgtcgtcgtcagagatatgatgatggatggactggcctgaaatggaagaaaagaacagcatctgaagcttccacactactgatgcttaatttccctgtgttcagttgctagtgatgtgagtggttagcttaattagcagctcgatcgcgttgatctctccaattcgcatgcacaccacaacaaccgatcgatcgatcgatcgagagcactcacgtaatacgtcgccttcgccgcgagaataatttagctatagctgcaagcatatataacgattcaatacagcgactcgcacctaacctaaccccgcaacaaccactaatcaaacacggcaagaaaccccagaaaaaataaataaataaataaacaaaaataaaaaagttcagatcagcagcatgtgatttttttaaccatttaatttctaaattttaaattgaatattctcaaaacttatttacaatgctgaacattttgtcacgcgtggcgaaataacaccgctagctaatactctaacccctcgtgatgtggcgcaccgtacgtgttagcaacaactacgggtgacattgtgacgttgttttagcacgtcaggcgggataccatggtctaaaggttcagatttaaaagtaaattttaaaacagcttatttttaaaataaaaaaataaaatggttcaataataataataataataataataataataataataataataataataataataataataataataataataataataataataataataataataattcggatgaagtagtgagcaatcagcagctgcagtacgtcgtagctaattggtgtgatgagtgatgagtgatcactctcgtcgatcggaagctccagctccaatcattcacgttttgatgatgcaagatgagtggccgggcggtcgctgtcggggaaatttaagaaacgggagccgtcggcgaactcgatcgatcgatcgaggtgccgtgtgcgttgcagctggcggcgctgctgccaaccaagctggcaggagagcgatctctgctgcgtgggtgatcgacggcgacacgcactgccctgtcttcctccctcgccgtcgtccggtcccggcctcttcgtggtcgtcgccgtccgacacagctaagattgcttgtgacctccgacttccttctcgccggactttcatcttcgcttcacttactccctccattccatctcaagtgtaattataagtttccgtgcctaactttaatcgttcgctttaaattttttttataattagtatttttattgttatgagatgataaaacatgagtatgtctaactttaatcatccgtcttatttaatttttttgtaattattatttttattgttacgagattatgtga

SEQ ID NO: 61498 - DNA, 29018 bp, Oryza sativa
cagtttggatacgagtaaagattcacgggtggcgggagaaaaaaatctcacgtgcaggggctcgatcccatgtacgaccttacatccactgagctactacatgtgttgtgtggttttatgagtcttacacctaaaatatattgtaattactttctaattacactataattatattaattaaggttgtactgtagtcacattcgataaattttaattttgagatgatttttttcaaaagttatataactaatccctactactgtatctgtcttataatataagaaattttgggtggatatgacacattctaatacaatgaatcaggataaattaggatgtgttatatctacccaaaatccttatattataggacaaagggagtatttgacttttgacctacaattacactttaatgacgtggtttaagtgtttgtaaattatttgtaagaggacgaatggttaaagtgtgaaagtgaatgtctcctgtcagttatttaaaaacaaattgaaggtagtaccaatctgcctcgtcgtcttgcacgcggccaaagctcatcgtcttttcagacatttacagtcgacagctccactctccatgtcaatgatttagtccagaacccaaatcaaaactgctgataagttaatcatcatcttcttttctttttgtgcactcaaacaaagttgttctagctttgctctgaattttgggcaacaatcactcaatcagtagcagtagacctgattaaggataagatgagatcaacgacgtgagtgcttgggcaaagagagggcagctttaatttgtgatcacaagtgcgagttcgttatgaatgtctgtgtctgtgtccatgtgtggtggtggtgcattttcagagaaggggattctttatagttcgctaataacaatatatacagggatgcctgtggctgatggctactgtcaccaccaacatcttgttattgttcagactaaagtgttggttgctagctcaggtttagctagctccaaatacaagtcttcactcataataatggtgttgctggtccatgcttgatcaaccatgcaagtgtggtgttctttgagttgggtgttgtcccatcaaaatcctctgtatatatatacttccatttgattcgtttgtgcggtttaagcacagtgtttagctttgctttgcttagttgatgcccatgtctgaatcacactgagaatatgccctctttgcttaatggacatgtatatgcctgttgctggtgatgttggttaaggcaattcatttctttttttttctaaccatgattgattattctgctctaataagatgagagatgcatgtgtggtgttggcttccactgtttagtgatctcagttgctaaccacctatcacaattggccagctgttcactctagctcttggacaacaatgtcattgttgcagttacaacggtgaaggagatatcctccaattggcaagataaagatcagagatggaaccaataaccaacctgcagacaaaattaactgcaagttcttccaattcttcttcttctttttttatccaagcaaacacagattgtaccaatttcattgaatacttccaattctctatcaaccaccatcatggcagaagactgctagtcttgaaaggcagttagctagttgtagatgcaatctattgcagggagattgacagattattggagcccaagtttcgtcgaaccggagacgcaaggaataaagggcaaagacaccggtcaaccatgcatgaacgtaaccatgagcacacacgcaacttgtgcctacatgcatttttcatgccagaatatattaacactattttttatcctatttttaatgatactatagtgggaccaagatggtccaactgatttgatatattaaaaataaataaatagacagttgtatacagcattgcatctgaaattcaaacttaatatgacctattctcactttaattttgcatatagaaattgttaatacattaaaaaaatagaagatatatttcttccatcataaatccatattaattatatctctcactttaatttacagatagaaattgttagcatattaaaagatataaaaagcaataactgatacagggttgcatcagaaatttcatattatttctatctcttgcttttatttgcagatagaaatatatatgtagatggctagctaaaggatttatttcattatcttatactccctccattttataatgtaagacttcctagcattacccatattcatatagatattaatgaatctagacacatgtatatacctagattcattaacatttatatgaatatggataatactagaaagtcttacattatgaaacggaggaagtagaaaaaaagaaagctaagatgcaaggagaatgccggtccatcacgtttgccatctaggcagcacactctaccagaagcctgaatgcaaagtatgcaggcaacctacccatgcagagacaaatcaaacaccaaaaaggtggcaagagatttcaaagggagagacaaatccttcttggcacgggactgatcatggttagtggcggcagcagcatcagcagccagtgattggtactccggatggagtactaattaattagctggctaacaccaatatattgcttctttctcaatcatttttcttcggtttaagtctctctttttctctctctctctggtgctgattgcaaagccactcacacgcaccacccataatgtaatgcccacccgaaagtccccacaaaatcacatggaagtcgcctcttcccaatcacaaagcatgaacaaaaaaaggagattgttccacagctcacaaaatcagctaaccccccttattcctgcctccctccctccagtaaccaaccacctgtaccgggcgcgaaaggacgaatggtctctcgcgctcggttagttcgttcgatggtgtacaatggactgtccagatcatcttaagacggcatttgtattgtcctaagtcgaacaaatggtatactcccttggtctatcttgaccacaactccataccatatgcatacatgccttgaaactgtggttcgctatcctgatatcagataaaaatcgctcacgagcagtatcttcggattttgtagaaaccattgataaaccaaaagaaaaccgatgaaatccgaacaaatctggaaaaaaattaataatccatttttattttaattttttaacttcacacaaaaacccgagcggtttatgttttagacatggtccgaaaaaaccagatttcacgaaatcagaaccggttttctcccgggataataaacccctgctgggaacaaatatccatatcgtcgcaaaccgaccgacgtatcggacgatctcgaccgtccgataccgatcgggcggtgcatggtagaggacccggatccgggaggaacagtgcttgccgaataccgacggcacgaaaaggtaaagtgcacacatgatagtgcattacattgctactactacatgatatgcattacattacacctgtccccagatgcgccaggcagacgggcctcacgcctcctcacgggctcacgcggtcacgcctataaaacgcgccacccctgccctttccacgcatcatcacatcatccactgctctgcttctcctcttcttttcttggcttgtgctctgttttaatttctttgcaatgatggggaggcagagctcgtcggcggcgaggagggtggtggtggtggtgtgcgcggcgatggtggtggcggcggcggcggcgcagaagtacaatgcggtgtacaacttcggggactcgatcacggacaccggcaacctgtgcaccaatggcaggccgtcgcagatcaccttcacccagcctccctacggcgagacctacttcggctcccctacctgccgctgctgcgacggccgcgtcgtcgtcgacttcctcggtaactttgattctttctttgattccttcgtcttcttggtttgcttgctccggcgagctgacggcggcggctggtggttgttgcagcgagtaagttcgggctgccgttcctgccgccgtcgaagtcgacgagcgccgacttcaagaagggagcgaacatggcgatcaccggagccaccgccatggacgccaacttcttccgctccctcggcctctccgacaagatctggaacaacggccccatcagctttcaaatccagtggttccagcaaatctcctcctccgtctgcggccagagtaataatcactcactcactgttcttcccaccacacaatttcaaaatctctgacaagaattcaattcgattcgattcgattaaatttcagattgcaagagctacctggcgaactcgctgttcgtgttcggggagttcggcggcaacgactacaatgcgatgctgttcggagggtacagcgcggaccaggcgagcacgtacacgtcgcagatcgtggacaccatctccaacggcgtcgagaagctcatcgccatgggcgccgtcgacgtcgtcgtccccggcgtgctccccatcggctgcttccccatctacctcaccatctacggcacctcctccagctccgactacgacagcctcggctgcctcaagaagttcaacgacctctccaccaaccacaacaatcagctcaagaccaagatctccgcgctccaatccaagtacaagtccgcccgcatcatgtacgccgacttctactccggcgtctacgacatggtccgcaaccccggcaactacggtacgcacaccactccgcttacactgttacacaaaaataactaattctacggccctgtctagttccaaagtttttttctaaacttccaactttccatcacatcaaacatttcatacacacataatttttctatcacatcgtatcaattttaaccaaaacttctaaacttcagtgtgaactaaacacagtctacgtatatattgcccgtacgttgcaacgtgatttggattttttttaaaaaaatttgtgcacgagggagacagggggccatgtgagccgtagcaagattcctcagttttgtgccagtgaatgagcagtttgcttaagtagggtagtagtgtccgacatgggcaatccgagctcgtgattgccattttatatggggggaacagtagtcgtcttgctccaacgactagctagacacccaaattatgccagattaatggcagatacgcccggttaggtgtgtggacttatgtttgtacctacgaatccaactgcacgcacgttcctccgttccctcaccggaactcaccccatgttcccccaactaaacacacatgtgagacagtgtcaaacgactacccccgagcagtggcgttttggcagtgtgcatcctactcctttcgttctgaaatataagagattttaaacggacgtctaaattcgtagcactaaaaagagtcacatccattcaaaatcgtttatgttttatgacggatggagtagatgatacagagaccaaagatgattaaactgatgagctatatatattttttgacatgtaggatttagcacggtgttcgagacgtgctgcgggtcaggcggcggcaagttcaactacaacaacaacgcgaggtgtgggatgtcaggcgcatcagcgtgctccaacccggcgtcgcatcttagctgggacggcatccacctcaccgaggcagcttacaagcagatcactgacggctggctcaacggcccgtactgtagcccggccatcctccacagctaaggcaaaatgactggaaagaacgagccattagttaatttattactttattattaaggctggtgtttattaattaagcgggaattaattaaaggggaattgtttgggttcttgatttttatttgggtggcatatatggtgggtggtgtgacggtgaaatggtttacttgcgttgccaaaaaagcaaagaaagcgatggcatctgtagaataaatgttggttactgttgtaatttgataattgtttctcttccagaatcaaatgaatcatcaatggtattatactcagttattttttttcttttgctttttagaaagagacttttttgccatggcagcttatgtttggatcttttgcctggccaggggcatgtggtctgtgctttaggaaaagcaactgcagaaaattcactctgatggtcatcctgtctgagacggtcttgtcattattagtcagagactctgaaagtgaaagtgacagtgttttcttctcattgcaaacttttagctaactaaccactaggttgatgaacaaattggacactcctactggggaaggaaaacctgagcaaatttatccaaggatagatagatatgcagcatatgctccaagtacaataatgcaaaaggaaagcaagctactcttgcatagtgatgcactcgctctcctactgctgaatctagctagttgcatcaaatcgacttgaatacatgagatggagtaatatgcagggcatgtgggtgacgcaagtgggatggcctgaattattcgtagctgttggaattaaatccaacggcgacccatccttggaaggaggagacgaatcttcgtatttgattgcctaacacatctattgattatgatagtgatgcacatttgcaaactaggacagggcacacaagcaagtacaagcatgaagcatcaatcagagcggctgatttatacttacataaacgcagtaaacaaaaaaaagaaataaaaacatggcatgcgtaggattgaaacacagaaccaagcctaccatagaggttgaaggatgttacgtatagcgaaggttaaaaaaatatattcaaaagtacgaagcatagaaactgtgtgttaatttgtgatgcattctactactatacaacaaaactgcttcacaagggcacatgatgagcattcctggcaagaatatactaccaagttctgaagtcataagcaaatgagaatgtgacaagaatgtggaacaagagctctgtgatcccgtgtatctgacgcctgaaatcggcggtgttggctgcctggacggcgcgccccaggcaatgattgtgcctggtgaagtcagtgaatgctcgggcaatccattcgaggcgtcagtggtcaaccattctgtcatcatgttgcctggactgtagtccgtgtagggacgataatttatcggtcgtcagattcagacaccgcagatggaccacctgtacattccttccttcgatgaagctccagcatctttacctccgggtggcatagccctggatgatgatagatttgggaacatgttagcatgcgtcagctagactgaaagatcttaggcattagtgtccttgagaaaaacaatgctttgcaagtttcagaaccagcttctgcacaagcacatccctcacttttattcatcttcctaacaagagtttggttttttagtactatgcaatacttgtgcaggttaatgttaactttattgattctcagcttcacagacctatatgggctacggcctttgtgatgttgaagttgatcaaaaggaaagtgtgatgtgataatactttaagggccacgcaaatatatagataaggaaaaaagataattcaccaagcacttccacttcaaatgacatcaatataagagtcaagaaagtaaataacctgaacattttggaatatcccaaacagcaattgaagactctgtgcactcaggtgaacaaagtgcatgtgtgttctcatggttgacgttcatagcaagcatccaggatccaatagtaacatcctcattgctgaacatacggaaactggagaaacatatgtgagaatccattaaacaaacatataacgtgactcgatcgtggatgaagtttaacagtgatgcaaaatgaaaaacatgaatgcaacaacagtcttatgtacgaaacttctactgctgaagcccatgacataaccatgtagtatgtttactttaggctccagggcttctgagtttaatatatcgtgagcaattaatcaataaccacacactatttcccttcgctcttaatttgttgagccagaaaagggaaagttttgctgaaaagaaacaccacttcttttacatgagagggctaaaactaccaagaatagctcagaattgtgggaacaaggctaatatgaaagccagtaagacagcagtaacagtcaatacaacttctttacagaagtatatggatttgcagtgcagtagtgttgctcatgttagtcatacagtgagcggtggcctcaccatcactggccatcaaagcagggaaaccatagacccaaaccaacattgaatactatttcataggctaactggtttgagaaggcaagttgaagaatgctgcttcacaataagataggatgagtactgttaattacctgttgttcctcaaggcaaccaagcttgccaccacatcggctgataaagcgtaaataggcccatatgcatgaaggaagtattctgatccgagcaaaaaggattgtggctcatacctgcatttggaaaaagagcagaaacaatatgataagcagtcattgatgaatggtacatggaatatttttgctgtgtggaacaatagaaagtctgaagtccaaacagcatgtggtatactcagcatatatgccctcacaccatttgccacagcaacatgccttggttatagaattctgtctatactaccctaaaagctaagctaacaactgtcttaaaactataatagcaaagaggaaactgaaaatcacgttggagggaatagactcacaaactgaacactttgtgcttgcaccaacttgtaggatcacaagagtgcttgcacagctaagctagcaatattttaagcacagattcaaaaatgacagctgcactggtgaattggagggtggagcgtgtgacaaaatacaaaactgatgaaggatatatatgattttctttgatcctcgaataatactgataagatgttgaacctgacaaaagtcgttaggattcaggaatcctttatacttacatagttcatccccactaagtgtagttaatgctatttctctcctctcattaagccacatcaccccaattatttctagcctttggatgatagatctataatccaaattgtctcttctttcttctctcttaaaaacatgcaatctcaattatttttaggctcaaaattgtatcaaattgttttagttttgataatcaaattacatcttatttgtacatattatgcaacttaattttccgcagcaacgcgacggagtattcatctagtttgggatacatgcgcattaacatctgaaaaacaatcaagtaaacacgttccttgctaatcctttccttcgccttccaaccctacagatcaagtgcttgctttacacaccatatctagtgtggtctgtgcttaactttatgagaaaccatccggatattgaggtaccagcagttctggttttgtacaatataacatactccctccgtttcacaatgtaagtcattctagcatattccgcattcatattgatgttaatgaatatagacatctatatctatctagattcattaacatcaatatgaatataggaaatgctagaatgacttacattgtgaaacggaggaagtaaacacgtaattacgaatctgaaactgagttattttcagttcatatttatacagtgatgaaatattttttgacaccataaaattattaacttttttgtggaggtgtgagggtcgcatctggacgaaaaaatttctttattatctaatttacatttgcttagcatgagccacgatgctgtatgcatttcttcatagagttaaactttctcaataaaaaaaacaatatggcataaaaggggttcattatgtcatacaagactaaataacagaactgaccatttcagctttgggtcagtaaaaacaggccccttcttcatgcatccaatgtatgtttgtgtatgtgaacgctccttagccaaaagcaatgaaagtctatctgcagaatagatatcagtaatgaaagtgccagccattaaaaaaaatatgatatccaagtcaaaatctgtaagaggatatgtagggcattggtatgcacctggtctcaagtagatatcatcatcagctttaacatagaagtcagagtcatacaatgcatacgcagccttaaagtaagctaacctacaacataagaataaatcagcatctttctgaagaaataacaaaagcatatgataatagttctgctatttacgttttgtacggaagcttgctatactcctcctccagatctaaaagcacgaaatcatcgtattcttgaacctctctttctaaagctgccatcttagacttgtcattactttttccaatcacaaatctgaatgccagaccagttgcttcctccaatctgtaatacagtgaacacaaaaatacaactattgtaatggcagttagccaaaatcaccattaacggaaactgaaatacagaaacagagatggtgatgatcatctctttattaagaatggttggacttttggacaacaaaagtccacttaggctgaaaccgaagcaaaacagttaatggctgctcatctactaggcagcatggagctggtttcagctggcaggccgctttagtcaaagtttattgaacctacgaattaaatatattccggaacctccatgtgcattttcatgtacattgtagacttatagttggatctcacgacataagtactagagaaaaaaaaaactaacaaatccacatgatcaatcccttcttcaagaatagcagcataattcttcctcgaaaacaatgagaacagatggaatgaattaagagcaggtacaatagcaggctataagctagctgtaaacatattttaaagagataaaggaagagagagaagagcagcgggctacagatttgtagccagctacagcacggactccaggacataatgtgtgtatggtaggtgggacattgatagtatagtaagcaactattgtatgaattggctattagattggctatagatgaattagagctagcaatgggccataccaataagcagatctcactaaagcaaatacaaccttatagtgatgagtgatctctatctcatgtttatttgacaacgaaccgtaaaattacatctaagatcatagaaatgaacaaattagattacctacgtactaaaatctaatcagtaactatttccgctccactcccgtaattaggtaaccagcaacatcaacagttgaacacctaaaactaaagccagatctcgagcaacacaagcagacacgaactagcaaactgtgataccagcgactaaccgaaggagaccctgccgatccgcggggagccacgtccgccgcagcgcgcgtcgccgcccgacggagccgaacccggtgaagatcccgacgaaggccatcaccttgtgcctcccgcgcgacccggtggcgtgcgacgccgggagatccacggcggcgcccgccgccgccacggccccggcggacgcatccccgggccggcggtcccacgcgacggagacggagagcgggcgggaggagtccgggcagcgggcgcgcggcgcgctccccggcgaccaggagaaggagagcgcggcggcgaggaagcccgcgaggccgaagaggaggcaggcggcggagaaggccggggtggagaggatgcggcggagcgtggcgcggcgggaggtggtcgccgaggagaagaccttcggcgagctcggcatggcttcggcgaactcgccgccgcgccgccgcgtgggttgacggcgaggcgcgccggatcggagccggggggagacgaggagggggaaggggtggtggtggacgctgggtgcggccgcgtttgctgcttctcctcctttttgttttgagttggtagagagagagagaggggctgtgttgagcccaactggtagcccactaagattcagcccaagatgatttcaccggcaaattttggagggctgtaattcgaaatgggcctagaatttcgttcgaattttatttgaaactggaattgtacgtgatccttctgttgcgtattataaaacgttttcgttttgttctcaatcaagtttaatcaatgtagcaacaagttcaaaaaaaaatgtagcaactcttgtagtacaaaacagatatatctctactattataaaaattaaagttgtttttgcggtattttggtacgtcgttcgtatttgagctgattttaaattcgttcgcttttgaaaatacaaattcgtattttagtcggattttaagttcgtttccttttgaaaatacaaaagaagtcatataagaaatcccttttaaaaaacttgcatgctaacttgagatgaatgttgaactcctaattgcagctcatgattttctagaaaaaaaatatctaagcgaattcccacagtggatttcaccctagccaaaccgtataacaataataaaaaaattataatagcattcacccgttacaacacacgggcatcttttcaagttataaatatatatattattcggtcgtagatttaatgaaagtaatctggtgttctatatgttaatatatttttttttgaaaatctttggtttaataacttgaataaatttggcttgggataggaacgaagggagtatataattattttttctagttgcacacatacaactattatcttctttttttccgtttacatcaaatgcgtactcaagtgcttctcctaatacacgttcagggaaccggagatgaacaacaaatcccaacaaactgaattttattcaaatccacagcgattacaatggtaaaaccaagttacaacacaataattactgtattcgagccagagaaaattgtccgacaaatcaattgcagcacggttacatctctgctagctcttctgccgccgtcagctaagttagcttagctgcggcgcttggtcttgcggtggtggtggtggtggtcgtcgtcgtcgtcgtcgccggcggcggcggcggctttggcgagctcgcactggtcgatccactcgctgtagacgtcgatgggctcggtgagcgcgtgggcggtggtggagtagcgcgcctggcagacgaagcaggaggcctcggcgatcatgtgcttgatgtcgatgctgcactccaccgcgccgccgtggtcgcagaacgggcagctgaacgccgtctccagcttcggcgccgccttcttcgccgtcgccagcatcttcgacacccgagacttcctcttccccatctccgactccgacgccgacgatgcccttgctttcttgcttctgctcccggcggcgaatcgatcggcgaatgcgaaacgattgatcgagagagagatgcatcgtcgaggcggcgccgcgcgtgcttatatcgggagctcttcccagttcgcgtcggactcggactcggactcggactccttcacgaacacggcccgcattaagcaaattaagtgtccaattagtacggactaattaaaatcatttcttccatatcgattttgcaaatttgcagttcgttctgcggctacacttgacttggatcaagagatgatgattaattgattgattattaattaagcctagtgttttcttggtttggttcatgcatccatccatggcggcggcaggtggtgcagttgatcgatggttctagtggtgcaggatgggagggtggcagtagggtcccctgagccagccgccggcgacgagccggttcgccgcctccgtcgtgtggacgccgtcccagcacacgtgcctcgacgggtcacggcacgccgccgcgcccttcatcccgcaccgcgcctcgaactcgtagttgtactccccgccgccggcgccgcagcacgccgtcatcccgctcctgaaccctgcgccgccgccgccgccgccattgccacccccatcacatcagatcacaaccaccaactcaaaccaaacatgcctctccaagatcgattaatcgttaccgaagcgcgccggcgtgtgcagcatctgggcgaccatggtgtagtagtcggcgtacatgatcctcaccggcgccggcgccgccgccgccgccgacctgtacctggcctggagtccggcgagcctcgcctgcagcagcgcgttgtggtggatggccagatcgttgagcggccggaggcatccgtgctcgtcgtagtccgactcgttgctgctccggagcatggtcaggtagagcgggaagcaccccaccggcatcacccccggcaccacgatctccgccgcgcccatcgcaatcagcttctgcaaacgattgcaatcgcgcgcgaaagatcagatcgaccaagaaagtgaacaacattttctggatgattcattggttggttggttgattgcctcgacgccggtgatgatggtgtcgacgatcttgggcgtgtaattcctggcctgatcgacggtgaagccgaagaacagcatggcgttgtagtcgttgccgccgagcgagccgaacaggaagagtgacttggacaagtaggctctgcaacctgatgaacacttagagtaattagctcgtgagcgattgattagctgaagaaaaaatgggagtaattcgatcgatttgaattttgattcagatttagaatttgatttttaccctgtggttgtgtggcgcagatggaggggagaagatggtggaaccactggagctggacgttcatggcgccgttgttccagatcgggtagccgaggccgatggacttgaggaagtcgaagtcgagggcggtggcgccgacgatggccatgttggcgcctcgccggaagtcgccgccgccggcgctccgcttcgacggcggcagcagcggcaaccccagctcctgcgctgcattggcaatgcaggcgaatcttggcatcaatcagcaatggcggcggtggcgacggcggcggatgcgtgtgcttaccgaggaagtcgacgacgaggcggccgtcggagcagcggcaggtggggtggccgaagtaggtcatcccgtacggcggctgcgcgaacgtcagcagcagcgtcgccgccgccgacttgttcacgcagatgttccccgtgtccgccagcgagtccccgaacacgaacatggcgttgtacttgcacctcatcccaccatcgccgccgccgccgccgacgccaccggccaacgccggctgcacggcgcaccagcagaggcagcaaaccaccagcacgctgccgacgacgtcgacggcggcggcggcaagcgcgcctcctcgccgcgccatcactcgcaacgccacagctcagtgacgacgcgagacagtggcatacttacattatatacacttggtcttggttggtttaatgagcagtgacgtcacctcgccgccattgttgctgtgcttttgtacacacgtacacgtctgatatctcgtcgtcatcgttgggctaaggctaagctgcgcaacgtttgcatgttgcaaccgatagaccgggctgggccggcacgacaaggcccatgggccttactgggctatctcggccggaaagtgttctgccgtaaagtaagttcactttgactcccttaactagaggcttaatctaattcgtatccctaaaccacaataccgggatatctcgactccctaattactaaaagagaaagactacacaacggtataccgttgaatggtataccgcttatcccccatgacgcggccccgcgtgccggcttctcccgagtatgtcgcgtgctgctaggattatcatcacgcatgtttgctatgtgtatcagtgtatagtcttgttcctgacagctagctaatacccagcatgcctgtcctgcctttgatactagcctagctattaaataaaaccgaaagtactactagcttgctgtgcatgtcaaatccctgtaatagctactagtagtcccgtaccctagccatgtagggtacttattatggcagagcctagtagcctagctatgtgtttaagatgggttgcatctatttgcatgtgtcctataccatgcatggattagaccagacaaataattacctaaattatatatggatacaatgtattctaattagatatgtcatgttgggctcttggttataccacatcttagaaactctagtatgtgatatatagatgctagattatcatatctgatatccaagtactgggtcgaatacctaggtaccaagtatgaaacctataaatacaagatctgatgccgagttatcgggtctgatacctataagtaccggatccgataactaggtatcgcgtctgatacctatgagtaccagatcggatactcgggaatcgggtatctgatctgatacctatgagtatttgttctaatacctatgcgtaacgggtcgaatacccaggtaccgagtatgatacttatgaataccaagtctgatacctaagtatcgggtttgatacctatgagtaccggattcgatacctaggtcaggtttgatacctatgagtaccagatccggtatctcgtatgatacctatgagtatcggatcggatacctgggtatcgggtatctgatctgatacctatgagtatcaattctgatacctgtacgtactaggtcggatacctaggtaccgagtatgatacctatgaataccaagtctaatacctaagtattgggtttgatacctataagtaccggattcgatacctaggtcgggtttgatacctatgagtaccggatccaatacctatataccaggttaatacatattagtagcggatctgataccaaatatagggtgtgatggtaggagacttcagacgtgataccactaattctgatatttatgggttatatacttctattcaaccatcaaataaaaagatggaccatgcatagctaggccagaaagtacagccaaacttgctcatgtgccgctgagtgcttaattctaacttgctgacatgctttgtttaggctcatgctactagctctagtgcttaattctaactttgctagttgaagcaggtgtgagacccatatggacctaaagaggtgtagaagtagtgttgtattagagtatttcatagctattttgtactgtaggagaaaagagacctctcgtcagtcgtcactagtcagcagcctccatgtgaaaggacagcacacgacatgctttcagagagaaagaatcgatgagtgattggtaagtataaattataaactataccgttgagacggtacaccatcccatagtttttctcttattaaaaccggtacaatttaactcggtggttttcaagagcggtttcgttgatgtggcgtctacatgacggtattaatctggcatgtggcattgactttatgccatgtcaatgccacagaccaggtcaacagtgccacgtggacgtcacgttaatgaaagcatcctccaaaattatcgagggagttaaattacaccgatattaatagttatgagtcgagatatctagtattgtggtttaagcactggtttaagagtttaagagagtcaaagtaaacttattccttctgccgttgttgtcacgtacagccgtacaggagagaggaaattcggatggttattggtggctcatctgggtacacactacacagtattcaatggcgattcagagtactacacggcattgcatcattcaatcatatgcaacctggtagatcgatcagggagaaggcaccgcatttggaatctatatctttactcttcataaagaaactgattttaagccaaactttactctttagcatgtaacagtagtagtaagtacaggcttaaagatgcttaattttgttcttgcagaagagtttgttagccttggacagtaaggtggagaagccaaaataaaaaaaaaaaacagacagaaccaaaagggatcctgcattattttggtttggtatctaaaactggggtgcatgcatcatattcagacttaaagtttggccaaacttctttaataaagaaactgttttttttttccctgtaaataaactccaaagcaacatgcacagtcactcactctgtgtagcatagtttctgtaccagaaaaggaggtgaagcattcattcactagttccatacaagcatgtggtcatgcgatccaggattcctaacttgtattaaagtttttttctttctttttttgagatggcagcaaaccaagttgatgagcttagataagatcttgctcgcatttatgatttcatccggatccagcatgtgcgtatgtgaccatctccaaccaaaccatgcaacaaattactaagatttaattaattaattgcaacacataattaaattgcctcccaatctcatacatactacacaaatgtgcattacctaaaacaaaaacaaattaaccacccacaacgaaaatcaactaatcaccatcttattcatttcccagtcgatcgcaagatgtcttcttcttcctcttgctatccatttttcttctcttcttctgctaaacaaatcaaatcagcagcagctagccggccatcctccggccgccgtcgccgccgccggcgatgatctagggcatgatcggcgggtggcagtagggcccgttgacccacccgtcggcgatctgcttgtacgccgcctccgtgagatggatgccgtcccagctcaacgacgacgacgggttggagcacgcgtaggctcccgacatgccgcacctcgcgccgttctggtagttgtacttccctcctcccgccccgcagcacgccctcaaattcgtgctaaaccctgcgcaaattcatcacaaaaaaccgtcgaattaatcattcataaacttcaaaccatccaagaaaatccgctactatcgctttaccgttccagcagaatagctcatgcgagcatggattcagcacgatatcataggtagcagacctggtacccgtggtaccagataggtaccaagcacgatatcacgctaacgtcataattcgtaccagaaatactacaaaacgatataccgttctaatggattagctgacatcatgatgacgttaacacgatatctaggtactagatccgtacctacgataccatgctaatgtcgtgttgatgtcagctattccattacaaaagtatattgttctgtagtctccttcaattggtacgtaggtgtcatgctgatatgggctattccgttggaacgatattaccgttttgtagtgtttgtgttgaggattttttttttcttaccgtagttggagggggatttgaccatgtcgtagacgtgggagtagaagtcggcgtacatgatgcgagcccaggggtacttgctctggagggaggagaccttggcctggaggagggagttatggcgggaggagagggtgttgaagcgggtgaggcagccgtactggtcgtagtcgccggcgttggaggtgccgtacagcgtgaggtagatggggaagcagccgacggggagcacgccggggacgacgacgtacatggcgcccagcccgatcagctgctccacccccttcccgatcccgtccacgatggtgccgctctgccccgccgcctgctccggcgtgtacccgccgaacagctgcgcgttgtagtcgttgcccccgaactcgccgagcacgaacagcgacttggacaggtacgtcttgcaagctgcacgcaccagcagatcagaatgagatgatcggagttcatggcggctcgccggcggcgaggttttgtgggggggggggggattacatgagccgcagatggagggcatgagctgctggaaccactggatctgggtgttgagggggccattgttccagatcttgtcgccgatgccgagcgactggaagaagccggagtccatggtggtggcgccgatgatcgccatgttcgcgcctcgccggaagtcggagccgcccctcttcgacggcggcagcaacggcagcccgaacttctccgctgcaaacgcacgccaaaacagcagtgagcaaagcagagtttgctctgcttttttttggagggaaaatttgaaaaaacaagaagaaacaaacgcgcgccacaagaatcatcggcggcggcggcggcggcgcaccgaggaagtcgacgacgaggcggccgtcggagcagcggcaggtggcgcggccgaagaaggtctcgccgtagggaggctgggtgagcgtcaggccggcgggggggccgttcacgcagaggttgccggtgtcggacatggagtcgccgaagctgaagatggcgttgaacttctggccggagacggccacgaacatggcggacgcaaccgcgaacgccacaacaacacgcgccgccattgttgcaaaggtttagattcagctcgagctcgatgaccaacttgatggatggatgaggcaatgcaagatgctgcagggactccgtgagcttatatacacctcgctaatggtaggttagcacgtagctgttcgccattagcccacctcgagcttaaacttaactactagtctactactgctagtctgctacgaccaccttcaacttactcacctggttgttgtgcatgaattgcatgcatggatgaacagcttttgatttcttttctcgttcatctctctttccctcctgtttcctactctcgtgtttgatcatatcagtatcgaatctttgcctttcttttggtttctacacacttttgatgcaacatcttaatttgtttttgatgtatgtgctttaatttcctttttgcataagatgttttctgagttctgacaatttgctgcctgatcaattgctaacagtttgattagtccctgtgtaatttagtagtactgctttagtggacgcggcaatgtggcttatattttcgtcgtcttttcattatatgcgtaataaaaactgaatgattgaatgtgtgtacaatacatctgagttggaccagcatcgctggtgctactctaggacagtatgtttcataattgaaagtttgaaaagaggcacctaatcatgtattccactgacttattttaacacttggaatagccttttggattgattatttggcaagtacaaatatactaatgcctgcagaacaattttcattttttgtcgaacttggaagtgagtgattagtaaattaagtaggagtactaatgcaacctgaggctgtcgactctgatgaagtatccatgcattctggatgtcactacatgtctacatgatgtctgcttttgcttctcagtagagaaattcatgccattactgtttgagaactgaaaaagatttaatttgggatctgaagaaacacttctccttatttactactaccagcattagtcttcctgaacattgaattgtgtacttgcaggagtggttgctattcataactgtcaatctgtcatgcatggtgttattgacttgcctgtaactgctgaaaaagctttttagtatttatcaagaactttgttaggtaatccaactctatcatccaaaacagcaccctcgctctcatctacatgctgcatgattccacaaacgcattatgattgtcagatagtcattattcatatcagtagccaaaaagttatttgcctgtgatgaaacagaaagctagtctagctaagatagttgcttcatttcagcatcatccagctaaacagcactgatcatcacctcccttgatcctttgtgtcaattagacgtcaccctacctttcttcctcctcttttccaggattgggaaactgctagcaggtcaagcagcattgtcagcaacagcatgagtctgcatctactatcccaaaattatgcgcatgatttatatagttaaaaagaaataaaaaaatatagttatatatgtataccaactctataaagatataggggatgctttaactttatagggaagaatttgaagtggtggttatatttgtagtacttgaatctccattgatgcctacacttcaacataaaaaagtagggcacaacaactccaattagttcagtattgggcaaggcagtgacatgcactggctattatttggggataggttggatgccttgtcaattctttgagctaacttggcactggatgagtggatgggccatgcagtcagttattagccaaagtgtgagaaaactatgtttcttttttcttaaaaaaagtgtaactgattaactgaagcatcagttagtcagactgtttgatctaatatcaaccatcatctgctgtcagtttgtcacagttttgtcactcataatgtgtcaacctcagagaatggattaagctgtgacatatgttgtttgttcagagttcaggctaatccagagagagaaataatatgccattgtgttaccatcattcagatcaacatcttgcaacaatatatcatgcatttgctgatttgctttgcatggatggatgcagataactccatcatgcatgtgacatgagcaaagctcaacaactactaattaatttacaagattatccacatgagacctctgtctacaagaccaatgtcaaagcacatcttttgacaacttcgattccttattcctctagctgtcacacattcccaggaggaaagctcaattagcatctaatcagtggatcactgtatttgtttaatctgtcagctgtaattatctgcctgctaactcagtactactccttctggtttcctaataccaaatcattaacttttaaatacacgtttaatcaacattctcatttaaaaatcttatacaaatatataaaaaatatatgtcacatttaaaatacgtttaattataaaaacaaatcacaacaaataaatggtaattacatattttttaataaaacaaatttttggataataaaaataaattacatcgtcggtttttattataagacatacaaacattaagtttttttaacaaataaccaatcttaaagttaatatcatcgtatattaaaaaacaaaaaatatcatcgacgaatcggatgagagaagctggcgagtgtggtgtagtactagggtactcgcagaaacgtctcgtttcgctaacggacaagcgctccagtaccacgaactgctgcagcgactcgcagcgtggacttgatgcagagcaatttgtgcaaaatggccgtcgttttctgcggcatctgatactgtgttttgcaagcgaaccttccaatgtaactaactcactctctctctctcctgctaacaactcaatttcccttttctaacgccctggtttagggtcgagttgaagcaaccaaagagctttggtactctgcctgcaatttgtggttgatgctgaaaatgagatgtctgaaactctgaatattcaggtataaatatgtttgctagctgcaatttgttcgattaagagaatttaattttaccgatctcgtgaagtagtgtttctactaccaatagatactactgtaaaacggtatacctttttggtggtttctagttgcatcgatctaatatgttttgttttccttaaaacctttagctgatgagctttcctctgtccttccatgaatcattgcttaatccaccgggtgacatgttcacatcatgagctggagaattgaattccaatggatgatgcatggatgcaaccgacgatccatcgatcgagacggtactaaatggagaatattagtgcaatacgtggttagctgcaacgacgtgcatgcataatgcattgcatcctgggagggtacagctttgtgtacattgatcataagataatccaaatgtaatccaagtgtccaatagcctcacagtttcgatcgaaattgacaggttgaaaaatagcaagagcaactcatcactcgcatgatgaacgtgtagtgctatcgatcaacagtcggcacaaattggggcggttaatgtgtcaagttcagagatgaatctggcagcaacatgttacctacctggaagcgacgtccgttgattaattaattggtttatttagctttaaggttgatcctatcttacaggacaaaaatggacggttaaccgtttgagaaaatctataaaaagcaatcgattataccagaggttcagtttatggatgcatctgagaaaatctggacggttaacagttcattttccgatcagacggcataagttcttctgcctcagatggtcgaatcagaccagaggtataaaacaaatacactagaaaacaatgttattttcgaatagctctaataatctgaaaagaactcaaatctgatgggtgcaatcaaaccctgaagaatcgaaccggacattcacgaagaagaaaaatcaatgcgagatcgcccgagaccgatcattctggtgaaagtacattgcatttacatcacatggatggatggatggatatccatcctgcagagagcctgaaacctgtagctgaaggaggtcgatctacagactacagctgaggctgcaggaccatggttagctgggtgtccggcacacagtggtttcatcacttagaaagttcacagggatgcctgaattgctgactcgataggcatcataacagctgagattaattgtagccatcatcatcatcatcatgccaggacaacccaactaactgttttacatatgtgttcttttaactctttttctttcagcatgttcagatcagtacttcagaccattgtcaacgggagaaacagggaactaatctacatcaacattgtttacacatgtgattgaatgctttgcagagagcagatgctagttgctatctcatttttagaatgtaagctggttcggttttgttataagtcaaactttttaatttaaatttaattaagtctatagaacagacgtaataatattttaacactatatttaataggaaaaattgtaaccataccattataattttgtaaaatttgagatatgacatcctgacccacatgtcattgactcatgtgggttctacatgccattgagataccgatgccatatcttaaactttgaaaaattataatggtatggttccaaattacctatttaataagtgtctgaaggaaacgatggacttaataaaactatttaagtcatgtagatgtcattacatttttcgataaattcagtatgaaaaaaacagaatatcatcttaccttctaaaccggagagaacagtagcagcaaaaacaagatgggccaagctaatgaagtaaagttatacaacgaccaaaggaaaaggattaaaaaaaagacaataattgcttactcctacatggatcatggatgcatgtaggtgactgcatttctgttggaggtttgctgctgctgattgatgacgaagtttgattcaacttcttctccttcttcattcggcagtcaacatatatatcagtcatcagtgcagacggtcggtggatgcaggtagctgtgctgacagtgtgtatagtatgtaggtgagttggatgttttcagggtcactgcaggtggtgctcgttaaggcttaaatcaataattatcgatcgcgtacacgtaaccatcagcttttgcatggcttaacatgcatgatgcattattacgggtataaatgtgtaatcagtacatgtaattagtcaacacggctagtatttagatctttgtttagatcatggaccatctatgattcagctagctaacctttggtgctctggagcagtgtgcgttgctttcagtaaaggtaggcaggatgttgattagtgaaatgtatgtatctgtctatatatactacgcatataaaatactgcatgagtttgtcggatttgtcattgtagtgcgtacgtttgattaatttgatgttaaaatcaaccatatcagattataatgccgtaatttagaagtatgcaggttatttagttgtacgcttgatttgaagaaaaacgtcgaacggagttttatcatttagtaaaaaataatttattacttactaaaaatatttcaaacagatgcaacattaaaaatactaattgcaacactaaagtaaccactgcatgcaacatcgaagaaaaccgacactacttaaaaacaaagtgtttttcctgacggctactttgcgttctctatgacggccggcgctaccgctagcaactaaaggccaatgaaaatgaaccatctttacaggcggaacttcaccacagttaggttacgctgattgttagggaaaatgatttttgatcacaaaataaaaaatcacaaatccgatgcctggccgccaggaaaatatgattttcgagcgaaaaagttccgcaaatccattgttgtgcccggctccgccgctggatgcgccggttgcaccccgagtcatcgctggatccaccaccccaagccgccggatccacagtccgagccccaagctgctgcctgttcgccatatgtgggataggggagggggtggaaaagccacgccgaagcccagacatcgcgttgtcaagcaccgctaccgccatattcgtcccctccaccgagcaccgctgctggagagaggtgaggtaggctggtgtgactggatctcagagagagagaggggggtgaggaagacattggatttagagagggttggagaagaggccgcagcagcggcggtgggtttggtggtggcgggggaaagggaggagcgagggagaggagggttggtggtggccgctgcaacgacagtggtaggacgtggtggaggagagggagctgggtcagggcggtgacggatctgccgccgaacagggtcaccgctggttgtggatgctgccacccatggggaaggaggaggagacaggcgcgctcaagctcatagtggtgccgatgaggaagaagaaaaggtaacggaggagggaggatgaagtaaaggagaggggacttaagtatcggaaattttttttaaaaaaaaaatcaatatagctatttaaaacaactgttttataatttattttacataataaaaaaatagtttagcagtttgaaaaatatatactcaaggaaaacgaagaatgaagtattgacggtaccaaccgccacaaccaagataggggtcaaatggttgcacgcccagctcagccaacccattccaaaagcagaatcgtcttgttaggcccagaccgctccactgtcgacgtaggcctcgtcggccgtttgctgttgtactcggcacaggtccaggttcacatcaacaatcgggtatacgcatctgtactggtgccattgtgtttggcaatttttttgtctaatcgtatctcgcgttccagtattaattatcagccatccgtcctcgtgtcgcaaaaacatgatagacatgcagtttaaagtgtacgattatgtttacagcttatttgaaaaaaaaatgattatgtttacactacagtgacgtccaggataatggtcaaaggcagcatttgtccagatcagcccagcccattccatggtatcttacctcaattacaaaataagttcattttaactaatctcacatatacaaatacaaaatctcaaaaactagaatattcatattttatcaaatcccaatataatttctctctgtccaaaaatatatgagattttggtcggatgtgtcccaatctaagctagactcttctgttcagactcgtagtataggatgtgtcacatccgactaattttttttattccccttaaaaaaatcttttgtattctaggatgggtggaattttgctcactttatctactcccaataaatcattccctactttcataaattcctatgcaatagttactccgaaaatacactagtgtataactttgagataagcgaaggaagctactccaagtcataagtacaaatgaacttagtatagaacgaatgatacatactgaaataaagaaccgcaccaagcgatgaatttttttaatttttaattttatttattaaaatatttacagaaataatttttgatttgaaaattttacaaaactagtcgtccatcgccctctgggagagcgattttactaacgtggcagaaagccgatggccctcctgtaacggttggccaccgagggatgggaaatttataggcggcccccttatagccctctgggagggcgactttttactgtgcagggtctgcctgcatagtagaaaatcgtccacccagagagctaaagggggccacctgcaaaatgtcacctcctcccgtacagtacaaaatagccctcctagagggcagtaagggagctgcctgcaaaaatgccaggcagccctcttagctcttttgcaagcggccctctagagcaaaaatcgccctctgggagggcgacaagggggcggcttgcaaaatttcagcgcccttggtggctgaccgttatgacaagccaacagccggctaccacgtcggaaaaacgctctctgggagtgcaatttttcccagaaagcgatgggcgactagttttgtaaaattctcaaaccgaaaattatttctgtaaatattttaataaataaaattaaaaataaaaaaaattcccaagcgatgcatagcatgacccatcagatccattttgttaggcccagatcagaccactccactcgtctacgtaggcctccttggtcacagcggccgcccacttctgcccaaatcgcatgtcccgtccaggttcaccgccacaaaccggccgggtggacgcatccgcactccactccactccactccactccactgcacgccaacgcccaagcccaccaacccaagttgagtcgtggcccccccttcgccctctcctcgggccggtccacttttgcggccgcgcccgcgcaacgcggcctctctcgtgacgcgagcccgattcccccgagccactgcacctgtacccgacgcgcgacgcggcacaatgcccgcctcacctgcacgtacgccatgcctcccacccctccgccgctccgcgcgcccatgtgtccaagattccggaaccgacgacgtacgtcgacgtacgtgagccgccgccatggattcgctgcctatatatacgcacgcgatcg

SEQ ID NO: 61499 - DNA, 19330 bp, Oryza sativa
  unsure (1)..(19330): unsure at all n locations
ctggccaaccactactcgcgctccgccaacgtcagtgctgcgcgggtacaacggctacaacacacggtggaagtccatggtcgccgcgcgcgccgtcgtcgccggcgcggcgggggcggcggcgccgccgaccgccgtcaccgtctgcttcggcgccaatgacgcctccctccccggccgcgccagcgcgctccagcacgtcccgctcccggagtacagggacaacctccgcgccatctgcgccctcctcgccgccgcctggccctccgtcgtcgtcatcctcatcaccccgccgcccgtccacgacgccgcccgtgtccggtatacacaatcgctctcatcttgcatcaattttattggttttctcgatcgtcgaacacaatgcaagaatggatcaccaatggcgcgccgccgcgcgcgtgcaggtaccagtacggcggcgattgcgccggcttgccggagaggacgaacgagtcggccggcgcgtacgcgcgcgcctgcgtcgaggtggcggcggagtgcgggctgagggtcatcgacatctggtccaagatgcagcgattccccggctgggagagctcattcttgaggtaatcaaatcaaagcaaatcaagcaaacacctcatcaccttgttcttgtgatgagctgctgagagcaagtttagtactgtagctaactactagcctcaaatcacgttaacaactaatttatataataattatctataaacatatactacattattaatatatgatcccacctatcatatatacattatgttttggagtccgtgtttcaaatagctacaaatctgtagtttgccttttattttctcttctattttctcttctcaatatgtgtttataattggtttatagtttactgttatacccgctctgatgaaatttggcgcgaaatttgaagggacgggctgcacctgacgccgcgcgggaacagggtggtgttcgaggaggtggtgttcgcgctcaaggacgccagccttggcctcgaagcgctccctgccgacctgccgctcttctgcgacatggatccaaacaaccccgtcaagtccttcgacgaatgactcatcatcgcaaaaaattcgcattactgatttgagaaagagaatttgaattccttttcgttgcgttttttttaatttacggtgctatttgctggagaaatgtttgaggttataaatgtctcggttattattgttttgattctttagaaagattggatgaataatacatgtatcgaccgtattgtcatgtaatgttttctttggacaatgaaattcaatacacgatcgagctgagctttttttaagataagagctcctgcttacgggccattacaacaagttcagaaacaatgatagcaacacacggctaatggtgaaggtacattgtttaatttggtggacttgcttgtaaaccgttgcaacttttgtcattctgaccatttcatggatacaaggattgttaggagaaatgaacagcccataatatgtttttttttaaataagggaggccagaggacttcgccgggcagaaacaaaccaaataaaaaaatattggtacacgctgtgaattggattaacgtccaaaatagcctaatcaaatcgtttctcaattcatacttactccctctatctcaaaatatgttaaccaagaatgtgactagtgtcagacgtaacgtagaggcggagaggtctttaagcctccactgtttgaaccatggaagcactccaaaaaatatatatatattgccacacctccattgaaaggcggggcttggaccttggagctctattttagtttcgagataattttgttcttgtctccactttgatgtctaatattgattttgcccttgttttttagggttttcgtttttacccctacttttttgaaacgaaacaactatttgccccagttccattaattcttactaatggtgttaaatgtagggttaaaaagacaattatacccttagatattttccggtacttttgacaatcaaaacacaaattgataccatactatagcagtaatttaatttgtcaaaattttgtgaaagtttgccaaaattccttatctcaaaatagggcaattgtgcaagtggtgtacagaagtatcagaatcgctctctctctctctctctctctctctctctctctcctgtcctacccaattcccaatcttgctctcaagccgtagcactcagcatcgcagcggccgggacaacggcgacgaggcagcgcaacgcaacggcggaggaggcgatgaggcgtagatcccccccaggtggaggtggtgaacgattgaccgtcgacgatagaccggcgatgcgccgaggcgcggccgagcggagccacaaggcagcagagacgacatcagggccactgtctagtgtcgaaggctccaagtccaagggggaaattaatttcaagacttcaaggtacataaaatttgaaatcaatatcaagtccagttgtgtggtaatagttaaagttcagtgctcagttaaaatttgaaatcaatttcaagtccagttgtgtggtacggagtaatagttaaagttcagtgctcagttaaaatttgaaatcaattttatgcttgatttaatgctttctgttgctactttgctgctcacatctcaccaactgagtcctataacaaacctcactcatcaaatccaatgatccagaatcatctaatccaacgctttagatcgtcccacgttacccctccccctccgcacgcacccctcctctctcagatcaatttcaatcgcgccgccctcctctctcggtcactctcctccccctcaaccgccgccgcatccgccaccgctgcctccacgtccccgatccacgctgcgccgtcttctacgccggtcgagatctccgccgtcgtcgccacgcacagccacctgagctgccccctccgaaatcgccataccctgcacctgagtcaccgaggtccgcgccgccaaaactccgtcgcgccaaccctccatccgctatccccgtcgccatcggccacctcctctacggctgtccctaccacgaagactgcctcctcctcgcttgcatcgtacatttgaaggtttccgcctcctgattctatccccgatcccccaaatctctaaccccaactctttgcagttcaacggagaaggccggtgtcttcttggtccttccgttctgatctccattcctttactccaattcccattctctgattttttttctttgttatttgcgtgtgagggtgggcccaccagtgattcaagggtattcagacgtatacccaagatttttgaaaaaaaataagtatatatactccatacctcgtatatgtattaaaaaattaaagagaaggctaaaacttctcattttgggtcctgttttaccatttcttctctattggatctaaatttcccacttccttccctcccctttcctctcagcccacactcagcttgggccgcaactagttcatttcccctccccgcttaggcacagcaaacccaaatcgggcaaaccactgaggacgtgcgcggtgcggcggcggcgtctgggcggcggcgactgcaccggctgcggcggcggctgccggctgcgtcggcggcaggcggcaccgaggcgagtaggtagcgcgtcgggtaggggtgggcagaaaaagaccgaaccgaaaagaccgagaccgagaaattcggtcattaattcggtcctaggtagtgaaagaccgaattttgttcggtcaattcggttagtctcctcggttaaccgaatggaccgaaaagaccgaattatcaaaaaaaacgtctaaatgcaacatacaatccactatgtttaataggattaaactctaattttcacatccctacttcttctaggcatgcaacctaacaagagtctttactcataagtgcttacaaattttttttttgatttttgtgttgaaaattttcattatttctttgcatatatgaaaatgttcttgaatttcggtcaagactgagaccgagacggaatttgtcggtcctaacattttttttcgctgaaattcggtttttacttttcaaagaccgaagacggagactggaattttcggttagaccgaatgaccacccctagcgtcgggcgtgcggcggtgactgcagtccagtctgcagcgtgctcgtcggcggctgcggcgtgcgtggcggcgtcggcggcaggaggcgccgaggcgtgcaggcggcgcgtcggcggctgcggccgtgcggcgtcggggttcgggccgtcaggcgtcggcgcgtcgccggcgtgcaggccgccagtccgctaggccaccacacaggtacgcgatgcggcggccgaacgaccacggctcgccggcctggcatggattgcgtgaggggcttgattcattgcattgatttgttctaggtagttcaatagtagttatgttttctggcggtgacggcttgattcattgatttgttctttagtagttcaatagttcactagcactgaaggattcaacttccttagttcctgtcttctttatttttcagtgtcaactgttaagtgtatatttattgacagattgatagtataaagctgtaaatattaggaatttagataacttagaaccataatatttaattttcggagtgtaaaatttatatatatgatgatagtatgaggctatatatgagctgctgttaggaatttagagaatttagagggggtgttttcttcgatggactatataaaaacaagaagcaagatgagcaacaatctacattcattggaagagaattctttttacaaggtaaaggatgaggacatcatcactcatttttaaaataccaagcatcgaaaagttctcctctaaactgtaagagttttttttatcattttaccattctccatcctttacatgttttatatgttgccactttcatatgtcgaataattagtacttatatatgttaaagaatttggacttatgatcaattctaccaatttataaagttatggccaattttgtgttctatatgctataatattatacaattagtaatgtgtgatattataccaattaattattggacttctggaggtaaaaagaattttgttttacccctacctattttgaatacccaacctctaaatcttaggcccaccccttagatatatgataagttcatttttgatgttcttattaaattctcaaaagtcttagcattgatctgaactctgatgaacatgttttctatatttggctttgttcaaaagattgctacctttcagaaggcatcttgttatcaggtagtgattcacctaagcatgttgctcatggtagctaagcatgttaccatcataattgtaattcagtacgctcaactgattctatgataaataatgaatccatttcagaaatatataataataatatatatctttgcttggatatttggttttcaagatatttcaacatttgtattgccaacatatatatccttttcttttaattgtttgatttacacgcattacgatattgtgtcgttgcattagcacgtgcatgttactagtattattctagtttaagaaacacaaataatgagattgcaagtcagccaaagaggctagagcagaagttagtcatttggatataattagtgacccagggattcgaaaaccaattgaagattatccacgtgagcatcgcattatctattggagaattgttttgtagggacaaaattgcttgcctatttttaattttatgtatgtgtaaatgtgtagccaatttatacatgaaacatgttaatttttttctagattcacccttgttttcagccgccatggacgcggcggaaggtggaggtggcggccgaggctggggtgacgccgtggttgcgctgccgtcgacatccgcagcagcaatggagggctgagagagggcgctcaccccgatgatagcgtacaaaggggaggaagaccttcgacttccagagcggccagggtttggttcaactggaagggaagtggttgtcaccaccaaccacttccatgttggcgtcgagaacgccacaatctatcagtataatgtaagtttcttcctcacagtcgcataatattctactcatctttagttcattttagaagcattcgcttatttcatactactactaaataaatcttgattttatattgaacattcaaagattcgttttttaataatactagttgggtgcccatgcgttgcaacgggcaaaaaaaaaaaactatacattaattttaaattacaccaattgaaatgatgggaaataatcattgagaaattttaatatagcacaaacaagaaatatgccataattttatagtcttcatatattagtaacacaaagagcaaaaatggttgaataaaacgctcgtaaggaagcacaaccatgtatgtaaatatttcaaatcatagttgtggttcaaattttattgtattggccgtaatcgtgaaactaaatagacaaaaccatccatagatatcacaaataatttttttttccaaagtcttcttaatagattgtgattttagtaccgacgaagttgactacaaatcttagtacattccacaatgtgataaattaatttttgagcatttttttccactgacttcatgattaggtttctatgaaccccgagccaaaatcaagagctaaaaaaggagaggtactttcagagatggtagagttgcatgaggagatgacttatgactgcaaagtgcttgcctaattgatccaggctgcttatgggcctctgccttctgtcccaatgcccatgacactacaccctccttttgagcagctcatcctcaagctgcaacacgatctttgttggctgagacaactccctaaacaaggcctaacatgactcaagccatgcagccgctgcacattgcttcaatccatccgcctctgaaaatcgtgccgatgcatgacgaaacaaagccatctcacctggaaatcgcgcccaaggttgtgtcagccgttgcgccgcaatcaccgcagtcgttggtgctagaggttgtgagccctaagaaacggccctgctcgtggcatcaccctgcatcgcggtcgccgacgacgacgtcgttgccaagtccaacgtcgaggttgagggcttcctggacctggccgttggtgacacgaatccacctgcctggacaacttgaagtgacgtggacacggtagtggttgctgatgccgtgtgacgatgaccttcgtcagatttgttgtgtctcctgcttcttccagaggtcagccgccatcttcgcccgaggcgatggtgccacagccggccttgtcatcattatactcagcaccatcttctgctgcactgccacctcttgctccatcgcgaaggctgccagcgggaacggctgagttgaaggtgcagtggtcagagatgttaacatcgtgtccacaacctgagtagaacttgttgccggtgccatgaagtcactagtcaagccatcgccaaacgacgtcattgctgtcctccttgccgaagaagaatgttgtccatctttgcctccaagacatccagcatctctaacttcttaaggatggccgtcagcttgtcatcgatcgacataaccacaggcgtaggagattctaggggtggggaggggggaggggtggggggaggttcttgtcaggttttgaaaattcgaggggagagatgtctggttttgagtttagaggtgttatttgtactcacctaatagttcgggtaattcgtacttttctcataatttaataatgtacatcttttgtgataaaaatgctactatatactctctccgtttctaaatatttgacgccgttaatttttttaaatatgtctgaccattcatcttattcaaagaaaacaaagaaaacaccacattaatatacatattgcggagagatacactattatcgtctgttacaaacttggtcattcttgtccttttaggccttcattactaaatacagagatgatcaaaccatttgtgtataatacgaagcatagctaatcttcttcctttttgaaaggggaagcatagctaatctgattgttcaaataatggcgaccacttggcagtggccgaaatctcaagaccgtccatacaactagaacagcctccacttgcagtagaactcccctcgttctgtggtacaaacgacatactcccaaacaacacatcctcagtgacatgctcaaggagatcattaacaccaccaccatgactaaagctcttatcatttgaagggctgttatacgtgaagaagcgaagcaacagaattccatcaccgtccacgcataatgtgaccgggggcaacttgccaacgctcaacttgccgtcaaatatcatgaattgtccccactgtacgcagtaacctgcaacaactgtaagtgaatcaaaacagttctctccgagatcgagtacctcaagctccaatgtgcccagtactgccttatcaagggcaaccatctccagagcaacagtgccacaatgaccagtgtcgatgtgccaacggtatctatgaagttctgaatagaacgatggggcatacatagaatgcccgtctatcaacactttatcgtctttcctttcttgacccttaatgacaaggtagtattcgatcaacataggcccaactgcatatatgcctctaggtggccaaattagaggccgtatcttattagagccctgtgcagtaatttgtgaaagaaacatcaaagttattagacatacgtgcatcaaatgttacaagaataaaatgaagtattaattctagtgcctaatcatctggtacataaaacacttgtcccagagataatatattggtgttttaaccactaatccctccatttatgaatataactgttggtgtctattactattttgactctgaccgcaaattactcttaaatgattagagtttgatgaatgagagcttcacgtttgtatatatttaagatgccatacactacgaaaatatggtgtacttttttttttctttttgcgacaagtggacaaagttaaaaaatgaataattcccaatgtcagttatttcaaaaaggagatagatttatgtcaaagtttaaagagcacaactacagaaaaggaggggacccttttaagacaaaaggtataaacaaaacaaacttagtcatgaaatctctcaccggccgaagcttatatggtttgtccctcgagtattgaaagacatgattacgttgttggttgtttcgtacatctctaaatgcaaatataccgtagatctccattggttcatcatggggggacgatacattcaaatcatacacctggattgcacgccgacaaggttcattcctgtggttgtatccatttacccaacgatttttccactttggcagctggggcactgcaacaggatttcaataaactagtattacagacacaaacaccgtgagtcattaacttgtatcctgcattctaaacattatacaaaatctgtaatcaatatttgtaaactatacttccacatgttatatgtaaagatatagttcaaacgtaaaaattaagttgttcactagaaataataataactaaatggacaaaggccatgtttggtgagattgagagatcctgggtagctaggtaagaatatggataaacaggggctgcctagcttttggtagctactactaagtcttagaatctccagcaagcatctggattatttgagagaactggatatgaagctctcctaaataggatctaaaaattgaaggaaaaaaaactatatatgatcatttgtgatttatacaataccttgcttatataagattaataaatactccaattatttactagaagatgtagcatgttaagacttacatagatgctccgtcgacaggatatctggatccaaatgacatggcccttcaacatgtagagacccctcaaaaataggacaaaagaaatcattttgtcgttgctttgcaattgatactgtgaacttcatttgctccataacctgattctcccatctctcctccctctcagcagcgtagtaaggatttccatcctcgtagcggaattcataccagtatccgtcgaaagaatcgcattcatctggatcaaccgagaattcactttcggactggtaattatcttctcgagggcaggcccagcctggaagtgtcccttgccattcagattcttcattcagaatagagtccatgtccttgccccagagccaagtgttgagcacctcacgctccaattcctccctcatcatccccaaatcccggtccaaatcgtcagcctctttctcctcctcctcctgctgcgaattcccgtcaattttactaaaacctactcccgacattgattcttggggggatttcagccacaaatcaacaagaatcgcgaagcgggacgggaccaaaaataatttgaatgcctaacctttcctccgtagcttgttggccccggctgctctacggattgggattgcgattggaaagaagcatagcagcatcgagtgtgtgtatgtacagtacaggagcaaatcgcttccaacacggactctgactctgagatgcattgcgaggcggctagggttttccttcctttcacggacgggaaagcagaggcttttagtgggcccagcccagcccagcccagcccaagcccgtacaagctgagctctttctcattgggctacatctcagaaaggcctgtttctgagactcggctcggctcggagccgacgtgcctccaccaccactcgtcgcacgagcttggcgaaggtggagggagtggctcgtgggcttcctccgcggccgacacggcttggcgggtgggcgggcagagccgcgtcgggtagcctcctggtggggcggagccacccccagctgcaacggccccagcctcacaaaggtgacatagggtgaatctcagccctagaaagtaaatccaatggctaagattcgtccacataatcacgagttaaaattttactcccaatacctgaaaatttactcctagtaaaatttttactcctaaataaatctgcgagtaaaattttaactcatgatgacgtggatggatctcagcagttggatttgttttggagggccgagattcacgctatgtcacattgtgacatgcctaccttatgtcacccaatcccaatccgagggagagagagcagtggaactgaggaagagataaggtggagactaaggataacatgtggggcccactttcattttttgctacatcagtgtctagtcagcacgagtggatcgggtcaaattgttacgtcaacaaaatcagatgtatatactgctataggatccaaattggatggttttgtatagtttaggggtgaagatttctggtattgaggataatggatgtcaaacaaactcagtgtaaagttgagtgacggcaggtgaacttatacctttacttgggcatcgggttgcaggaacggaagaggaggaggaccaacaacgcttcctcctcaagctcatgccttccacaaggaccatcatcagcgtcatcggtcggtgttcgcgtccgagctacatagcggcaggcaggaggcggaggctgacacccatgacgacgggttcgctggaccaccacaaatttctaaggctctctgatcaagagcccgaggagtaggttctatgtgagttttatttttttatgtcacgccatccaaaactatactcaacactgagacctaatgtgatatgattttataaggttatggatgtgttatatccgatattttgatttatgggtgattttgaaattcgacgacatggaacataaaagtgaacattttctttatcccatgtaaatagttaatatgggcagattgtcgtgaaggccgcctacattaactgggtgccaatgcaaacatcgtaaaaatggcacaacacgtgtggtcaaataatttactcgggcagtacttctctatgtctgctcaggtaataaagtatttttcctttataaaataatctccataaacttaaaaatcttgtagaaatttgaatttagatccgattgacacggtgagcacttctacgtgatccttgcggtattccctagctttaaaacggcatgctaacaacttgtcatggctacctcttttttcatttggttcttcacgggcaccggaatttccgtatgccattagctgcagttggagcaaaaaacacccatgcaaatagcacatggccttagacgccatccaacgtctagagatggtgcaaaagcaaaggcaacttacctccaccgagctgagcctaagaaccgccctaaaacacaggctgctagggctggcagtaatcgaaagagcaaggaaaagacatgcctcaagaatcaccaacatcaaagaagagggcaccaataccaggttttttcacttaaaggttaacgcgaggagatgaaagaaccacatccattgttttcacacaaggcggatgggcggtgacgcacgaggaaaaagagcgaaatgatatttgatcacttctaggggataattggaagacctagtccaagacaacggagttgaattgggaagcccaagagattcagccctcgatggaccttgctgtccaatctgaaccattcactgaagaggggatttggaaagccataaatgcaatgcagtagacaaagctcctggacccgacggcttcacggtcaatttcttcaaaacctgctggggcatagtaaagcttcactccatccatgatcagagatgcaatgatctaaaccttctcaactcggctaatactgttctattaccaaaaaaggaaggcgtggagagtagcaccgacaataggccaataagcctcatacacagcattgtgaaaattctcttcaaggtgctagccctgcgacttcacctggtcatgcaatccctaatctcggtcaaccaaagcgctttcaaccgtggcaggagcatccacgataacttccattatgtacagaacatggtgagaagatgccatcgcaacaagagcccaactctattcttcaagctagacatttccaaggcattcgactctgtgtgttaggcttatctgttggctcttctacaacagtggggcttcccgcagaaatggagggattgggtcgcagccctcctctcaacctcttgctccaagatactcctcaatggggtcccaggaagtaaaacatgtcatgggtgtggactacggcaaggagacccattatccccgcttttctttattctagcaatcagcccactacatgccttctgcccgaagccacatacctcaatttgctcagcaagcttagggctagggtcggtcaccatgcctctgaatctcaatgtacaccaacgacgcaacggtcttcatcaacccaaagaaggacgatgtagatgcattcgctggcctctgtgaatgcttcggacaagcaacagggctatgcaccaacatacaaaaatctcaggtgaagccaattaggtgtgccagcatagacctcgacgacttgttggaaagcacgccgacgaccagagcaagcttcccaatgaaatacctagggctctccctagccatgacaaggctacacaaggcagacctccagccactttttgacaaatccgcaagacacctagtaggctagcgaggaagaaacatagggatagggggggaggggaataacactagtcaagtcaatcctcacgtcagcaacctgtctactctggacaactctaaaagttacgaaggaatcccttgaggtgcttgacaaacagaggaaacggttcctttgtgcaggggccgataacatcacaggcgaaaaatgcagggccaactgggcaagaacttgtatgccaacagcttatgaagggctaggggtgttcaacctagaaaagtttgcacgagcgctgagggtaagatggctatggcatgagtggaaggccccaaatcaaggagaaagccaaaacttgggtctcagcaggagcaaaacaccttgcgcttttaattccttaggctttgccattttttacagttctttatttcttgtaaatgtaacatttactcctgtgctggttcgttaaaaaaaggtatttaaggataattcggttataatataaccacggtcatctttgcaaactttattactaccacaaccataccgatagtccacatcgtaggctcgcagctcgatgagaactgaacttggctcaattacaacttatacaatagctcaccacaccatacagctcgatcgattagcttagatggtgtttgggtgggaggggctaaacaaaagcataagtctctagaggagagacttatgtttttgtgagagggactaaaataagtccctcccctcccaaacaccaccttaattagctgcgcacaacaacacagtgaattaattagtagttactaattgattgattccacgtagggagttggacagcctcatgcaaaattcccacaggatcaatcaatggtgctgaggatcgggccccccggggctcgacctcttcgactcggagtacggcatcgccgccgccaccgccgtctgcgagctgatcgtagtggcagtgttgctcccggcgacgacgagcattctccgcccggtgatcacggccagctggagctgcacatgatcatgatcaggctcgccgcgcgagacggcggcggacatgacgacgagcagcagcatcagcacgacggcggcgcgcaccagcggcgacctcaatgtgctggatgaggagtaggccatggaaaaagctagaggtcttcttcttcgtctaatctcctagcttagcttagcttgagagtgagctagctgtgttctcaggcgcaggttgcaatggcatgcatggtgctgaatttatagctaagctaagctgatcgagattcgaggggcagtttccggccgttaccgtgagcactatcgagctagcgacaggtgtagagagtgatgggtggtggtgatataccggaagtggatttttgtccctagaggagacattccctcgttttgtgcataatgtttaaatagttattaaaaaaatttaaaaaaattgtcaagatatagattaatatatgatatatcttttcgcaaacatgtaagttaaaattcgacttatacgattcgaaacaaaaataataaatttgactgtgaattacgctttctattcatagtcaaattttttgtttttgtttctgcttgtataagttgaatttgaatatgcatgtttgtgaaattttttcaattttttttatgactctttaagtgacaagtaaaaacgaggggatatccccttaaggatgaatagagttttccgtgatatacctctgtggcgcactgatctctgccattcatgtcgacgatgcatgcatatgacctcacacacaaaaacggctcaacttttcatttttaattctgccttaacaaggcagtgcaaaactgtgatccaatacaaaatccaatgctatgcatgctgagatatgatcgattaatgccattatcatttctgttgcatagtgatcacaataacttaagacatggatgcatgcatggtcccttcttgatatatagtaagatttttagggggaaattttatgagcatgttgcacgttttagtgggcactggcggttgtttagttttgtttggacaaaaaaggaaaaaaaaaaacacaccaggccgttagccaaagcaactgccatttatcgttatgaaatggccactatatatatctatatatgttcattaattcataagctagccaagtcagctcacacgaatcagcaagcaccgtgatcttcagccggatctcatttgcttctggttgccacaagcatcgatcatcaacttttaaatacatactccctccgtctctaaatatttaacgccgttgactttttcaaacatatttaaccgttcatcttattcaaaaacttttgtaaaagatgtaaaactatatgtatacataaaagtatatttaacaataaatcaaatgatatgaaaagaattaataattacttaaattttttgaataagacgaacggttaaacatgtttgaaaaagtcaacggagtcaaatatttaaggacggagggggtaatggagtatattgatatatatacttgatctttattactctcttcatgcccatttgtcaacgtataaattatacaagttcctccacgtacaaatccactttcaaggagtacctgcagtacacaaaaaaggccttgttaaaagccaaataaaggcataactaaccaacctatgtggccatatataggtgaacatgcatgtaggtgatagatcagagagtacaatatgcagtacacacacattcagttacctagttggcctcttcttccttaatttttccctttaaattttcagagacccatatatgcatctccgtgtcattttccactggtcacaaacggaagcaatgggcgtacgcgaggccgccattaatcgcgtgtgtgttctagctatatttcttcttttgctcaaccaccgggctgctccaatggcggccggcccaggaggaccccatggctctgtggccacgaacttcacctgccattggaggctttaagctcgtcgacgacgacgaccctgagggcgacgagcagccacggtttgctgcatgcggcgcaaggaagaatgatgaatgcacacaatgggaaagtactctgttttctatttatctctcaaggggacatcctttttgttttttccatgccgcctaagaagtcagaaaaaaaattctgaattttgttggcaaggtatatcgatatgtttatatcacactataaatatgcaagtttaaattcaaaagtagaaaaaaagttataaatcattattcgtagttaaatttattgtctctgtttctacctgtgtaagtcagatttaaatttgcatgtttatatagtaatataatgcatacttgatacttccttcgtttcaaaatgtaactatttctaactacgaatttgaacatggctccatccaaatagctatatgttgggatgggagggagtattcatctattataattctataggaggacgacatgcgcaaatggaggacgtctcctggagggggaaaaaccatccacataattctttggtcccaactcacaatgggagatgatagtaagaatgtgtagtacaccgagctagttacatgcatgcatccgggagacatgatggtataaagaaacccggcagccaaatgtgtttaatttcacactgaaactcagcagccaaatgtgtttaattccacaccgatataagattgggccagtagcatgtgtcggcaaacattttaattgcatttacaaactcgcagcttgagctgtataataatcccaggagggaatgtgcctaacaactaatgacagtatttatcacccccagctcacaaaagttgccaaaatgatcctgtgagtcatctgaaggccgtcaggttttatttctgacttctgagtcggaaccgattctgtacttctgtatgcgtaatgctgcactatctatccaactttgtaaattacagccactttctgatggatgttgttaccatgttatcaatagcaacccagggaagtggaaactggaaaaagaattgacattcatacagctaggaacagcaggagggtaagatagtgagtgctactctgggaggaaaggcagcctgctgacaccgttctgtttatagtccatgtcatctgaattgtctgaatctgtgagctcagttgcagcttcttgcttgacagacttgccgccttcttccacgcctacgaattgcggaagaattctgaggcatgcgtttggctcctggcctatagattcccacttgagcttgaaactttcgactagatccacctgggaagcgatgatgcttggtggtctgggcagtagctgcacgctttcaccttttgggatcactacttgctcgattgccaatctagcttcctggcaacaggagatgattgtttatgttattcatgaaggtgttgatcagaataggtcaaaactgctatagcaatggcaggagagataatgtaaaggaaaatggtaatcatacctccaaagcatcagtttcctccgaagatctcacttcagtatcttcaaaatccatcaacccatccgtgtgatcatcaacaagggcacgaagtgcccttctgatttgcaccagggagtttgtctatacaaatagttagccaatatcaacattctgtcacatcaacaattaacagtgccatgaaaattaacaatgctctatacaaaccttggtgaaaaaaacaggtatatcttgagacttcacaacagcctgaatctgggtattcttcttgagcttcgattgcaatgcaatcactgcatcagcttcactgatgttataagtcaaggttacaatgtcctccagctccagctgtttaatggcttgcaaggcagtcgactccgagatctagaatagcctatccaataagttacaaactaagtataggaaacttaataaagagttgacagtgcgtgaaattcagcagtcatccgatgataagagatatccaaccaaacaaaggaaggaagttgcaaacttggaggcttcacaacgtaagccatgaaacaacttctcttccctcaccactccaacaataacagcccacagctacacttactaaacaagaactaacagggttttgtttaggtgtacaaggcttaattaatgccttggaggtttggtagctcaccattacttcaatgtgccatacctaaaagctgtaaatatattaagccatacagcacagttcataccaaataatgcaaaataaagcacaagtccaggcaaaaccttgagcaaacaaatgaaaagctgaagtacgagagagggggtgggtgtggggggtattgaagaaatgcataccccataagcatatagattgaggtctggttcagcttcagttgatctccctatatgcccttcagcaggatcaagattaaatgccgagtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 61500 - DNA, 4027 bp, Oryza sativa
  unsure (1)..(4027): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgccttctaactgaggatacttggctggtgcagggtgtccatggtgagatacagtacatcaaggatgagctcgagtgcatgaatgcattcctacgcaatctgaccatatcacagattcatgacgaccaagttaggatctggatgaagcaggtgagggagatagcctacgactctgaggattgtattgatgagttcatccataacctaggggagtcatcagaaatgggattttttggtgggctcatatctatgcttcgcaagctagcctgtcgtcaccgaattgctctccagctacaagaactgaaggcccgtgctcaggatgtcggtgaccggcgttcaaggtacggggtggagctagcaaaggccacacatgaagaagcacatccaagactcaccaggcatgcctctctccatatcgatccacagttgcatgctctcttcgcggaggaggctcagctggttggcatcgatgagcctaggaatgagctcgtcagctggctgatggaagaggaccttcggcttcgtgtgcttgctattgtcgggtttggtggccttgggaagacgacgctggcaaggatggtgtgtggaagccctgtggtgaagagtgctgattttcagtgctgtccattgttcatcatttcacagacgttcaacatcagggcactttttcagcacatggtaagggagctaatccaggagccacacaaggcgatggcaatagcaggatgcaagcatggccttattacagatgattacctggagggaatggaaaggtgggaggttgcagcactgactaagaatctcaggaggtatttccaagacaaaaggtatgccagagtttttttgttattcctccctgatagtgaactataatagtttgtgctttaaaaataatccatattttcttttgagatattgctggttatggtgaagtagaacgtcaaaatggcagtcttagatataggaccgtctccattttataggaccagttggtattcaatttgaggtagttgctggatgtaattaactgtcaggcaatttaatttgaaattgtgtatttattgccaaaacataagtgtgtttaacttaaatataggaccatatccattttataaggaggtccctctcatttccattaaataaaccatgttacatagttcaaaagggagcagaaaacaaaccaacagattgcagataaaaccttcacatctagaaccagagacaactagttattcatatagaaccaaccagatacagagatttggctcaagccaccattggcaaaatgcaaggccatcatacaaatcgagtctcaatttcctagagttggcttaataatttggattcaatgtgaaccattcaaagccagaaaattagttttacgagttgtgatggagaaatcatctgtaaggtcttctactattctagtatctatctatctatatatataggagagagagagagagagagagggcccaaccactatttagtattgatgaatcttgaaagttccactatctaaggcatgtgtacctgaaaaatataacaaagatccaaataggttacagtgttacactatccagtgtaaaagagaaaaaacatcgtatgcaatgaaggacttttcacctatttgtttgcaattcgttttctgttttcccttttttaccgatgcaaaggaaaaggaggcgtatttactgctaattattctttttttttttttgggggggggggggggttgttcctagctaatcctatctgttaccacgtttccttttgtttactgaactgtttcttctaggtacattgtgatccttgatgacatatggactgtatcggcatgggagagcatcagatgtgcattgcctgacaacttaaagggtagcaggataatagtaaccacccggaatgcagatgtggccaacacgtgctgttctcgtccccaagatcggatttacaatatccagcgactatcagaaacgacatcacgagaactgttcttcaagaagatatttggttttgcagatgataaatcaccaactgatgagtttgaggaagtgtcaaattccgttttgaagaaatgtggaggcttgccattagcaatagtgaacatcggcagccttctcgcaagcaagacaaataggaccaaggaggagtggcagaaggtttgtaacaacttaggatctgaacttgaaaacaaccctaccctggaaggagtgaagcaagtcttaaccttgagctacaatgatctaccctatcatctgaaggcctgcttcttgtatctaagtattttccctgaaaattatgtgatcaagaggggacccttggtgagaaggtggatagctgaaggtttcgtcagccaaaggcatggacaaagcatggaacagcttgcagaaagttactttgatgagtttgtggctagaagcattgtgcagcctgtgaggactgattggactggcaaggtgaggagctgcagagttcatgatttgatgttagatgtcattgtctccaggtcaattgaggagaactttgcatcattcttatgtgacaatgggagtacattggcttcccatgacaaaatccgtcgcctctccatccacagcagttacaattcgtctcaaaaaacaagtgccaatgtatctcatgctcgctccttcacgatgtctgcttctgttgaggaagtcccattcttctttccgcagctacggttattaagagtacttgacttgcaaggctgcagctgcttgagtaacgaaactttgcattgtatgtgcaggtttttccagctgaagtacctaagcctcagaaataccaacgtgtccaaattacctcatcttctagggaatctgaaacacctagagacgctggacattagggcaactcttatcaagaagctaccagctagtgcaggcaacctgagttgtctcaagcatttgtttgcggggcacaaggtacagcttacaaggacagccagtgtgaagttcttgagacaatcttcaggtttggaggtggcgactggggtggtcaagaacatggtggctctgcaatcacttgtccatatagtagtcaaggataaatcgccagtactgcgggaaattggcctgctgcaaaatctgacaaagctcaatgttctcttgcgcggtgtggaagagaactggaacgcattccttgagtctctgagcaagttgcctggccctcttcgctctctctccatccacactctggatgagaaggagcacagcttatcactggataatctagcctttgttgagtcgcctcctctattcataaccaagtttagcctggccggtgagttggaaaggctacctccatggataccatcgcttcgaaacgtatccaggtttgctcttcgtcgcaccgaactccatgctgatgccataggagttcttggggacctgccaaatctgctctgcctcaagctctatcacaaatcatatgctgacaactgcatagttttttgtcacggtaaattcgtgaagctcaagctgttgatcattgataatctggagaggatagagaagatgcagttcgatgcgggttcagtgactaatctggagaggctgacattgtcattcctgcgagaacccaagtatgggatttcaggtctggagaatctaccaaagctgaaggagatcgagttctttggcgacatcatattatctgtggtgaccaaagtggcatcatgcgtgaaggcgcatcctaaccacccaagagtcataggtgacaaatggaatattgtaacggagtatgcgtaaggagcaatatctgaagtctgaaaaacaacactgactgggctgcaggaat

SEQ ID NO: 61501 - DNA, 10922 bp, Oryza sativa
atatgacatggttaatacaataatgtacccatctactatggataataatggcaattagttattatgcagtgatgctttggatatccaatagttcaatagtggttcatgagctttgactaattaaatgcacacatctacattttttctcaacatccatctcttcagtatataccttagcaacttgaagcacaaaatgaccaagatcagggtgctttctgacacagtgccgaacctcatgtgctccactgaggtaagaattgtttgttagcccagtaatcttgcaacatgagaaaacaaaaacaaattagcaaccagattgttgaaattgacagggaagtcatctagacagcattttgtataaataaaagttgtagcgtacaaattgattgggcacataacatggtggttctactgattatttgcaattaaatttctaaacacacaagttgttgattcttgctaggaagttggatgatggcatatatagggcatatgaattgcaatgagagaaaacaatgcacatttttggtcattctatccaaataggctattatcctaaggactcttgtcaaatagttggtgtatgttattcacaaacaaggggtaaaggaaaaacaaaagaaaaaaggaatgtgaagttgccactggtaaagcagccagagtgaaaaatgttgagatttaacaagcgaggacatggtctactgtcaactggtaaataacatgaagtggtttatgtcttgtatgataaaaaacagaaagaatgtagattaaaaagaatggcatggatataagtttcatttagacaatacctacagcactaccatcactgttctaaattttactatcaagtcccaacaagcaaaagaacaaaaaggagtacagctgcacaatggttatgcaaaagaactttttgcatttaatcaaaatttctaagtttgtcacatttttctactatttcatggtgtctaacttaaattttcaagttgcataggcatgaaacattcatcagacatatcaggaagacatgcaattaacgataggcactaccaattcaccaccacagtaagtattactgcgtgatttgttagcaggcagaccaatatttcagggtcaaagcaattgcacaaagaaagtttatagtttccaacacattgagagatgcattagagacagtgaccaactaacagcatagacaagtcatcatacctgaaaggtagctccattatgaatgatttcatgcgcaacaggatcattaatgtactggtgtagtggcataaccatatcctccacatcatatgcattaaccctgtggctacttctcactttatcaatccccctagcatctctctgccaaattaacagtatgcttttatattattgcaaaaatggtttagtataggcatcaggcaatgaaaacatcatcatcataataatggtaattatatgtgtgttgattccaaatatttctgaactctattttcctgatcactcacatcaacttaagtgtaaactaatagcgggacaatgacactaaaaccgatgttcaggtgttacaaaagcttaagagatcccacctgaaagtcaaaaccttcctgctgacaaaaccttaaattattattattcaaacactggagcataagcattatcttagatacttggagttaaataaaattgattcttgggaaactggcatgtcctagatggcttccaaggttcaagtatatagtctccgctccatgtagcaaaggttcaattgactagattattgcaatgtgtttttgtttgattgcttctaatcaagactagatttaagatgcacctgtggatcatgatgttggataaatacattggcatataaaggttcaattaaatagaggcttgattatagtctgctccatgcagcagatgttcaatttactgttagaatggatcaactactttatctttgctgcaatgtgtgtttgtttgattgcttttggtgaagactagatttaaggtgcgccttctagaacctgatattggatgaatacattggcatagaaaggttcaatatctagaaatgcaggcttgatagtttgtcctagttgttttcctactagtggaaaaggatgatactaagcaaaaggtttggctgaaataagtaaacataccctggcaaacagatcttctctcatccacgggaccaagtatttccaaggccatatatccaatgtacttacagcacgagattttgttaacacacggctagtcattaactttgcagatgttaagtttggatgcacaagaaatctggctgcaacttcgaccgagaactcatatgtgctgaatactcggtcaactgggttccttagtattgtgacaacagaagtcctctcacttggcagcttggacatgaagctatagtcatcatgactaacaaccagcttacaatcaggatggctgacacaaagatatataaaacatcattattaattgtaactgcagaatcatgtgaaataaacaggagtatgaagccgctcaacttgtacagcaaatactagtggataattacatatcagatgctttaattgaacaatcaatcttgagtccatcacaattttctcgcatgactgacacgtgttcacgatagccatataagttgttgattacgttgttcaagatgtattgaatgcctggtaatccgtataaaggtaaaccatatctactgttttcagtcagataagcactaagaatgttattccaatacatgggaatactctaaatcagtgttaaaccacagaaaacatgttaatccatgggaatgttattgtctgaatctgaataggatagtacatagtgtaaagtaataatattagtaatacacaaaagacaatctagtttattttaattctcatttggttggccaacataaagcttgacaaatatacaatagaacaaaaacagagaacaaacttttctacctggggtcgaaccgcagcttatcgtaggatcgcggacactcctcagcattggtatacagctttttcaggaagctgccaaaaacaactagcatgagtgaaatgcacacatcctttgatgacgatgaaacaagctactatgcatgtccccatcgtaccagtggaagtaggtacggccaccggttctaggaatgtgaaggaagaagagcagatccctgaggctcagcttgtccccatccttgccctcgctccccgcaaccgaggccgcccagcccttgacgaccccctcgcagcgcgcgtggtcgccatcggagctcgcaacctggagcaagttcactgcaaacaaacgaaacaccaaaaacgacacgcgcaaatcagcgcagacacatacatagctacccaacgcagcgatgattccacggaatgatcctaccaaaaaccgaagcgcgttccgcccaccacaaattcgcacgcggcgggggagggcgagaggagaggggattgattgattgatcgattacctgatacgacgaggagcgcgagcgcgagggcgagtccgccgaacgccatcgggggttcgggcccagatccagccggggtgccgcggccccggttcgaggcggaggaggaggagggcggcgcggcgtggggaaggggggggcagagcggggcggtaaaaaggcaaaaacccggaagggagaagagggggagggcggcggcggcggtggcggtggcggtggggaattgagcgcggcgcggcgtggcgtggcacacggcgcggcgcggcggtgtctcggcgggcgcgggcgcggggtggtgggcgtggcgtggcgtggcggcgcgttccctagtttattgtgctttggcgctcgctttctcgcgcagtgtctgctgctgctgctactggcggtgtctctctctcgttcgccttctccacctctccgcgtgccgaggcagaggaggcggaggacgaggccgaggccgaggcggggcgacgtaaatagtctagtggtggaagtggggggaaaatcgcggcggaagcacgagttttccttctcgccacttgcgccgttgcgctgcgcccacccgccgtcctcctccgcctcggcgcctcccttttttacccgcacggtgtccaacgaacggagccagatcgccggcctgatggtggagaaagatttacagcgcacgcgaaacgagaaaattcattacctccctccatctacttttaatagtcatatttcatcttgacacacagaccaaggataagtaattctacttatcatttatttaagcatgctactagtcattcatcgtaaacaagcgattcattaatatttacatttctcaaagcccatatagccaatcatgtgtggaagaatggagagtcacgcattaaattcgagaaaatcattaagatgatatgttgttggattgaaatatacctatcaaaaataaaattttcagatttggaaatatgactatcaaaaatagatggagggagtattattgttataaacttgaaaaaaaaatctatttgattctttaacaacttttatatagaacttattttttaaatacacaccatttaacagtttttaaaatatgctaacggaaaatgaagacgttgaagtttggagaccctgttctaatcttaactccaaacattaacctcctcattttcacatttgatatgttttgtgaaacaaaaaaattatatatagaaatttatttagaaaacaacatgttgtcgttttcgacaactgcgtcacgtcgaaaaacgtggttctctcaacagtggttggaaaaaaagataattgtattgcttagtaaaaattttttagatccccttgttacatggccctaggggcctatttatagctctattatagactcctccatcattagggtttaggttttacatagaatttacatgtatgggcccctaatgggctaagtggctaggcccaattgttggcgaaacctctggaagacacgatggcccgctaggccttctcccgatgaggtttggtacttggcgaaacccatgccttcgtgcaaaggctttcgtcccgcagtcttcgcgccgtatggccctccaacaaggtccgcatttagtgaagcccgcgtacttcatgccacggctttcgccatgtggctttcgcccatgtgggtgccttctcggccttcgccgcgtgcccccggcttgagtccttcgcctaggtccttggtttcagtaggcccagccgaaggtccacgtggtatacctctaacacaacaataaacatatatttcacatttgtaataattaatacttaattaatcatatactaatatattttcttatttaatatatgtgttgaaaatctctcttcaaccctaatgaagctttttaagtcactaatatagacgacttattttactgtagtccatacgtcaatggtataactatagattgcacaaagctatagtggtcttgtccccaaccaacacatttaaaatagtaaaatttcattgttcggctaatcctcaagggattataataggattaaggtggattaatttcacacctcaatagtcatggaattaattctctccaaatccctctcaatcctcctatctctaaatctctctcaatctttttgtagtgataagtgtggaataatacttttgactttttaggggcattaatcgaataagatccgatgggttttgcagcctccagcgcacggtaaaattagaagcgtgttttatactgatctaaatttagcaggttgttaataggtatttaagggcctatttagcacagctccagctctagctccacccctcttggagctggagctcagccaaacagtttcagctctaccaaaactgagaatgaagctgggtaaagctctctcacaaaatgaactgacttgtgtagctggatctagggagcttcacaactccactctagacccaactcctgaagctaaatttaggagttggggctgtaccgaacatgtcctaactgtgtgattacaacatctttgccgtttctgcttagaaataatcggggctacctctaattaagcctaaagaaggttacacagcaagggagcaacttgtggtggcagtcacgcaggcttgccgaatcttgctgctactgaagaacaatctttttgtggaagcaggctgccggattcaggcttatcttgtccactaccataacactacaacttagtgccgtttggtagagggaagatgattactcactaattgatcaggttatcagggtccctgctcctgccaaaccttttcttcattcatcttcttgtgtattccatccatctttttttaaaaaaaaaaacttgtggaggccatcgtttcgtttattaacggaataagcgaaacgttatatttacaaacaaaaataatttgtaaataaaacttttatatacgttttcttagcaatctaaaagtaaaatcgaaaaaataaagtacgatgaaaaaaacctcaaaatcaactccaaatttaaggtttaaaattcaaattttagcttataagtataatcataagtcaaaagatgaggctgtgtcacaacttatagttatgaatgtgactatattcaaaatcaaactaaaatattgattttttttctaaaagaggggggatacattcttgtaggtactgatgactctctgtcagagtgcaatgttcagtaggacagtgtcacctgaaaggacttaatcttatccaatgaatgattgagcagttgttttcaatcaacctgggaagcctgcaactgaacacttgcatggatgatgcattactgacagtgaaagtgaccagctttgctcactgaatgcagttaaccaatagggaatatactgttctcatacaatcaggtcactgtgatctatcaagtctggataagtactcctaaagatcactgaactacaaggtatttgtccaaaactacaaggaaactgtgtgcactgtactgctaattaattccatgacatctcaccatttcaccaatatagtgacgtatatccaatacttcttcacaaaactcaaattcaaattataaggtttccaaaaggaagaactgattatggactagaacttaactagaatcctctttgagtgactctaaaatcctcaatagttaacaagtgtcatgtaacgactcatcaacactaaacaaataaaacaagaacaaactaactgattactactccatgcatactgctgcctatcatgtcatcaagatacaaaaaaaaaaggaagttcaaattaacaaaacgaaaatcatagccacgtcaggtgacacgtggcacggttcatcacgcgtctctgtattggccgtacatggaagcgtggccaaacaatggcgggaacggcaggtgcgggtcgacctcgccgtggtacagcgggtagtcgaacccgccggcggcggcggcagggtcgaccacggcggaggaggaggcggcggcggagacgacctcgtggagctccgacgagtcccctcggctcatgacgaagtggccgccgcctccccgtggctcgtaggagtgctccatggagaagtagctctcgccggcggccgaaccggccggcgagacgaacggcggcgaggagaaattattacaccctcctcctagcgcgtcgtccggcggcggcggtggccccaccccggcgtggaacggcggcatggaggggaagcagaagtgctggtcgtcgtggaagttcgtcgtcgtcgtcggaggcggcggcggcggaggagccagcccgttggtctccaccttcaggccgtgcctgaagttgacgagcagctccacgctcgggtcggcctgcggcggcggcggaggcggttggtcgccggcggcggcggcgcggcgctgcttctggtggcaggtgtgggcgccctggtaggtgacgtcgaagacggcgaggtcggcgtcggagcgctgcacctgcttggtcgccgggcagccttgcgcgttgcgatacgtgcaccggtagtaacccctgcgaatccatccgacacgtgtcagtgacaggaggcatcagatcatgcatctggcccgttcatttttttactttctttttgtcggcccacaagctttaaaaaactgagaatgttaattttgacccaattttaagaaatgaatttgccacgataaatcgattgggctcggactaggcctcccaatcaaaagcttttatcgtttgttaaccacaaccaaaatataaaaattgaaacttaactttattttttaaaaaaatatcatgttttatcagtaattcatcattaacttttaaatcattaaatatacttatataaaagttgtacccataaattatttttgactgcttcgattttttttaagcttatcaaccgtagagtcagccatgaggctgtaaaatgattcgatttttgtgtttggaactatgggggcttcaaataatggtgaattttgtagggtttttttttgtggggaatgaattttgtaggtttaactccctcccgtcaagaaacaagctgttttgggtatttacagtcttcaaaattgatctttcaccactagttttattcaaaataataataatcctgacaaaattattataatatttttttaacctacaatatgttttcatgcatccaatctaaatatttagaaatatacttatgtttaaaattaccaaggtttaaattaaaacatgtataaaatgatatgttgagctaaccttgggaatttggcaccgaggatgtccttctgaccatacttcctccaactgaatccatcatctggtgtagcctccaaacttgcatctggcactctgaatttttctgtccatcttggcaggcccttcctgtatgatgatttagagccaagaaaattataccaaatggtcagtcaatgatatttgactcctttttttcctttggttgactcaggcaaattctaataattcagtacagctgtatgcttatgattatgactgtttccacttatgattatgactgtttccatgcttttgaccaaagaactatgacatggatttctacattgcccgtccttggggttaggtccttttcaaatatatttttgacggttgcatatgattggtttgaaaacggaatttgttctttttatatttaagcaaataaccacaaattaaatagccttttttttaggaaattaaatatcctctgtttagagtcacaatgatatttcgaatgggttttccccctgacattgattaaccggagacatcgatattttggaactaccaaaaacatgtggaactggaagctaaaaaattcacattgcaccatgatacaacacagagacgacatacatactcatctacatccataacgcattaggtagatcatttgccctttttgctaaaaagaaaaaaaacagtgacttgattttaaacctagtttttttagcaaattaaattttagagttggttttgagtttttttaccacggtttatttttttagccttgacttgtaaaattttacctagatactacctccgttttttaatagatgacgccgttgactttttctcacatgtttgaccattcgtcttattcaaaaattttatacaaatgtataagatataaatcacacttaaagtactatgagtgataaaacaactcataacaaaataaattataattacgtaaattttttgaataagacgaatggtcaaacatgtgagaaaaagtcaacggcgttatctattaaaaaacggagggaatattatttttttattacttcgttaatttgtctacgacttatagttatagactgtagctggactgataagagccattcttaacattaaggcaagagatttataacaaaaaaaaagtttaaggctctaaacaagtccaaccatgtacacaaataggggcttagaaagggtgacacgaattttatccttattcagtttcagataagacaagccgatgataatatactctatccattatctcaatttgcttaagtggcgacttacgcgtggcgggcatgtccttagtttcgcgccatttttttaaaaaaaattaaagtgatgtgacgacggccaaaatgccaaacgtgtgtgtgagacagtgatagagattttaaagcaaattgaaagagaaattttaaaacgaactgaaagagagagatttttttttgtttagacgaatttgaacacacacacgcaccttctcttgatcgtgtcatggtggcgttcttgctgcgcgacggcggcgtccctcgccgtccggcccgagctctcgtccgccgaccgtggcgagtcggagcggtcgccggtggtgccgcgcgaccccgacgcgccgccgccgccgccgccgccggcgaaggccgccgcctcgatggccctcgcgatgcccatcgccctcgcgagcgtgccctgcagctgccgcgccacgcccctgtagtactcctccccgcggccgccgccgtggtactcgtcgtcggccgccgcggcgggctcgccgagctgccgggcctgctcctcgccgtcggcgaggatgctcagcagcaggtggatgtctcctccgtccatggggcacaattcttggacacgacacgacacgcgaaagctaagctgattgttcttgtagctttggatcaatcagcttgcagattcagacttcagatgttgcaagcaatgcaagatcgatgttgcaatggcagatttgaagagccaagcttgcaggcaggagcaatggaaggatcatgcatggcaagttcagagaaacacaagagaagttgcagaggcgaccaacaagacggcagcagcaaactcccaaagtctgaaactctgaaaaattagtgatctaggacgacaaacaaagctctgacagatatcaggtctttttattcacttcctaccatgtagcaaacactgcaagattgcgtgaactgggagagaagcgaaatgga

SEQ ID NO: 61502 - DNA, 1518 bp, Oryza sativa
agaagtttgaccaaacagaaaccatgcaaagtttaattcttattttttccctttgtatttctctccttttattttcctgggtgcttgctccccgttgaccagtctttggtcatactcatcatcgtactagtgctattactgggagatcaggaggaatttgctaagtacacccggtatcggtaccggccgaaaaacttgacatcgtatactatggtagttcgtagtttgcgaaagaagaaagcattacttggagtagtatggatctactttatgtttttaatgtcaattaatctcatctggttccatttatcttgggaatattacagtgcataattgcataagctttactactttgtagactatttgattccattttgtaagtcaacttgttgtttttccccctgattcagttggttgtgtagaaattaaacacaagagtttccaagaaaggagctccaatctccattgcaaaggagaaaataaaggaggaagaaaagggaacacgcataggcttttctttttcttttgtttaattaatgtcatattcaccataagcattaagctaccatgccaaaagctcagaacttttgacttgtgaaaataaaagataacaagtgtgatgatctaattagctccagccttttccaaagctcacggatattacatcgaaattgcaggtattaatgcgatgccttccagaacaatcacatatttggagcctgatgtggtatgcttattctcactgggataatgacatgctctgttgcattttaagcttgataccaactagtagcatcttttgtgttggcattcactcaccatagaactgctttttggcaaagtttggtggacttaggaaagttcaaaagctcatatagacagtgttgaccgctgaccagtcaaccctccactccaaattgctactggtcaaacggatcaaagaagaggagaatagcacaatactattggcaaaagagaggtcaacttagaaggttggaagaactgaccaggaatcttcaaacctgtttccgtgtgtagagcaggagatggatgacagtgacgcagaggcttcagagcttgtgcttacgactgcgtgctgacccaagaaaagggagtttgtgggtcacagccgcacaaggaatagttccccccccccctttttttttcttatcattatttgctaagcaatcagaaatagtagtagtacatgcacagaatgagattctagcctaagggaatagtagtaataattaagttgtgcaaaacataggatgacttaacagaatgatctaacaaaagacagtccctgtcacaccgtttctgacagtaatcatttcagcacaagaaagacaaggctatgatctgtttccagtcttttatgagtggttaggtacatgacatgtgaattggatttatatatataccaacatggtgagattacatgaatgggtgaagcctttcttcaattgtctgtagcattgctcgtttactttgccatcttgtagagtgcgtcaatgg

SEQ ID NO: 61503 - DNA, 1276 bp, Oryza sativa
gaatctaagtccaagagctcatctgatgaagttgattatgagctcttggatcttttggcaggtgcaagtgaaggatgcagcggaggaaacaacaacgatgaagtgaaaaactttgcctatgcagaccacaagatgcatgttttgagagagagggagagaaggaaggagatgaaaaacaagtttgagattctgcatgccctcatccccaacctcccagaaaaggtaggatttacaatcctatgggtttgcatacaaataaatcatttaagtatgtttgagatacttacaattttattttttttcctggcttgattagaaattctagatatgtaaataaaagagtatgtgcgatgtatttgcatgtttgttttcttatgacttgattaaattatctgttgttctctgacttcattaaataatctagatttacatagatagattatgttgtgttaattgctagattgtttttattgtttgatgtacagagatagaatatcctttttctattttgcaagggatagagaggtttgagctggccataacttttaggtgacaacagttagaattactttagatgtgtaccgtggtctatgacatggtgtttgagtgatggaatggtttttttcttgttatacaaactatactgccgtgtcatgttcaactacattttagtaacttttgattagatctatccataatccaaatcaaaatcgacatattgcttgcacattcacatatttatgttactaagatgttgtttaaattacttgtattggatttatggatgtatgtactaacttgaatgtcatcatatttattaagataagtaaaacccatgactagtccatagagttacacgtgatgttactaaggtccatgaacatacaaaatgcacatttagctcggttatcttggtttaatccatcacaacaggctcaaacctcgcgcggttgactatatgactggccacttggcgcttcacgctggcaagatttttgcgttcgctgccgttcgctccctccgaagcacaacgcggcagtaaatttgcattgaccgatcaattgattgttgttgctattgttgatgttgttgttgccgttgttgttgttgttgttattgttgttgttgttgttgttgttgttgttgttgttgttacttttatgcatgtagactgacaaggccactatagtggaggcgaccataaactatatcaagaacctccaagacaaaatccataagatggagatgctcaaggtggagcgcgagcatgccatcg

SEQ ID NO: 61504 - DNA, 29429 bp, Oryza sativa
  unsure (1)..(29429): unsure at all n locations
agtattaatggctagatcattgttttattgcatgggtaaagatatatacctattcttttttatgcaaagagcagttgtgttctctatggtttgagtgtgaattaaaacctatgtaaaaccaatacactgcattggaagaacattatacgtgtagctttgatgttggatggagtttttctagagtaatttggtttatggaaataatgttgtgaatgcatctttgtaggagtagttcatattgttttgtcaaatatacattcataattagaatttgaccttgtattttagcatcatattaataaataccagcaattaaaacgttcaatgctagctgtaatttgagctccaataagaactttttaatgccacattatcttttcgcttttgttgaattttaacctatacgctagcttgttagatgtggtaaaaacatgtcatgaacttttgaatcaatatgatctggttgtctggaggatacacctacaagctattaaacaattctaattttgtacccttccgttttaaatgtatgaagctgttagcttttggtttacgtttgacaattagttttactatattaaaagaaatagtatgtaagtgtcatttattttgttacgatttctttaattttatcagtaaagttaatttaagtgtaacttatactttcacatatttgcactaaattttagaataaaacggatggtcaaaagtcaccaacgttatatatttaaaaatgtagggagtatgtctctttaccttttctatttctaaaaataaaagtaattgttctagaggacatgatagtttagttatgtttctatcaaaacataagaattacaagaaatttggaagaaaacaagaaacaaatataaatatgtaatgttcacatccttttgttataggttgcaaatgcaattgagaagttctatatatccttgatttaccaggatttggtattttccaattgttacaagaaaaaactgacattggatagttcttatctctttttagattacacggcagacgcgcgcgcacacacacccacaaatgggtcacctaacatatgctctaagagacgaaaacctatagcacatccttgatcttactaaatttatgttgaatgcacacctatatgtgcgtaatattcgtggacaacatgatttaaaccctagtgggtggagttttctatgaattaatctaaccaaccaaatttgatgtgtttaaaagcaaaatctgcattacagcatgtacatacatatatgcatatccctacaaaagcaaattaaacttgcggatagaacatggatgcatataacctgatgatcatgttgcagactgacaaggcctccattgttggggaggccattggctacatcaagacgttggaggacgtcgtccagaagctggagaccatcaagacggagcgcgtgcgcgcgcaccagtgggcggcggcggcggcagccgccgtggcagccaacggcggcggcgaggggtcctctcactctcactctcagccgccgcgccacgccaccgccgtcacagtcgccgtcgccgagcctgcgccggtggcggcggcggtgaacgcgcaggcgccgcagaagaaggcggcggcggcggcggcgccgacgctgcagacgtggtcggcgccgaacatcacgctgacgatggccggcgtggacgcgttcatcaacatgtgcctcccgcggcagagggcgtccttcaccacggtggcgttcgtcctggagaagcaccagatcgacgtcgtcacctccaccatctccgccgaccatgacaagagcttgttcagcgtccatgtccgcgtaagtgccattagctcaccgacgataatctcttccaaaatatactccccccgtttcacaatgtaagtcattctagcatttcgcacattcatattgatgttaatgaatttagacatatatatttatctagattcattaacatcgagataaatgtggaaaatattagaatgacttacattgtgaaacggaggaagtagttaacttctggctactttttagacaagcatttgtccagatgcatagtcagaacagaagttgttatagtttaggatggatgcagcatttgttcggatacatagatataataatataagttatatgtaatgtgagtaatttgttcattttgcttgtgtggttaagcagctcaacgaagcatcccttcagagcacagagggtctgacgcctgaagccaaatacaagctcgcagtgtcagagttgatggtcaggctcgccgaatgagacgaatttgatcgtcctgaatttgctgtcccccttgctactctcatcgaggattcgtactctcagcatttggaataactaaaaccagtctttgctttcagtttagtcgttgaacttgttactttttggataattcggttaaagtttccgaacataagtacaccaccaggaggtaaaagtgtaaaatccgttgatgttgtcgtcgtcgttgttggagttatagacatgttacttgaataatatagtgttgtttcttgatacatttttttttgaacgactcgcacgagacggtacgaagttctattgatagagcaggaaaaaattacaagatcacaaccctaaagggtcgtaaccaggaaaaaggaaaaatataccaccacccacacaccgacagctccaacacacaagaccgggagaaggctaacaccggaccggccgccgctaagcttgaccgactgccgctagaccaacaaagaaacatagatgagatcgcccaaaagaacaccctcacaaccaatacaaagccaactcctagagtgtgcttgcaccaatcgatcgagaggcttcggctaggggataccaaaacgacgtattcaagaagagaagcgatggtaaaccaccgccgccatccgtcggggctcaaaggagccaggactgggctttcgcccggcaaccacccttgagggatgagacagcacgacaacaccctcaagagggggaattccatcgttgtcggtccggccatggccaggctgggttttcacccgctgctcaccaccggcgaatccacggctgacgcaccaatgctcccaccacccctcaacctctgccgacatgtgggacccctgcaccggcgccccctactggctagccttcgagcgccgaagaccgcgtcacatccatcagcagctcctcgaaccgaggtcgcctccactgccggccgcgcctctcgcgtcaagccggcctcctccaccggatgcgcctctcgcgccaatccggcctccctccatcggccgcgcctctcgcgccaagccggcctccatctcctccgcccgcgcctctcgcgccgagccggcctccgctgccatcggttgcgcctctctgcgccaagccggtctccaacccctcctccaaacgctgccgcgccggctagatgcaatcgtctcctacaccctcggctagccgtccaaggccgccatacatcctcccacctcagccacggtgatcaccaccatgcctccttccaccgcagccacgttcgccaccgtgcctccacattcacagccgctgcaagccggccgctgtcgccgctgctgtcaccaaccgccaacaccagccgccgccaccgccaacgcggctactgcctcgtcgccctccgtcaccaccgcctctgcagtcctccgctgccgccatcgcggccgtggaccgccgtcgccatcgccgccaccggggctgtggacctccgccgcctgccgtcgccccgggaggaccggaaccggcctcacccctaggccttcgccttcgccacatccgtccacagcagcgcgcatccatcgcctccttccggccgccgtcgccgcgaggctcgccgtcgcttggcccctggatgcggggaggccggatccgccgccaggggaggcggatccacctccggcgtggccggattcgccgcgacgacccctcggcgccgcctcccgcgccgctgaccgccgctcgctgttgctcggccctggacacggaggggccagatccgctgccgggggagacggatccgcctccggcgtggccggatccgccacgccaaccccccggcgccgcctcccgcgccgcggaccgccgctcccgagcagccccggtgtccccgccgctggcttcctcgaggaggggagagggccccgccaccgccgtccttgtggccggtcggctttgccgacgcgccgctcgggcggtggcgaggcaaaggggaggagaagggaggaggcggcggaggaggatgaggcgccgtccgtgccgcccctgggacgggagcgacgcggatgggagcgatggaaaatgatgaggtgtttcttgatacatatgatacatgctcctatcataccattgagctgggggtaaaatttacttgtctatggttagatgttgaaattagtttcttttgcagaaggtaacaaacatagccacaagtaagctagccttcagcttgacactccaagggatcccatagcttcccttgccccacactatccctcttacaaacgggaagaagcacagcaccagccacccacaacacatgaattcgccgatacccggggcacagggcacaccttccgctgtcccgaaagctaccctacatgctccgacagtgaccgcaacgatgtttaacatcgcaagtgccgtcacggggatgaacaccggcaatgagtcgaaggtgaacctcccagggtcagcaccatcggtgttgtcatcgtcatcagacatgcttttgtccttgccggtgacctcaaaaacagtttcggagaggcctaaggacttgaggagcacggtaagaaatgctagtgtccaggcagagaccgagatgatccgttgcatcctatgattgttccaccatgcacgggcggagagcccgcacgccatgtactccatgaagttgtatgtgttataggatatgaatagggctaacgggacgctgaaaccatcttctgatgcctacaggataccaagagtataatagttcatccatatcactctctagccaaccaattgaaaagtacttgaaaaatataaggaatgtattaatgagtggcatgcaaatgattacctttggcaagaaggattggtttgtgagtatgcaataaggtcccaacaatccatagcatagctcaaaaggcgctctcagaggccacccaaggacgatcaggtaggcaagacattgccggaatttgaggcgcttgaacatggttgcgagaattgggttgttccggctgatgattatctcagattggccagttgcccatctcttgaactgagttaggcaggctggtcctccaatcggcgcggagcccatgaatgcgggtggttcggttaccatcaatacggatctccaacccatcgcgtgtatccgctgtccggtcaatatgtcttctgttagtgatccatagacccaaccaacctgattagaatatgagggatgaattgtatgagacttgcagaaaagtgtactgcactgtagcataacctacaaaaatatggcaatggaagttgtctttacctcctgtccccaacatgtgccaatatcatagttgcaagctgaaactgcttttgccacttcaatgcgacttgatatatcaaccattggcttagaggacagatcccaaatgatgtttcttgctgattcgttcaattcctctgagtttccaaacctggtatgaagctccttataagacgatgaacctgaagaattatgccaggtctctcaatttaagggtgtgagatggcatgattgatgtactcctaacaatcacatcagtgtatgcccaatttcacctatggtatcttctctctcggctccattgaagttcggtggcacgccataaactgctttcctacggtgaaagcagccggttccagcataaaaggcaccctgaactccttgaaccccactgataaatctctaaacatgacacaagatcagtttaacttatttggaatattagtggggttaataagcagcatagaacgggatacggattaatgaagaaacattttgtgcatagtaaattcagatttgatcagacaactcattttccatatataagcaaatgtacagccaagcacgacagctactccctccggttctataattcttgacgtttattttaaaaggttgatttcaaacaatcagaacattaaccatcgatagattaatactccaacatacagatgaaggcagaaatactagctactagcattgatcatcagtacactagctatgtaccttgaaaaaacactccatctggttcccaaatggatcgtccttgagggcgtcgtagaatctctgcggcgcctggacgaacccgctgctggcctcgtcgtcgaaccccagcagcaggcacatcgcatggaggacggcctggggattgttcacaaacatgtcgcagtccatgttcagcatgatcggtgcgttggtcatcacagctgacaccctcgtctgcacagagagagagagaaaaaaatgctttgtcactgcagattctacttcggttttcattagcatattttttaaaacggctaaacggtgtgtttcatgcgaaaactttctatatcagaattgctctaaaatatcaggtaagtccattttttaagtttaaaataattaaaactcaattaataatgtagtaatgagtttctcgttttacatgcccatatagcatgtttttaaaactggaaaactttctatatcgaaattgctttaaaatatcagataaatctattttttaagtttaaaatatttaaaactcaattaacaatgtagtaataactttctcatttcgcatgttcatacttaatcttcatcttcaataatttcgaacggggcttagtgagcagagaagttcatgtatcacgatgaggtaaaaaaatgccgaagagctagctattgccatcgaccttgacgatggtggggtgattcctcctctcgacgttcaagaactcggcgaagaactcgccgccgccgtgccggaggagggagcgctcgtcggtgttcttgatgcgccgcactaacttgtcatactcatcctatatatgaaattgatcaaacaagaaaatggccataaacataagatcatcggaacatgacgctgtgttccggattatttagatgacatgtaagaaactcgagaatattgacttttccaagtatagttgattgaccttcatgaatgtccagtcgtccaagaacttgcgatcggccgggccgccggactccggcgaggaggaggaggagaagtaccggaacggggccctgacggcgacgccgtaccggcggcagaagggcacccacgcggcggcgaacccggcggcctcccgcagcgcgtggcacgtcagcggcgagcacccgtcgtcggagacgtagcaggccagccgctcgccggcgcgcgggtagtcgagggcgagcagcgagagcaccgtgttcaccgtcaccagcggcggctccagcgccgggtccgccgtcgtcaccagcatgtccaccgccggcagctcgccgtactccgccgccgtcgtcgacggcgtcctgccctccgccacgaggttctccggccgcgtgacgaaccggacggggctccacttggcgctcacgttgagcgcgcacagcgccgcgaaccacgccttgcacacgagcgccacgcgccacacgccgccgtcgcccccggcgccgccgtggtggcgaagcagccggagggcgaggagggcgaggagtaggaggaggacggcgaggccggccagccgccacgcccacgccgcgcgccgcccgaggggcaccctctcctgcagcggcggcggcggcggcttcttcctcccggacctcgtcccctcgccgccgccgccgcctgatctggtggtggaaccggtggccgccgccgccgccaccaccgccattgacggatcgatcgagcgacgaagcgatcgagccatgcgtcgagcgagcaacgcacgcggcaaccgcacacgcgcgcccacgccgcggcgcgcgcgtaggcgtagctagcgagcgagtacgtttcttggtttctcccattattatctactatagtattaaaaacgaaaaaaaatcattgtcttctcctcactccacgcacgcatcgcgggggcacgacgagagtatcgttttcttcaacacttctattttccaacatgcatgtgtttattctatcaccagtaaagtgtgtcgtcggtccttaactttgtttgttgagatttccagctactgtttccggtttgcaccgaccgttttagtcagtaacgataatcgacggtggtggaaatagaaacggtaatatcttccggaaatgggatggaggtttttccgaatgttttgtcggtaaccgtatttgtatggtaatttccgtcaaaattctaaaaaaattccgaaagttcctcggtggctcagttagcccaatccatcggatgcctatgaatgacggaagcctaataggcttgcagcccataaaaaaggggaagtgaccagggaaaatgttgttaaccctatgacgtggtatgttgatttcgtgaattttggtctcctcaatttatcgatgttaaagtattgtcgaattttgtttatattgttcgtcaaacttattatcgtatcattaatcatcatataacggtgtcacgtgcagagcgatgatgcaacaataaagttaaaaagtcatcttcgtgcatagttaaatgtgtgctatgccacactctgctaattccgatataattttcgacttccaaccaatatcggtatattccgttctgaattgttccgtttccgatataccgatattactgatatcgttaccgttttcggatctaccgttctgattctgttttcgagaaaaaaatatgaaaaagaaaatggtatagggtttttccaaccatcttcatccctaatatatatttttgaactctgaaaatacattttcagatctacaaatttattaaagcgtgtcatttcggtcctaagttatcatgaccactctagtatcctaagtgacgttgcttcgcatacgagcgccacgtgccacacggtgccggcgtgccacggtgccgcagagatgacttcgccaccaccgtcattgccggatcgatcaagctacatgcggcaaaggcacacgccgcgtgcgtgtagctagtcacatactttgcaccggtggcgtggcacatgcagaagcagctagcgtcgtatagtactggacacggtttttatctatccatgtaaacgtccacccaacctacgggccgttggatggatcataagatttggaatgtggtcctgagatcctaggtaccgatcgaattcattgggggagtacatgtgtacacacgaatcatgtggacatccacctaagtagataaaagactacctcgtatagtactcgaacatacggtgcactatgggggaccaaatcaatgggccaaaaaggaaagagaaatggccagtcttccacacatgtaaaacaaagttgacttattagcacatgattaattaagtattaccctaaaaaatttaaaaatatattaatatcanntttnttnccncgaaaaagcccaactttactnactccctccttcccaaattgatcatcatgtaatagaatttaaaatttctcaaattgataatcatataactgcatggacacgaatttcatcggaatacaattaatataatatgcgagaatgtgtgcatgctacggtgtaattggcatagggttttaattgatgcatgcattgtgagagattgtgtgcatggtgtcttgattgatgtgatttaaatggttcttggtcttggtacataaacttatatgatgatcaatttgggaaggagggagtataggagatggaatagaatttcaaccgaatacacggtcaccaaccaaatactcttatatttctccaggggcacatcaataatacacatagcgggaacaacattttcccctcacaaacaaaacttagcctaatctctaatgccacatcaacattgcaaatcatcatccaatcaatttatacattttcattcacttccctgcatgaaaaaacatgccgaaactgaatatcccacagtcgtggcgggttttcgtcgaattggaatcctcgatgcggcgaattgagaaaaggtcagcagcggtggtggcagtgtcaccgctgtgatatcacggtgagggaaggaatgtatgaggctagaggctatggacccggtggcgacatcgcgcccgcatctccatgatgaaacaaatgaggacggtatagactatagaggcactcatcaagaggtggtggtgacacctcatcgagggacagaaggggttggggattgatgtattctatctagcaattggttagcccaatcgtacccatatgtaaccaaaagttatttagattgatacctgatacctggtggtacgttcttaagaatggaaaagcactcgtatttttataataatgtacttgtaggtattcggaataaagaattactctttgtttggaacttagggtctcatcgtttgccctagaaagaattagttgttaccaaaatttaaattttgaaaattaattgtggggttcattttagggtattttcaatatagttgttttcagcattggcttttaagtcgcaaatgacacatatgaaagcttttacctataaattatattttaatctctaataagttgttttagtatataatcagctcttaaccaaccgatgacgctcttagtggttgaactgctatcttatagaactcagttatgtttaccaacaacaccaccagctgaaagtgaaatactccatatgtttatagttgtcgtcatttgctaaatggaattacaaacatattgctcaaataatacatacatgaaacatgttaagctgactatgcttacatgctgaaactaatttctattggagcagaacaggaacaaggccaccagcaaactagccttcagcttgacactccatgggataccatagcttcccttgcccactagccctctcacaaatggcaataagcacagtagcagccatccacaagacatgaattcacttatacccggaccaccaggcacgtcttctgttgtcccaaaaactgccctccatgtaccaattgtgattgcaacaatgttcaacattgtcagcgccgtaacggggatgaacactggtgatgcgtcaaaggtgaatctctccgggtcaacctcatcgttttggccattgccatccgatgtgctcttctccttacgggtgacctcgaacacagtctcggagaggcctatggtcttgaggagcacagtaaaaaatgctagtagccatgcagaggctgaaatgatccgttgcattctgtggttgttccaccaggcacgtacagagagcccacattccatgtactccacgaagttgtatgtattataggtcaagaatagtgctaatgtgatgttgaaacaattttctgatgcctataggaacaagatattactgcatcacttctctgctcccaaccaattgaagtactaaaagaattgttcatgaatatgtaaaagttctacaaatatttgtactacaaaaactaattaatacttacaattatataagcaatgtaaagataagtatggagagagtacctttgacaagaaggattgatttgtgagtaggcaataaggaaccaacaattcatagcatagctcaacaaatcccctcacagcccacacataaagagtcaggtacgcaaggcattgtcggaattggagatgcttgaatatgctcagaaggagtgggttattctggcttatgagtatctcaaacaaacccgttgcccatctcttgaactgggttaggcaagctggtccacccgttggtgcgcagcccaagaatgctggtggttcggtttccaactttgcagatctccaacctgctgcatggatccgctgcccagtaaaaaatgtacttcagntcattgatccataggcccaaccaacctgtagatatatggaatgacttgctatgaagcttgtttaaaagtgtagtgcattgtagcataacctacaaaaatatgacaaatgaaagttgtctatacctccagaccccaatgtgtgccactctcatagttgcaggaagaaacttcttttgcaacctcaatgtgacttgatatatctactattggctcaccggacatatccccagaaatgatgtaccgagctgattccttcaactcctctgaactttcaaacttgaactgaagctccttgtaagatggcgaacctagagaagcaaattgaaaagtctcgcgatttagttctactagaatgataagactaatgttctcctgataagtgataaccatcacatcactgtgtatgctccaacttcacctgcggcgccctctcttcctaccacaatggagtctggttcgatgccgtaaatggcttttctacagtggaagcaacccgttccaccataaaataagccctaaatccctgcaaccccgcctagaagtttctgaacacacgtactgcaaaattagtctagttttttttctatagatagaaatctagcatctatattcagaagtggatatatagtgtagttttaattgttactttcaattgggttacacaaagatgtactttcaaactttcactataagaatggataagtgttatcattaattagtactccctccgtttattcacaatgtaagtcattctagcattttccacattcatatttatgttaatgaatctagacatatatatctatctagattcattaaacatcaatatgaatgtggaaaatgctaaaatgacttacattgtgaaacggaggaagtacttcatatgtttcatatgacaagtcgctttgacttttttagtaaaatatttttaagtttaatcaaatttatagaaaaaatatagtaatactttttaaggcaaacaaacatatttgtaaaatatattcaatgttatatataatgaaatgaatttagtgtaatttgatgttatagatattgttaattttttttctagctataaatttggtcaaaactaaagaagattgatgaggaaaaaaaatcaaagcagtttataatatgaaacggagggaggaatacactggtagatgtattataacggacaaccacttgtgtacgcacgtaccttgtaaataacctccagcttgttcccgaaaggatcgtccttgaggtcgccgtagaaactctgcggcacctgaacgaacccgctggagatctcgtcgtcgaaccccagcagcaggcacatcgcgtggaggacgacctggggatcgttcgcgaacatgtcgcagtccacgttcagcatgatcggtgcgttggtcatcacggctgacaccctcgtctgcacacacaagagagagaaatgtacacatgttttcagtactaacgcacatctctgggctcgatctgaatctgactcccattacatgtcgatcgagctaacagtagatatcagtgcactgatcgagctagtaccagggcgttcatggcgccggccttgtagtgatggtggtgtccggggctcttctcccttgagacgtatatgagatgcgggaaccctccttcttcgcctatcctgttcttgctgttattatcccatataacctgatgatgatctccccgatatgagaagttcatgtcatgagagacaagaaagatttgatgtagttctgacatgatcagtttgaaagctagccatgtggggaatcgaccttgacaatggcgcggtggttcgtcctcttggcgtccatgaactcggcgaactcgccgccgccttgccgcagaagggtggtctcgtcggcgtcctcgatccgacggactagcttgtcgtactcactctagaattatacacaatcaatatgccgttaaagattaaagtgctaaagagattcgataatttaacacgttttaaaatgtgttttgattatttaacattttggacattttcatttactcagatggccccacatgttattctcacaagtatcaattaaaataattgggaaacgaaagaagtgttaaattataaaatttctctgtgtaagctgtggttatttctttttctcctttgtcattttggatgttagcatgttctcactctggtcataatatgtgttgttttcgaattcgtgtagtaatatatgtttaaactttgaccgtcaaattctatttgaacgtttcggttctacttttgaatgttgtatggttaattagatttgtcctgaataaaagtttcaaaatgttatattaacttgtatgtatcttttataagttttatacttagtaatagtaactgataattaatagtcaaactagtgtcccagtgactatgtcgttgtttagcacatcacgttgtgatacgctaaaaaaatagttagcacagttgtgcacctagcataccaacagggacgaatctggaccttggggcctcgcgtagctctattcttgacccataatgttatgggctagctcaattaaacctgatccgcccctaaatttatttagaataaatttcacagaaccccacgttattggggtatctattaacttcagttattgtgatttgttttaagaaatctcatattttagagtaagatatttcaaaaaaaaacctatatttatgtaaatactcatatttcattattacattattgtttttttaataaattcacattgttggctcaaaatacacatttctcttatctagtttaattgttttttcaacttttcaccgcatacaaaactcaccataatcataaccgataataataaatgataaagcagataacgtgtatatatatgtattttaaaaaagatctcaaacatttttatacaattaatatagataaatatattagtcggatagacgatataagcttgtagctgagtttcatgaaacactttgcccctaaaacttgaggtttcatgaaacaaattgtaaaacccgggttttgcattaaggatgccccataaccttcgattctgtgaaatttatttccctctatttcaggttataatacgtcttgactttggtcaaagtcaaagtatttcaagcttaactaagtttatagacaaatataacaatatttataatactaaattagtttaatcaaatcaataattgaatatattttcttaataaatttgttttgggttgaaaatgttagagcaaggataatagtatagctcactttctactattagtccatcttaaagctaatatatataatagattagctataagattagttataattttcttctcctctatctatctctcacttatatatttaatgtatttatcttgaaacttgtgttaagctagctcttgtattagaatcaatactcttgattttttttttgttacctctctcctccacgtaagcttatagtagacttatagctcattattatacttgctcttactattttttttttcaacaaacttggtcaaacttaaagcaatttaattttaactaaagttaaaacgtcttgtaacctaaaaactttggggagtatttacttatccagggatagcataaagccttaccttcatgaatgtccaatcgtctaagaacttccggtcggccgggccgaactccggcgcggaggcgaagtaccggaagggggccctgacggcgacgccgtgccgccggcagaagggcacccacgtcctcgcgaacccggcggcctcccgcagcgcgtagtacgtcaccggcgagcacccgtcgtcagagacgtagcaggccagccttcgccgccgccggcgccgccgccgcccgggtagtagtcgacggcgagcagcgagagcaccttgttcaccgtcaccaccggcggctcgagcgccgggtccgccgtcgtcacgaacatgtcgaccgccggcagctcgtcgatcctgcatcaaagcacactgtctccgcatgagatcgagatggccggagatgcacgacgactttctaggacgatgggcggcgccacaccttccggcgaggttctccgggtaggtgtcgaaccgggcggggctccacttggcgttcatgttgagcagccacacgaacgcgaaccacgcctcgcaggcgaacgccacgcgccacgccgcgccgccgacgccgcgctcctcggcgtcggcggcggtggcgcggcggacgaggagggcgaggaggaggaagagtacgacgaaattggccagcatccacgccgtgcgccggatcggcgccctctcctgcagcttcttctcctcctcctccttctcgccgctcgccgccgccattgttactgctaactagcttcgtcaccactcgagaagtcgagctagaagcagagctgcacgtctctcctctccatatttataccggcgtagctagcaccttcaatcaaatatcaatggcagccatgggtttctctggttgctcttgctcgatcgctggcgtttgtcgcgtctccacgggcgccgtcgatgaaccgccgcgtgacgacgtcgcgtcgagagagaacggccggccggccgagatcaatcatcgatgtcgagtaataattaatttctcttggggcgatctgcacggcctgcatgcatggcgtcacatcgtctggcctagctctaaaacgtagcgatccgatgaccagaaaacgagcagtaattactgagggagatggattagctgcgacatccccttatctcttactcccttcctccgtcatattttaagttatgttctgacgactttctatgtccattgtataattgttcgtcttatttaaaaaatttattaaaagatttagaaaaacaagtcacacataaataatattcatggtttatcacctaataacaataaaaagactaatcttaaaaaattaaaataaaatgaattgtcaaacgttgaacgcaaaaactcgcaactgcacttaagattaggggtggaatcgagccgagccaggcttggctcggcttggctcgtgaaagcttgacaaagaagaggatcggcttggcttggcttgattaatgaaacgagctaaaatagcagctcggcttggctcgtttcaaagctcgagccaactcgagccagcttggttcagatacaggcaatgaggtgatggacggcatcaacgccgtagaggacggaggcggtagaccggcggcgctgggaatggaggcgacaggctggcgacgctgtagatgagggaggccgcggaccggcggcgttggccgctagggatggaggcagtgccataggggagggaggcggcggaccgacagtgtagcggagggaagaggcgccacaggggaggaaggagacggtgcagcgcagcgcctcgatgtcctcatgcggtcgctgcggactcgcggtctcgcgtagtgggaaggggagaagacggctgcctacgcgtggggtgggtgggagactgggagaataggttaggaacttagggtttttgatgggccttgggccacaacagcgacaataatgtgctaggccatttttatgcaaaaagcttgacgagctgaacgagcgggttgcgagctagcttgggctcagctcgatttagaaacgagctgcgtaggcggcttgagcttggctcgtttaggtttcaagccgagccgagcttttgcgagctcgaaccaagcccgagcctgctcacgagcccgagctttttgtccacccctacttaagatgttatagagtgggtatatgccatctaaatagttattatttctttaaaacagattaatgagaaatgtatcactccacaaacatgtaggatcaaattcgacttctacaagttgtaacaaaaataataaattaaattgcgtacattcacggttatatatatttattttttttacgacttatacaagttcaatttgaattcgcatatttatgaaaggttatatttcatattaatttatcttgttaaaaagaatttcaatttttgtaactatttaggtgaaacaaggggatatcttctcgagagatgaaaacacttttccattgttgagtggtcataatgcgaaaccccgtagttcatgcgccgatcgagatgtgatcgtctaatcgagatgtgtggtgttgaaccggtgtgatgcttcttgatgcttcatccatagacaaattgcacgaactgttggaattattacgtggaatatttcaacatttatttttgtagtgtagtcagtttggaagtattgtgtgatagggaataactgatgcacaatgtaacatgagaaaattgttactcgtcgagggtgactgtgtgcacaatgtaacatgagaaattgatactggagatatccagggcgactatgttggaatatagtagatgaattacttgagatacactctactacaataattgtcgtacacatacgtgtttttttccctcgtcacagggtgaaatagatgtgtttgtttacaaaatcggctctattataagctgttgaccaacatgatcatattgaaattaatcttatatacaatatgatcatgatacatgactcacatatgtgtgctagggacttaggtcctgtttgattcagcttagaattattataatatgaattattaagagtaaactgaaacaaacagatagcttattgtgatagtttattataatctataagctagattactgtaatctggtaatccactctaaaggtgcttttttaaattattaggtggctaacagctaacaaacaactaataatccagagaaacaaacaactaacagtttattctatgtaggcttattataatccagcttatagtaatctggcttaataatcttaagctgaaacaaacaggggcttagtcatataactgaactgtctgatcatggttggtgacatggttataagaagtctaatggtctatcgaaaacatttatagtgtatgtatatatgtgtgtgtggaagtggggtccataaatatatcgctaccctctactaacctcataatgtattatgagcggtccacgaaattgatctagaattaaaagcctaacatgaaccaacatcatccaaattttggttgactcaagcaggtaaatatactagctttaggttatgtacaaatcgactcgatggctgagctttttcacgcacctaaaacgagcatagctattactttcttaagaaacttctatatgaaaagtcgaatgaaataaacggtcggtccttaaatttggaccagagcatcacatagatcgtaaatgaggaagtactccagcgcataataagttgtttaattaaaacatagccagtacaggtagccactacaggaatcctggattacatcgggataatagtataatacattagagcatggtgatgtcaggtaaattctaacagtactagcttgtcgggaaatcaaattaggcctggtttagtttaaaaaaaaattattttcgtgatgtgacacccaaaaattttcttttagtgaactaaacaaggtcttagcttggcatggctctgtcataacaaataatcctaacggtgttaaccgtcacaataaatttttccttcatatcatctacaccgtcgggtcgtttattccaatctcaatgacttgtaatacgcatttaatcaatagtctcacgtacggaacttaaattcaaatggatctaatataactatgggaccgtataattatacgttcaaagcgtaaatatctttagaatataatggacgtacgtagcaatacataggatactctccacagaaatttttcctaaaagggaaaaagaaagagtaaattgcatccacggtgcatcaacttggctgatggatgcaatttggtaaaaatgagcgttctagtgcaacaacttgcaatgtaggtgcaatttagtataagaactttataagtgatcgtataaatacaacaacttgcaagataggtacgattttgatacaataaattaaaaagttatgcgacaacttaattattttgagcattttttaataaaaattcaatttgtaagtactaattttgacaatatactagcgcaaatttgtataagtatatttatatttttatcctaataactaaaaactgaaagccaattaaactagatgtagaaattattatatttggttgatatttgagaaggtgaagaaaacaaaaaaaatcttaaaggtaattggatgtaaactgtattactatgtgcagtataattcttaaagattaaattcaatattataaggtaatattcatatgatttttttaaattcaataccttataatattaaattcaatattataaggtaatattataaggtaaaacattgtgaaaaaaaaactcacctttcatatgcttagcaaagttgatgcaccaaaatactaaattggtaagttcttgtactaaaacccacccacttgtcaaattggtgcactcggaccttcaattctcaagttcatgcactatatcgcacccacctactaaatttgtatcgggggtgtaatttacttaataaataatggataaacctaacaagcttcaaccttggtattcatgtatcttttccaaaacttttgcctaacgactacttctgttatcgggcgttcggacatatgcatatatggctgtgtgtacaatcgatcgatcgacagaagcgatcacctcggtgtggacgtctggatgtggtcacgccgcatcttggatggacgtttgtgtttctgtgtgtgtataaaggttttataccgaatgtttctatgtgtacttattttagatgtaaacaaaaatagaaaaaaaatcgaatctgacggaacgtggggctcctcaccgggagaccgcgcaggcccccctttgccggttcggccgggggcgctaagtgagattctttgccctcgatctgtggaatgttcgcgagagagagaatgcacgagacacggacgatgtagacaggttcgggccgctgagaaacgtaataccctactcctgtgttctggtggatctatatatgaaggagttacagagagctggagagcaagagagtttaggctatagaacctctcctcctctttctctcctctagagctcccctatttttgttcttttcttccttccccctttcttttttttcttttctcccttcctctttttttggtgggcaaggtcctccttttatatctcaaggggataccacatgcaccacttctacctactcttctttttggtggggacccaccctatcttgaccaaaatcacagcttgtccttgagtgaggcccagcgccgtcactcgcctgacacaggggatacccctgtcattcctccattaatgggcggagatttgcaatggccgctgtccgaatgaccctccgatgggatgggtcatacctacttccactccgccggaagcagatgcaatgtgggagcacggttgtctgccgatgacgtaaccggcgtcagaccagtcacagaccggtcattcttgtccaccacgcgtcagtttagcatgccgcacgtctgtccttcttcatacaatgacttccttgcaatggttgcgatgaagcctagaatgaatctggctgggactgacgtgccaactccaggagttcccacgccggctccggctagggacgagtgcctggaggctctcattattccgacgggacggggcgaggcgagtgaaaaggccgcctgctgccacctaacccacgatctgaccggtctgtgaccggtcatacgctgcgaccggtcacggaccggataagcgtgcgctgcgctgcattaaatgcagcgtggcgcgctcgtataacccgctataaatgcggttaggtgagcgccgctgtgctcacctaacccacacacgtggcgccaacaccacagggggtcggggcgccccagccctcggggccgaaacgggagcggcccgacccctcggggagacagagggtggggtgtccacgtcaccctcgggcccaacccccctgagggggtcaggccacgtgggtgagggcggctgcccaagcctctagtcacgatactcccggtcccatgtcaccaacagaatctaattcataggagtgatgtgaccatggctaccacggatacaaccattgctcacatcatggatgaacaagaagatatcgagatcaagtactccaagtgctgaaatccgattcggccacctactacactgctgacttcaaacggccaccgaatctgcatacgacctccgttttcggcccgtgagtacttgatggaaagctctcggagccctctttctaacggatccagcctcttctctaaattccatctcgtgtggccggaatcacaggaacaaagtgatgcgtcacctataatgggcctatgggcttgtaacttcttttgggaccccgacccaggtggggcccatgtggggtgcgccccaagctggtggagcacgaccctaggcacccctaggtcatcctcccacccctatatatagctagttacctcttcagggtttctcgggttttgattaattgtaagtttagccattgctacttcgcttgcagcgcgcgtgtcggctagaccgtccgtctgcttgttcggaaccccactttatcgtgtatcaattcatctttgtgtgtcttgtctatctagcaattcagattgcttttatcttgttcttgcttgtttcttcgatttgcttgcaggaataaggttgatttgcaccggcaagatcaacaacccacagagaggtgtatcgatcgctaagacgcaacgcaacgtcttgtacggttgtagtcgggtcgtcaacgtttctcccaaatcgtagttattatcaactcaccgaaagatcaggccaacaacagccgtgagtgtcgagaggaactcagggttcatcaaggagtatcccttccccacctctccttcctctctttcctttttagggcgccggtagcagagaggacgggagagcggcggtcagccagagcaagggagggcaccgatggctcctcacctcttctctccctccctcctctctctctcccatcactggtgctctgagtccagctcgcctatgttggtagcctcgacgagaggctcgtgacggtagatgaggttcgtgtggcccttgcccattgcctccagaccgcgctcgaagtgggtgcgccaaggtcaacaaagccaagaatggtgcggaaggcaggggcttcgctcatcagcggggccatttgaggcaaggagcgcacaaaaggcgatgatcgccgctttttaatacaccattctacacgaggccgggagggcagcgatggcaaagtggggaccgcgccatccagctccttgttatcgtcgctgcctcctcgattgccgtagcatggaggagagtaggtggcgacaaagtagcaacaatagcaaaagctcgacagccaaggaagtcaccatgggaccccgtgtagattggcaactatggtgttgactgaagaatcgattcaggtactgcaagaacccatacctctactatcatgcaaactctgtcctcaatgtatcctcttgcgtgcacggacgggtgaccgagcacgatctcgtgcaggactcatccggctactggtgccactgcttccctttgtactgggataggcagtcgtgcggggcaaagaggcaaccgttttttttatttttagtttcttttgtcacttacatgtgggtcccacatgtacttttaaatttcttcacgactaagttgtcacgtggacatcaaatcagcaaaaaggcaccatcaataccatcaaggaagctattttacacgattttagtagttgaaggagccattatatccggttttacggttgaaggatacgactcatatgatccgacctatatttgagggaatccaattggactttcccaacagaatatacacgctatatcatacatgggctttggaatgggctcggtctaacttggactccgtgcgtgcacatgggctcttacccgttgtgggcctaatatactcatgttcatgggccatctgatcatcaagaagtcatcggaccaggagtccaggataaagggcttctttggcatgcaatcaggtactacgaccattctacaatggctggcccctttacccggtaaattagcatgcatgggcgatccatgggtagagcgacaaaatatgtagtgaaaattaagaaactatgatctgaaaattgttcgtgtcatgaagagtaatggttaaatttgcgagtaaaatttatactcgtgatgacgtagataaatcttagacatattttatttaacgaaagttttcaggttttcattttattcgtgatttgcattacatatttttcccggctagagtagtgcaccatccatgaacgaccgtgccatcatggtccattatccatgtggactagctgaaggctgaagcagtagtgttggagtatcttttttgcctacttgtttgcaggagttattgaaacctacatacgcttccaagatcaatgtccaattattagacatcgaaggacacgaaaagattagtatatgtatggaagcatgcaccgaacatagtgcagatggccccatcgttttggctcattcatcaaataaaccaaacgacatatttacaaataaaaaataatttattaataaaacttttatatacgtgttcttagcgttttaaaaccaaatactgaaaaataaacttcgttgaaaaaaaatcccaaaatcaactgcaaatttatggttaaaatttaaattttggcttatatgcataattataagcgaaaagatgaaaaataaatgaaacaactaaaaataattataattgacttgtttatgctttagaaatctactccatctttcaaaaaaaagtccaaattcatatcattggactttattttacaggaggagtaagtctgaaaaataacctatgaagaaaaaaattcaaaatcaacttaatttaaaattaagttttgaagtttaaattttagctacggtttgtaagccagtactccctccgtaaaaaaaaaccaacctgagaagtcacatgttgtttttttttttactgcagcagccggcggtactcccgcctccaggacgagatcacgcagcacaacaccaagatattagaatcctcgacctccgcgatttcagtttcttattttgcagaaattcaggctctaaaaaatcgaaagccacacatccagagttaaattttcgatcaaaaacctccacgaggtagatctccttgatatcgatcaaacgagtcctgtagtagtaaatttatttgtactttgtattggtgtattttcgttttgcgtctaacatgtaatcgcaaaaatattttatttttattatatatattataatagaaaacatagtgaaagatatattttgaaaaccatgatattattcaaaacgttaacaattatgaaagtgaagaaaataaaggatttacaaatatcacacgatgtacggttattggataactgtaataccgtcataccgtgaggcaacgataacccttatcaagacgacaagggaaaccatgctactaaccacttaaccagcaaccacctgtaaaaaaaaaaagcaaccaaaattttttaggatctctgttctttaaaaaaaggaataatcttgtagatatgatactacacctgttacatgtaatcatgcttgagtccacttgctgtactattgtagctgttgtaatgttaatgtatcaacagtaagcattaactaatcaacatggtccactgaactaggagtagtatagtatatcattaataagccatttgccgatcgcttcaaagaacaggggaatgacgcttgtgatctagcagtgcaaaggtagtactagcaatcagtggcttgtactattgggaccaagccaggtgtttcattcgtcacaacaggcaaaaaaaaatcgaagaaaacgaagtaaaatctccggataaattaagcgcacatctgtccactacctagcttacacgtgtccctttttcaacgtcgctctccagcttgattcttcgagcaagcaacccctccccaggtcgttcctatccggaaaagaaaggaaagacagggaattgctttgcagcaatgtcattagtttttcattcattttcagtcgatttctcgtgtttggatcgacattttcatccataggccggtgatgcttgtatccattgtttcactagagttttatttttatgagaaaccctatgttgggtttaattacttacttcctctgatcataagtactgtattaaacatttaggataaaattcgattagaaattttaaaattttgactaataaattttattacaataattttagcaaatataataaaattatgatgccgtaataatacttttaaagaaaatctatacatataattttttaaaagataactacatactccctccgtcccataatatagcaacccagtactataagatgtctcatccggtactaggttgctatattatgggacggagggagtattcaaaaggctattgatagcttaagttttaaaagtttaaacaaatattattttacattttaaatatttatgatcgaaggtagtatgttaaaagagatgtaagatatatcatatgtgcaatgagccaatgacccatatgtagctaggggtgggcgttcggtctacccaaaaatttcgatctcggtcttcggtttttcggtcacttcggtttttgaaaagtcaggaccgaatttcatccaaaaaatcaggaccgatgaattcggtctcagtctcggtcagaccgaatttggaggagccgaggcggagtatggagacgacgccggcgagatgtggaggcggagggcggaggtggcggcgcggcgcaatggatccggcggccggcggcccgcacgaccggcgaggcggcgtggaggcggagggcggagacgacgccggcgatgtggagacggagggcggaggtggcggtgcggcccgatggatccggcggccggcggcccacgcgaccggcgaggcgacgtggaggctgagggcggaggtggcggcgcggcacgatggacccggtggctggcggcccgcgcgaccggcaaggcggcgtagagacggagacggcgccggcgatgtagagggcggagggcggaggtggtggcgtggtacgatggatccagcggccggcggcccggcgcgaccagcgaggtgcagtggaggcggagggcggagacgggtggagcgatggaggcagcggcagtagtgcggcgcgatggaagggagggtggcgcgatagggatggaatgggaatgcagcctggatggatgagggtggcctctagggtttagtggtgtattaggcttattgggcctcctggacctattgggccacaattcagttttctcgattaattcagttaaccgagcctaataaccgaattacccgaataaatttcggtctttgacatgctgagaccaaattactacacgaatttctcggtctcggtcttttcggtctcggtcttttcggttcggttcttcggttcggtcttattttgcccacccctatatgtagctgaagaaactagtctagagagtagagacgaatggaaggggctggatggccacatgatgtacatgccagaagtacgtggagaaaaggccgtgcgaggtatgtcacacaaggacaggaaaatagaaggagcatggttactgacatccaatgaaatatatggtgtatgtgccaatgtgaaatcagggggcgatcacctaaatatgcatgaaaatgtcaaaaagggagacgataccatagatatgatctataatatgtgcatcgaatttgatatgtcagcctaatattcgacttaaaagtacttttaggataagtgttactttttcttactcttagatatatcttacatttttgcctttaaaaaatgatttttttttccagtgacgactaaacatgaacaccataagctccatggcaaatacacgatatgacatagcaaaaaggttaattcatccgtcccgtaataagtattaagctgcatgcatcgaccagttcaacccgaaagcttaagctgatgaggaaagacagacaattcattttatattccaacactccccctcacgcgaggcgccctcaatccagccaggattcgaactcgagacctttggctctgataccatattaagttgcatgcaccgaccagttgcacctaaaagcctaagctgatgaggaaaggcgggcaattcactttatattccaacaataagttcattttagctcattccgtttattccaaaataagtttatttttagagcaattattacatccgagtttgtgaaattagaaaataattatcttatcaggagtagataaagtgaggaatagttgcattgggatttgataaagtggagtttaatatttttattttgtattgatacgtgtaggataagtgaaagataaacttattttggaacagaggtggtaactaggtgtactacataatttgttgttcaaatttttactgtggagccaagcacaactcccattttatagtcttagtcgccctctcaagaagaaacaatattttgggatcctcttgacaaaatcctaatttgtgatggataaagaggaaagaaggatagtggaagcaccatgaatgctacagttgtttttgatgctggaatttgatgggttgcttttgaccattactcggacaaacttaattcatggtgaaagtgatatagcaaatgtgaaaaaaaaaacagagaggatcagtcctcgatagccatgaagactagcatgtttgtgccaagtcattcatcgacaccacacaagttgctatctctatctcaaaatgttactatctaattaatatatagaatgtaatatcacctagtattataaatataaacagaaaaagattcatccagattcaaatgaacatatatgtatataactcaagtgagtgctcttggctaactttttttttaatataataagttcccaacaattcctacggtggtgcatgcagtccatgtaagaaaaagtttgccttttgatccatttgcaaggcccctaccaaatttctcccctgccacaaaaaaaaccggtgttccacatgggcggctggatatgcactctgccacacgggatccgcgaagattcctgcgcctcgcgggaagccgccactgacaccaaccgccacctctccatgacagcgggtcccacggaatcccgggcccaccgccacgtgaccggggcttagagcaagttcaatattatagcccactactatctctaattcatctatagtcaatctaatagccaattcatataataattgttaactatactattaatatattgtttcacttgtcatacacacattacgtcttatagtccgtgctacagctggctataaatctatagcccg

SEQ ID NO: 61505 - DNA, 2000 bp, Oryza sativa
aagaactctaacctcttgaaaatttttcttcgagtctatctctctcatccgattcctatgtttttcatgagcttcaatcaaacggtcattcctatatttttcctatattttgcaattgcatttctattagaatcttgtggtttttctattcctctatgtttgtattcctacgattcaaatgggcgctaaacgatgtgtgttttaaaaaattaacgaaaaatacttttaaaaatcatattaattcatttatttttttagtaaatatttaattaattatgcgctaatgaacaatatcgttttccacgaaggaggtggagttcacctcccgaacacaaccttcgtcaggaagggagcggtgcagaaacggaaaccatgagaagaagcaggaggaaatttgttcctcgttcgatcctgacgaaatttgcccggaatccatttgaatccatgaggttttcaagtttcgggcgacagttttctgaaacttcgttgtctgaagcagtatttttgtagggctggcgattggtgcagggaaatagtagtggcaagggaaattttgccaggtttgtctagttctgaagtagtttgggacttgggatcaaggtgctataaattgcgagagctactggatgaaagtgacgatacatcgaacggtggcccagtgctgaaaaagggcgaaagcaaccagtagaagataggcaagggaatgaaacagccgatgtgtataatccccaagtggtccttgggtttgtgctgttgttcaatccaagtccttgaccacctagctttaacatgatttaaattcattggtgcaacttaaatataagctaggtggtgtccgtgttttgctgcgaaaattacaaagcaatcttcagaatgtttttttttccaacaatcaagctaggagtccaaacgatattagttattaacaataaattaaactggtttaccaagctatgtttggagagaaataaatttagtagattatataggagattgtagatgaaatgttatattgttggctaaaattcgcattgcaagaagcagaagatagaaaaaaattaatgaaacatcagggtttatcaataatgatcataaaacaaacaaatgatactcacactttgatacaaaatatattgacatgtatatgttttaagtattatgttgaaatattatggaaatgatgtgagtggtgatgaaaggatatgtttgcatgttgattaagggtgtgtttagttccacgctaaaattggaagtttgactaaaattgaaagtttgaagaaaaaagttaaaagtttatgtgcgtagaaaagttttgatgtgatggaaaagttgaaagtttgaagagaaaattgggaactaaactcagcctaatttgtagaattcaatagattgtagattatgttacatgcttacataaggtttgatatgtaattattattagtgaataatgatgtgacacggatacatgttgagtttagtatatgttaactatcctagcccctattatcaatggcccctatggcagcgtcccagtcagcatgaacagtcatacacatacgaggaattaacgagctgtagcttctgaacaggcacaatcttatctcattttaattcacttatatgcatatttttttgccatcacattgcaacgtccaaacttcaaacagtacgtggcaccaactaacagaggtgatgtgcatctcacccaaaaaagaaagtgagattgatgctttaaaattgaggccaaataattggattcgtcgtgatatagtcaaattctagaaactacttttaagccaaatggaacattcttagctccatcgtgcaaaacttggttcgtgttacatcaaacccttggacaaaaaatgttgaatttctcgtccatccagaactttataccttgagtaaactatgctcacaatacatatacttacgtggtgattataaataaatactcctaagcatcaccttgtaaattgctagttctggtacaataactt

SEQ ID NO: 61506 - DNA, 851 bp, Oryza sativa
cgaatcagattccagcacttggagtacttgatctcgatatcttcttgttcatccatgatgtgagcaatggttgcatccatggtagccatggtcacatcataggaaatatgaaactggagggagtagtttacaacttccacgatatagcactcttgtaccgcctttaatatggttgaattcatggttttcgccatttattgcgagtaatattcaaatgccgtggttctgttcactttggattgtgtttcatcaagtagtaattttttttcaggtaaaattatgcctgcaaaagaaagaaacttttctcaaaggtttatatgtgccactgcaaaacacatgttacaaccaaattaaccattgcatgtagaagcagtcgtaacactgctacaacgcatgcaactgacaaattaaaaaaagcaatgaaacgagatcaaacgcttaaactaaaactaaaaagcacatcatcatttggatccctcctaatctggatgtcactcgggttgtagaacacatacgattgaaggcaaacagagttaacatgaccaacactgcaattacatagacatatgagcgtttagtcatatgtgccaccaacactgtcgggtttgcctggtcagagagggaaagtagcagaatgctttccccgtttcccgggttgcgagaattgggattggatgaggccgcgaagttcccaacacctcccacgcctggatattatcacaaattctcgcaatggaaatgcatgctatatatcatataggttcttttctatttcttcagctaacattcttaattagtttgcgagagaaatgtccacatgtataagagtcacctaacatgcaggccacttg

SEQ ID NO: 61507 - DNA, 8334 bp, Oryza sativa
  unsure (1)..(8334): unsure at all n locations
caaaggcacctcaccattgcaccaccaaaccactcaaagttgtagtcataggatagttccgttccgattggaatatcttgtttcgcaaaaattcccactcttacttccccaagaacattccatttccttgtctcacagtttggttggctgcatgcttcaataacaagctatcagatttaatcattaaatgctagtaaatggaaaaaaactcgataatcaattatcaaataatgcatatgaaagaaacataatataggcagacatatatttgctacaagacataccacgaatggttgatgaatcttgccaggctccccttctttgttgcgtcgatagactcatcagcattcagatagataatataggcatccgttaaacctaacagggcacaaaaaacaaatgttatagctagccaaaattagggatggcaatggggacccgaaccccgatacccgataggtaaaaactctattagggtatgtaaacaggctaaattcatcacccatggggctgttatcggctagaaactgtcaccgttgggtgatgcggggacggggatgttccataggcacccggccccgaatccccgtgggtgactcgagtagtgtaggcatatgtacagtccataaaagttaaaagcccacttagtgcccaatttagaggtgctggtatataaagcaaaagaaaccctacactagaccagtcctcccttgtccccttctcagatccatcagcagccgccagtcgaggtcggcaagggcgccagccatcgcacctcctccaggccacagcagcgatatagcaccccgccgccgcataaggtgaccatgccgcgcgagctgttgttctgcctccaagtcgcttgctcatgcgggaaagcaagaggacgggcacttgctgcatccgaatgccggtatatactttgcttgttattttctgctctgtcctgtttgtcgctgtttatttttctcattttgatggaagttggagctgattcttggcaacagaatcatgcaagtctggcaccatggtcatgttcataatctgagaaaatgatagatgtatgtcctcgtgctatttttgccgatctgttctacttctaccttcctactagagaaccttcttgttgatttatgcccacgagtttatcgggtgtgcgaccccgtgggtgccccgtgcacccggcgaggcttggggacgggagaaatacagccccgacaccggggacgggggcgggtgatttctaactgcacggggacggggacggggacgggggaccacaccccgccggggatggcccggttgccatccctagccaaaatgtaccaccatgctaacattgagggaagataaaatcaacagaccctggttttcatatgcttgagatctcctcttggcttccttccatgatattacttctccacaatattccataacaaattgtccagcctaaaaaccattaagaaaacaatgactcactaaagcatactcacttgaatatatttaacaacattagcagaccataaaatcaaggtaaattcagtcaccataatattctcatcagccaaaaggccccatccacgcccttcagtttttaccagccttgtcgcagcatattggcttttttgaaatcgctgccaacagagaaattgattaaaatacaaacataactaccagtgaaactgtaaagcactccagatgacattcggcctccctagcaaattggtaaaactatatattgaaaatgatagtgttcggtatctatagaaaattagtaaaactatatattagaaataatggtacatcatgtataagaaaccagattatattcaatctcacttgaaaaaaaatccttacagctaagagccagcacgactatattgaaaattgctgtacatctataataaactggattatattcaatcaagaagacaagaaagcaaaataaccgtgttacaccatttttttcccctcctgcctagtaactaggctcgagtgaactaaagtaatcatgtaagaacaaatgtatggatattcattcaatcaagatttggaacggttgcgctactacttgaacaagagaaacaccaacctggttcttgcagtatacaccgcagaggcagtatccaggcgtacactccgtgctagtcaagacgttcaagcaccgatccccgcacgcgctgtccggatccagcagattatactggcactcacacacagctatgtcctcctctttctgcctcttgtgcctagcatcgcgcaccaaagtataaagattcgcattacatccaaaagcacaggacgcagccgttgtcccacatcgccgtgaaactcactcacctcctgtgcaagaaatcgttggtctcgatgtggatgtacggcggcggcggcggcggctccatgcgctcttcctcctgcaaaaccgaacagcccggggagctcaatcatacagaatcaggaatctctacgagcgagcgagcgagctcacagagaagttaccatcagagacgctagctcttggacggcggcgaggtatccggcgagaggggtagggaaatcgcggctgatagcctgggacaggagcccgcgcggcgcgtgagtggttcgaggagcggcggaggcggcgactggggaagtggtcgccggaggaaaggcgtcctccccggggctaccgaggggggcgtcgccggcgccggaggaggtgagctccgcggcggaggacttcgccggctggccggtggtcggaggaggaggaggaggaggagaggaaagacggattcggctgggtcggatcggcggcgctagcgcttggaagcgtagcgggctgcacacgtggacggccaggatgggagggagagatcaccgggtcctcgtgccgccgtcgtgttgggccgggccggaagcaacctggctggattgcctcttccgttttgcaaacggagcaaataatctcatctataaatggcaaaaggaaaaagtataccaaaggtccctcaacttgtcatcgaattacaaaatcgtccttcaactgtaaaaccggatgacgcatctccaaacttacaaaaccagtgcaaattagatctctcggcggttctaggcggttttgactcggttttatcctatgtggcagctgactcagcgtgggacccacgtgggcccccacgcgtcagcctcttcttccttcctctctccacctctcttcctctctcctcttttctccaatttccgggcggcgcgcgggggagcagctgcacgtgacgggcggcggccggcgggcgcaggcggcgtgggtagaggccgcgcgcaggcggcgagcggccgaggaggagctgggcggaggtgcacgagctcctcgccggactaacgctagaccggctccgccatgtccgccgcgaggaggtggcgcgcctcgtcggctcgctcagctggagtgccaccgacgccgagcacgtcgacgtcgacgccgcgctgatgggtgtcaccagcaacatcgtccctcgcatggtgatgggccggcggtggaccggcgacgacaacgacatggaggagatgcggagcgtggtcgccgagacggcggagctcaccggcgatctcgtgtaccaggacatcttcgcggcggggacgacaggcggagctcgacgcggtggtcggtgacctgcaggccgtggcgaaggagacgttgcggctgcacccgacgccggccgcgccccgctgctcccccgttggctgccgcccgccgcccacgtccgcccgcgcgccgctccatcgcccgccgcacgcgcgcggctcctccccacgccgccttcgcccgcctggagttaagtcaaccattaactttgtaccagttcaaatcagtggcaatcaccaaaccaaacagtgcgagcatgtgagctcgatcttaacaacaagcaagcagaactgtagcaggaaccaccagctgctgaggatccaaagcaaatggggatcatcagatcgattgctcatcggcgtactactggagatgatgggctccagggcaaccttgtcggcggttgccttgcaggatggatggattaaacgaaaaagtacaccgaaggtcgcccgccgcctgtgcccgcctgcgcgccgctccgccgcccgcgcgcggttcctccccacgccgcctgcgcccgccggccgccgcacgtcacgtgcagttgctcccccgcgcgccgcccggagattggagaaaagagaagagaggaagagaggtggagggagaggagggaagaagaggctgacggatggggcccacgtgggtctcacgctgagtcagctgccacataagataaaatcggagtcaaaatcaccgagggacctagtttgcactgttttgtaagttggggaatacgttatatctggttttgtagttgaaggacgattttgtaacatccatgacaagttgagggaccttcggtgtactttttccatggcaaaaggataatggaataagtctatttttggtccctcatctcttgctcgtgattaagttgcctccctcaaccgtaaaactgggtataatgtctcccccatcttaaaaaaaaaaggtgccaatcgactctttcggtggtttggaggttggtttgttgacgtggcatgatgaccacgattgatttgccgagtcagcatgtaaggcccacgtgtcatgactcctctattcccctacctcttctcttctctctcctctattttcattggcgaccgcgccacgcccgagatggagctctgacgagggttcaagatgctcgcagtgtcgcggcccaacccgtccgtggcggcctgtgagacctacctcaaccaccccgtccagctcaatgacctcagcccagaagccttctcagagatcccccatgccatggcgctcctcaacttcctccgcactgtgcgcaccgtcatgctctccgttgtcggcattgacctcagctcttgcaggaaccccacctggtcctctccctgtcgggcagcgccgatgacgaccccctgcccacaaccgaggtgctccaccgtgccatcctggagatgttggcatcagtcacggccatcgagcgatgcagaacgccggtgatcgcggcaatgaatggtgcttgcgtnnnnnnnnnnnnnnnnnnnnnnnnnnnnnnggcacaatctatcgcaggagggctctggggagcgttgcccaagcgtgctcccatcgacagcaccgtgtttgtttttgcctaacatagatagacctggctctctctctcccatctccaatgtctccacctccctgaccagcacctcccctagatggccaccctccttcttgtcagcgcccccgcgacactcttcctccttcacccacccatcgtcaccgacaccaccatcaacccatgtagcctatccatgctctaggacttgcgccgctcgctgaccaatggcaatgccctcgccttagagtgggacctcaacatcgccgagccctacgccgcctgtccgcacatctcatgcgaccacaccagccgcatcaacaacatcgaccttcccgccgacaccaccgccatgcaatagctttagagccttagcctcaacgactgcaacctcaccggcgccatcacatacttcgtgcagaactcacggactggctggtgttggcgctcctaccattgagtgacgtcgtctggctccggctgagaacaaagagagatagagagagagggtaaaggggagaaaaggaatgactaacttgtaaggctactgtttatttttttctcactgatatgtgggtcccatgagcatcacgtaggacgaaaccgccattcaaacagcgaaggactcgatttacgccggtttaagggagcaagattggagatatgtaaactagactaattaaaaaaatgttaaccacaccgaaaaaaataagcatgtgttggagctcctaccgcggagtgacgccatttggcactggcttggcgagaacaaagagagagggtagagagcgatggtaaaggggagaaaggaatgactgccatgtgaggccgttttgtcttattttctctcactgacatgtggatcccatgagcatcacataggatgaaaacgccatccaaacagtcgactgacttgatttacgctggtttaaggaaggtgaaaaattgaccgggtgattcagagttcagaaatataaaattgattcattaaaaaaaatggtcgcgtaaacaaaaaaaaaggaggacatatgacatgtggatcccatgagcatcacgtaggatgaaaacgccatccaaatagtcgactgacttgatttacgccggtttaaggaaggtgaaaaattgaccgggtgattcagagttcagaaatataaaattgattcattaaaaaaaatggtcgcgtaaacaaaaaaaaaaaggaggacatatgctaggcgtatgtgtcatgcgtcttttgcccttgggcggtgacaatgattatttcctttgaccaatgtgaatattgcgagccgtgcactcagcacgtgcagccaccggactcggggtgtgcccgtcagcacgcttggttcggctgtcgcctgccatatgaggaggactaaacgttgttagctctccggtgtggtactaaacaacgtgcaccacctaagcacctttgtgtttagaaacccgcggagcggaataaattcctcgtggaaagacgagcgcacgtactgtattcacgtacgctttcggtgaacgtaccagttccgtcataatctcagcccatctccttcgtcacacaacgtatgactagtagaggttgtttggttgctagccaaaatttggttaatttaccataagtatggcaagtaggtttgatcaagttagtgtagtgtttggttctaatcataagttagttatgccaaactttcctttaacttgaccctacatttaatagacacaataatgtgtggcaaggaggctaagatgtggcttcatttttcttggccacaactttagcaacttagccacaaatgtctggctagcttaggcagttttacacaaccaaccaaacagccacatctgccgaacaaatggcagctaaactggtataggaattgtccaacaaagtcaacaactcgttgattttacaatttttttaagaaaatttaagaagtaccattgataagtgtctggttccaaaaaaaatgccatagacaaatacgagtttcatgaattactattgtacaagcaactttgtcccataaatgctaatgttgttataattccgttagcatctccccgttggcgttgggtagacggaagaataacgacaatgatatttctaggacaaaatcacttgtacgatggtattttataaaactcatatttatcgatggtatttcttagatttatgtgtatgtcaatggttggattttctcttccttttaccatcagcgacgctagctgtggacgtaggggtgggcagaaaaagaccgaaccaaaataaccaagactgaaaaattcggtcttatttactagatgaccgaatttttttcgatcaattcggtcatcacccttagttaaccgaatttcattgaaagcccatatcagcccaagaaagcaagctcaacactagtaaaaccctagctccctctctattgccttctcctcatccacccagctagcagccgccacgctctcccacccaactaggagagagcgcttatttcttttctttttcacctgagcgctcctttctttttctctcgcacatcgacgtcgtgttttgtcgtcggcgcctctgcaccgtcccagcgtctcctccttctcacaagtcacaccacgacgacctactcttgttgcgccaccttcagtcgacacccatgctgccggagcccggaggcctcaaacccccaactgccaagcccaagccgcgatcctccgtggctccaccccgggggcacatctgatggtgcctcctctaccccgccagcgacgagaggtgccgaagccgatctgggatgagtatatgataatgaagaaagccgatctgggatttttatgaattttcttcatgtgtatgtttttttatttgaaatttattgtggatttgtgcgattcttctgaatatttctgaaatttcggtctaaccaagaccgagaccaaatagttctatctttaatatttttcaagtccgaacggtcttgcgctttaaatgaccgaacataaaacagattgaaaaccgagatcgaattttcggtattactgaatgctcacccctagttggacgtggatagcgctgcgatttagcatgccgaggcaggtggaagacgagaaaaatccaacgtgcggtagcataattgtggctggggctgcaggaatt

SEQ ID NO: 61508 - DNA, 11067 bp, Oryza sativa
  unsure (1)..(11067): unsure at all n locations
agcttgccaccttccactagggcggcagtgtctatttttgtaaatttttctgacgatagattatttctgtaaatattttaaaaaaatgaaaaatgaaaaaaattctgatagatacacacatacggccgtgttgagccgggccggaagtactgataggttttgcttgattgggcttccaagacaacgagctgatgggcctggacaagctccgtgtgggctgggactcgccggaagggagttcccaatggagtgtgttttcgctaggcaacctcaggaagggcttcgactctttcgtttccgggttacaaagcagctagctttggttggaaacgaaattctcgtgcctctgatagtgtttttttgccagatcggcacagtggtgaacatgatctagatagaggcggaaccttcttctctaggagatctttttagcacttaggttttttttcagctaaattcggaccctattctccccatcataacccgccatgattgttctaacgttaaagttgtattcaaacatttttcttctactataataacgtgcaaagctttttttaaaaaataatagaataaaacatcccggcctttgatcatcagagctatagccaattattacaaaagtaacacccaaacactgagtgtagttcaaatgaattaaacatacccaacaaaataaaatatcaaactaagataaggagagcacatttattcaagtctatttatgaatctccatctatagtttgcaaggagttgcatgaccgttgtctcaagcttacgacatgcaaccttcataagctctcgatcatcttcacacatttgcagctgtgcccaaaatcggagcaaatatgttgccctgaaaattacctgtatatatgagatagatagtgatttgtcaaaaaccatatcattcctagtcaaccacagagcccaacatatggcagaagctcctacaagtatgagtttactcttcttcttatctaccctcaaaagccaaccatcaaacatattagatatggtagtaggaaggtataaaccaagagagaactgtactgctctccaaacaaattttgcataatgacactctataaaaagatgttgaatagtctcatttttcataaaaaacaacattttaaactgtcattccaatttcgtcttgccaagttatccttggttagcacaacccctttaagcaagtaccacataaaaatcttaatcttaagtggcatcttaagctttcaaataatcttgtttctttcactataaccattattaattaaagctagatacatcgacctaacagaaaatattccattctgatgataattccatctaaagctatcagaggattgattcaattgaatatgtacaatagaagcacacaattcatacaaatatgtaagattctgaccaactaatgatctcctaaaggaaacatcattaaaaaaaaatcatctttcttctagaaaaacagcgtactacattttctctttctccaaaaatgaaaaagaaatagcgtcgattttacatgcatcaacttggaaaactttgtcttttcttataaaacaaatcttggccatgcagcagaggttttcagctaagctcaagacccacggtatgggccactgcatcccgtcgcgtgttccgcgtcaccgtacacggcgcctgcacacgcctgcacgaccaaagcgaaaacggaagcgaacaccaaagaccagttctccaaaaaaaaaaaatctcaagaaaaaaaactaaagaccggcaaatcgtgcctcgacacgtcacgtgctcatcaaataatcacaggtactgaggtacgggaaaaatactaatcgccacgtggcggaatgaccccgtttatttagtgttattttacatgtaatgtaataataatgttattatcatccatcaatcaccttatgaccattttccaccgttcccaatttccctgctcgatcgacttgctttgccttcgtctcctccactctgacttcctttctagatggtcaaactgcagccatcacaaaatctatatctctttttgtctcctacttgattcagagatgagaacaatccaagaatcgccataaacacacacggacaaaatttgcttttgtttttgtcttttttagctttggctcctgggtttcttgcagcagtggaccaagagtcgaagcaaacgtttagagtcagcgcagagccaccacggatcatccaatccttcgtggccaaggatcgagggactgtcttcttatgatccactgatcttctcctaattcggtttcgcttcgtcctcattcgctctaatcaaaccatttgtttttgctaatttcgatgttgcttaatccaagttggcttccgcaaaccgtgttttcgatttgtttgttttgatcatggcgatggatggggaagtgtccggtgtttggagtttcttggctttctttaagctcgagtggttgaggaagaggagcatataatttggggggtgttcttgcatgaggtcaaacgagcgtagctactgcgtcggcgatggcgttgtcggagccggacctcgcggcggagacggaggcgatcgtgtcggcgctcacgcacgtcgtcgcgtacggcggcggcggcccgccgccgagcgaggagaccgccgcgtcgcggtgacaaggacagcgccgtggcgcgcggacggcgcgcggcagggggcggtgccggcggcgaggaagtacaggggggtgaggcggcggccgtgggggaagtgggcggcggagatcagggacccgcacagggcggcgcgggtgtggctcgggacgttcgccaccgccgaggacgcggcgcgcgcctacgacgccgcggcgctccgcttccgcggggggcgcgccaggctcaacttccccgaggacgccgccgcggccgacgagcgacgcgccacggacgccgcggccgccgcggcggcggcgtcgtcggcgcccgccgcgctgctggagtcgcagccgggcgacgtcgcggactgcctcgactactccaggatcctggcgggggcgccggagcggccgacgagctccaccgtcccggacgggttcttcggcggcggcgggaacggccgcttcttgcactcgtggagcattggcacgtcgccgtcgccgtcgggctcgggctcgggcggagccggcggtggcggtggcggtggcggtggcggcgcccctgttcgtcctctgtttcatggcggtaacggctgggagcaacgcggtgacagtgcatacaacggtttctagacgcctcgggaatcgggattagcgatatttgaagaagaaaagcaaaggattcgagaattagcatattcttttatcatggtactgagaattaggctatttttttaggtactcatagtatattcgagaattagcctattcttttatggtactccgtagtgtagtagtagtggagtagtagtaattagcagtagtagcagaataactttgttagattgtttcccgaaaaatcattgtatgttccaaaaactcatttaaagtaaggcaagcgattatttatgtagatagatacatgatgtaaactcaaagcaattttggttgtagtgatttgcgatacaaggagcccccgaatggggggcagagcaaaaataaaaaaaattgctagcgtatgtgtcatgcgctgttttttgctcaattgttgagcgaagagccgaggacaagcaacacagcaatgtccacaagtcggccttcataatccatgggttttgtttgatatgcttacgtgtgacatacgcacactaccatcagcatacacgtccgtgtgtgcgaggtgtgccttcgatcgagcacgtcaacagcgtagcaggatagatatgtaagaagaggtgaaatcctttcgatctccggtgtgggactaaaaaaaattgacggcgctaaagtaaacaacgtgcacctctgtgtctagtgttagaataattgggctagacttaatttatcctattaaatctcagacccataataagtgttaaggataataataccacctcaggatttaagcaagaaatatcttaacctaaatagggagttattggaggctcccagttgactggttgaggtgggggtcggaaagccacgcgcgcgcgccgggtcgggcgagggcgtgacgggcgtgcgtcacgtcgctattcttttgcgtccacgatcccacgttcccacgactgcctctgcaatggcgcgtccacgatcccacgttcccaggaggccgctagataaggaggccgcaagtccgatcagattcctcctccgcaacggcgcgtccacgatcccacgttcctaggaggccgctagataaggaggccgcgagtccgatcagattcctcctcctccgggcctatgctgctctcgcgttctgatccgcttgcttctttcccgggtgttagttcctcctcccaaccacaccttcgcctgagatctgcaccgggtaggcgggtgatcaggtttttggagatgcttcccgcacgactgctcgtcctcgcccaccatgtctgcgcctggagccggtgccgctactgctgctggaggagatggcggaggtggtgcgccaccaggagctggagctggagctggaggtggtgcgccaggagctagagccggtgccgcgaacaacaacaccaacggaggcaattctgcctcacaatccagcggagggccattctcaaggtatatccttctcctgttcctgttcccgttgttagcgctttactgctatattcctgttcctgatattcatgatgcctctagcatgctactgcgttactgctatgttcttgttcctgatattcataatgcgcatgatgcctttagtatgctactgcctttagtatgctactggttatgttacatgttgtcattagatcaccctacactgtttatgccatgattattgtcttaacattttggattaaaatatgccgatttatgaccatattttcaactatccaaaaacctgataggtcattttcggtagttggctttgctgctacattgaaaccacatgcttttgatggttctaactataagagatggaaagcacgtgcactattgtggttgacagcgatgcaatgcttctatgtttcacggggcaaacgaagtgaaccacctctttctcctgaggaagaggctaagttcgaggcttcggattgtctgttccgtggagcattgatcagtgtactcgctgacaacatagtggacgtgtacatgcacatgccttctgggaaggacatgtgggatgcacttgaggccaagttcggagtttctgacgctggcagtgcgctgtatgtcatggagcagttctatgactataagatggtcgatgaccgttctgtagtagaagctcatgagattcagatgctggctaaggaacttgagaacaacaactgcgagttgccggacaagtttgtggtgggtggcattattgccaaattgccaccttcttggtcggacttcgccacttctctaaagcacaagagacaagagttcagtgtttctgatttcattggttctttgggtgttgaggagaaggcgagggcaaaggacgtccggggcaaaaaggttgagggaggttctagtgccaatatggtacagaagaagaaccctcatgtatcccacaacaacaagaaagtcaagcctgatgtcaaatccaaggctgcaaccaactttaagaagaaaggcaagagaaaggcaaagggagactgctttgtgtgtggcaagtctgggcattgggctaaggactgtcctgagcgcaaagacaggaagtctgcgaacatggtcattagcgagggcggaggaacatcggggtacggtaaaatattacctacagttctctctgtttttcactcacctgattggtgggtggatactggtgctaatattcatgtatatgctgacatttctctattttcttcttatcaggtcggaagaggttcctccttgttgatgggaaacgggtcgcttgcggctgttcatggtgttggtacggttgatctgaagtttacttcgggaaagaccatgcagctgaagaacgtgcagcatgtctcttcaataaagaagaatctagttagcggctctctattgtgtagagaaggttttagacttgtgtttgagtgcaataaatgtgtcgtatctaaatatgggacttttgttggaaaatgttatgacaacggaggtttgttccgcttttctttgaatgacatgtgtaataatcataatgttgtgaaccatattagcgagaatgatgagtctaatgtgtggcattcgcgactctgtcatgtgaatttcggttgtatgacgcgcttagctaacatgagtttaattccaaaattcactttggtcaaaggttccaagtgccatacttgcgttcaatcgaaataacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgttgtgtgtatctattgaaaacaaaggatgaagcattgcattactttaaaatctataaagctgaggtagaaaaccaacttgaaaggaaaatcaaacggttgaggtctgatagaggtggggagtatttttccaatgagtttgcatccttttgcgaagagtttggaattattcatgagaggacgcctccctattcaccccaatcaaatggggtggnccgaaagaaaagaaccgtactctaactgagatggtaatgccatgttagacactgcggggctttccaaggaatggtggggtgaggcagttttgactgcgtgtcatgtcctgaataaaattcgaatgaagcataaggaagtaacaccattcaaggaatgggaaaggaagaaattaaatctctcatacctacgaacatggggctgtttggccaaggtnnaaatggtacccnttnattnnanaacnnncaaaaagncgngnanaacttggaccaaatattgttgattgtgtgttcctttgttatgctattcacagtgtgggttatagattcttaatagtaaactctggagtacccgacatgcatgttggtacaatttttgagtccagagatgctacattctttgagaatgaatttcccatgaaacatacacctagcacttctagtcaagaaactgtcatgccccatgagcactttgcaccgatagaacacaatgatcaaacgcctgaggaaaatcctgaggaggacaacattgtagatactcgcaagagtaagagacaaagggttacaaaatcctttggagatgactacattgtatacctcgtggatgacaccccaagaaccatagaagaggcatattcatctcctgacgctgactactggaaggaagcagtacgcagtgagatggactcgattatgtctaatggtacttgggaagtcgttgagcgtccatatgggtgcaagcccgtaggatgcaaatgagttttcaagaaaaagcttaggcctgatggtataattgaaaagtacaaggcaaggcttgtggccaagggttatacccaaaaggaaggcaatgacttttttgacacatactcaccagttgctcgcttgaccacgattcgagtactacttgctctggtagcctctcatggtcttctcgtccatcagatggacgttaagacaactttcctaaacggagagctagaggaggagatctatatggatcaaccagacgggtatgtactagaagatcagaagggaatggtgtgtaaactgttgaaatccttgtatggcctcaagcaagcacctaagcaatggcatgagaagtttgacaccacgcttacatctgcaggcttcgttgtgaacgaagctgacaaatgtgtgtactatcgctatgatgggggagaaggagtgatcttgtgcttatatgtcgatgacatattgatctttgggaccagcctcaatgtgattgaggaggtcaaggactatctgtccaagagttttgaaatgaaggatttgggagaggctgatgttattcttaacatcaaactacaaagaggagatgagggtgggattgcacttgtgcaatcccacttgtggacaaggtgttgagtcgctttggatatagtgactgcaagctagctcctattccttatgatcccagcgtgctattaaggaaaaaccgaagaatagcaagggatcaactgtgatactctcaaatcattggttcattgatgtacttggctagtgcaacgaggcctgacatatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaagccagtgtcagctatcctaatgaactgtgataatcaaacagtgattattaaagtgaacagttcaaaggacaacacgaagtcatctaggcatatcaagagaagactgaaatctgtcagaaagcagaaaaactccggagtgatagcattggactatgtccaaacggctagaaatctggcagatcagtttaccaaggggctaccacgtaatgtgatagacagtgcatcaaggaaaatgggcttgatacccacctaaggttgcacaatagtggaaacctgtccattgtgatcggagatcccgtgaatttggatggcgaaacaaactattgtgtgactgagagaagagacccttgtaaagggctcattttcatgatgtacttctcttctttcctgctggtaggatggctcatgccttaatgtgatccgagtggcttttccaagcagagatgttgacctgcagaacatctcaaaaggaacacacctatatgagttcgactgctagtcacagtctatgaggtttgggcgatctctagatactcatgaaaggcctggagtttgacttatatgctccaaacagaggggatgggaacggcagcctagtaccagtcaagggtctgagtgaaacctgatcacacaaaactgacaattgaaggcatagtccattgttcagttgtggtctgatgtagctcatttcctaggtggaagttcaacttaacagtctccaccaaaaccctggtatatcaaacaggcacaaccttgagaacatttcttatgagccttgaaatttggtggggattgttagaataattgggctaggcccaatttatcctattaaatctcaaaggcccataataagtgttaaggataataatatcacctcaggatttaagcgaggaatatctcaacctaaatagggagttattggaggctccttgttgactggttgaggtgggggtcggaaagccacacgcgcgcgcgcgccgggccgggccgaggccgaggccgaggccgagggcatgggcgtggtgggtgtgcgtgcgtcacgtcactactcttttgcgtccacgatcccacgttcccacgactgcctccgcaacggcgcgtccacgatcccacgttcccacgactgcctctctcctgatagataaggaggccgcgagtccgatcagaacgatccgcctgcttctttcccgggtgttagttcctcctcctccgggcctgtgctgctctcgcctcctcgcttctgatcgcttgcgcacacgagagatcggaaggagcagggcctccggaaccacaccttcgcctgagatctgcaccgggtaggcgggtgatcaggtttttggggagtgcttcccgcacgactgctcgtcctcgcccaccatgccggcgccgctgctgctgctggaggagatggcggaggtggtgcgccaccaggagctggagctggaggtggtgcgccaggagctggagccggtgccgcgaacaacaacaccaacggaggcaattctgcctcacaatccagcggagggccattctcggggtatatccttctcctgttcttgttcccgttgttagcgctttactgctatgttcctgttcctgatattcatgatgcctctagcatgctactgcgttactactatgttcttgttcctgatattcataatgcgcacgatgcctttagtatgttactggttatgttacatgttgtcactagatcaccctacactgtttatgccatgattattgtcttaatattttggattaaaatatgccgatttatgaccatatttctaacatctagaaattagaaccccgcttcttgggctccctggagcattcggacgtcgccgtcatcgtggggctcaggagtcgtatcgctcggcgccgccgcctctggtctcctctttttgatggtggtaacggctgggagcagaggcagacgcaggattaaaaataaaatggtgcgaagatgtttattttataataccaacaaaacacaataaataccatatttatatcataatcacataaaaatatagtctaattaataaattaagacaaacaaaaccattttaaatcaaagtaatatttaaaacactataggctctccgatgtggtactaaaaacaatgtgcactttccttgtgtttagaaccagctgaacatatatatctctcatggaacagcgggtgcaccacgtacaagcctaatcatgattctcgtcaacaactcgtcgtttatacattttttttgttaggaccattttacacactaataaaaaaagtttttgcaagcggtcaaaaatatttttccaagcagggaaaaggaccacctgtacgcaaaggttttcataggcggcctaacggtcttgatagtctaggataaaattcgatacattac

SEQ ID NO: 61509 - DNA, 11709 bp, Oryza sativa
ttttggcacttggctgtttttctatagccaacaccaccccctgcaccttttatttggagcatattccggtttagttagcccacttttagtttggattctccccctcataacccctccatgatcattacaacatatatgtaaacatttttttttctaatatagcgacgtgcgaagcttttgtgcctttgcgaaaaaaaaacatcattcttcttctaacatagtgacatgcaaaggtcaaagctttttcatatttgtgccaaaagttgtatttaaacattcttcttctaatatagcgatgtgcaaagattttgcgcctttaagaaaaaacataattcttcttctaacatactgacatgcatagctttttcccgtttgcgaaaaaaagattatatgtccatcagattagtctaaatatagtagcaatatatttattttccaaaaaaattgcctagaagcacatatgtaatgtgcttgggagctagtggcgggaatttggttacaaacactcaaagtttggttttagggattactatgtaggcatatcgcccacaaattacgccgccactagcacgcttcgtcaccctcagcgtgtgcttcctcttttgcacgcccagatgccacgcggacggtatttgaggggcagcacaccccctttgctccgtggtatgggactaaaccagagagtgcatcgacgtgtgcagagccaaaggccctgtgggctgtgggcactctgctggagcgtgtgggccactagcggcccaccaaaccaattgggattcaacttgcctgtataatggatctaattgtcgttgacgagctgatgatattggtgggcctaatttgtgccaaagcagagcgtgtgcaggcatggcgtacatcactgcatgtaaaaaaaaaaccctttactaaactctagtaaccattgggttttaattggatctataccattataatttttatggttttaaaatttcactgcaattgatgtattaggaatcatgctactagaatacttttaaaatctgatctatatcatgtgtacatacatttcaactctctttttcttggctatttataattttatatggatcaaaatgcctctccctcctgtgtcagacaccgtgggttcctctgcccccaatcgtctctaccctacattcctccaaccaactgagcgagcaggggacaacagagcaagtgccatcggttcgcgacatggcgtcgacagcgaaacaagcagccgggggtggcgctgaccgtgtcgacggtggagcaagcggcaatggtggcaaggtcaggactgtgcggagcatatctcataatcccaccctctctttcttcactccgttcgttgaggaccttgtagatccagtggttaagcatatctggcgatggtgacgagactcagagatagcgggtttagtagtggctcagcgtgacgcaagcagatgtagggcggccactggtgggttctaggtttagctggtgctcgtggtcggcaactcctctacgccaactcctccatcaccattcttttgcccgagtgattttgattcaaaatgttgtggatttgatctgacgcaaagcattaattaaattatactccctccgtcccttaatataaggatttttaatattttacttacattgtttgatcattcgtcttattcaaaaaaaatttggaattattatttttttacttactttattatttaaagtactttaagcacaactttttattttttatatttgcataaatttttttaataagacgagtggttaaatagtgcaagcaaaatgtcaaaatctcttatattatgggacggagggacggagggagtagtagacaaatagacaatgcataagtcataggatatctgatctgacacgaagcattaaattgtagcatcataggagatcatataacgtggagcattaaattgtagtagacaaatagacaatgcttgggcaacaggaggcatgcctattttggtatatgggaaaatacgattcaaaacgtgtatcagacctacaacatggcatggattagattttcaaggtgttacagtggcatagatcctagtaacatggcatggatccgatatgattttcaaggtgttacagtggaactgaatatccattttttcaaaaaaaaaatcacctagattttttctacctttagatttatatctaacgaactacaaaagaaaataacaaatgcatatttacttacacattatttttatcaaaattatagtgcacttacatgtcatatcaactgaatttacatatataatttagttatataggactgtaattttatattatgatgtaaatattgttttatatatacaaccaaattctcctccatactcaaatggccaagcgctgcacatggtaagtggtaagctgccttagttttttggatgttgttagcacgaatctcaccataaatttaagggttgaaaaaagagtgatttgcaacgaaaaatctgtcgacaaagatttagcagaatcggttatgaaaacctacgactcaatcacaaggtgacacatgagtcatattcatttatacaatgcagagttatcttcatttatacaatgtaaagaagaaacaaaaatgcatcattttcatcatctaataagtaaagaggaagaaacaaaaatgtacatgagtcatcttcatttatacaatgcagagtcatcttcatttatacaatgtaaagaagaaacaaaaatgtattattttcatcatctaataagtaaagaggaagaaacaaaaatgtatcaatttcatttatttaataagtaaagagaagaagaaataaaaaaagtttgctaagcgcatgtgtcatgcgcctggctagtggcggatcctcttgtggaggaagttttttgcaacatcaagtttggggatcgctacgtgcacataccgtgcacactgtgccgccactaggtcacggggatccacgggctcctcgtgtgcctccattttggcacgcccagcagccgccaaggccaccatttgagggggctgcgcacctgcttgattccccggtatgggactaaactcaccaagtaaccaggatgcatcgacctgtgcactctcttatctcgcagtcgcaggctcgcaggcccctgtgggctgtgtgcatgggcagggccttcctagcccagttccttcgtcgcggcactagcaaaccaattggggatccaactttgcctgtgaataaatgtgtctcttgatttggcctaattgtcgtcgacaattaaccagctggtgtcaaagcaaaagcgtcgagttgcaacttgcaacattggtcagtaaatattgcagggataccaccggttgttgtttcatcctcccgtgttaatgttgtcatcaacgctgctgccatctttgggcaccatagttaggacaggagtaatataggagtacgctttgtgcggttccttgtcatcgctaatcaaagctgtggaggaaccacgcatggtactactccagcagtagccagtaggagtactgatttcgagcgagatcaggattttctgcaggttctgcttgaattcgctttcaaaaatgcatgggaaagtgtactcatctctcgttatgtacatcctatctaaatagttacagaaaatttaaaataaatttaaaataaagattaatatcaaatatatcactccataatatgcaagttaaaatttaacttttaaaagttgtagaaaaataacaacgaatgtatgataactattttcacagtttagtttgtttctttgttgtaacttatagaagtcgaatttagtcttgcatgtttgtaaaatgatatattttatattaatctatattatcaaaactttttaaaattttttataactattttggtgatgatatgcaagcaacgagaaaacattcactcgaggatgaaaatccgatatcaccgatgtgcatcagtggtagggaccggagttttacagccatcaatctgttcctatcgtttgattcgtttctccctcagtcttgtattgtatgcgtaaatagatcaggagttttggtgcaatcttttaccttaattgggaggctagctttggtttttgaaacaaactgggggtggggggtcgttactgtagctgttttaggctttaatcagtataatataacaagattatataggatgataaatgtaagaattaagaaaccacgcggtcgtactggactcgagctcgtactatactttcggttagtataagtactcctattattaacggtttggtattcttccgaattcgaactgtaatcttagcagctatacagtctacggagtacggacatgacacgagacaatattacccctcccgtctaattgtatccgaaacagtaatctaattatctaatctgaactccgggtagttcagtactattcaaaacaattttgctaacgtatttgtctacacaaattttatattgtagttgcatgtaatattgtatatttatcaaagtcccattcaaaatctgaagggaaatctgaatctggacatggcaaaggcgttgacctcaccacagaccagccccccatcgacgcgacgaccgcccgatcggaaaccgacagtccagatccaacccgtgcccgcccgcctcgacatgcgcgtccgatttatcccctttttttttttcaattttccccaactcgatcgacgcggaccggaccggaccagataccccaaccccgacgcggacagacacgaccaaccaacgcaccccacccaacccaacccgagagacggtccgaccgaccgtacgacgtgccgggcccgggctcccaaaccgggtccctgtcgggctcgctccgaaccctatccacctccggcttccccccacctatatccttccctccccctcgcggcgtcgagcaaagccaaaaactactactcctctcgaggcgacgacgaagaggagaggagaaatctagcggcggaagcagcagctgcgagaggcggatttttcgattcggttcgaggcgaggcggagcggaggaggaggattcgaggcgatggatcggtaccagagggtggagaagccgcgggaggaggcggccatcggcgccaacgagatccgcatcaccgcgcagggccgcacccgcaactacatcacctacgccctcgccctgctccaggtccgccttcctcctcctccgccttcgatttgttttgttttttgttttttttttgggtggggagagctagggtttagtgcgggttcagtaatctcgccgccgttggcggaagcgaatctggggcgcgtctcgatgtttccggccgattttctggtgacctagggctctactattgcgttggtagatgctgctgctgctgctctaggtgttggttggttacgttttatttttgctaattgctactagtattatatcccatagaatatacaaattgttttaggaagtgaactcttttctggtctggtgtagcaggcggtttatcgttgctgttgatgattgataggtggggcttgttcactgtgtgtcttaggatagtactttcaccctgtactatccttaaaataaaataggaaatagatttagtagggtaaaggtggtattgtgttgtgaatgatactaattattagtaattgttttctatatgtgtggagatttgatttgtccactgtctggtatggcacagtaatcatgagggaatctgactgtagtggctttgttaaatctgtccatctctttatgtttgggactgctattttgggggaatatccatgttttctaattagtcactaataattgcttttgctttctcgttcctcatagcaggacaacgcgacagatgaaatcgttatcaaagctatgggaagggcgatcaacaagaccgtcgcaattgtggagcttctcaaggtaaatttgcaattccataatgtaatcagataatattggatatccctcactgttacgatatgccatgtgctgatctacgccctccctgagcagagaaggattgttggtctccatcagaatacctctattgaatcaatcgacataactgacacttgggaaccattggaagaagggcttaacacgtgaggatcacacaatcttttttccatgtacctgtatctattttggaaagggcttatgtgtttgatatgattgtttgtctttatgatagccttgagactacccgccatgtttccttgattaccattacattgtcaaagaaggagctggatacgtcatctcctgggtaagtagaattctgcactttcttcctcccctttcgattttttgtaaaaaaaatctaagagagctctagttggatatgattattgtcagtagttcaagataagatagaattctttccaggaatggctcatttaaaattcatcgtgtcgcatatcttaactttttgctagactgtctcagtatactactgctgctacttattatatttgctagaaaattcaaaccatagagttattgtaggcaatatttgctccaaatatatccctattatctggcggtctatttcttttcaacatactcatgcaatatttatctcttcaaaacatatgtgatgtgactttgctttgtgtagttaccaaccaccgataccggctgatcaggtcaggccgccaactgactttgatcaggaggcagaggccgtgcccagtggtcgtggaagaggacgtggtcgccgtggaaggggcaggggaagaggtaaatatctgcctactgatgattgtaaagtttatatccctgcaaattatgattggtcttggtgttgatctgatgcctctatgaatgcaattcagggttcaacaatgaagattatgatgatgagcatggagatgcagaggtcccacagcctcagggatatcgtggcaggggaagaggaaggggcaggcgtggatcctttggacctggcaggggttatggtggagatggttttgcaatggaagaagctggtggatatgatgatggggagcctaatgcacctcctatgcaagggcatggttagttatgcttaaactttattacctagaaatagcattataaattatagttccttccgttcgattgtatttttcttacctattggtttgtactgaaatatactatctgctatcatttatcacacatttaatggatgttggctgaacgttgtccgagagccacttgattttttatggtttatgttgatataaatttaagattattttgtcagatgtgtaaaataagttacaaaagtaatatttaaccttaaatttacaactactatgactgttttgccttggatttttttttgaagtgttacaaatttgcatacgtaactttgcatttgttccttactttgccttgcatcttttgtgaactacagaaggtggcagaggaaggggccgtggtcgaggccgaggctgtggacgtggtcgtggtggaggccgtggccgtggacctcctcctcctcctcaagagtagagattggctggctcgtcaactatccaatgcagtgactcgtcttcattagattagtgttatcttctgctgtaacttaatctgtttaggtttttatgttcaaaagtttgacatagtgacttcagtgtgggggatgcggctagttatgattttgtagctaggttattcttccatttgctttttcctcagttctattaccattccaactgtgcattgtagcatctttttagtgtgttgtcctcaaatctagctcagaagatccatttgttatggtgttggaagatcgcacagcattttctatgaatgtgcaaatcgtatcgaactcgcttttgaattggatatggtgacgttgcatatgttttgctcgactttcctgtgcatgtttcgcgtaattctaactgggcagctgtttgacattcggattagctgattgcctgattccactaattgttagtgattgtgaaacaacatgcttctgttcctgcagtttaatgttacgatgattgatttatatataaatatctgtccatctggcatggaggcactccaatcctccaactgcaaaagtcccagaatgtctgtaatttacaggattttcaaacaatttaatttaatttctcataaacagcttccaaaatttatccattacaaataggcctttagtcagaggagattaagcctatatgaatgtagttcatcaagtggatacttcctaaggccctttgtaccaagaaccaccttaccatactatcgcaaaacaataattataatttttatagggtgtatgagaaaagcacaaattttgatctaaatttatgacagtattacaattttacccaaacttacattaaactacagacttaagagggtgtatcacaatagcatcaaatttaccacaatactacaggtctaatgcataatattgtagatctacaaatttgaacactaattttatcacacaatcatagcatgtagctcaacccaaatataaactcttgaaactagtagttttataataatattgatgttaaaattgtaattttgtgatatacataaatttgtagttacgaatagttctgtgcaatttactcatttcgtaacagtttttattcaactcattcaaactaccatcaaatagtatttaatttgtttcgaatcaactcattcaaataaaaccgtgatgttgttgctatcaatgttgatgctgcaacttttcagtaaacacgtcgaatgggagtgggcatggtaataaaaaactacacctgtgatttattggcttgcaatgagcgcacaaaagaggttaccatagtatagcttgctgaagcattggctctacgccgcgttgttgctctcacttgcgaagaaggttttcaaaacgctagtaattctgaatgcagtcatacggagagttaactcattatccatggaccaatcttcaaatggcatagtgattgcagacatcaaggtcatagcagtgggtttctcctctattagttttaatcatgtttatctatgttgaatgccgcgactcatttattagctcgtttctgtgaacattctagtgatgttatgcaccgtaacgtaaccttggagtgtattcgggagatactttgtagtaatgatttaccataaccaataaaacaccgctctctctaaatagacaaaaccaaccagtagtagtattcaatctacttccaaatttgaatcaaatagtagtcaaatttgcagcatgttggggaagcactagtgggtggtgatggagtcgtgggtgcatggctccatccactagggtttaaatcctaataagataatagatgtttcaccgatctccatctcttagagtctgccatgttatctcataaagaaatcaaatctaggtgaacttttagcagggttttagtaacataaaagatgtttggctgatttccgtctcttagagtctgccatgtaatctcaaaaagaaaaaaaaactgcagtatatgttggagaaagaaacaaccctatccctcgcgggccagcctgggccggacatgtcagatgggccagagagatacacgattacacgtgggttttttcttccccccgtttatttcctttcctgaaatttctccaaatctgccccaaattccgaattttactcgaactccaaaaacccttcccctcttctcccctcgcctcggcccgccggcggccggccaccaccgccacctcctcctccgatggatctcgccgccgtccacgccgccctcgccggcaagtcctactcctccgtcgccccgctctgcgacgacctcttcctccaggtaccaatccctcccctccccacccctctcccgcctcccgcgacgcgaggagggttagcgtagcgctcctgactcggtgttcctcgcgcaggccgcgtcccggggcgccgccaccgacggctggccctacgccgtgcacctcctcgcccacctctacctcaacgacctgtaacgccccgcgatctgctcccccacctctctcccatggaatttttttgggctagggcttccgggattaatgttgtttttgtgtttctgggtgggtgcgtgtgtgagcaggaacagcgcgaggtttctgtggaagtcgacgccgcaggaggcgaaggacgcgcggccggagctcgccgccgtctggaggatcgggcagtgcctctggaaccgcgattacgcgggcgtctacgcggccgcgcaggggttcgagtggagccctgaaatcgccgacttcgtggccgccttcctaggtactggttgttgctttactgttcatgatggaaacgtgcaacagttgaattattctgtgtctttgtgcaaagttgtattgcttactagaatgaattgcatactgtggtagtattgtgttggaggtcaccactttgtggtgtgggttgggaagtcgggagattcagatgtgcatacatatacttcatggagtaattgtggaaacgatttatctgcacaatcaggctgaatcagcttccttaatgaatacgcaaagttactattagtagagtgcccgttagtagagttttgtgctgcgtagtgtaatggttaaagtgtttatcttggaaatacttgcttcctaagatagccttgttcagtgggtttatactatctccttaataaggactagtgatttgattattttcaggctgctcataagagtttggttcccaagaagttcagttttgttcctatttttacttctaattgacaacatgatgcaacaattctagatgcacagaggatgttcattaactcatgcttcaatcaaaataaacactttgtagttatcatttatgagtgaaactgttgaatgtattaatgtaatagcattataattaaacatttgcacttttttataaggtgattgttaacattttaccagcagtcattgtgacacagtagtggaactagagaagttaagttctttccatgaagtgcttactatgacatataccataataatacgtcaatcaggataataagttaataacatcatgattgtttcccttttgcttgtttaaccaactaatcttctagtattatttttatattaggaaataagtataaagcctgctgttttatattttttttagtatttataattggttaacttgaatatccaatattgttttctgattacacagaaagctacagaaagaggattttccagttgttgacttctgcatattccacaatcagcgttgctgatgtggctcacttcatggggatgaatgaggaggatgctactaactgtacattttctgaaactatcttgttgctgtactatgttttttaatgttaagtacaatgttctgactatcttcatgttaatcaacagtatagatcatagaagttctgacatggttaatatggtgtttttagtcatctttatctgtagaaatcatccaaagtcccaattttaggatacactgcatccttttcaacttccatagcatttcttcatagattataatctttcgtccaatatgtgtttttgcaagttccttgaattttggaaggtaaatgtttctccctatgtctcaaaatataacaacttttaaccctcaggatttgtcccaaaatataacaacttctccaccaacattctctttccaaccaatcacaaccctccaccattcacttttcccacctacctccactactcatccaattacaaccctccaccattc

SEQ ID NO: 61510 - DNA, 3772 bp, Oryza sativa
caaatgagattgtaattttatagtgatcaatagaattttagtactgacctgattatttgacagagtcgctgttcacaattcaaattaatctgctttagtcactactcatattggaacactattccatgtatataccttgagacaaattccaggcctgctgatcgattatgaattgaccaacacatttggactgtagtgaaaatgatatctcagtcaataaaaaaagccaacgtgtgagaatagccggtaaattagaactaaactgcacatagatattatactgctcttccttcctaatatctgaccatgtactaatttggctactcccaagaatcagatgggaatgattagaagaaaccactgtgtacaactatgatatgaagtatatgaaccgttcatatctaaaactctgcattgcaacaagactacctgaccaaactgatccatggaagcaaatctgaaaaatacatcaagcttaaccaatgtaaacaaagaaaaaaaaatcgaacgggatgctcatcagccgggataacaccagataaaatatgacatgctcacagccatcaagaaagaatgttgatggcagcggcatgcatgccaggagatacttaacgatcttctccaccaagaaatagcacaacccatgtcataattaacatgcaacatggatctggctaggtgtcacgccccgaactaatcccgaccggaaatagcccgtgacgctccaaattaacctgttaatcgataccagtcccaggaaacagtgttggtatcatagggagatagaatgtcacagcaacagaggtctctttattatagagtagaggtacagtcatgttgggctgcggacagatcccgagctcacaactgcattacaaaagggaaacggaagccaggacttggaccaatcaacacaggcgcgacttgaacctaagccgaaactctaactcatattataccggtcgctcttgtaaaagatccttataacaggggttcgcgttatattctctacaaactgtggggatattttatttaaagcagggtgaagaccggaagacttcacaaagcatgggaaataagtgtttaatgcaggcttcaaggaaaggttgttgtttttgcaattgattttatttgaactcttttctaaaaacaactaagtgagtgcttctcaaacgacacggatgagacagtgcgtctcgtccggtcggagtatgtgcaatgtatcaatctttaaaatagatcaagattggcacccggccaacagctttcaaacggccacccgggccaacaactttcaaacggccacccgggcctagctgatcccatcagctgcagattttccaaacatcgatctcctttccaccacagcaatttcacaaacagtaggcaaacaaaactacgctaggaatcacctcacatccgcccatgaccgtgggcacggctgttcgaacagttagttaacctctgcagaaggggtacactttacccacacgacattactaacccggatcacccagcccgtggggatcggccacgttgggagacctccaagctttcatgacaaggcatttcgaaagccgacacaggtttaccatatgccgacgagaggggtcccagaccaacaacaagttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagagggaaaccgtacacccggtacgttccccggtccgcggttttggaaattcatttagttcgcaagcaccgacccaggtgtcgggttttccaagtcttttgtaaaacccaagttttacccaagttgtttttcagattttaagtttgaaggcgtccgtcgatactcgcacagggtgcacgaatatcgagacgcaactagatggttacaaggggacatgatataacaattaacaaaggaaggatcaaatgcaacgaattaggtaggtctgccaatctgccttgcagacgggacaacagattaagtgcgatcctatcaatgcataatatttttcaagcaacataattaaattcaaatataggctcaagatgttcaaaggtggcttgccttgctcgagatctggagcttgatccttgaaatcctcgcactgctggtcttcgggctccgaaactatacgcaaaacgggacaactcaacaaacggcgaaaataaagccctattaatgacctctaagcatgccattagatagatctcgagatttgaggaattttggaagttgaacggagtcaaacggatttacggttgggaagatattgaatttctaagattattggatttttggtctaaaggaaaaggatttaattaaatcctttttgaaaaagaaaagaaaagaaaagaaaagagggagggaaattagacttccctcgggtggctagggcgcggcccgagagaaaaggggcggctcggccgagcttaatgggccggccggcccaaaaggcggcccagagcgcgcgtgggaggggaggagagagggagccggtggaccgggctcacctcgcgtggtcccgggtgggacccgcttgtcagcggctcggctcaccatgcggagggagtatgcggcgtgcgctagggtttggggaagagacgcggtgcacgcgcgcggttcgcggaggacgcggatgcggcgggcccacgcgcagcctcacggctcgcggtggatcgcgcccgcgagcggggccggagggagtggctgaccggggtcggctcgacccggtcttggccgagctggcgccgacgtggcgcctacgtggctgccacgcgggccggcgggaggtagacgacgatgccggccggaacaggcgaaagcgagcacaccgggtggttgcacgagacgaggggagacgagccaacggctcggattcgccggaggaagcttgacggcggtgaattgcggcggcggcaaccggtggcggaagaagggggaaacggcgacgaggtcacgaggggccgattcccggcagcgagagcatctacgcggctacgggaatccgtccctagcgtcggattaggaggaaacgcatcgagggaggccagcgacgagaggcgctttcgagctcgggcggcgacggcggcgagcacgtggcgagcggcggcaacggtcggggcggcgccggctagctacggggaggctactcgtgctactacccgagtctaaggggaggagatggaacgaggaggaagaacggagggaggcactaccgtgcgggcgggcgcagtgacgagagccgacggcgcgaaacgtgatcgtctcggcctcgggccgaggaagaggaggaagagggcgcggccgaagtccccttccgcgtccttgctcgtgtcggctcttccgacacgcgcaacgacgaacggcgacagcgaacagggcgacagtggcggcgagagacgaaaacgagggagatttggagggggaggagcttgggtttataggagcagcaatgtcggtttgggagaggggaaccgacattggacggtcaagccgacgagctggtgctccggctagcggccaaaacggcgacaggaggtgacgccggcgagagggaaaaagggagaaaaggggggagagaaagggggcttgtcccttgcctctttgggaaaaggaggaggggagcgcg

SEQ ID NO: 61511 - DNA, 8659 bp, Oryza sativa
agagacagcgccgccgaccccgggggagatgggccgagagaaattcggcccatcgaacccgggggaggcaaattagacttttgcggaggaattgatttgggaaggatttggattcgggattgaactcggcgatagatcggggatttgagatctgagatggcacggacactagagaacaagcaaagaaacaaatttcgcaattagggtttttaagagataaatttcccgctaggcgccacgacggaacgggcgctacactaggccattgaatgaagagtaccctgagctaaatcttagcaagagggaaatatattaggtacgaataaaggttttatcctaatgaaattatgttgctaggctatcgagaaaaataaattgtatttaactatttaccattagcttccaggtgttgataatccatcaatatatgcatatttccatccaaatagttccttttttaatatcttctgttgtttattgatatcttccactaaattgatgcaagaggaaatactaatagtgattctcataggtaaattaaaaacatcttattacattgcactaactttacttgacaactcatatgtttttaatatgcagagctagctaatgatgatgccgacgacaccgccggtgacttgcagcagcgggcgcgcgcctctccacactccagagagcgtggtggtgggcgcgcctgcaaccaccgccatcatctcgtccaacccctcaaccatactgaggtccgcattcccatcctccattccaatggctccgaagcagcggcagcaacggagggtgatgatcgaagagctcagtccgacgataacgacggctgcccagatgatcgggatttgagggaggtcatggtttatggaggggggcggtggcgcgatggagagagagaggagcgggcggagcgagggacggcacaatacggagggaggacaactggagaagaaggcgcgggttgggcgggatgggaaggcggcgcgtcggtggggtgaggaggcggcgcgccgaggaggaaggatggggggctggggagtgcgatgcggaattacggatcggagagacagggagcgcgatgcggatcggggagatgagaaggggtgcgacgggtggatcgtgggagaaaatctcatccgctgatgcctgtgagaggatccttcgatgaatgttaacccttcgatcgttcaggactcaccaccatcactacgaattttttaagtagtaaagatacagatgaagctacacacatgttgcatgcaatttaactgcaatgtagttatatacgtgcatgagtaacctatactcccatgtcctgacgtatagttcactagtacagggtacagaatcactgcctggctcataaccattactgccagttttcgaacagccagtgggcaatgagcggacagtgatactttggttcacacaagtttggatgggaaaactaaaggaattctatactatgttacagaagaaaaactttacatgatcgaaacaaattgagcccaaaaagctcagtaagcccgtgtgtagttcccatacaaagcacaactcgtgcaaagctaattcctaatgactcacatacctacgaaaattgttgcaagtactgttgacaatcatgacattacattgttgggtctcgacaaacatcgtctagctgttcgatcaggtatggtatatgtaggtagaaaccatatttatttgagccacaaataaatacatggttaatgttatccttgatttataaaacatgggttattttgatatataatggtttcacatgatattgtttttccagaaaggaggggggacaggagccctagtcaaagggggtattattaatgtatggtcctcatgatgtatggtagggtaacataccagatgcactagaaataacattaggtggtatctgttagagtttgtatcgaatatatatacaaagttggttaccattttttagttagagttgtaatatgtgttatgatatagttatagttagagtcagagtccgactctctctctcttaaatatatgtagagatacatccgttgtaaatgcatgacaacaatagcataggagagggttgactggctgacgacttagctggtcaatgatcgtgaatacactaatacactatggctgcgttcgtttaagggtgttcccaacccctgtccctcgttttccacgcacgcacttttcaaactgctaaatggtgtgtttttttttgcaaaaaatatctatacgaaagttgcttaaaaaatcaaattaatatttttttttaaaatagctaatacttaattaatcacgcgctaatggaccgctctattttccgtgcggaggagatgggttaccaatctcatgtatcaaacacaacctataattatattagattggggaggaacaccaataattagtgtcttgagatataggcttcggctaaacctcgttaacaaatatcttgccttgccttagtgttgtcatcaaatttgcatattctataactttttttttgtgttcagatctcgatgtgctattggcggaagttttataacaatatcgatcaatagtacccctcttgccacacgatgacatcaatgtgtgcacagcgtggaggttttcttacatgcatccgtcgttgccatgttacactgaactagtatgtccgtgaattatatagaagtaatccattttatttcctacttgatagggttgagcaataattctatggagtaatgcagttttaatccaattgatcgaaggctcttttggcacattttagtttgcctctgttgtcttggcaacacaaatttccgacatatagtgtagctccaaagcaacatagaattgccgacacatagtgtatcctactatacagaattgctgaaatatagtacgccaataacctttactggcatatagttcatcagtgatgtttttttttaaaaaaattttaccaacatatgcctgttggtacatactttggtgtcatggtgtagtgagatctgaagtcaaagtgcaggcatgcattctgcattggctgtaatatagggctggaaactggaaagctgtaaatggattcaagatacattatgaatgtcatagaacttgttcttttttacgtacgttcatgttcctatccgatttggtgctaaatgatcaaacgggctggtggcagagcatgaagtcaaaaatcctaatgaattcttttgctaatttttttctataaacttagtcaaacttaaagaattttaacttaaaaaaaatcaaacgacttataatatgaaaaaaaggagtaggatcagcaagaaaataaaaggctgatcagaaatcgtccgcaaatgctatggaacctgcagctttctcctaggctagcagagctcaacggaagccggaagtactacaatcggtgaagtacatgcacctcacagttgttttctttggccggagaactactgtgaggtgcatgacatatatagggggcaaatatttccctggacatcttgagattgccttcgattgcacatatatacactgccaaagcaagcccaacaaccatcactgattctgcatccttctgttgggtgccatccacttttcaattgttcagtagtttatatattcctgacacctaccaagtttatggcatactatctccatgcagctcaaacttaatttggcataacccttttttttttatttcgaaaaggaagcaagtaaaatatctttgaaattgcctcgctatgactgtttggcactatgtatagcttcttatactggcatactgctcgatcttcgataaaccaatcttttaaggccatttttatcaatgtttttgttcatgaactcatcaaaatggtagtatatatatgctacttgctacaatcgctcaggagagagtatagaccaaactagatatgtatcaacatgtatgtgtgcatctatttggatacacatgtgtgcattttctgtataggtcgtatggatatcaggtacctatattctctacacctctgttacaacacagtccttctcctagcatggagcacgtaaatagaaaaatgttaataatgtctatcatgcagcggtagttactatagtgatgcagaggggttgaacccaagtagaaggacatgggtgtggtcaccctctagcattctgacactcctgctcataacatacaacttttgtttcttttgatctccgtccaacactatcatagggattaaaactttcatgttcaatcatgcattatctcttcactcaatttgcgtcttgtatttcttcccacaggccacagggagataggtcgacctagataaattcctgaaacctttcaatcccacatatctcgtgttgtaagggcaaatatattgttgccaggataataggatattgaactattgaccgtatgtaactgatcatttcctttccttgccgccgtcgctcgagctgtctgatgcactcatggtcgagttctcttcaagctagctgaagctactaactgtggctctacatatgcatgtgtatatactggccgcttgcaataactcaaaccctacggaacaaaagtttgtgtactgtatgcaataacattatgatttttagctcaaatgcaaagaatctgagattattctgtttttggttttcccccaaaacaaagtttgacatgtttcttcattatattgctagctcatagttacttggtactccttgtacaatcccaactcattatctaaaaaaatgtaattctagtgatttgcattactgaatgtgacatgtatctaatattcagtatcacatcatgtgcaggtttgggagtttcagttctctgaaactgaaattttctactttatgaagagtacttctactctttagaccatagggcggttttttctctctttagatctccttgctagtacttctgctgttttaaccattgctaggtaaataaaattattttcacaaagataggacgatgaactctgagttccactcgacactcaaggctattgttggcccgatctttcggtgagttgagataactacgatttgggagaaacgttgacgatccgactacaaccgtacaagacgttgtgttgcgcctttgcgatcgatacacctctccgtgggttgttgatcttgccggtgcagatcaaccttattcctgtaagcaaatcgaagaaacaagcaagaacaagataaagttaatctgaattgcaaataggaatgaatacacccgataggttggggtttcgaatacaagcagacggatggtctagccgacacgcgcgctgcaaggaagtagcaatggctaaactttcatctaaacaaaacccaataaaccctgaaggggtacctagctatatataggggtgggaggacgacctaggggtgcctaggggcgtgctccacctggttggggcgcaccccacatgggccccacctgggccggggtcccaaatgaagttacaagcccataggcccattataggtgacgcagcaccttgtgcctgtgattccggccacacgagatggaattcggggatgaggctggatccgttggaaagagggctctgagagctttccatcaagtactcacgggccgaaaacggaggtcgtatgcagattcggtggccgtttgaagtcagcagtgtagtaggtggccgaatcagattccagcacttggagtacttgatctcgatatcttcttgttcatccatgatgtgagcaatggttgcatacgtggtagccatggtcacatcatcctccccttctttacggaaaaccgtcctcggtttttccatatagtgctctttgcgtagtccatttacaacaacctgtttcttccaatcaaaacaaggcaaactcgagacaatttggttagcaataacattttctctagcttgcatgttttatccacatgtacaggatgttctaaatctgagcagatgtaaactctatgcacagaatatattccaagatcattataatcgccaaagatgtgaaatataacattacgaggacttggctaatcagaatgagcaaatattttgtccttcaaacaattgagctcacaagaatcatcaaacataacatagcccaatgtatttaaagaagattgcaattgaagttcatcattctcgctggacgtgtgaataacatacttaaattcagtacatggagaatcaagattaaaagtagcatgttcattcactagttgtggaatggatataagtgaagtactatcgcacaactcttctttatcacaaggaacagaatgcaaatcaacttgtgacaaaggcaattcagaagtaggttccactaaagtttgctctagatcagcatggaaagtggaaaaatgtaattcatcagaagcatactcatcttgagtaatttctgcaccatttaatttaccttttatgccctcttcagataatgtaggtgcattagccttctcctcattcgcgagtgaaggaagtgacatctcaaacatatcgttcttctcattttggggactgttctgaacttcctgcaaaacatcagtgataggaggcacaagcatagcttgttgctccgttgggttctccaaaattttgcgctcaacattgcaagcaagcatgaacaattggcctatatgattatatgtcacattaacaagcccagcctgaatattggaattaagtcatctgaaaaatctagtcattgtgttctcattagattcttgtaaatcactataagtgataccaattttaaaatcatgaaagtactccctaacagttttgtcaccttattttagatgttcaaatttctcaaggagagcacgtctatagtatgaaaacacaaatctttttctcatcagtattttgcattcatcctaagtttcaagcttatttcccacagtatgccaccaaaaagacacagaaccggtacacttattactagcagccttaatcatttgagcattagaaaaatcatactcatcaaattgtttttctactgctagttcccaattaacataagcggcggaatcatacttaccatcaaaaccaggcaatttagattctacccttgtaagatcattatcatgtacctcatatgtgatgcgtgaagaagtcgctatatctcgttgatggtgaagatgttgacgttgagcatgaccatctcgtttccgcgggcacaatcctgccatggttagtagcaaacaagaaacatacacaaaaatatgcgcgttcctattaactactagatagtggcagctcaaaaatcacacaaactcaagcttttaactaagctcttacaagatcttaccaaggcaagcggaatggtgacatacaccgactcaatcaagcaccccaatagaggttggatgtatcgatgccttggcaaacacttgctgtacggctgcaatcaaatctgtggagctctaggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtatttttgtgaaagcaaactcaaagatacaactgatttttctcttttctttctttctttttctatctttttctttctttcttttctttttttctttttttttggtgcggcttttgttttctttatttttagcacctttctgcattttttttctttttttttaatttttttttcagcaaaaaccaactcaaggaccttaatgcaagattacaaggactcaactataaatatacaaattacagggactcaaatgcaaaagtgcaaacccaaaaatttggactatacaaaaatggaatgcgctcatcccataggttctgtttttgcaaacagatctcgaaaccgacactaaacaaaaattcaccaatgtgtttaacacaactcggaaccgaggaaccacgtgagagagggagggagtcggactcacaggatggcgaagatagagtggttcagtcctctgtgatatggaaggccggacttgtgtaggataaaaacagaaacttatttttaaacgatccaatctactatttccttcctgatcaatcttgcatatttccaaaaccgattcctccccacaagcacgatagaactacagactcacggccaaactacaaactcaagcaaaatctagatgcaacttcaaaactgaccgacagaaacttctagaaactacaaaaatagaaccgtggcagcgagccgattccattttcgtaggtcccgacaacaacagagacacggtggcagcgacgactgtggtacaaaacgtgaccagaacttgaaactctaaacgaactagacgctaagaccagcaacacgacgtgacgatgcaacacaaaattcaacaaagcaaaaattgaaaagaacaatgcaatggcacaatatggttaggtaaatgatacgaatttttttgtatggctattttctggttataggaagatgaagactcaccgagcaacgaaagctctgataccacctgatgaaccctgagttccactcggcactcaagactgttgttggcccga

SEQ ID NO: 61512 - DNA, 8568 bp, Oryza sativa
  unsure (1)..(8568): unsure at all n locations
atttcagggccatgaagttgattcctttggtattggaacttatctagtaacatgttattcccaggctgctcttggctgtgtctttaagctagttgagataaacagtagacctcgtatcaaactttctgaggatgtggctaaagtgggtctattttttcttttcatgttgacaaagaatttcatttctttttgtttacttatagtgtcatgatgggttccaggtatccattccatgcaaaaagcgatgtttcagattgtatggaaaagaaggctaccccttagtagatatcatgatgcgtgaaagtgaaccatcaccgaaggtaactatgaatattgtccaaattatccctatttgttaccatgcaatgctgctgtcacttatatcctttgctgacccttttttatctacactaattattctcgattattaaactgatcttgtttacacctaacatttcaggctggagaacgaatcctttgtcgtcatccattccttgaatccaagagagcatatgttgtcccccagcatgttgaggagctcctacaatgctactggcctggtacatcaagtatgtatcgtggatctttctaaaaaatgataagttcttcagttgacatggctaattttgaattgtaaaggaactaatcagagttggtattctatcctactgcttattgtgcaacaattacatttgcatatgtgtccctttcagataaacctagggtagagttaccctctctagaggagatcagagggcgctgcatgcaacagcttgaaaaacttcgacccagaaatcacatcaggcggttaaatccaacaccttacaaggtttgtcttcgtttcaatctttctttccctttttgcttccttcagttcccttttttttttacaagatctttacttcgagcaggtgagtgtgagtgcaaagctgtatgagtttatccattccctatggttgaatgaggccccagtaggagagttacaatagatttctacagaagttgggaaaaacagagaagcgtattctttgaagcatagcaaaatagcaatacatcaaagaaaagtagagctctgttgtaaaaaaataaaaaaaatcgtcagttcatgggcccaaccttataggatttttgctccccaatttttattagtacaaactagttatcagtatagagataggccaacctatctgactgtacatccatgatccattgtactatacgtcgttatggaattgaacatcctttttggagatttgagtccatgagatgatgagaacaaataatcgctgtaaaaggttgagatcatgcccccctttgtccttccagaaacatttgcaggtgattgattcagaaactaaggcagccaagcattggtataatatccgtactccatgtaagattcatagttttttttttttcgttttgatttataagattcagagttgaaacttgagcagaacaaaaatgtagttgcaccctgtgtcggctgttgggctgggttcctcgttgtgttcatggtacaaggaaaattgaagatccctgaataataaggtcaacagcacaagctgagaaaaggtgggtgatgtacttcccaactaccattgcattaacagagctgaacataggagtactggtcaggtatttaagtggagacaagttggcaaccatggtcatttgaccattccctcatttgccattattgccatcatagaaagaacaaaaaaagggaaaaatatctcctcatttgccaataataagtggaggcaagtaggtcgtctatttcatttcacccatatttagggccccctttgaatgcaaaaatagtggaatatgaaaaatgcaagattttaataggaatataagtacaaaacagaggattgcaaaatacagaaaaagcaaaggaaggaataggatgagagagatagattcaaaagaaaatttcttagaggtttgaagctcttgctaaattttctctagaatctctatagaattgtctatttcaatggaattttaaagaataacataggattaaatcctttgttttaaaggccttcataggaaatttttctataaaattgaaatcctccaaaattcttatgtttttcctccaaatcaaataagcccttaatgggtattgtgtaactgggaaatcaatggattttgcaagcgtacgggacctaattataaaaaataaaggttaaaaacatactcctcagcaacaaataccaagttgtacctcgctaagggctttcataatttaaatggttttaaaatgccatataacctacgggcactcattaaaaaaacaattctcccataatgcaagtggtatctttgatcggcctcatcttttcgtttatacttatacttatcagccaaaaaataaattttaaattggaagttagttttggagttttttcatcggagtttattttttaacttttgcttttagatcgttaagaacatatatataaaagttttattcacaagttatttttagtttgtaataggacatttcgcttattccccgaataccccgaataagtggaatgatgggaccggatatttcatatcagcctctagcataaaaataattctaccactcgccacgtcacagtgttgttcatcccctgaggccacgattgagaagccaaaaccgccacctaagccaggaactgtgcaagcaaccccctccacagtgcatgtgaccttccatctattatagtgggtcccaccactcttcattcctcttctctctccacctttccccaccgtcggacgaagcgagaggagaccaagatgtgccagcggggaatggagcagcgatgcgccggcggggaacgagcggcggcggcgcgacaccacgtgaggtcggcggcgggaggaggcggagcagcggcgtgacctcggtgccgccacgcggtgcctggaggtggcgctggccccgctgcccgccgcgtcgctcctcccgctcaccgaggcccgggtgcggctgcgtctcgcggccctgctgctgcgttcccgctccaagggcttgccaccaccaagtcccacctcgagcgtgccttgctgctcccctcctcccagagctctggcgtggatatccggcgggcggagcgatggatccagcgacgacggagcagcttcagggcggccagatccagccgagcggcgatggagcggggcggagcagcggtgagggcgccgggcgaagcagcggtgagggcactgagcggagcagctgcgggcgatggcggctcgccggatctccttctctcttcagctcgcctgcgccaaatccctctcccctctcctcgtcggcgcctgctgttctgggcaacgacaactagcagcggggttgcggttgtgcggatgcctgacgaatcctggctattccctgacgaagaacgtgtgtcccattttggctccccgttcctcgcttggtcacggtagcgtctgacatggaggggaatcttggctgaggctgggtgaggctgaataccacctatgcgcactgtgaacgccctgagtcaccggcagcaggagcctccaacccaatgttggctttcctttttgtttgtgatgaagtagtagtatatggatgtactgtcaaccttgtactaatattttcgctgcagcttttgttaaagcaaaagccaagattttcccattatcgaaaaataaagcagcctccaaaccctgtacgggcaacggactgatgaatgtacgaacttctacagcgcagatatggactgtttcttctccctaggaacccacattgtcatcagtacatcgtttctgttttcaagggcatgtctactgcattagcattactactaaattaatagtggtactaccaaattcagcagctttttgtaggtaatgttggtatgattagtttaactgcttagaatatttatgattagccgttgaattgcgttcatgtactgtctacttccggggtttgtttgatataggtggatattagcttcgaactttatgaatgaatggacatggaagttgaattgatccacaacaacctgaatggattgaattaaaatccacaacaacatgaatggattgagctgaattgggttactcccatccacaagatcatgtcatgtttgcaatgattacaggttttatgtggtactcctatgattacaggttttatggagtagtatgcagtatcaatgttaaggtcctactcctatgtgaggtctgtaagttcaatagtactactactttgtgaagttgcttttcaacaaaatttctacaaaagaaaaaaaaatccataagcctacaaaagtgattagtgacaggagtaccattgtggcaaggagaaatgtgctagtacaagcctacaaatatgcaattaatttgcaacttctcttcaaggctataatggagggaaagcgtccacctaaaccgtatgcagataacaatacgtccttgcatcctgttggtacaatacacacaagttttgtgtagaggctgttggttactcatcatgcaccagcacacgtacacacacacacgtgagtcggtgagtactaaaataagattgaacacaagcttcagcttcaccattatccatagccgaaatttaaattttagaatttaatttaaagttaatttaatatttttattctagtttaattttcagcattggcttttaaatcagtagtaatacatatttaaatgttcacgtatggatttttttttgctaataagcctcagggtttataataagcaatttagcaccagctacactaatggtcaaaagaaagaaaaaagtaacttctagccgcacaagaatttagtcctattcaaagaataccacaaaaattttagagtaacaatgaatgccaaaactaatcatcaagtatatcaaaaatgttttcccgaataaaaaccctccatagtagtaaaaacattacaggatagctttatcgtgtaggtgttcacaataatattatgtctgaaatgaatcaaactttttccttgccctgtgctgattactgagaatatggatctaaccacaatgctcttcctccatagttcatggtggctactggctacccttggttaggttaatttcaaaacgaatcaaggtcgttccatagcctctggtctaaattattggatcccactgcatcaaaatcataactttgataaaacctatactttaaaatatattttctgtcttcatatataatatatttctaaaaagaaaccctttaattacaatgaaagacacaacacagtaggtgtgtgtagtgtgaaaaatatttccatggaagagaaaccctaatataatatgttctatttgttgtacagacatcaatacttaagtctaagggctcctttaatttggccaaaaatcatagaaattttgaagaactttaataagagctctatccttttggaaacttttttttaagtctatctatctcatcaaattcttatgtttttttctatgttccaatcaaacagtcatttctatttttttctatatttatatttttctatttctttgtttttttcattcctataattcaaagagcacttaaatgaaactctttccttgtcccatcccaattactaaaaatttccctagatgtagccacaaatccacaatgctcttcccatattgacacagctatgataggctcaaaataaatctaaggtttcatggatctggcggcaccgtgctgtccgctagctcacccaccgcagctcaagaagacctgcattcctcctcccccaaatcacccccatcaaaaatatcctaccagtattctgtattcccccatgcctcccttctcttctgacttgatttgtttattactgacgataatcttgacttgtctgcctccaaatccgattctccacacatgcaaaaagaattaagaattgcatattgcatattgcagccttgcacttgcagttgcaaggcagctgctgctactacaccctgtcactcactcacacactctcatccctgcaacacacacacacacacacacacacacacagtggcagtacacactacagtacatgctgcagccagcagctacctatacactcactatcacttttgcaagagtgtactactccatctaataattgcatccttctcctctacatttctgattgatttcttttctccccctttgatttgttgtttgttgcttcttgtgctcctccctccaaagatcaccaccaccaccaccaccaccaaccacccacaccaccttcctttctctcctccctctaatcttctccccctctccccaccaagaaaaatccaggctttgtattagggaccagattaagcagagaaccaccaccttttgcctttttgcagtttgctgttttcacctcctcaaagagaagaagaagacactccaaattcttcaccccccacacaacacacattgtttcttcccaaaaatccaatcttttggttttgggcccaatttgtcctcctcttaaatcccacttttccatcactccattctgtcataaatcctctcctcttcccctctcaaagttccagcttttcccactaagaaaatccaatcttggccactccatttattcgctgagcaaatttccagccttttttgcgcccaattccattgggagatggagaagtagattttagcgcaaaaaaaatcaggtttttttggcacccgattttggttgggagagctcgccggagatccgccatttgaggtaaggcgaggagctctctctcccatgtcggactcggagctgtcgcagagcacggtggtgttcgggctccacctgtgggagctcgtcggcatcggcgtcggcgcggcgttcgtgctcctcctcgtcctcctctcgctgctctgcctcgtcgcctcacgccgccgccgccggcggcgaggggtcgccgtggcgacccccgtgctccacctcgccaccgccgtcgcgccgcccaagcaccccggcaagccgcccaaggacatccaggaggtgccctcccgcgccgccgccgccgccgcggcgcccaaggcgcagccggcgcaggtaatccaggcgccgccgccgcagccgccgccgtcggaatccatccagatcgagacgggcaaggagcaccgcatcacgttccgggagcagcagcatcagccgccgcagccgccgccctaccaccagcggagcgggggcccctcgtcgcgcggcggcagcggggagagccgcggcggcggcggtggcggcggcggcggcggcgcggagcccggcgtgcccgaggtgtcccacctcgggtggggccactggtacacgctcaaggagctggaggacgcgacggccatgttcgccgacgagaaggtgatcggcgagggcggctacggcatcgtgtacacggcgtgctcgaggacggcacgcaggtcgccgtcaagaacctgctcaacaacaggtagtacctaccactcttaccacctgctgctgctgctgctgctgcttcccatgaactcaagcataatagggcaaaatgcagcagcgtgcgtgtcgaattgggtctcttttttaagaatgcgtaggttcaaggttaagcattaaggaaaggcttgcttagtttcgtgagggcattaagcattacttgaatggagatgttgacaattgtagatggtgacatttttgctgagaacttgggtagtagagacgatcatgtcgtgttccgcactgaacattttcttatggttcacatgctctgtgtggaagctgtcgattttagaggccgaaatatatgtcgcgtgtgacgtgtgttggttcgttctagtgctctctctctgttgccaaatttagtaaaattttgatgcttgctttgttagggggcaggcagagagggagttcaaggttgaggtggaagcgattgggcgggtgcggcacaagaacctggttcggctgctgggatactgcgccgagggtaaccaaaggtaccttgaaatcaatggattctatgactgagtagcttgcaatgtataatattttctgtacgaatccttttcaggatgcttgtgtacgagtatgtcaataatggaaacttagagcaatggctccatggtgatgttggtcccgtaagccctctcacatgggatatgagaatgaagattatactaggaacagcaaaagggtatgcatctttcagttcattaccgtagactatagacatattggtaacattatttacattgtgcagcttaatgtatctgcatgagggacttgagccaaaggtggttcatcgtgatgtcaagtcgagcaacatcctccttgacaagacctggaatgctaagctttctgattttgggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 61513 - DNA, 12873 bp, Oryza sativa
tacataataatttgtgatacaactacagcagaatcatagacaggacttgcagaccaaactctggtggacaaaaagatatatataaggggagatatcatttatgtttttgggtacactgtttggaaggctgttcacctatcttatagagggaggaagaaaaaggtcttacagttacagagtgatttgtttttagagtaattctcagttagtacgtcatataatgtcaaattctagaattagagaaagagataacatgaatcctttttttttcatgaatgatgtgaataccttagtgctttgtgaaatgcacgaaaggagaatttgtatggactcccaagtgtgtagttcttttgcatcttgcatggaagaacatcattttctgctgttaatcctgattcacgagcagcaatcacataattggctgcacttgccactctggtccgtggccaggagactgttcctaaacagactgaatttccggtgtctcctagtcccactcccaactccgaagcatactttctccgtctcattcgtttttttggatggatggagtatatcagtatactgtatatcacaaatccccattgcctagtaaatagcaacattgagtcatctacgaatgtttgaccttgaactctcattgatcttctttcggggtcatattatcatacatagttgcatgcatgtcttctgttccgtgttgtgatgcaactgtgggcctgtggcagctatttatcactgaatcgtacatggacttttccaaaccatataactttggcagatacatattactaatgacaataatttatagctggagaagagcacataaatggtgatgtaagcatacaatggtctatttctaagacaatttttatggagagtttattggtagtacaagtaataatattcggaaagtttcggaaactgactctaactgtgttatgtcgagtgcgaattagaccccaagcacgtgctttcgtattagccacccccacctgaccatacagtgcgaaaattcattgaatagagcatgagaaaacttacagaactagagtcctaggaggcaatagccaagaaagagaaaaaaaataatcaccaccacacagtccaagagaagaccagcactgtaccggttactgctaagtgtgactggcagccgctaggccaacaaagaaactacaaccgagatcgtccatgatcttctgctgatggtttcccaattcttcctaatttcaggaggttggaagctatgccatcttttgctgcattagccatatgcatgacggcaaccagacgacatttggcccccgtgtttcatggcggtagcattacctctacacactatcgaattttcgatgcatcctagtccccaattaatatatcactatcccataatcccatttcatacctatcatgctcatcgacgatatatacatggagctgcaatggttgtgtttggaggagcaatggctacacagctcggctacatgtacatgaggttgaatgccatatcctgggctccaatgaggctgtggcaatattaagacctgactatggggcatttttctgtctgtatttgtgttccttgtagatcaattcttatgatatgtgatgcttcgtaattgcaaagagataaaactgatagatccagtacaactggcattaatttttagctgttatataatccgaggtccgaacgtggtaaattgtgccaaattgtttcatactgatagagatggactactggttgagctgctatttttatgtcaggagtagatgaaatttactttgtaaacacttcagggatgcactaatgcacctttatcattctagctggattttctcatctcatattataagagaacctctctattagaaaactttccttctcatcacacttttaatcgattaatcccatcttagccttctaatgccatcgatgttctcagtttgttttttcaaaagatgttataactatttggatgatatgtaaaaaaccatttgaatgacatgtaaaaaattgggggatattcccttaggacaaaaacatgtgcgttgaagtgtgagtatgaaattgtttttattggaaaaaaagtcactgttaatgtcatttcttaatcagaataacacaactatatatgcctatatcatattctaatagggataatttgaaccatgccacacaaatttaaatcacagaatccatcaaccgggggaaacatagcagagaaaccgaacatagaaatcacagatctgacaatcgggtgcgggcatagtggggggtggggagcttagctgacggcggcgaatcggcagcgactgtgatatgtgaggcttgcaagttgcagcggcgccggtggccgctaggagggaaggagcagcgcgcgggaggtcgggagtatggaaatggcgttagacctagggtatgggaacaccgctggctttggaggcggcggcgcggaggagtcggagtgaggaggcgccggaaggaggagatgcggtccgacgattggcttccaaggggaggaggcagccacgtggcggcgctcgaccacgcccgtcgccgctgccaccgccggagctcgcttgctccgccgcccacccgcgccgtcgctgcccgggaaggagagacagagagagagaggaaagggaagaagagagagaagggagagggaagaagagaggagtgaggctaacatgtggggtccacgtgggccccaccattttaaaattatttttgtgtgcagctgacatgtggggccatattttttttttatttttccgagatatagttgccatgtaggtgccacgtcaatgccacgtgggacaaagacctagtcaaacaagccacataagcgccacgtcagccaaaaccgccttcaaaaccaccgagggacctcgtttgcccgattttggtaagttgggggacgggtagtatccggttttacggtgaagggacgaaaatcgaactgggtgacaaatagaaggacccaatgtgaacttattcgatatgaatatagcccacatagttgagggacgaaaaatagacttattctataaagaagcacgataggttgtcgtgccttcaagctggcccggcatggcccgagtcatattaggccgtgtatgcagcccgtaggctggtacggcatggcccagcgtgtcggtcggggcgtgccgggccgactaaccttggcccaggcatcacgccccgactaaccccgactaaccttgcctaggcggtccatttggcaactatacttagaaccgacccggaaaaaaagaaataggaaaccggaaccaacaaaataagaaatactccctccgttttataatgtaagtcattctagcatttgtccatattcatatggatgttaatgtatctatacatatatatatctagattcattaacatccatataaatataggcaatgctaaaatgacttgcattatgaaacggaggaagtagaaaatagaaagggttaattagatacatggcattaaaaatttgccggttttgaaatatgccattactatttgcatatttggaacgatgccattgctattagtttgtaatctcagtagtgccactaagatatgtattttgcatgtatgacgaaaatgccctcatcttctacctctctccctcttctcttatcttctagctctctctccccgctgcttctgctccggcgccgtcaccaccgctgctgctgccgctgccgcgccattgctgctcaacgccgctgccgctcacgctgctgctgccgttgctgcttgccgccgctccgcacactaccgctcgccgctcactgctgttgccgctccgccgccgccgctcactccgacgctgccgctgctaccgctcgctccgctcgctgccgccgccgtgggagaggcgcttgaacacgagcttgaagagacgggacgacgtgtcgagcgccgggtcaaagagtatcccggccaggaacggccgcaggaattgctccacgatggatggcgagaacccaagcttctccaggtgcatcgccgtggtcgtctccagcgacaagatgatgacctcgtccgggggtggacgctgcccggagccgggcgaggccgacgaggagcttgtcagcgagtgttccgacgggggagaagatggcggagagggaacgcagaggaagtcggaacgggtcagacaacaggtagaatggctcgccggcgccaaggaagacgagcgttccaggataaaacggccagagccgcaacgccagaaagtcaaggagacgccggcactccgggtagacgagtgctccgacgctgccgctcgctgctaccgccgccccctgttctctgagctgtggaaggaaggagaggggagaaaaagaaggaaagaagggtaatttgatctaaattttttttttgtaaatggtaggtagtgacatatcttgaatctgtgtaaaattgtaatagcattgtttcaaatacgtgaatactgatggcatattttaaaaccggcaaatttttaatggcatatatctaagtaacccttctttgattctcattcccagatctggtttctgcagatgcttctctaaatcgatggcattttttgttttttttccgtcttcaccgattgatgtgtgcatgtcatgccatagtcggtattcatcctagttctcgattcgtacgactcccttccttttccctttaggcctcctccaacaaggatgagtcagctagctcataaatctccatatcagtttttgtatgatgtggaagagagagaagataaggagagagaatgcactatctcttcttcaagagctaagttcctaaagaaaatgtgagaggaattgtgaaacccaaagcattttaaacaatgtgctatgagacaatctattggagagaggtagactttttgctatctcttatatgagatggacaagcatgaagcatgagctagtgcaccattaaaggaggccttactagagcagattagcagatgacgagaatcgagacaaggtgtctgcagcgtgctcgatccaagtcggggagcgcgatagcatgatgactccgtatagaggaatctctgatgcaagatacgtcagttttgcgaggtctccttctcgcgcgacaaccacgaccagctctacgtctccttctccttcttcgatttctcagctttgatacaaatccgattttctccttttcgtttttttttcttgatgcagattagggtgtacatggcgttccttgctgcaattgtcgtcgtaggccgccgccgctccttccccgccccactccggccgccggcactcctccccgccgctctgccgccatcaccgctccacccgccgcttcggctggagagaggaggaagatggagtagagagagaattggtagtgaggatgacaggtggggtccacgtgggccccaccatttttttattatagtgtgcgtgaaacttacatgtgggtcctatagaggttttattatttttcggatcgaattgctacgtaagcgccacgtcaatgtcatgtcagatgatcaccgggtcaaattagccatgtaggcgccacctaagctaaaactggagtcaaatactgccgagggaccttacttgaacggttttgtaagttgggggacttatcatacccggttttgcgatcaaggacgaaagtcaggctaggcgacaaatagagggatccaaagtgaacttattcctattcatatggttggaaaaatgggtctattttgtatctcttctttttgggccttgccctatatggttatttaagtatattttgcatccctatactatttttcttcgatcgtgctgagccgggccggccagacgtgccgagggtgcagcccaagtacggcacggctgtagggccaggccagcacgggtacgacccctgtcaggccatgctgtgcttgggctgggccacgggccgcaggcaatatggccatctatagtttggggagggagagggattataagcgatattggaatggagcgatctggcgagagagcgacaagttacaagttacattataattttttatttcctattcctattttcagtctgaggttctacaaagtaaaagtttttggaaaaaaggttgttaggtctggggagggagcgatgtcaagacccgagctcagaaatgggtaatcaactctctctctgacgtgctcaacaaatctggttggtcgccgaaaggataaactagggttctaattagcctactcctaaagacaataaggaaatttagttctttcttatcttcttcatctggccaaatgccaacttaaatagtctcttacatcaggaatcatcttacagctgtaaagagagtaaagcaacgataatgacaaaaacttgaagtctgcagtggtccttcatccgcagctccgttggatgtaaagagcgaaccgttatccatcgatctcagccattcattactcccttctcttcagtcttcagaatgttcagaaatgctttcagtcttttcatttctatctttcaggttctgtcaagcgatctgtttctgatttctatttcctatttcttattttcccggtcggttatagggagggagaaggattcagaagccatatggggagggaccgatctggcaagagagcgaaaagttacaagttacattatctactaatataaaaagcacgagttgtatagtgcaattaacatcacgattgcaattagcgtcggattaacatgcgattagcgcttctcggtcccttccttcgacaaatcgaaagaaaaaacgtcgccagaccacctgcgcctcctccttccccaccttctgccgccgcgcgtcctcccccgcattccgccgccgcgcctcctcctcctccgccttccactgccccgcctcatccccgccttccgccgccccgcctcctcccatgccttccgccacccaaatctagaaaaaatcgctcctgatggtgcgccacgccctacctctccggtctccgcctcccgtcgtcgccggtcaccgccgtttgattgtgtttatatgtttaccatgatatatagtgctggaacgtgccttgcacgtgcactattactagtagattaaaatgcatcaacggtccttaaacttgtcagtaggtttcacttaggtccacgaacttgcaaagtgtacatcgagatccctaaacttggtttattgtatcatcccagtccaaagccgtgtttaaccgtggtcctgcctacgtggcacgccacgtgaaggctgacatggaatttttttatcctttcttccttcttctttcaccactgcgacaacccttcccctcgtgccgcctctcaccaccgagaaaaaagaaggaaggaagagaaaaaagaaggaagaagggagaaaaaaaataaaaaaaaatccatgttattgtccacgtggcgtgccacgtaggcaagatcacagtcaaacgcggctttggactgggataatacaataaaccaagtttagggacctcgatgtgcactttacaagttcgtggacctaagtgaaacctcctgacaagtttaaggaccgatggtgtattttactctacattatattttagaaaaagtacgaattaccccctcccccgcgcgaactatcacggttaaacgaattgctcccctaagcttaaataccagacattttacaccttaaactatttataccggactaagaacccctgacactgttctgagcggttttgacttgatttagcacacatggcagaccagtcagcagaaaaaagggtaaaaaacccttgggcccacctatctccccccccccccccccccgagaatttagactatttaccatcaaattcgcttgtctcaatttttttaccacccaattcacgtgccttctataatatgtcattaggattgctaattagtctatttggtaccactttctctatttttattgtatttctattttcttaatttcatctatttttattgtatttctcttttcttaatttcatttgtatactttttcaaggtttgtggacgtttttgcccatggacccacctgtcagataaaaagagaaatatctctctggttctggatcgataccagacaccagcgacgccgagcgccaccagacactagcaactaccactgcgccgccgagcggctccgccccaccaccgcgccgacgagcggccgccgcccgggtgcgtcgccccaccaccccgccgtcgagcagcgccgctagcactgtgcgccgccaccccaggtcgacgcccccgttctgcctccaccgcctccgacgccgagtatggtggcaactggatgagctccatcggcacctagctcttatttacagatgatcgcttatagtgccgagcatgatggcaactggatgactgcttactgaatgttgtaggatcttaattagttctcatttacatatttcctgggtgcttgaggacattgagtctgtaacagacatgcatattgtagccaaaaagtttcaggtatattgcaatattgcaaacctctaatggcgctgatggctggggcggctggaggtggtgccgcacagtgccggccgggtggtggtgaactgtggcggcgggggcgtcggtggtggcgctcggcggcggctgagtggtggcacttgggcggcggggatggtggggctgcgggtcggtgctggcgctagggcggtgggtcggacggtcggtagtggcacctggcggcggggcgacgccgaagtagcgcgtgtggggcggcggtggcgctacgcttggagggatcaatcgatccagaaccagacatatatttctctctttgatctgacaggtgggcccatgggcaaaaacgtccacaaactttgaaaaatatacaaatagaactaagaaaagagaaatacagaaaacatagaaaaattggtaccaaatagactaattagcagtcctaatgatatatcatagaggcatgtgaattgggtgttaaaaaagttgaagcacgcgaatttgagggtccccggctaatgacatattatagagggcatgtgaattgggtgttaaaaaagttgaatcacgcgaatttgagggccccccccagcgcactctggcggccaatggcggaggtgggcggagcgagctcgcgtggctgggggcggaggcggaggtgagccggttccccaaatccggccgccgccgccaccctcatctcccagagcaggaggcagccggagctcgctcggggaggcgtgtcgaggcgggcggatggtcggcgctgacgggcggcgcgggaacaggcggtgggcggcggtggtgagggggcgcggggacaggcggatggtcagcacggacaggcggtgtgcgggagcgcggggacaggtggtgggcggcggcacggggacgagcgatggcgacggcgcgaggcgagcggtgggcagcggcgcggggacaggcggtgggcggcggtgcggggacaggcgatgggcgggcggacgattggcgtggacgggtggtgtgcggtggcgcggggaagacgaggtgcctctgcctccagtcgccgcctgcctctccatcacggcttgcctcccgcgcggcttcaccgcgctccacgccgtcgacctcccggcgtgcgcgcccccgtctccgggtgctcgcctacttcgggctcgcaccgagctagctcacgccgagcgcgtggcgcctcctcgccagcttcaccgtgctatgccgtcgcaccggtgttgcgccgccgccgctgactgtgctccagcacttcttcacggcgcttgggtgcccgcccagggcttggttcttccgcgccgccctgtgagagagagtgtgtggagagagagagagagaggaagggaagaaaattatgtaagaccgaagtcttaccctcatccgaaggactttgttgctctgcacgacacctgttccgcacgaatcacagcgcatgcttactccctcaatccccctcgtctcgcttcggttcctcattctttcgctcctggtgactggtgaggagtcgagctcgggcccgtccgacagcccacgcggcggcgccccgcagcatcgagctcatgagggcagccaggaattagaatcaaggcatcaagctcgtgcttccggcctgcttgtacaagatatctcaagatttggaagaaggtgtgtcatcgattcgaatctgctccttgaactgcaaagagttgcctcacgatgaaattattcaacgattagattttgcttgccgttgagtttagtctgtatggtgcattgcactgattatcattgagccttcaaagatttctttgtatttgagcctttcaggattataatatgttgatgtcttgacgattcttcccgagcagcgactcatgcgagcatggatgctgctgagtttctctgccacatcacgaatcccgctcgatgcccgcgacagcgacagccgcgagctcgacgcctcgccgaggagagcaaagagaatgaggaaccggaggcagaaggatgaggggagtaagcctgtcttgtgattcgtgcggggacaggtgtcgtacagaggaattaagtctttcggatgagggtacataattttcttccaggggaagaggggaaggggagatacgacggtgggtcccataactttttaaaaaagaaaatactgactagattgccatgtgtacgccatgtagaactatactactctggattagatcgaggggggtaattcgtccagtattgaaaattcagagcgaacaatgtctgtttttcaggtttagagaggtaattcggtcgaccgcgatagttcaaggggagaatttgtagtttttccttatattttgatttcctattcctatttcagggtagatatgttaggtgggacgacaaaaccactataattttttttaagtaagccaagacaaaaataaagataaagataaaataaagatttagttgagaataacaaatgaacatttctaaagggaactaacgaagaacatcattacttttgagtcatgtgaatggagctgctgaatttcatacgcctccaagtgcacacaaaccagtgacgaattgtcgataactcgagacaaaaccataacttaccatgcatgctctagcggagcaaagcaaccaactttcacaaggtcagctgctccaccaggcaccagccaaccttcaaatctaaaatacgtcgtgtgtacattgattggtggtgagaattgggtggatacatttatcttctcggttgaatttgcttgatccagtgttgaaattgcacgatttccggttagcaatctctgacttttctgtaccggctggttgcttgttgatatggtggttttccaagttctaaatggcagtgttattatatttgagcaaaagacaataataagtgcttaatttcaactcaagctcatgctcttctttcaaggatctcgcactctcgtataactgcaaacctctcacgtaagctttgagtacgatgcaatagtttagcactacttttgtgcttctgtgtccaatacccatcgtaacaaacaattgttcactgtagacaggtcaatgagcaggtcatacaaatatctaacattaccatataaatggtaacagaacgtggtacttgtgccgactccagactaataggaaacctcacccaaaaaatgaggaaaattgaaatgctttttggttaagtatgtaaccaatcacagagcatataaaaaaaccatcgcagttgggaggcaattcataaagaaataataccatcccgattatagaagggcaaaattaaggtatcttacaagctatatcattgcaggagatgatatcacacatcaatagacaacacacggagacacacatcagtaaagcacgccatctagtctcttactacttgtaacgctccgcttttcgtgagtcgttaaaaactaactcggcaaaatcctaattgcgaaaattttcgttctttgtgtgagagtctaagttgtgccaaggatctcaatttaatcccgttgttccctctcatcgaaatcgaaatcctccacctcgaaaaattccttttccgattcaagtctctgaaatcaaattctgaaattcaaatccttcctttgaatcctcgccaaatacttctacgaatctagaattattcaaatctcgcctcgaatccttcccttgacttcaccttatgttcctaaagtcaaagtatcaaggttaaattccaaaaatccttctcaaattctctccaattgaaacccccccaccaaatcagttctctcgaaaaaagtctaaattgcgtccttcttggctatgggccgtttctcccttgctcggcccatttctcctcagctccctccacctccacgtgcgctgcacgcgccgagagagagagaggcatcgcctctcttcttcctctctctttcctcgctctctctctctgcttcctttctctctctcccacgccagcgctgccgccatcgccgcttcccgccgtcgccgcccaaaacccgccaccgccttcgctctttcccgcgctcgtgcgtggccgaccggccggtcgttgccgccgtcagccctgccgcgccctcgcgtccgcgtgcacgcgctcgcgcgtgggtcgccgccgcaccagccccgctgccctgccgcgctgcaccacgcagccgcacggccccgcgcgcgtgctcgagccgctccacgcgcgtcctgccaaaacccggaggccgagctctccctctccctcctactcccttcccgaatcggcttggagcgagcctctctttttccccttctttttccctttcccgaccaccatcggcgtcaccgcctgccaccgcctggaccacgggcgcgaccgccagcccgcgctcacgacccgaaattcggccgtc

SEQ ID NO: 61514 - DNA, 5094 bp, Oryza sativa
tccgagcacccccccttcttccccttccccggcctgagaacggagaactcactcccgcaccgtcggccactcgtcacggtgccgtcccgactcggtagtgactccctccattctccttcctcgttctccctcgccctctctagcttgcgtggtagctctactagcccctcgaaagcgcgtagacaccgccccgagctccgccgccgctcggcatggcctcgccgccattgccgcccgcttccggaggccgccgccgtcgctagccctcctcggtgctcctccgccccatccgatgccggaaacggatttcttgaaccccggacatgcccccaccgccttgaattgaatccccgtcacccctccgccgtttcccccttttcccgccaccggcgtgcgccgccgcgattcgtcgtcgtcggcccctcctcgaaggatccgagccgttggctcaacccctctcgtgctcccctttgtaccggtgaactccctctcgatcgaatcgctgcgtcgtgctccggtgaaaccccgccgtcggccaccgttggttggagctcctgttcttcttcctcctctcgcccggcccgcgtggctgccacgtcggcgccacctcgacgcgaccgggtcaaagctgacctcggtcagccgcctccctccgtcccccaccctcgcgcgcggtccacggagagccgacatgctgcgcgtgggcccgccgcacaccgcgtccacccgcgcgccgcgcgtggaccgcttccccccccgaaccctagcgccgccctcgcgtgcgcccatcccaccgtgggccgtatcaccgacaagcgggccccacccgggaccccgcgcggtggaatcggtccaccgggccgtctctctcacccccgcgccccctctgttgggccgcctccccgtggccgcgcccggcccaatggctcggccgagcctccttcaaccctttgggccgcaccaatgccacccgagacaagtccaaatcacatccctcatccctttaattttccaagggatttaataaatccttttcctttgtttcataaataaaattctttattccaaaattccatgaatcattttcctttggtcccgcacgtcagtgactgtcaataatattcttgagaatattatttctataaattccataaaccatttctcgtcttccagaaattccaattaaacttccaaaattcatatcttcccaaccgctcttccgattgactccgttcaacttccaataattccgtaaattgagatctatttaatggcactactaattagtctaaataggatctttctttttgtcttttgtttaggttttcgattgtttgcgtatagttgcagttatcggattttcgtcgatcgcgggttttctcgaagattcgtgaagcttcgtgaagaccttgagcaaggcaagtcaccctttgatcaattgcccctataattgaaaagtcattattattttgtttgcaacttgcattattataatcacacacttaacttgcttggcctcggtttgcgtgccaaatcgacggacctacctagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaacttgcgatgcgggggttgtgcctatgtggcactgtcccgtattcgcatataaggaccgattcctatgggaaactcatcgaacataatcaaagtgcaaccacaaggtggaatgggacaccctggctaagtaactagtcggttcagggaaacctcgcatgccaatagttgggaacgttggggcggggtcggttggagccaaaccgggttcctggtaatgcaagaacgagaagcttgctgaattaccgatcgaggtggttggagtttgatttgtgaacgcctaaaatggcctatgtttatgtgaggatttgatccttctatgtggcatgaggtatccctgggtcggcttgggaaaggctttgtcgcgaacctctgacaccggccagtgtctggagtaagttcgtgtcttgtgggtaaagtgtacccctttgcagaggttaaccaactgttcgaacagccgtgcccacggtcatgggcagatgtgaggtggttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggcagctggactctgggagtccgagaaaatgaaaaaggctctgggagccgattattcaagtggaatggctctgggagccgagaagtaatgatctgacccgggaggtcggtacatttccatttgagctgttgaaaagcatctcttaagtcgatttgagacgtaagtctcttttcgacccaaacttagaaagaaataattcacttagtgatttcaaaatatcttcaaataaaagatttgcaaaacaaccttgcctctcttccaagcttgcattaaacacctaagttcccgtgacttgctgagtacgaaagtactcacccttgctccatataaatatatatagttcctccgccctgaagagaagacaaagtgaagtgaagattagggtttcgtcctggttcccagccgtcgcctgtggtgttgggtgttagaccgttggttccgctgccgctgttgttgttggtgttcgcctcgtccgtgttgtcggttgtattctcgggctgtctgagctgcaacctaagttaaggtaaataagtcctctatttatttaaggattgctatgattcatatttgtcaccgtgggtaccagcactatgtcctgggactggtaccgagatcgcggtttcgtaggaagcggttcgcgccgttttccctacgacacgctcctgtcaggtgccgttgtacggcggtatcagattggggtgtgacactactagacttcatccagagattgtagggttactaatagatagtaggatgcacaatggataaaacaaaagtccaaacttgtgacattaataatacaagcatacctcttatagtctattaagatactaatgaaaagtggactaagggaatcttcttggaagcaaagcaagtctcaaaatatattagaacactgactcaatgaaagtgccgtcagtagtggtgtgacatttcgacttgtgcttgatcattcggagtttctttttgccaccattgccgttgccattgccattaccatggccattgcaactgttgcttgcactgccattgcaattgctgcttgcaattctgttgtctttgccaccgttggcactgccattcccattgccctggtaggtacgtggcaccacctccacaccggttatgatagcaaatgtctggtcaatgaaatcatcgccgtagtagctaattctcgtagtattgaagaaccttgcaatgcagaacttgcccgagcctatgttgacaagctgaggcccctgcagtagatcccagtcctccagcgggtcaaactccttccaagtgccaactagctgtggtttggagtccaggttggagagatcagcagcagataggtggttcttgtcagagaatccaaaccagagattgagttccggcacatactcaatcttgccatacaagggtagcatccacttgccaaccgggctccaagtgtgggtcgcaatgtccatgcagtaggtgccaacgtcctccattgatatcaagatttaggtgccaccaccgaccactgcgtaggacatgatctcggagcggaccttcatctgcatggggtcacgtaggtaaggcggcggcggcagcagttggcacttccagtacttgaaggatgtcttcttgtgctgctggccataggtgtacgcctcaaactggtcactcgtctggtctttgtagcgcagctccatattgggactgctctccatgacaaagagggtgccaacatagtcttcatcatactcctcctcgtccatgttttgactgactgcgctcgggatgaagagggagaggggtttttccttgggtttgtggaggctgggcatggtcaccacgtggtgcgtctcggcgtcgaagaggaaggtgcgcccagactggtccgcgcagagcatcttgctctccgtgagtgggaggtattggatgctcctcctctggtcgtcgtccttgggtgaagctcggaacgtgatgatcgggtcgggaagatgaatcctcggcatctttgacgcctcacagtcggcattggccaccgatccttttccgtttagtggtggtcctgggttaaagaatttctggcgcgctaggtcgatgcggcgcagcgacctcaacccaaggatgcggctgtccataatcacattcagaaagcgtcgcgagaggctcatcgtcgatccacaaacttcaaaggaaaaaaaaatcatcagaaaatatagtgaagattcagtaagaacgagagggaaaaaaaaaaagaaagaacagacaatctccgtgatttgggtacggtactagctagcaagattagattgcggggaagaaagagtagaagcacggagcaacaaaccgattcgatctgctttgcagtcaatccagggagcgtccggcctgctctgctgcaggataagatggtatcacaagttctgcaaatatcaaagataaaacaacgagaaaatgaaaaaaaattggctttccaaccgagaggataaagataaaacagatgtagaagtagaagcagcggacctggggcactcggttggaaggggcagggcgtaggcgtagctccccagtggccggccggaggacgaaggcgagcaagatggcggcggaagggcgagagaaggcgatggggatggatttctttctaggtctggacgcctcgggacaatatagtaaacgaacctac

SEQ ID NO: 61515 - DNA, 2097 bp, Oryza sativa
attgcgagctttgcaatttagttcaaaagtagttttttcagcagcaatattaatagtttcaagaatcacataagaaagagaaacttttctccaaatattataattctcagccataatgtaagattgcatcctactacaccaatgagaaaaatctgttccatcgaaaatatgaggcttagttgtaaacttattagaagtagccatggaaaaaactcaagatcggtaaagatcaaaaagagcaaatgtggctctgataccacttgtaggatcgaatcacaagaactagtccaaccagaggggggtgaatagttggtatatccaaaaaccaaaaacttttagtggaaataaaagttaccctcgaaatcaatggatcgcggtctgaccgaagtagtagcgccggtctgactgcctgaatatcgtcggtctgaccaaggttgtaacaccagtcgaaccgccgagatcaatcgccagctcctgtcgccgccgccggtctgaccgccctagtaccgccagtcggaccgccgcgatgccgccggtctgaccgctggtgagatgccggttagaccgccgaaacccggtgaaacataaatcgaagaactctcaaagtagatgaaaactttattgcttctctctgtgtttacaaagtgcaccaacagcactccttacaaaaatctcgactaaactcgaaaccctaactaaactagcaactcaattgctctcaaaagcgataccgggaagcctcacgctctctctctatttatacatgaggtaggcagcctaaagccacgaaccaaactcatactaagagtcctaaacaccttaggaaaccctctagtacaagaaataaactccacataaccaatcgtaccaaatttggactccttccaaattcgactccgcatcccatacgcacacaatacctccatcgtatgccatatagaatctccatcaaccacgtacatcaactctagccttagtatcccgcatgatatctgaccaccacggacatcgtcttaccaccaagccgactcccggtccatcaccgcaaatactctcccgaggcatcgagtcacctacacatgaaacaaacaaagaaaccatatttcgagaccaagctatctccaactcgactcattgttagcaaagaacagtattacatacgtatagtatccatctagaagccataaccatgaaacaatcatggatatccaaataaacaacacgaaaccgaaaccgacacagcgtcggccagtcagaccgcgggcaagccggtctgaccgctcacatagcgccggtctgaccggcaaccaccgcccgatctgaccggtcccgacaaaccagtaaaccctgttcatctcctggaaattgattatctccaaaaccacttcgacgataatctccaaatatcaaaaccgataatcacaggtaccaattgttcatcacagaattagaatcaaaacacacgttgatcttacagctacaaccgattaaatgccgtatctcgcatgtatatcatcagttgtaagtcatcaatttatccttatacatcgataccatactattattatgtttgtaccgcgctattagtaagtgaaagttaataataggtaaaaaataacaatttaagtagtgatttaatatatatgtctaatgtctatgtcaagtggtcagactcatccaacttatataacaattagataaaaataactatgcaaaaccaccttaggtggttctataaatggtattgtcaaattgaggggattgaatattcggtttcaaagtttagggtgctagataaactttaatttaaagttttttttttttgggggggggggaatctggacctttcctttaactatttcctacaccccaaatacatgcaaaagtctaacaagttggatctgttctagtttaagccagaggagtccagtatgattctgcacggtggtgacatttgcctcgatcttcttttttttctggcttggagagagtagtccacaccgctgaaaatttccgatgtctctagttccaagattaccaatatgatgtagagtattccattgtattggtatgccattccctaggcagagacaacat

SEQ ID NO: 61516 - DNA, 2875 bp, Oryza sativa
gtctagggtgtcgccggcgccgaaaaagaagaggaggtcatcggagttggaagagaacctggagcacgaatctcgaagctcatccggagtcccgaaatttgcaagatttggggatggaatttctgtcgaaagaaggttagccgtttcgttaatggataatataggcagaattaaacaatgcatgtcataccaaatgcccaattccagaaagaaagcttacaatgattttcttggatgcataatgtgacatatgtatgcaaaaatagctagtttttagcttagaaaggaacagggatatcagtgctgtgaagtgtccagtgtctcctagttcgctctgtttttcacacgaagctcgtcgaagatgcagcgtttcatcctcttgttcatgctgaagagactaaacatgttagtcctgaatttcctatgcctcccaagtccacaaagatcagtgacgatcatgtccacagttcgagcagtactaatctagctagcgatacacagatacaggctgcaggctgcagctgctcctgttttgtgatcaccaggaacgttgtcactcacacaccatatccttcctggtctcagctctggaggcaagatatatatgggcatcaattaattaatctaatgcggatggtttaatggatgattggtgtctcggtgaaaattgggtgcctatatttatcttctcagagaagatgcagagacgatgttttactggctatatatgtagccacacaacggcgccgacgaagtaagcactattatacgttctaactggcggagttatactgaagcaaatggtaagtgcttaatttcatgaaaccataagttcatatactcttctttgaagtagtatgagttagcgttgaagtatatgagttggtaattgtttctcctgcttaataagtgcttaatttcaagccataataatgccattaagttcttgatcataaattgtacttgtgggctgtggtcttacgttgctagctcagctcccaatcgtgcctgtacatcatctagattttcataagattgctcttagcgtaatggataacaattgtagttgtaacggatgcgatagtatttattttcatatattatctaatttgataaataaacctgcgcaaacaaaaccatcattattgttgacacgaaatataaacacatgcgggcttatatataatcaactgaagttttttaacgtgccatcacattctagcttgttcaacaactattagctttatggcatgctgggtagagacgacatcacgaactgggccatcttactccattaccaatgagatggactccgatggcaagtcatttgttccttagatttcaagacatggatacttgaccgtggtccgtggagaccgctgaatttccgatacctcctaatcccgaaatttcggcacccctctccccccacggcaagagattatctcggccaattttttttggtttttctcatttttttacggatttgatcaaaatatagtcaaattcagttaaaatatgttaagattttaaaaaaaaaaccggtcaaaaaatgccaaaaaatcctgaatttttaggaattacagtagaaccaaaatggccaaaattttggaagaaatcgaaattgaaaaccttgcatatccacacctcattgcgcgcgctgttggtgtaccgctggggcgcctggtcacatactgccaaagtgcaaagtccaatcaaatttgttccttctccttagtaagaaagaatggtggaattgtaaatttatctgatttctatcgagccatggatctaagtaaccaagattactaacacctgataccttccaagccaaaagcaacccatgcctggcatatctaccaattgttttgctattccctacctggctacttcagcttgcagtaacgttagacattgtcttccattgcacacacttgacctccttagcaacctcttttaaaggccatatagtactatatatatattgtgtaatatctaggtgaaagcaatcgcatggactttactgaagcctgataattcacagccatgacctatggccatgtggactctaaacgtactctgacgatcatccataccagtgtatgctgaaaacatcgcttgcttttttttttctttacaaattaaagaaaagtatgtatcaacacaacgtcaatatattaggccaggtggctaggtgcacgtgcagttgatcactaattaggctttcgactcagccattaacccaactagcagaaatccaaaatctcccaagccatcagcccaactcagcattggaaatttagcatagttaaattttgtttctcagctagcaatctatcatctctgctcggctgctcctagaattgcaagtttgcaaaaggtcgaaaaggatatttttgaattattattcaagctgcagcagtagtactcctactgtagataacaataagaatacaagctagacaacctgaaatggcaagagtgaagtttattgctcggatattattattgatctaggaatgctgaaccaattgttagtatccatttgagattagagatcaagtgaatattgaattgtcgtgtgatgtattttgcctttttttctctctcaatgttttcatatgaaaccacttcaaattacagccacgtttgtcttgtatgcgagataattgagttaacgttggtgttcagttcaacccctcccacttttctacgctggatccaccgctgctctcttattcatgatgaggagactaatcctggtgctgacaaatttcctatgcctcccaagtccacagatcaactgacaatcacgtagacaacttgagaccaaaccatgactaccaagctctagcggtctacctaggggtgtaag

SEQ ID NO: 61517 - DNA, 1405 bp, Oryza sativa
caccaaactacatccattgatctaaatgtcacacgataagagaaacataagggaaacaagcattatgaatagcgcaggaaccaaatctagccattgatgaatcctgaattaatgaaacataggaaggttcacttgcacatacaatatctccatttatagtagccacaggtgagagaggcaagcagtagaaattttcgaagtccaatgacagctgtgcaaaacaataacaatgagaacagaaaatcaacagaagtgataaaaagtactaagcatgctttcaacaaactgcagagagcatgtgacacacccccaccaaaatatatttaaattggtcaaatatatacagatttatcatcaatacatcttccataataccatacttataatggcatacatatatagctagataaaataattgtcaaaggtgtgtacagcaacatgcatttggtaaaagatagagaagaggacacattaatcgtcacaacatacgagattaggagcatagttaacagctacaaaaataggggcataggtatctaccacagatgaacaatttctgcaagataatatgctgccaatagtcccatcaaagggaccaaataggttttgtttccatcgcttgcattcaggctggttaccttccctttgactatatactttggaaggaaacatggtgatgtctgccagagaactcctatttggtacataacaacgggaaaattcatccctcagtgaggtcaaaagatgatgaaaggcttccgaagcatcctatgagggttaaatagttctcatcatttaaggacatataatataaaagtaaaatttaaagagaagaaatatacaggattaaacatcatgcctgctctcttgtcaaattaaagtggccgacgtagaagctcaaagcatccattactctgtgtggactcagttcagtccttttgtctcgaactacgctcaagtctacaacatttaagtaaagttcataaactagtaaaagaaattttatgagtaaccaactaaatgaagttttacaagtatagaacttgaaactgggagcatcacaagttatattctttttaagaaaaataaaacaacagttaaaaagacatgctttttctttcatattgaaggaagaaaccgtgatgtgtgaagtggagcaagaacatcaaactgtgagctgcaagcaattcattttaccaaccaatgcaatgacatgatatgatgttcagcaatttatgtaaatagattcataaatgtcaacactgcatcagagtatacctgtaaaaacgaaccgtgtttacagtattacagtatgtaacgattccaccagaccaccactgctcggtaattcctgagaccactagggtcacaggaaccaacactttattttccactcaaattatgt

SEQ ID NO: 61518 - DNA, 2284 bp, Oryza sativa
aagagagagagagagatgcggcggaagcagcagcacgaacgacggcgacaccgctcgctcggggatcggcgcaggcggggcgcggtggcggaggatgtgctcaccgggatggatgcggcgggagaagcagcagggcgaacgaacggcggcgccctgctccgctcgcggcgcgggatggatggggatcgccggaggcggttgcggcggcggtgcgggtgggctaaagggcaaactgacgaggaagtttatcagtattccgatccgtatccctactctcttcctattctacggatccctacccttctacgactccgatcagtattacgaaattttactgtcgcgtttctacaatcctacaaaatattactccctccgttcctaaatatttaacaccgtttactttttttcatcgtattataattattaattatttttctatcattgattcattgttaaatatacttttatatatacatatagctctacatattttaaaaaataagatgaatgatcaagcatgtttaaaaaagtcaacggcgtcaaatatttaaggacggagagagtatttagtataagatagattaaaaatagtatgaacaaatatgcttaagtttacataaaccaattaaatttatcggaatcaatttatatgctttaatttatataacatattatctattttatatcaaattttgtattttctaaaatctggtagtatctcgatcctatgatactatccggatcctatgacattataaatcagaaaacgattctacctggtatttcgatactgattacctttatcaggatacgcacaaaatggtaacagtaattagtaatttcgtctagcacatcctattcccaccctacctgaacaatggaaacctgaaaaatggaaaataatattaattagttttaatcgcattatccaaatggcttggatagacgagtcatgctagcacgatccacagccaaacggatcgtgtagttcctagtttgtcatgacacatgcacttgtcatgttggtacaccgggccgggtagcggcccaagcatggcttggcgacgagtcatactagcacgatccacaaccaaacggatcgtgtagttcctggtttgtcaactacacatgaattttcgggcgggcaaggaaagacccagcccaattgataacctactgctacaatcaacaaacaatcgttcctctcagaaagaaaaaacaagtgatgattgatcacaaaaggagacatgctacctagacagtcccaaaaaaaataatggctgatctccaaaaaaattcttgttacagtgaacaaataatggctgaactaaaaataagttcaaatggtggcatatggaccacataggcgtaccgaaacgcagacatggagtagacttcgaaatttgtaacaccaggtatttcagggtttccatgagtaaacatactcacgttaatggtatttgcaataagaaaaatatgaccttgcataattttcttaaccaaattgtatcagggaagataatcccctaaacctcaactatgtctgacaatcaatctctcgcctttttctagcttttacaagtccaatttgtaaatcggttcatggaccgttttccaagtacatcaatccattttgctctgtaggggccgcgtcttcttttgatcttagaggtgtggaagcaagattcttgataatggaagcatacagatcaaaatcagctttgtacttgcagcagctagcctcaatccacttctctgcaaggcttgtggccacgctgtcttgactatccctctcatgctcttcgatcgccggccttatctcgtcgtacaggctgtcaatttcagcagcagcttcattcttcatttcctgacatttgatttggaaaaaaggtcattgcaaagcctaagctttcctagagcaatgttcaataaaaagggagttacagtagttctttacctcgcaatacaatatttcttcacgtgccacctctgatgctaaccgatcacagatacccacaacattcagttgcttgcgcataccacgtttagcttttccaccacgaagtgtgggtctacgttcaccgcaaccaactctgtatggttgttgtcccggggcgcactttgattctggaggtttgcaactccacgcgttgagttttgcagagcatcttcagcacattgcgcaccatattcaattgatccattctgagtaaaatcaactcccattggaatagcattcaatggttcaatagtcattggtgtcaattcatttgagctcacattc

SEQ ID NO: 61519 - DNA, 974 bp, Oryza sativa
ttctgtgccaatgcctaatggttagagaaattcttttcaagtatacctgatagtctgatacattaaccatattcctttgtttagaggaacattagccacattctatcctcttcatttgccagtcataataggcgagatgctttaatgcatatatttttcgccgttgcaacgcacgggcacccaactagtatataacatatactgagtgagcaactgagaacaacacatcaaggggaggcagtggtttcacaactcactgccgtggcgagggtagcatagggatgggaggcgtggggaaatcagttgaaacaattgctcaaactatttcttaatgctcaaatattggaagacacaaaactcctccaccgtctgaaacatcctcagactcttccggtaaaacacttccatcttccggcaaaacacttccaactgttctactttctatgcttccgggtgctacggaagcagtgttgtcttcagacacatcccgccctcaattggaaatgccctcagaaggtgaccggaagaagctaacctatgggttgttagactgaagaatagtgaaagatgtattgtagatgtctgaaaatcaatatctaccctgatgtaatctcagtgtaaacctaatcttactttgaaacgaaattcacgtggggtccccccccctccccttccctgggcagtgatttggtaaaaaaaaataattgctcagcttcagtagtagacactgcagtgcagtgtgataacccttactgtgataatctatcaccagggttttacttttacaagtggctcattaaaagtccatttgtactaatggctaagagctccggagcgggtttagaccacagttggtttgttagtcaacttttgatatagtaattaggtgccacgtgtaaaaaacaaaaataaaacagtgggcccaacatgtcagcccacctctcccatctcatatgcacttctctttctcccga

SEQ ID NO: 61520 - DNA, 725 bp, Oryza sativa
acccacaccagagccatcggacgcgaggatgaactccctcaccgcgccagtgcgcgacgacaagaaggaagaatgcaggacgtacctccccatgatggagacgttgaacagtgccgtggaaaggtcgcccgattgtgatgcgtaaggtaagaagtgaaggcggaggactagagttgtgttgtcgtcgggcaccacggtggcaggtagccaagccagtatgagaagttgctcgtgcctacacgcattgtggctaaagagtgtacaaatggctcgcgtcggggttactgaacctggtaacgttgtgggagaactttcctaatagattgccatcgtttgggatgaatgtgcgctatggtgaatcggatttcacgacaacattccaaccggcgccacaggagagttagatggagaattgtgaagagaaggttgcctgcccattgaaagctgaaaccaagctcagaaagagaagcaacaacacgatcacaacaatccgcacgactcatccaccgtggtgcgagatgtggcagcccctggcgacggcgagtgcaagtaaattaagctcatgagctacctaattgtccatgctgttgcggtggtgatgtcagtcatggactctatgtcaacaaaaaccgctctaaaaaccattgagggagttattttgcatgattttaacattgagggagtcgttatacctgtttttacaattgagggataagaataagatc

SEQ ID NO: 61521 - DNA, 824 bp, Oryza sativa
acctgtggcagcagttagtcgccaacttctaaggaacctacaagcgccacgcgatcgaagacgacctacacgcgttaacacagaactcgagtgaatccttgagggaatatgttcggcgcttcaacgagtgcagaaatacaatccccgaaatcaccgacacttctataattcgcgccttcaagtcctgcgtcagagatcgctatactactcaggagttggcaacaagacgcatcacaactactcagagattgttcgaaattgttgagcgatgcgcccacgcagatgatgcgctaagacgcaagaacgataagccgaagaccgggggagagaagaaactagccacggacgcacctgagtcaagcaagaagaaaaatcgcaaaaatgggaaaaggaaagctcaagcggaagtcctcgcagcagaatacgcgaaccctcccaagcgcccagacccacaaggtagcgacgcaaagaaagcatggtgccccatacacaaaacggacagacattctttggaagattgccttgttttcaaaaagtcgctcgagaagcacattgcatttgaaaaaggcaagcgagtacgcgtggtcgaaaaggatgcggaagcggctcccaaggagtcggactcagcatatccagactctgacctccacgtttcacacatcttcggaggttccacaacgtactcctcaaagcgagaatacaagaaagtggaacgtgaagtctgttcgacatggcagggggctgcacccaagatgaagtggtctgaacagaagatagaattctcggaagaagaccacccagactgccaatcatccgggggatcc

SEQ ID NO: 61522 - DNA, 3808 bp, Oryza sativa
tacgaccccaccacccacctcgtctccacccgcctcgtcggactgtccccgcacactctccttcctagccatgttgctcgaacccaacatcacactactcatcaccatggcaatctacaaccccaacccgaccttcttcacctaagccataggggacacaccgatctcacctacatgggcacccacatcagcggcataaagatcgaccaggggaaaagctcgagctagaggagatggcaacatgacgacggtgctcaccatccataccggccgcttcgccggttacatcatgcagcttgtccgctatgtgatggccgtcggtggcgctcaacgcgagcaagaggatcaccggcatcaagtccccgaattcctcgcctccgcagccgttggtagatgcctcttgctgcttcgtcatcgtcaatcgaatttgttgctgccggagtgcagccaacagaggtcgatggaggaatggctgccatagtgcggcatcgacgaggcgcgatagctcccatctcccgggcgcgacatagactatagaggggattagcggcggttggccgcctcaactcttccctcccaagcgacgcgcgggaggtgggagagaggacacgaggcgaaggcggtgaccagtggtgcgaaccagtcgtcgtctgcctcaacctcgctaatcgtgccaccctcgtccttagcttccccgtgcccacccgctcccatgccccctcttctccttgcccttgtctttgatgtcatgggccacactgtcctcggcctcggcctccccatgccgaacctcgacctcgctggccacatcgtcctcagcctcagcctattgccaaagcttggacggatagaaaggtgtgcgtcgccgccatgcgcttgggggagaggtgcaagagaagttttgcttttatatttttttgtgtgacttacatgtgggcctcacatattttttttattctctcgttactgactaggatgacacgtcagtgaaaccactcatgcatactgccatgggaccttctttgcacggttttgaacacataaagggtagaaatttctgatatcggggattagggatgtcatacagattcgacgtaaaattgagggacagcaagtggacttattccgtaaactagtagaagcccttggccgaacgagaatatcacagtttgggccattaaagaagcccactactgctggaatacaaagccagccatcaatataactacttgggccaaacccagttaattatgtaagaaaatgtgaactccctatgggctcagatgggccatatttcctgcaccaaagctgattcataccccatgtttgactcctttggaaagtaagtccactttgacttcttcagtttcaggtgcaatctgattcataccccctaaccaaattaccaaatattttgacccatcaactattaaaccagatattttgacccatcatctattaaaaccagtgcaacataactcctttggtggttttaaaggcggttttcattgacgtgtcgaattgacttagtctctgagtctgacttgtcattacaataacaaaaataataaaaatagcatgtggacccatgggtcaggactgtttcctctctatatactccttgtttctcctctttctctatggtcgggacgacgacgatgccaacaagctagagtgggcaaggacggtcggcagtttcgacgagcacagagctaggtgccagcgtggcccgaggcggagtccgagcagctgtgatggctgatgagagggatccgcgacggggcttcacccaagacagagcgacggcctcgaggcacaacgatggtgcgccctcaagacggagcggcggcttacactgatctacagctcattgcccttgaggcgcaatggcagcacgacttgagatggagcggtggcggcacgacctcgagggaagggagctcgtcaatggcatgacctgcagggtggtgagaggttgaggagatggcgtgccggcatcactgacagcgcaatgaagtagctggagaagatgaagaaggaccccatcacccactggatcatagcattcccctccacgaagtccagcgccaccgatgccgctgcaaagcacaccaccaccgacccccttctctccctcgaccatctccgttcgtcgctacaatcccctaagtccgcccatcgctagtcattgccgcaatccactccgcctccatatcgcctcgattccctcagtccgcccatcggccatcgccgctcgctgcctgactggctgttgtgtcgcgtgtttgctagcggtccggcaccggagcgtgtccatggagtcgatggagaacttgtggaggcgagcaaacagtagagggtgtcgatggtgctgctgccccaggggcgtcgtgtggggaaaggagaaaaaggagagaataaagaggacatgacactgacacgtgggatccgcatgctgactcagccattttgactttaggtcaacatgccacgacggcaaaaaccgatctcaaaacagccgagggagtcgaattacactagtttcaatagttggagggttaggatatctggttttgcggttgggtgatacgaattagactggagctataattgagggagttaaagtggacttattcctttctaaacgaggctagaacagtattttcccgagtaaattgactttggttgaggcatgcttggattcggcctgttttggggtgtatcaggtattcgggccaaaccagcgtaaaaatttgtggtttacagcccatccaagcgtgattttgagcccatgtaagaaaagtaataggaataagtccactttgattcccttaaaaagtaacctgaatctaatccgtgaccctcaaccgcaaaaccggatagaacgactccccaaactattgaaactggtgcaatttgactcccttaacggttttggatagtggtttcgctgacgtggtgcttacgtggtagtgttgatctagcctggtcttgatgtggcgcttaggtggcatttaattaaaaacatatatgtgggacccatttgtcataaaaaaagtggggcccactgacatgtcatcctctctctttcttcttcctccccctctttctcccttctctctttctctccccttccaccgtccacggggagcacggctggagcggcggcggggcaggggccgaagtgctggcggccggcgggagctgaagcggcggtgggttggagctaacgcgggtggaggcggaggagaaggaggcggcgacggaggggcttgagtggcggcggcggtggaaaccgccccaagccacatacctctaacgaggcggctgcggctgcggctgcctctgactagcgcgctggattattcctagcctccgtcagctccagcccacttccaccaccgctccagctagctcccgtgtcagctcccaccggccgtcaccactccggctcccgacggcggggaggagcctcgacgacaggaacaggtcagcaacgccgaacctagtcgccttttctgcgcctctcccagcgtctccaggaactcctcacgccaccggaagccgcactcccacatgatggcgcgcagtgtcaagtcggtcagcgtcccggtgatctgcctgctcacgtttagtgccgacagcggcggcgatggtgccaacgagcacacccgccaaagagtatccccaccgtggtgccgatggagtccctcactgtacgctcagccatagaggtcgaagcccctgggccaggcgccagaaggaggccgagctccatcctcgcctttggccatgatggtatgcatgt

SEQ ID NO: 61523 - DNA, 7006 bp, Oryza sativa
gtgggttggccggattgccgggctgggttcgtggactgcatcctcgaagaccgccgccatcacgcatgcggatacgccgaggtcgaggtcgatggcgatggggaagctggcgcccgcccgctgctgccgcgtcagccatcgccgccgccaccactccggctcccgcttgccgtcgccgcccttgcctgcaaattacactacgagagagaaggtgaagagaaaggggggagagaacggggagagagggaaggggaaggagagagtgaatgacatgtaggcccacatgtcagtggggcccacaatattttttatgtgtgaatcacatgtgggtccatagattttttttttaattctaatgccacgtaagcgccacgtgggacgaaaactaggtcaacattgccacgtcagcgcaacatcagcaaaaccacccatcgaaaccaccaagggagtcaaattgcactggtttcaatagtttagggagtcgttctatccggttttacggttgaggatcacatattagattcgagttacttttaatggagtcaaagtggacttattccaaagtaatattacattcatgtaatttgttctaagaaaaaaaatagggttttgaaccaggcccttattctcgacttttcactaatgtatatacccctcacgtgatggaacaagtggcaaggaagataacatcaatccaaactacaactttttctcgtttttcgttaacacgtttcctaaactattaagcagtacattttgtaataaatctattttctagttttgtaatagaataaactaaacgtactgctatatgttactccaatatagagtttcaacccctcttgggttgcaggcttgcagctgcatagcaccgctgttcggttgcaattgttttgaacaatgtttgcttgtaaaaaaaatgctgctgtagaaggcaagtgtttctgattttctggctacctgcagcctcagttgacgcttcagagtacagtacagttacagcactgctacagaacgtgcttccaaacaaacccatttctgctaatgcttttccaacaagcattgcctacatgcatatccacctactaggtacgtagcagctctcatgtcctccatttctttacttcccgaagtagcatatgtagcatccaatgcgacaaacaacactctccaattcaacgggcaagttagcgctgcatgttctagagcatatcatatgctttatactagctcgaactaaaaatgggaagaataaaatcgattttcgagaagccaccttaaaggcttaaacgatgtggtggtaaagttacagttacttcctccgtttcacaatgtaaattattctagcatttttcatattcatagattcattaacatcaatatgaatgtggaaaatgctagaataacttacattgtggaacgaagggagtacatgatttacgattatttagagtctgagtttagatcagctgtacgttggacagaaactttaggtggtacttaaaacgagataagttattagcgtatattcaatcaagtattaaaattagatttatttgatttctaggaaacttttatatataatttttttgtgctaaacatcccatttttcagctcagaaacgtgcccaaggagaatgagtaagtagtcgccgaattaccgactattccctccgcccaaaaaaaaaccaacctactattgaatgggatgtttccagtataacgaatcttgtcaatactagattggtttttttagacgaagggagtagaacttaaccgaaatgggtggtaaacaggatgcactcgttggtgtgtgcctatataagaagtacgcgcgaagtggtggcattatcctcataatcacaaaagaagaagaagaagaaaaaggttcgaagtggagctcgatcagctgctccatgcctttggtcaacccttgtcccatgcatatgctccgttttcgagcgaaatatcaccaactctaccaaaaacgatgaaatccaccagccaaacgtccaaaaaccaagcagtaccattttgcagtactgcacatcacatgctccgatctgcgtcctgaatcaccaaccaccactacaaccggctggcctttttgcctgcttgatgcagaactaaactgccttttttcatcgatctcaatcagccaaccgaactctgcaagccattcaagcgaccaggctaagtacaagaaccgtttccattatatagagagatgattaattaacaaccaagtaatgcttattttgctcggtcggtacgggaagtaacaaccgcttagccgtgttaacctcttttgcgcctgcttgcaaattaaaccaaactaatctctccatttcagattgattatcattcgatttaacattggcagtgtcttataccggttcgttggattttcttttgacaatgtttgctaccatacactcaaattttatgtaatttgctagtagaaatgacaaaaccgtgttacggctgaaaaacacctagtaatttgctgaaggatactttcaattcaattggagagggaaattcttcacaaaaacgagaatgccctagggccaaaagctttcaagctaaggcttagagtgaagatggaatatgatacatactaacgatgtatttaggatgatgataaatttagagttgtataattcccaaattttcactctaacgccatatttgaaggggaccctatttgaagtatgggttctaggggtgttcttatccttcttaagaatttatctctccaattgagttcaaagtgtcctccagcaaattactagttttataatatgtctttctgctgtgacacgtttttcgatgtctactagcaaattacacaaattttaggtatcctatagcaaaatttgtatttttttatgagttcataaaatttaacaacgtgcacattatgtatcatgaaagcatttctcaagatagatataaaaacataggggcaattgtgttcttgcccttgctttgtgatccaattgtgattttgccccctacttttagggttgtttttgcccctactttttataagtgaagcaaccattttgccactggttttgaccgtggttatgtgggactagaatttttgagataaacaaagggaaaggaaaattaaaaaatgattttgcaatttgtcaatgactgttatacccctggtgagtaaatcattaagcagtgtgtgaatcagattgaagccgtgtattcccggaaatgcttaccattggccgtccagccagaaataaaaaatcagatgtctcaatttaaaagaacaacagtgtaggtgcatggtgaaacagttggttaggtgtactgataagccaacggagcatgcatgcaaacatgtttcaaaatttaaatgattttttctcttaaactattagtccgaatttcaatctaattatatcattggattcgttacaattaaatctttataacaagatatcacatgactacattccgatgagttttaattttactttttaaatattgcacacattgttactgaaatgttccaaaaagcatttgttgatgtttcactaatgcattagcaatgtttcatgctgtctttttttatatgtttcagcaaatacattttttatgtttcaacaataattataattcgatgtttcaatctaaatataaaaaatgtttcactggtcgggacttaatgtttcatgtaataatgattattattgccatcaatactttttatatgttgtacctctttggaacaatttgtgaagagggttgaaacatctccacaagtgatgaaagaattatttttaaatagttcaacataagtttgttttttttctagaacacatatatatttttatcaaaatatattcatgtgagatcttgttataaattatagattgggtatatattttagaataaaatttcgtttaaagtttgattaagagagagagagaaagtaatactgcctcaggccaccttggcaaccagctctactcttgcatgcatgcatgcgacaacctcgctcctccaacgcgtccctgcatacatacagacgaggagcagcattcgatatttgaaaaaaaaaaatattgaatgttcgatttgtagcgtcctatttaaaaatatttcaacataattaagtatttgtgcaaaaatctaatggtataattgaaatttagatcagatatataattttggagaaaaatatttacaatttgaggaaaaaattaggcacgtgtaatgggagggagagggagagggagagagagtatgcaagcagcagcgcaagcaacgcatgtagggcaggcaagcaacgcagcacggaagcaacgcgggcatgcggcagtgtgggggcgagcgttgaccaacaagtaaaacattaagttatatatggtgaaacaaagaaaacaacaaccgaaacatttaaatatgtttatgaaacatggtgaatatacacgttgaaacatgttgttgtcacatatgaaataacaagtattgacggattgaaacatatgtttttcttttatcaaaatataatcatgcgatatcttgttgtaaagagttaattacaacgaatacaacggcgtgatcggatcatagattgaataagtaatttaaaagaaaaatcattttgaagcttgctaaaatacatgcatgtatgcatgcatgaggtggagagagagtagtagcagttaatttcaggaattttgtgaaacacaccgaagacacatattgaaacctatctctatcacgtatgaaacatgttattctaacggtttgaaacacatgtttttcttttgacataatataatcatgtgatattttattgtaaagatttaattgcaacgaatataacgatgtgatcggatcgtagatcggataagtaatttaggagaaaaaatatttaaagagaggagaaaagaatgaaaagaaacagctaggcacatacgttataggacagggttcattctcacatgcgcttgtttagacatccgatttttggtgtgatgccggatgtccgagccgtagcgctctccgtgtattccccatctccagtacggcctagcgagtggcggcagcggtgcaacagcagcagcaagaccaggcagccagcagggtgggcgcggcggcggcggcgacgactgcgggtcgacgcggctcaacagcgggccagcacgacggcggcgaccgttggccagcacgcaggaggcgcggcggcaaccgtgggtcggcgcggctctgctgcgggccagcgcggtggcgacaaccgttggccggtgcgcaaggaggtgcggtggcagcgtgaaggagaggcgtggccttggtcaggtggcctgttggcaaccgcgggctagcacggtccggcgcgatggggtgctcaggactgggtgagtacggttggggaagggaaggtgcaaaggggaaggttggcgcaggggctgctgggggccgacggtgcttgaggaggcacagatgcagcagggcgacggtgctagaggagatgcaagggtggctggctggcgctactggactttatggtgtttgctatagctgaaattgtgttgaaattcagtgaaatctccttgaaagtatgttgaaattttgtgaaatgaaatcttgtatatttattgctgaaatcatgttggaatcctgttgaaattttgtgatatttgtcaagctattgctgaaatctagtcattttttttataaatttcaagtatagcaaagttcacttcgaaacatttgtaaagttcagttcaaagctgaactcaaaaaagggcaaatacacaagtgggcacatatttgcataagggtatactcggcgttgtatctccgatctaacaccattagctagttttaacagaacagggggcactctgctccttcatttcaaaaaagcatgggcaaaattacaaaccctaaaaagtaatggcaaaatcacaattgaatcataaagtaagggcaagaacataattaccccaaaaacataagtcttgagatgttaaactacataaacttttaaaaattgatgataaaaaaataagtgcacaactgaaatgacaaatactgtctattccctcgatccccatcaccctaccaaacttcagttcagaaaccattcgagcgatatgatttccgtctcaaacagatcgtgcaactacgacgcatcggtaactaacaagttaaccatttccatcatcgaaaattaattaagtaacgatcaagcaatgctgatttaatttttctctgtactccatgatagaaaaggttgcatttcttttcaccgtgcaattaacatggtgagtgttgctcagtagtcagtattcagtatgaaaggacaagtaggcacgcggcataggctgggcgatgacaaaatgatcgttcatctgccacattgaatagtttgatcgatgattcgacgcaaaatgttgcagattttccgggctgattcagcatttgctaggtgattcgttgttgtcacatagacctcaagaaatttaaactttaatttgtgcatattgttgggggtaaattaattagccaagagtccacacctgcatgtgcacactgagctatattattggaccgagctaacgtgtttcggttcgtacaaattaactagctaggctgcaccactagcttacacagtaaccttctcttttccggaatcgacgggataagataacacggcaaacgccattgtttaagtacggttgttactacccttcagcactatttcactactctgaatatatatttaatttcatctcgtgattaattactgagctaatccgggctggtgattgatgagagggttggtgggaaattaaccaatcaagctagctcgaggggacgttttacctccatctttacttgtaaacatactgtatcgaggttgtagctgcggtttacggccaaaatggaagcatgtactccattttaatctctctctctctctctctaatttattgggtcacttaacccttaaacttgactcattttat

SEQ ID NO: 61524 - DNA, 9746 bp, Oryza sativa
ttcaaaacaaagagcggataatatggtgccgtgggccaatttagtcagattttaggatagatcgcaccctcccaagaaagcccagcgctagtatagaccaaaggttgcaatccaaactatagtgggtttttccgctcaaaaaacgaggtccacctttgtcgttgttgctgcatgctttgacagtatggttagcacggtacttccttcgaaccaaaataaaatatactccctccatccaaaaaaaatcaaattcaacttctaaagtttaaattttatcaaaaaaaaaaacttctatcattctacccacccttagcacgtaaaacgagaatttttttcccttcaataccctttatctacatcactcttactatttttttcaattattaagggtattttagtcattctctatatccactaattccacctcgggatactaggaatgtattttttgtgggacggagggagtacttccttagtcctaaaatataagcgattttggacgaacagacagggaggaaatgtctcatccttctaaaatctcttatattttaggacggagggagtttgacgcaactgccactaagctaaagattaaaaaaatattattatatcaccatgatatacaccacatacactaatggaattagatatgttaagggtggagtattttagaaaaataaacttataggaaaaaaagtattagttaattgcatgtatatatatacgtgtcttgtattataaaacatcggaaaaatggttgcttcttatatttttttatatgggagtactattttctccattttaaaatatactgtactaacctaggatctaaatagaacggaggtagtaattactttgatgcggttcattatgaaatttgtcgcatactcactgactcacacgtgctatttattgatgtgtattccctctgtccaaatatataaaggatattgttctaatattttatctaaatatataaggaattttgggatccctagacaatattttatcttccatccatcaactcatgtgctagtttaaataccactccaacctttacttttacttgtttatttcctcaatgatcaccatcttttgtcaatgatttgacccccttccactttcttaattctttctaaaatagcataatcccttatatatacgtacagagggagtattcattttatccattacggtttctgattctttgctcgccgtaaacggctaaacataaccgggcatataaacaatactgtactaacttcgtcctttaaaaaaaatctagacataatttggccaatcctaatcatcagccaataacacccctatctcgtgttttgtttaatatcaacttattgccctaccaaaattttagtaactttaataatagcaagtgcatatttggtttgttaccaaattttgtccacaatagtttaaattcaacactacccaatttggtagtgctaaaacttaccaatattttggcgctaccaagattttggtagggcaaaaattgacttcaaaccaaacaagcccttacatatcgaagtttattgttccctgctccctgtgcgcacgcatgccatcggcggtcctcggtgtgccggtcacccagacgggtaggccttgtgcaattgtgcaggtaggttacatgccggttggtgcagttgattgtataaaagattgtacacatttgtagtactaaatatcatatattatatttaattttttataaggacagagtaaatactttttttatataaaaaaacttaatagaaaatataaccccttctatatagcaaatctcgataaaaaagattgtctattttaccaggtggggtcatcttttagttcgatttttttttaaaagaagggagtagagttaatccgtcgtagtacagcgcaaattccaagttatcacgtctcattgacctccacgcttgccgaccacactgctccagtgctcagtcaaagcactgcctcactctcacccctctggctattctcaacaggccaatcagaccaaaaaaaaaaaaaaacactgacgtcgatctgatccaaacaacgcgcggaattaattgagcacacacggagaaggagatcggccggctgtttcccggcgcatatccatccacccgaccgcgaccagcggcgtcgtcatcacgtacgcggcgggcgagtggatgtggatttggctgcgctgcggtggtctcgccgaccaatccgtcgagcagcagccgccgttccaaaaaaccggataataagcaagctagcaaagcaagcgctggcggcttggaagggatacttcaccgatggtgtccctatcgcattcttcccacttgtcgcggtttatggtggctcgcgcgcggttttgccgcgctgctcaggtgtcgggtgcagtggattggatccgactctttcaccgggttaattgcagatttgagtcaaaaatgttcacctccactagacaggaaaccacacacccgggtttctgcgtactttttctactgtatatttagagtctcatagtaaataggtaatggtatctcatggcatcttcttaagaatcgtaaaattgcttttatttagctagatttcaactatggttgtgtttagttcacactgaagtttggaaatttggttgaaattagtacgatgtgatagaaaatttgtgtgtatgaaaaggtttgatgtgataaaaagttagaagtttgaaaaaaaaaatttagaactaaacatggcctatgcacaacgggatttttcctgtgtttcaggagtagggagtactgtacttgtgggcatgaattcagtgcgaatttggccctggaaaaaaaatgaatgggaaagaaaggagcagcagtaaatgcggcgagaagacgacacaggatgtgttcggatacgacaaaggggattcattacttcctcgtcgtattgtcagattcgctgtgcttgagccattccagaagcttccaaacactgcgatctcgaagcagagcgtctccgctcgaggtaagcagcttgccttttgcaacgaaacggtttctagaagccacgaacattccaactgtactgaaacaaacaaacacaagctgcgaaaaggcgtgtgtttgttacaaacacacactgtcatttgatcaaaaatttcaaaattgatacactcgtttaaccattttttttcctcgcaaaagttgctgtacaaactcgaactctgctactcacacatatgtgatatgtacatagatggatacacaattatacacggaatttagtttctgtaatacgcttcagatttctagaaggcaggcggcctggacgtgcccggagaactcgggcggcgccggcgcgcgcgcccacgacgcgggcttgccggcctcctcccgcagcgtgtacaccgtctggtcgccgccgtggcagtcggacccgatgaccacgacgcggccgtcggggatgacggaaacggccgccgcggtgcgcgcgtcctccggcaccggcgccacgggccgccacgccgcgggggcggaggagatggcgccgtggcgcgccacgaggtgcccgtcgcggagcatgtacatgcggtctccggcctcgggggcggcgctgcaggttctcgggcacgcgccgtcgtcgacgaagccttcttggacggcggaccaggtggacgtcgccgggtcgaaccactcggcggagccgacgaatcgcccctgcgccggcgtcgggtacccgccgacgaccaggaacttgccgtcgacgcagagcccgcgcggctcgtcgcgctcctccgccatgtcggggagcgcggcccacgcgtcggcgtccgggtcgtacgccagcgccgatcgaagggcgttcttctcctcgtcgtggccaccggcgacgaacaccttcccgccgacggcggcgcacgcgaagaacgaccggcgcgggcccggcatggccgcgccacggcgccacgcgcccgtgaggaagtcatacacgagcaccgagtccgtcggcgcccacgtctccgggtcccagccgccgacgaccaccagccgcttcctcccctccacaccgccatccaccgccgccacctggcagaacagcggcaagctcccactcgctccacccacctccggcagcggcgtccacctcccctccgccgggtccaacagcaccatccggtacgagttccccggcacaccgccggccgacgactgcttgtccgccgccgggcccgcctcggcgagctcacgccgcgcctgcaccagcgcgagcgccgggcgcgccaggccctccgccttcctcaggcggttgtacgccggcgactccacctccgccttccactggcgcgagatgcggcgcaccgccggcagctggtcgaaccccacccggatgaggcactccctcgccacctcctccggcaaccccggaatcagctcgttgtaacccatgatgctcaatcgagctggaattcgagcaagaaatgcgtgagatgatgatgatttcttggcttctcttctcttctcttgtctgagcttggtgtgtttgatgtgttttgtgtaaggcagagtggcgggagtggcatccgctacttatacaaggggaaagaagggaacggactgcggatggagggatggatggattgcgtgatttttttggggggtttatgtgggccccgttgcttgcacggctatggtttatgtttctttcagtttggctttttctagttttttttttgactctgtgacgtgtaaaattgagtagattagctcttttgagactaatctaccagtagatgatatggtttgttttattttgggagactctgtttcgggtaagaatgccacatcggatgcagtatcctttttatgttggccgaggtaaagggatgaggctgtttgtgggaattgcctgtttgtgtggaggtttatctcaaccgtcgtcatgcttagttcaacttcgtttggctaacgaactgcttagtactccactatacgacatggaaactgttgcttcgttctgcaatctgcaccaggaaaacagcaaaaatccttcgtcgggtgttgccaacttcacaggaagtaaaacaagaacgacatgacacgaccattacaattttactagtagtactgtacacgcaaatgcaacaaaagaccgagctgttatagttctacggacacctgtgccaacaaattgggcccacatgacctccaaaaatccgtgcgcttggatttggggattccggattccccttgtcaccctcctcacactttccgccggtcttctacaaacacacgtactagtagcaataagagtagtaaacacgctctgtgcaatcatgtttccatatttcaatttcactactgctactactagtagcacggtttttatttcggttagcactgtctcctctccacgcagtcgcacacgtgtagggctcagcgcaggtatcgcgcgcgtgccgcccgtggagtcgcgccactgaacaggttgatgtgccgcgtcccgtgaagctgtatacgctttgcggcgagccgggtgccgtctctgaacgctacggttttctctcctcctggccacacgtcggagactcggaggctcattattgccgaagagtgtgcacgcgtcacggcgtcaggagcagaagccgccgcggccaagctaaggtcagaccgggttcggcctgcctccatgaacgaacggatcgatcccgcgatcgagcagccgcgcggccgccggccggcgccacacgtcaagtccagcgagccggacggcgcgtgaacgtgcttgctgccgaactagcggcgtcgtgtcaagttcattgctaaacgccgggaccgggaaggattactatagtagtactaggcatcatgaccacaccgagaattgtttgctgtgcctgtgctgtgcacgcagttccgctacaccacgcgcaacgtcgcgccgcccccgggatttttagcgacagcgacgtacgcgagattagactattagagagcgaaagaaaataaacgggaggagaaaaacaacgggtgggtttctccggtgatccggacagccgcctgcctgcatgcctgcctagttgccctcgcagggcccggtagtaacgcaagtggaacggaatcaccgcgcgcgcgttcgcgggtggtgtcgggaagtggtaagccctatccgctaatcccacctcgctcgcgctgccttatctcgtctcgtctcgccacgccagggcccaggggccccccgcgtctcgcgcagccggcctcaccctcgcgattgattctggctggctctcgcgcgcgcgagcggtggggaagggtaaaaaagaaaaatctggaggcgcgcgacgaggcgtcgccgtcgtgggcgggggaggctgtgacgattgacgaacggtggcggagcggtcgctagctagcttgccacgcaatcgcgcgtggtgatgcggcgcgcgcgtcggatcgatcgaatcgaacggcggcggcacagcgcttatgtatccggaattccggatccaccatacggcctgacggtttcgatacggctctcccgctgttttttctcttcgtttttttttatgacgggagtgtgctgggagcctgcgatttctgtctcttgccacgccattaagccacagcaatcttttctaataactcgcgtctttttccgaagtctagcttaagtaagaagcgtattcttagccaacatatggaattatggataacgcttggaagaacagaagccttgctgccgtcaaaccgaaatgggagacgagcttgggttgccaagttgtttctagaatcattgaaccagctagttcgaaataaagaacgagttcactgagtgatattatctggagtccgttggtctcaagtaagacaagctgactgcagagtatgttaaacagagcaagcaatacgaactggcaaacagagtatggctaacccggtggtgttgattagtgcattaaccaatatcaaacattatgggacgtgggtatgctaaaaaatttaaaagacccaaaacagcgatggaatcaaaaaacgaagatgtcgtaaaagacgggctcgcttggtcgattcaatggtcgtcatctccatgaccatccaaccgtgtgattggtttaaggggaactggtgaagagggaatgaaagtttgaggttatgtaggaaccagaggcggctgaacctcagaatgtagtggacggccccgctcgttcgcgggtggtattgagaagtggtaatcctatccgctaatccccccgacctcgcgctgccttatctcgtctcgcctcacgctctcaccaccacgcgcccgtgttggcgcgcgggggaagagaggcgagaaaaagaaaaatctggaggcgcgacgaggcgtcgccgtcgggcggtcgggtggcggagcgcgtggtgatgcggcgcgtcggggtcgatccgctcggcagtgcgcctgccggtttcgttacgactcccgctgtttttctccccttcgttttcccgtttttcgatccgttcctagcagcgtgccgcccctttccgttgaaagccaccgcaaacctgcgtcgttttcggaggattagcttatgttggaagcgtattctttagccaacatatggataggcttggaagaacagaagctagctgctgtcaaagctaaaacaagagagcgtcctaaggtttgccacgttgttcataaaatcgctacagctcaaaataaagaatgagttcggtgagtgacaactgcgaatccgttggtctcaagccaaacaagcggactgcagaagtgcagagtatgtcaaagtcaaacagagcctgtttagttttaaacttttcctttaagctttcaattttttcaccacatcaaaactttcctacacatacaaactttcaacttttccgtcacatcgtttcaattttacctaaacctccaattttagcgtgaactaaacacacggggagtaagaaaaaaaaccgtgaagcagagtatgttaatggcttctacatcggacggcaccaaattcagatttcccaaaaaccgtatagtttcaaaaactaataagaatatcgtacccggtaaacatgattgccataagcgaggtagaacttcatcgtttggcctaataaatcaaaacaaaagccaaaatttaaatttttaaaattaaatttaatacattttcaacttaattcttttaaacattggtttttaagtcgttacgaacaaatatataaaagtttaacctagaaattaacttttattttctaataaactattttgccttattagaaaatatgggtaagtaatgaggctcgtattcgcgtgatattgcaaactctgaccctatgccaatccaaagtaaagaggtgcatcaaactcagaggatttcctttcctcactcttgttttatgaagctctttctactaccacctggaacatttggaaggagaaaaataaacttaaatttaagatattttcaacttaatttttttaagtattggcttttaagtcgctacgaaggtgtaaattgatggaatcgagaaaagaaggtgtctcgattaatggtcgttgtctccttcatccaagcgctctacacacggggcgacgctaatgggcgatcgatccccatcccctatacgctcctctcccccttcctcctccccttcttctcttcctactacaccataatttttttaaaaaaataaaaaatataaagttggaaaaaattatgtatagaaatactataaataaaaaatatttgaatttaaattcaaatttgaaacgggtatgtaaacttttgacttataaactttgggtctataaactaatatttgaattcagattcaaattcaaatttgaatcgggtatgtaaactttgggtctataaattttaggtgtatagaaaaactatatataaaaaaatgtgaattcaaattcaaattaatatttgaattcaaattcaaatttgaatcgggtatataaacttttgacttataaaatttgggtctataaacttgaggtgtataaactttagatgtatagaaatactatatataaaaagtatttgaattcaaattcaaatttgaattgggtatataaacttttgacttataaactttgaatctctaatcattaggtgtataaactttagatgtgtaaacttaaggtgtacaaactttaggtgtataaatttactaaaataggaaagtaatgcggtgtcaaaaaagaaagccagccatatggggaggggtgatcgcccaggtaagggtgggcagaaaaagaccaaaccgaaaaaacggagaccgagaaattcggtcagtacttcggtcttatgtgctagatgaccgaattttattcggttaattcggtcatcaccctcgattaaccgaattgaccgaatttcacagaaagcccaatatcagcccaagaaagcaagtccaacattaataaaaccctagctccctctctgtttccttctcctcatccacccagccgccacacccgagcgctcctcttctttttaacgctctccccacctgagcgctcctcgttttctctcgcacatcggcgtcctgttccgtcgccggtgcctctgcacgactgcagcgtcccagcatctcctcctcctcctcctcctcctcacaagtgacaccacgacgacctcctcttcttgcgtggcttcagtggacacccaggccccaacagccaagcccgagccgcgtggaggctccaccccgggggcacatccgatggtgcctcctccactccgacggcga

SEQ ID NO: 61525 - DNA, 4710 bp, Oryza sativa
tagtatatgatagtgaagaaagctgatctaggatttttatgaattttcttgatgtgtatgatttttttggatctgaaatttattgaggatttgtgcgattcttctgaatatttctaaaatttcggtctaaccgagactgagaccgaattgatcggtcttcaatatttttcaagaccgaacggtcttgcactatagatgaccaaactttcaaaaaagaccaaagacctaaaccgaatttttggtctgaccgaatgcccacccctacgcccagggcgatcgatagcccaacaggaattttgctacacacgaccattcgatcacggcccgcagccgaagtggtagaaccagcgtcccgcggcgccgctggtgggttgagccgttgagcgccattcggccgcatgatgggcaaatggtccggttaagctttggagtccatcgtaaacagccaagattggatcgctaccaatgggcttacgcgtcgtaggaggctcatgggctgaacaaacccgcgccgagaaaatgagtcggatataaagcccaaacattccgtgagatggtaagtttcggcatgtttaggcatcccaggtactacaagtttgctgtgaaaatcatacatttaactcaacctcagcagctaatggctcaagaactgatgccaccttacccatgtccacgccttccagtgttgctggcttccactttggtttctacagatctatctatatctctattgctggctttgtctgccagaatcagaaaatttaatctttttcaactagcccaatttctagtagaaaaagaaatttggctatacattcaagagcattctactgattcttttttcaaattccagacacacatagccactccgtcacaatttcggcgtcgcaatgcttttcacaataacttgtgtcattttctgaagtttagcttaggtaggagccattatcttagccaacttatggataatgcttggagtaacagaagcttagctgcagtacttttgcacaaacgcctcatctactgtgaaacaactttgttggtctcgaaccgggaaggaggctccattgctgctctcaaggcaggcaaaatttgtactgtgcaaaccagctttgtctatcttcctcagaagcagctgaagcctgaagatgaacaaaaaattcttggttacgcagcacaaagggaaggagctggcatcgaacaggcgcttgcttgttggcttgctgtggcatcgggtgcccagacatggaccatctcgaacgaagcgaacagatgccgatgccggcatcccgtgcagtgccaggggggcttgtctttcatcagagtaaaggtgcagagcagaatggaatcaaaacgaaagcttaagcttgtgctttgccactactattctctgcgcattgtcgtctctttcgttcctgcacattcttggagattggtggcagccggggatcgtggacgatcgaagcagtgacattctgcgctctccggccgctcaatcgccggcgccgggggggagatcgagcgatggagtcggtggccgtgaacgcggcgcggcgggtggtcagcaaggcgctgagcccgctgtccggagggttcgtggaggcgtgggtggccagcaaggagctcggccccaacgtcggcgccgtcaagatggagctgctgtacgcgcaggggatgctcgacaacgcccgtggcaccggcggcagggaggcccgcagccccgcgctgaggcagctgctcctggagctgcgtggcctcgcccacgacgcgtcgacgccgaggacgtgctcgacgagctcgactacttccgcatccaggacgagctcgacggcacctgcgaggccgccgacgagcacgccaagggctgcgtcgtccacaacctcttcctcaacactcgccatacagccctcagcgtcgcgagcaacctagtgctcctcccgtgcgctggtgatgatcaccctgacgctgacggtcggcggtcgggagaagacaagaaccgtcagatcggctcctcgtgtgctggtggtggtcaagtgatgaaccgtcagatcggctcgtcgccgtcgcgcactctccacgccgccgccgacgaggaggctgttgccagcaactgctgcatgcacaagctctctcccagtgctcgcggcaacacccatcacatcggtaaacactttccatgcctctcttttgcaccttaacatgacggtacggtggtgataactctagagtacaattcaattctaatttatacttccagtatgacgacctaacggtgtagattgattccttttccctatttaatgagtaaaactttttaaaacatttttttttgaaaaaaaaggcaaatatgtctctctgggtaaacaaccagattatagtgaagaaataagtagtgtggctctatcctttcccgctgatcggagttgcgtttagccgccatagtaaacctagctgcagtttttgttttgtttttttctctcttccccccttggcataagcctatatagctgattgcattgtgtaataagaactcttttccttctaatatattgacgtgcaatctttttgcgcgttcgtgaaaaaaaaatagtgaagaaataaagaacacaccctgctaaacagcccttgctcttgaccatatatacatcagctcgtcgccgtgtctagcaatgagccgtgaggctcggccaaaaggacgagcgcacggcgagcctgccagaccgccgcgaacgccaacctcttggccgggctcagccacctcgctgctcgtcaaatcgctctagcaacgttcttccctagtgcacgatgagatccagtactaaatactcctcccaattggattaaatataaactataaattgctgtaaaatccatctctaattttctaccaaattcctaacatgcccttctatatactgctaggatattgtactgtacaagttttctaactctagcgtcatgtgcacatgcaggaagccagttcctccgctgcacctgttcctgcggcagggtattgcagagggaggatacgatgaaaacaccaaagctgaagttcgatagggtggatctgtcccaaagaatgaagcgcattgtcgaacagctgaagccattgtgtgccaaagtctctaccatactcaatctagagttgttggaatcaaatcgcagcattggccagtacattgccatgagtctcaatgccgagttttccaagaaaccagggcatgcacctgttcttccaagcggttttgctatcagtcggcctatgaccacttcagagtttacagatcctacagtttatgggagaatggatgaaaaaaaatacaactattaaaaacattactcatggtgattactgtgacaaggacctgaccatcattccaattgttggtccaggggggatagggaagacaactctcgcacagtatatatacaaagaagtacataactactttgatgttaccgtctgggtttgtgtaactcccaatttcaatgtgtatagattgaaagaagacattgccaagtcgatccctcaactcaaagatgagaaaaacagtggtccgcatgatttgattgtgcaaagcttgggatcaaagtttttacttgtcttggatgatatgtggaattgtggccacgaggatgaatggaaatatctattagcatctctcaaaaaaggacaaaccaagggaaacataattctagtcaccactcattttctagcagtggtagaaatggttaaaacaattgatagtccaatacaactaaaagggcttgatcctcaagagttttgggaattattcaaagcatctgtgtttggtgatgagaaatcagcaaatgatcatgctaatttacttgagactggaaaaatgatatcaaaaaaatctgaagggttcccctttggcagcgaaaacagttgggaggttactgaaaaatcaccttgatttggaacattggacaagtgtcctggaaagtaaagaatgggaattacaaaccggtgagaatgatattatgccagcattaaagcttagctacgattatctcccttttcatctgcaacaatgttttacatattgtgctatgttccctgaagaccataaatttgctagtgatgagataattcacttatggataggactagacatcctacattcacaggatcaaaacaagaaaattgaagacattggattgagccgattgaatgatttggttagctatggattttttgaaaaacatgtagaagatgggtcttcatactacgttatgcatgacctactacatgagttagcattgaaggtttcatcgtatgaatgtcttaccatatgtagttcaaatgtcaaatctatacaaattctaccatctataagacacttatctattgtggttgatgacatggacgtaaatgatagagtgacttttgaaaacatcaagaaggatttcatcacattaagtaagagactagatgttggaaaactgcactcattgatgctatttggacaataccatggaagctttatcacccctttcagtgatttgttaagaaaagcacgtgcactccgcatagtcttgttgtctatgccatcttatgctatagtcagtatgttgcataacttttcaaaacttgtccatctacgctacttaaggatcaatggaggaaaattttcagaattaagtctacccaacatcatatcaagattttaacacttgaggaaaatt

SEQ ID NO: 61526 - DNA, 16755 bp, Oryza sativa
gaggaggaaaaaaaaaacaaaaacaaggtccttaagacgcttggaaataagcagtaggatgcgatgtttcatcagcctctcttatacttgctctagcttaatttctcgcgatcagcaaaaggaaggaggtcaacgaaaaataatgtgcgttagcaatatatagcctgtaggctatagctagcttaactggagcttgaattattatttttttcttaatattgcatgagtacaccagtgtcggttggtgtttgagatcttcagttttgccggtcacctgcctccctgcaattatagaagattgtacggacggcttggcgtttgttgcaagaaagtgagcagaacgttgtaataaaagtccagtgatagatatatagtatgtttatgctgataagctgattgccgagagagattttactccagacactcatacaattatgaagctgatgtgaactactaacttccaaataatagttgttgtaggaagaccttccatatatttatatatatggtacgtagagagaagtaagtgaagtatgtataaataaatgaacgaaagctgcatgaaaattgcaaaagcaggtgtatccgtgtagtacactactccattcatttcatattataaatcattttaacttttttctttaaccaaatttatagaaaaacatagtagtatttttaacacaaaataagtaaactattaaaatatatttaatgtgagatttaatgaaacaaatttagttttttagatgctgctaaagttttctataaacctagtcaaacatttaaaaaaattaaccagaaaaaggttaaaattaatgatttataatataaaacggtgtaagggttatctatatggattagtataattattactcctattcaacgatgagttagtgtatgcgtactgcctgtgcaatgccaaactactgccactattttggtactatatgctgggtccgcatcatggatcgagccgtacacaatccaagtatctacgtacgtgcatcatgcatggctgtgtatgtgactagacccagtgtcagtggcagagttagaaattatcttaagtatatgacttgacagtagtaatatactacctccatcccaaaatatgtagctgtggatatccatacccaacgtttgaccgtccgtcctatttaaaaaaattgtgaaaaaattaaaaatatttagtcacacataaagtactattcatgttttatcatctaatagcaataaaaatactaatcataaaatttttttcaaataagacgaacgatcaaacgttgaacgtaaatagtgtaaaactacacttattttaggacgaagggagtatttcaacacagatatcagatatgaggagtgtcactctctcgtacgtgtacttgcaggttgattgtcacctttcacactttaaccgaatcatcacaaaaaggaagatgatcgaattggtcgagcacaaaatttatttcgaagtgaattgtactttggatcagtttttattacttaaatcgcatattgggctaggcattcacaattcttttcgttttattgtatcttgtccttggcctcgaacaagatgcattttgtcgcttaccatcgttgttttcctcctcctcactggtggtgatattctaaggcggtcgcggtgagtccatgcatcatgacgggagagttggagtggaggtgaggaggcgtagtgagtgagagccagagcggtaacgaggaactccaattgccccctttttattagaagaaaggtggcgtgggaggtgagccacagtaatagaggacgtcactggtgtctggtgtcgacggttggtcttatgataggaggtttgtctccaagggaaaactcatgtagtggatgtagctagccacttgaaatagtggcgtgaattgaagaaacctaacgggcatctcacacagacacatatttaggacccatttaaatcgtaggactgataagaatacaagtgtaaaataaaggattgcaaaagcacaggaaaaacataggaatgaccgtttgattggaccgcatgaaaaacgtaggaaccagatgagagagatacactcaagggaatttttccaagaggttagagtggatgttaaattttctacttttttcctctaaaatcataggaataggaaagtttcctacgtttttccttttctcatttctacgaatcaaaggcatgaatagtatagaatttccattcctttgtttttcctccatttatcctccaattcaaagggggccttaagagtgcgtccatgaaaagaaaaatgtaagacatagataaattagtatacgtaatcctccacaaacaaccataaatacagtggcatatgggtagataatttttcacggccaatgattaatagtaccagtactgtaccacgcatgtcacaaagcacggtaaaaactgaggtggtttacatctctcgctcgctcacttactctcaaaccagaggtcgatattaggtagctcccagctacctattgtcgtactactacttttttcctatgaaaaaaaaaatacataccacaatagatatacacgaacaaattaatattcagtgacaatattgtacgtgactaataatgttattgggggcggccatggtatattagacgagatcctccctcatcctggcggcgaagtcgtcggcgtgctccttggtgacgcagctcgccagcagccgcgtgccggcgagcggcgccggcgcccgcatgacgatcaccgacgagatgaggtcgcagttcaccagcggccccgccgccgacggcgcgccgtacccgtagtcgacgtcgttgaacccgagcttgctccagtccgacacgtacacggactcgtagtcgaacgtcatctggaacgggtcggcgccgccggtgcgcccctccgcccagcgcaggcactcgccggccatccgccgcttcgcctcccggaccacgccgacgagctcgatcaccgacgacgccgccacctcccccgccgccgcggacaccttcaccgggaagatggcgttgccccagtagccggtctccaggccgagcacctggcgggcgctggcgaagaagcagagcttgacggccgcggcggggtcggcggcgatggcgcgcgtccggcactgccagagcttggcgatgacgatgtcgaaggcggagcagatcttgctggcgccggcggtggcggcgtactgcgccttgagcttgccgaggtaggcggcggggaagtcgaaggcgatgtactggagcggcagcacggggagctccggcagcgggccgggcttgatgtccgggtccgggaagcggtcgcgcgcccagatcggcttcacccgcggctccgggaggccgcgggcgaggtcgccgacggcgttcatgaactgggcggcgccggtgccgtccgccaccgcgtggttggtgcgcagcccgatcacgaagccgccgcaggtgaacgtcgtcacctgcaaatcacgtgacctccaactaattaatcaactgactgatgagtccgcgtcatttttttgctttgtttttggttctgtacccaggttttgacctcgacattttttctgcaagctacactggttttcaggagtactccagtacatagtataggtatgagaataaaacatcaattcaaattcgtggcaaaggagacgaaaaaggtatttttaatctagctaggtgttgcaatcacgttggtactagagtcgtagatgcagttaactcctgtactaatcaagtgcagtacactcacaatgcacaacaggagctagcagtagtattaatttaattttcttttcacgaaattaagtttgacgtgcatgtttgattgatagattcaaactgccgcatgcttgttgccatatcaatttcaaggacacatgaaaaacataacgagatccaacagtgcaaagcaaaatctagaaagccaaaaagaaaaaagaaaaaaaaagcaagcaggaataatgcagtattaattcacgtatgtacctggatcatggcgaggctgttgtgcggctcgacgggccactgctccggcgtcgggcacggcacgaggtcctccttggacagcagcagcggccgctccaggtggttgacgtcggcgagggtgcagttggcggcggcctccacgaagtagacgccctcgccggagcacagcacggcaggccgccccggcgaccgctcgtcctccacgatccgccccgcgaacgggtagtagtgcaccagcgcgtccgccagcgcgccgcgcaccaccgccgccgccggcttattattcttcttctttccctcgacgatgacgccgccgtcggcgcacggcgcctcgacggcggcgtcgtcgcggcggaggtagatgtgcacggactcgacgaggccgcggtgcgtcgggtagcggtcgacccaggcgagcggcagcgtctccgacggcgtcgctgcggacggccggacggggccctcggacaccttggtgacggcgaagacgcccatggatgcaagctagctgctgctgctgctgctgctgctgcaaatcaagcaaagctagagctaactgtgtgcgtgtggtgggtgacacggcatgccttgctgggtatttatagaagcagattagcttcgctacttagctaggagtacacttttttttttgttctccatgtcttttctgaactttttcttcagaggtttgaaaagaaaaataaggcagggaggtagtgtggttgtgttgacttaattaagcacgtttaacctgctttgtttagctgcgctatggtgcactgatcactgaccaggctgacttaatttgatttgttttaattctatcgttgcgtaataacgtcatttgatttgttttaattctatcgttgcgtcataacgtcatttattaatcggaattgctacaaaacttgcgacagtttaatttaattttgcagcccggttcacactgttaaattcggtttacatgggcgtcgtcgtgcggttagaccgagaacgcactaacttgtacattttgccggtgtagtcgtgtagaagtgatatatctccatataatcttgcttaaatcatgcatgatgctatattagctctgctagtcaccccaccaaatcatattttgcatggactattgttatacttcttggagtactttcagtgtactgttcttaatttaataatttttttttaaataatggaaatgtgttacatctccggcctctgcccgtaagcacacagccaaaaaaattcagacgtgaacagaaaagttaaaaaaggcgagatgggacaaaccctcaacttctgccgatgatatgatctactaaaataataatttttttcaaaatcacgtagattctatcacgaaattctgtaggtactacgccatccaaaatgaaataaaagttccttggctactatttccaagcgtgtagcaccattgcgcatagtatcctgttgttcctgtgaaagcatcatacaccaagagtggagccaattggaacacatgaagataacctgcatgatgttaggcatttttttatggttaaaaactatatcattacggcaacgccaaattgaccaacataaagcactagctccaaataaaatcattttttttgtgggtctaggcactccccttagctagtcaccaaatatatcttttgcattgtggggaggggggatgttgaaggcaaagaagacacatcgccaagcaaaacgtacaacatgacagtcaaagaaaagatgttggatggtctcttgtgtattacaaaaacaacattgcttgtttcccctccaatttctctttatgagattatcttttgtcaagattacttttttgtgaagaaaccacataaatactttgatttttagtggtacctttacctcccataagatcctcttgtggattcttacattggaattgatgatcgcattatacatggatttgaccgaaaaatggccatttttatgtagcgaccaaataaagcaatccttttcatttgacagggttatgttagctagttgagagatcagatcgttccactcaactaactttggtcctacaattgatcgtcggaatgaaacattcaacggtgttgtgctcataacctctgccaaagtagaatgtctttttcggaccacattgtacagagaaggatattgatatttgagaggttgtaagcccaaccatgtatcttcccaaaatcttatttccatcccattaccaggtttaaaagatccatactgaaaaaattgatcttttactttcattaggccagcccaaaattgggatgttcctggtttgtgtgacatgtgggagaggggtttaccctttaagtacttgttgcgcaaaaggttttgccataggccatcaccattaagaagcttgaatagccatttgctcaacaaacatctattcatgatatcaagatttaggacacccagtccaccttgatcttttggccggcatatataatcccattttgttaacttatatttctttttctggctatcactgctccagaaaaagctcgatcggtagtaatctagtctttgaagtacacctcgaggtatttcaaaaaaggataacatgaacatgggaagactcgaaagaaccaagttaagaagaaccaatctcccaccataggagctgtttttgcccttccatgcgctaagttttctttgaaacctatcctccacacatttccaatcaaaatttctgagttttcgatagtgtatggggattcctaagtatttgaatggaaaggaaccagaattacaaccaaacagttgtctatattggtcctccatttccttggctcccccaaagcagaaaatttcacttttatgaaagtttattttcagccccgagagatgttcaaacacacaaagaatggccttcatgttttttgcttgttcaaaatcatgttcaagaaatattattgtatcgtcggcatattggagaatggacaaaccatcatccactaagtgtggaattacccctctaatttggccatcgactttgactttttcaataagaatggctaacatatcagccactatgttaaaaagaattggggacattggatccccttgtctcaagcctttgcgtgtccggaaattttttcctacattatcattgactttgacacttacagttcctccttccacccagttggaaatccaattgcaccacgattgtgaaaaccctttcattcgtaatgtctgctgaaggaactgccatttaactttgtcataagccttttcaaagtcaattttgaatatgataccatccattttctttgtgtgtaactcatggacagtctcatgcaaaatcaccaccccttccatgatatttctatctggcaaaaacgctgtttgggttgggcgaatgactttgtgagcaaccgttgtaatcctattggtgtccacttttgtaaaaattttaaagctgacattcagtaggcaaataggcctatattgttgaatttgatttgcatcagccttttttggcaatagcgcgatgatcccaaagtttaggttataaagggataatgtccctttatgaaattctctaaatagagccatgagatcattcttaacaatctcccaaaagacctgataaaactctgcaggaaagccatctggacctagggaggagttatgatccatttgaaaaattgcctctttgacttccttttctgaaaattcagcagtaaggatgtcattttccaagtcggacacttgaggaatatcatcagtccatccctctatcatggatacatgattatgatctggaggaccaaataatcctttataataattggtgatgtattctttgagattcccctcacccgttattatagtgtcctcttgttccaactggaaaatcatctgcttacgatgtttaccattgtctatcaagtgataatatttagtattactatccccttggagtaaatgatttgtcttagatcgctggtaccaatacaactcttcgtcccttaacagttttgccaaatcatttttgacctgcttcaacgaagagttaatgtgtttggcttttttgtctagtgtgttaattaaaactaaaagcttattttttgttttttatatgtgccacttaaacttcgcgcccaccctcttaaatgttgcctaaggtggacaatcttgtgtttccaacgttccataggattccttcccttgtttatgctttgccactctttggctaccatctcaaagaatccatcccgctctagccagcctaattcaaaacgaaatggcggctgattgccaaaatgtgcatgcgatccggatctcagtataattggagagtggtctgaaatggctcgaggtaaggcttgacacgtaactaaaggatatttttgctcccagtcagtgttcattaacactctatccaacttctcataagttgtattttcgaggttcttggcccaggtgaattgtctccccgaaagataatctctctcaaattgagactattgatgaccgcattaaaaagaaaaggccaacgagggtcaaaagaattattattcttttcttcgggtgatctaatgatattaaagtccccccctaccaatagagggtatgactccttaccacaagtctgagctagttccgtcaaaaattattcttttaactcgggttgagcagcaccatatactgccattaaaacccatttgaaaccatcctctttatttcttcgaagaaacttcacatagaagtccccttctgaaatttcacctatatcaaaaacatttaaatttactcctaaaagtattcctcctgatcgcccgataggaggtttctcatgccaaagaaaatcttttccaccacaaaggtttttaagatttaaaggggtgaatgatggttttctagtctcaagaatggcaataaaatccaaattttgctccttaacatattcagatataaatctaaatttagatgcatcaccaaagccacaactattccaaaatattcctttcatttcttaaacttattagctttcttttttggaccagtcaaaagaggacataccactttatgtttgactttggtcgaaatcttcctcatttgaggtatggcctgagaatccatagactcatcgtcattactctcagcctcttctagccagtcactacataagtgctggagagaagacaattttaacaattcatcattgcttttatctacattactagtagacgctacagcactactataaagagtagcaaatctatccacttctgaaattttaatctggttaatggactcctttatttctaaatcattctttcctagagaaacccctaatttagaaaaatttgcagcaagagtcttatctggaattgaagcaacagaatttgtggtattaaacttgttacctgttagcgtctcgaggttatgaacctttttaagcagctctgcccggtttgccaccggcgcatctgcatttgccatcgccttctgtctttcactttgcctagttggaatagggtccactgggcgacgaggtcgccttcttgtcggggatcgagctccaactgcctgtgctgcatcctgggctttagatgtggcagcactggaggcactaagttggtcttcattggttgctagtactgccatcaagttcttagtcgatgttactcttccatcgcctgcaagctggctattcttggggagcaattcagactgcacgttgcagtccaatacatgctccacgggagacaagaagctagctgaaacatgctgtaattcttgtgccatgctgacaggttcttgttgttgctctttgccattcgtaaccacctcatctgttcctgctagctgcacagcaacctcagtagaaagtaccttagtcgttgccaacttcgctagctgtgtcgaaacctcgtcggagtacaccacctcaccgacagcctccttggttgactcggagtttcctgtcccttgggctcccaattgactcatgggcgtttccaacaccacggaggagtatgaggcaaacgcttccaactccgttgttgtagcaggcgtatctgagctaggagacggtgaaaatgcttcattatctagaaccatattattggtgcgcgttgagggcagcttagctggcgctaagcctcctatttccatccttagcgacccatcagaaccattcttttggcgttttgggtccctatcttccatgtgaacatcatgatcaccaccattttttctttctccgtcctggtcaatatcatcaatcttcttctttcctttcccatccacctcaggcaattccggttcaaagaagatttcatagccatggtttcggacaacaacgtaaacactaggtggtaaatctgctaactcatcaactgccacctgcatcctaaccacaccatttttcctgagataaatcatgtccacagttgttgtttgaccaatgacagaaccaacagcatgtagactgagaaagtctctaatctcatatgacactccataaactttaaaccaagttttctttagaacaaacttcgcttcaatctcttgctcccacttgtcaatgactaggttcacattaaagtcaaaactaggaacactgccaaccctacgcaacctgtctaattcgatcacagagggaaattgaaccatataagtgtctggagcagtctccttaacatcccattggaacctaaccggcaccaaccttcgcaattcaatgatcaagttgtccacagaaatgtggccattctccacccggataattgctgttttgttgtgttccctgggtttcactgcccctgttgttggcgtggggatcatgaaaaagcctccaccatcaactccccatccacacatgcttgctgtgggtttgggagcgagtaaaagcgggcatgaaagtgcagtatgttcaggtgcttcacaaatatcacacaaaatctttgtgcactctgaaacagcatggctcttctccttgcatctgaaacaacgcccttttgacgcctttgaagaagtgccagcctctgcagtcactatgtcaaccctagactctcctcttggaacatcagtacctgatgctgttgctgcattcagattcacagcgaactgaccatccggacctctgttactgtctccgccacggccttgatgaccacggccggaagcaccaccactgccattcccggtagccgctccagacaaagccgtgttcccgggatgtcaacctctgccgcgaggccgccacggtcctctcccccgcggccgcccagcgccaccttctcccctgcctggattgaacacgccgccacggccgtcaccatcctggccatcgccgccgctgccggtaccacggccgccgccatatcgtcctccaccaccagccatctcacccgctcgcaccacttccgcaaaagatcgcttggggttgattggtcgacgctgtttacgagctagggcaagcagcgcctttggttgtcgcttgtagaggccatcgccagggcccttagactggagcccattaggcggctgggcccgcatgtttggtgtgatgcatggcccattcttttgctaatgttgtgccggtcttggagacttcgtttgacccctcgtttgaagaggaagcgctgatctcggctgctctgatccgctcggccgccgcggccggcgcaaaggacggtgcgacgccttggaaatcaggtcgccgattgtcaccggcggcgaacgtcgacgcggaggaagggcacccgtccacggagtctttccattttccgtcttacttgggctagttgatgcatgatggtgaacgccggacgacaacgcatccaaatgttgctgccgcccttgtcttgaacgtctggtcaccgtcgtccacccttcttcaagacctgcacccataggaaaactcatcttgtggttagggacggatggttgtaaatgaagcatctcatcctcagactcatcgtcgtcgatggaggcaacgtcagagatagcccagaatcggccgcaaacgccgccgcctcgcgctttgccagtaggtgtgccggttacagcttgcgtcgagccgacgatcgggcttgcacccgttgtcagcgtcacggagggatccaccgcgatcgcctcacaaacgcctaaccgctaaacccggaacaccctcacaacaaccctttgcagactgcttaggcaaataattttaatttagaatttagtagttgtgaaattttgaaattaccaactacatgctcggtatatagactcttgagaggctgcattcgtttgcacctgattaggaaaagaaatatctcgttctccacgtgtacactttcataactgctaagtgttgtgttatttacaaaaaatatctataggaaagttatttagatttaaataaggaaaaagtatgaattaccccccctaactatcacggtcgtccgaattacccccctaaccacaaaaccggactttcttcacccccaactatgcaaaccggacgaattacccccctcgacctaatccgcggtggttttggtttacgtggcagtagagtcagcaatttatttattaaaaaaataggtgggccccacctgtcagtttctatctctctctcctatctcatctctcactgtctcactctctctccctcttctccttcggacggcgacggccgaggcagcaagcgcggtggagtcagcagcggcgaggcgaggcaaggcggcggcggcggtggagagcagcgggggcagaggagaggcgagcgcgacggggacggcggagaggcgagcgcggcgggggcgaaggaggcgaggcggcggagaggcgagcgtggctggggcggagaaggcgaggcagggcgggcgtggtgggggtggcggaggaggcgaggcagcagagtggcgagcgtggtggcgaggcgagaggcaggggcgaaggacgctaggcggcggcggtgaggcaggggccgcggaggaggcgagcggcggcggggtgcggcgaaggaggcgagcgcgtcctcccattcgcggacgcgggtcaacgggccggtcgtcggcggtggcagcagcgggaggaggtaggcgttcacggcgaatccccgcgacgttgtccccccgccaaccgcctcgctgccgcgctttgctgccctccgcagtgacaggggggcacgggcgccgtcatgcccgccggccaccggccgcctctccaccacgcccgccacgcccgccgcctgtcccgggcccaccactccccgccgtgccacccgccgcgcccgccgcctgtcccaggtccaccactccctgccgccgtgctcaccgcccgtccacgcgccgctgccgccgcccactgcccttcgacacgtgcctgagagagagaaggggggagggggaagactgaagagaggtaatgacaggtgggccctatattttcttttgtttgttttgttgattggatttccatgtcgacgccacgtgtataccacgtaggagcaaaaccgcttagtattgagtgtgtgtgtgtggggggggggtaattcatccggtatcaatagtttgaggtgtaatatatccggttctgtggttcgaggggtaatttgtactgtcgcaatagttgggggagtaaaacataccttttcctttaaataattaacattcaattagtcatacaagcacgtatatataaaagacgtgttatacacgcactgaacactggcgatacacgcgaggcgatcgaccagccaaagtatacacaggcatggaaacgtgcgggccgtacgatcacccagctggtacttgaaagattgtacgtgtgcatgggcatatgcatatacgctggtggtcgatctaccgatgcacacgtgaacgtgcatggccatgctgctctgaccagcacggattggcatggattcatagaggaacaggtgtcaggctggttcgctggtgcatacgcttgtgtgaggcgatatgcatatatgccctttatgccaaaatataaaaaatattaggtgaatgtaacaaaactataaatttagacagactttcatataaattcgtatacgtagtattatgatgtgtcacatacacttaaaatcttttatattttagtacggagcgagtaatatacatgcatgcatggaacggttgcatgcacatgagagctagaaaattgctggatggatcacacactaccacagaacacgtgaaaagtggcggttgggaaaccccataggtgttggtttttccaaccggcaccatgaagatagcactgatgagtgctccggcactaatcccgttttaagaaccggcacctttgagattactcgcgagccaaaaaaagactcgagtatcgagctcattcatcccacatcacagaactcccaaatcaatcacaacccccaatccccaatcaaacaacatcacagaacaagaaacattgaagaacatcacagaaatctttcactaacattgaagaacatcaaaaaatcattcactaacattcacagaaatcattcactaacaggaagtgcgccgccactgccactcgttccgctgccaggccgccaccacctcccctcccgccgcttgccctccatccaaatccgacggagggagggcgccaccgtcggacagccactgcctttcatcccgccgccgggccaccactgcctctcgccagcaggtctccactgcctcccctcccgccgcctgccctccctctagatctaacagagggaaggcgccgttgctgggccgccaccacctcccgccgcatccccctcccttccaccgccgcatgccacctcccgccgttgccgccgctaggccgcccctccccggatctggcggaggggaggacgcgccgccgctgccgccttcgccggccatgggcagcgagagagagaggacaacgagagagaagggaggcagagagttgagagatgagggagagagagatgcaagatggctctggaagtctgtggatggattgaaccttatctcctcgtgatgccttatttcgtcattcgtggtggggcccactggctcggcttaagtcagaagtgtatttttttttaaaaaaaacacctataatatgttataggtgtcggtttttaacattaaaggttatgtttttttttttaaaaaatggcacctataaaataggtatcggttattatttagaactagcacctataattgcttaaaggggccaattttttaggatttcaacatgcgaaagtggaaaaaagcctacaggtgtctttttagcacttacagcgcatatagtgctgacacctatttgatattttgtagtattgacagtggccttcctacatttaatttcttggggtgaacgcgaaaattaaacccatataggctattcaattattaactatattaattaatatattaaataataagtatgtattatatcctcgataattttttttatgtgtgttcgccgccgcgtttcggagctggattatgagtgaggaatctctcaggtaaactcacaaatttgcataattaagtatccaactacaagacctttctcacgggcatcagcttctatctcatccggcctccataataaaattatgagtgaggaatctctcaggtaaactcacaaatttgcataattaagtacgttcccctgacattaggattatatatatacatcgtatactacttgtgagaataattagcatgccatattgctagctactacgcgtacgcgtatacaaagacgtacaggattcacatttctgacattctgaacgtgatacaccatgcaaatatagatgaatcctacctaacatacttggatagccatcaccaaccgtacgtgtgctgccgaacccacccaaattaaccaatttggacgagtatagtgtccagtggtaggtgacgtcctgacgggatggatcaaccacacgtacgtaaattaacctcggacgtggccggacatttacaaggcttagtaggtatatatatacttaaaagctcgaaaacgatcgagtttgggaaaggccacagatcaaggacagtatatatatatgaaccaagatatacaatcaaacagttaatagaaggctcgttcgtttgtgtttttgagaaaattctttaattacttgctcctgagtttttcttcatccttatgtaccgctaaattttgtctcaattctctacatgttttttaagtttttgttctatgtccattccgttacggttttgctagctagctgtcgacagttttggagccagaaacattcgattttatggccgttcgatctggcgccatgattcgtgtgagatttttttctattggatccaaacctgatgaccaatagatgtgctacccgttggcgtgtatagctgcatgttgcctttttccagaaatttcttggaggcgaggtggcctaggcggaggcggagaccccgccagatgcagctctcggcgattttttttgctgccggccggtgggtttctcgctgcccacttcctcgccgatttttccccttcagctgctcgtgttcctcgctgtcgcagcgatcttctctgcctcacgctctctactcaaaatttcatgtgattttttcactttttggtgcgttcatgtgatattttgtgttcagatcctgcatcatgtttgccctataaatcctttgtatgtttggttggtgttcttctcctagatttctaggggaaacgattcgttgattttcgcacgcatgtattgttgttcatcttgaggatggaggcgtcaatgtttt

SEQ ID NO: 61527 - DNA, 3500 bp, Oryza sativa
tattagtcgaaataacatgtaagatggctacactttgtataattttcatctatgatcgactattaaaaaagaaagctataaacaattaaaatgttgtggtttataacaatttaaatcatatatggattgatcaatcaaaagcaaaacttacgtgatgtggctagatgagagaaggaaaaaaaaaaagaaagtaacatagattaatcatcaaagacaaaactaaggtggtatgactttataagagaagaaaaggagggaaattatttggaccacatatcaattatcaaagggctagaaataatcgaggtgatgtgtcttaataagagaggagagaaataatatttactaaacttggtggagatgaactctatagatatatatttactaaacgtatagctaaatttccttttcaatttgtagaatccaaagtggaagccagcaactctggaagacgtggacaagggtgaggtggaatcagtttttgaaccattagctgctgaggctgagttaaatgtatgatcttcacagcaaacatgtaatattattggtaccggaataccctcttcaatttccctgttatgttgcaataagaaataacaaggataaaaatgatgattattgagccaataaataatatcatgattacagtatttgtgacttactgaagtactagcaatgtattgtcatttttgttaggagtaagtctattttgccttcctcatctcttgccggtcaaattgtatccctcaccagcaaattgtatccctcaaccacaaagctaggtataacgtatctctttactttaaaaaccgatacaaatcgatttcttcggtggttcggaagctgacctccacgcgaacaggagtattatttgatgtcgagcatcttcttgcaccgacggtgggagaagtgcaactggcggtggaggcgacgtggagtagagaggaaaggggaaatcttctgttttccctctcacgtgcgtgacagggcggtcaggatgaaattgtgaatgcagttgggggcaccgtattccagcttttccctacttttaatatctattgtatactagcaaaagtgctcgtgcgttgcaacggaaaatgtacagaccaaaaaattgaggaaaagttaagaaaaatttacattatgtaattaattaaaatacaaatttgctgaaatatttggtatttttaagtaggtaggtgtataattaaatcaatttacaagtaaagtaagtgagaaataaaatgacatggttaaatttaattttattaaattctccatgattagttacactctttgaaattttattggaattttcagagcttaattgctaatttaaataatacaaacatcatttaacaattatttaattggaaaaaggaatcaaaatcctcccttttaggtttgggccgaatatagaaaagtttatattccttcccttttatctattctaagagcacccgcaatggtaaagtaaggtgctatctataaaacatgtacatctcagcaatagactagattaataataaacaatctcaatagtatgtctacatgggtatctatagctctctaataaattgcctcgtttttctctataaactatcttcaggttagtagatagctttgctctctctcttcatttaatctcttccaagtagaaaaatatgcttacatggatcttttatagagagtctatagataaccattgtgggtgccctgagggtgtgtttgagaaagaggggattgaggagattggaaagatacgtaaaacgaggtgagccattagcacatgattaattgagcattaattattttaaacttcaaaaatggattaatatgattttttaaagcaactttcctatagaaattttttacaaaaaacacaccgtttagtagttcgggaagcgtgcgcgcggaaaacaaaactatctttctctctttctcctgcgctcgaacgcagcctaagtttctggcctgtttcctttcttcgttgatgtccattttgtgtcctccattcggcggcccaataggcagcccgacgtgggagcagcttgagccgtccaatcgaatggacggtccagattaatcctaacctaaataaatatacccgaaacctaaccctaaccctaggattcaaacccccccccccccccgcccccgatctcccccaaacggcggcggcggcggcgtcgcccttcccccgcgagcggcggcagcggctcccccaccaccggcggcggcgacggcgtcctccctcaccaccgacggcggcgacggcgtcctccctcatcacaggcggtggcggcagcgccctcccctaccaccggcggtcgatctagcgggaggggaggcggcgggcagggacggcgccctcgcctccaccgatccagtgggaggggaggtggcagtggcccgacgtcctggatccaatgggaggggaggggaggcggtggcggcccggtgtctcggcggcggtggcgccctcccctccgccggatccagcgggggaggaggcggcggcggcccggtgtgccagatacggcgggaggggaggggaggcggtggcgacccggcggcggtgtcctccccttcgccggatccagcgggagggaagctggcggcggaccgatgtccatgtgtccctgtgacggcggcgatggcagcattctccccttttcttcttgtgttcttgtgttaatgttgttcttgttcttgtgttattgtagtagtgttttctctatgatttgggtccaatttagattttgatgtggactcgtatttgtgttctgggtttttttttgagggggggggggtggacggatgaaaaagcgcacggacgaggtgacgattgttttaattagttaagatattaaatataattgcatatacgtaagcatgagctaaaagttgtataacaaatccgattcaattagcacgcgcaaaatttgctttgtgcggggaaatctcctactacttgcgatcatcaatcatcacatctcggaattaagaccatcctatttatcaccatacaggtgtaacatttatattgtgttctgactagtggcagccttatatatttattcggtgtaattacaaataatagtttgtcctatgcatccaactaaataagtataaacagcaccaacaacatgatgtctatcataattaaacactcactagaacttataatatgttgaaaaaaaagagtatacttgttttttatgcattcctttgtcagtaaaaataaaaggttcttgagttgaaattattgattctgcatctctgtccatggtgcatggccaccctgagtattaaattgagaaaatcacctatgtatgcatgaaagttcacctaattccttctatacccttgaattttgctcaatcccttacatactcctgaattttagtttggatcccttccatgccctttccgctagttgaccgttagttgaccgttaaattcttttgaaaaagtccattttgccctttgctatgaag

SEQ ID NO: 61528 - DNA, 1518 bp, Oryza sativa
aacacatatgctaaaaaatcttttgataactaataaataaatattaagtttttatatcatatctaaaagtatatttatcgcaaataatatggtgcataactatctcataaacatagtagtctcatataacaaatttctatgcttcaacaatatactctattaatttatatgcttctttataccaaagggcaaaatggactttttcataagaatttaatagtcaactaatggtcaactagcggaaagggcatggaagggatccaaactaaaattcaggggtatgtaagggattgagcaaaattcagggatacagaagggattaggtgaactttcaaacgtacacaggagattttctctattaaattagatgcagcaactacaggtagctgaacatataaagaacatacttgaaagaatcatgttcaaagatcatataacaagtaagtcatcattgagtcttcgatttcatacttggaaaatcacatctaccagtggtgtctgtgaaagaatcaaaaggctacctctgtttccggttattccaagaacttcaaaacttggggtaccaaatgtatacatactttggttagagaagatagttacgagcacgacattagcacccacaaagagttgatcaattagcaggaccattaatcatgtataagtatgttccttattacttttctaattccatggcatcaacacatgaagcctgtgcagagactcaaatatagcaacatggaaactattatcttaacctacacccttcacagatctcataatttgatgatttcttaatgtatggtatgatacttctgccagatttgcatgctaataaactgccagaagtagtgatcaagaaaaaacagaggaacatattacatataagtagtgcacattctagttaaatgtaattattcccatggagaagttctcattttgaatttaacctttcaaacttgatggagtctttgctcgacagaaaacatatgacaaataggtgatcaagttggtctgatcaattcagcatcctgtgtccatacattgatctgtaaatatttgttttctgaccatattactttcattaagctcagcatgcatagatttggtgtgtacttctcacataactctatttctagaagcttgggagctcccatattaactagaaaagtcacaagttcccacgctaattgaaaaaaaaatgttaagcgctcgtctatgacatactagtgttgtgccaaacaaaacgtgaactgggctaagtcaaataagtgagtatttgttaccagttccaagtagtcttcatcttcgatgattgcaattgttccttttagcttgcggcactgccttttgagctcttcgctttggctttcataaacatgtagtacttctagtgaactcggaaaacagcccttgggcagcgaatgaatgtttggacagtatgcgatctctaatctcttgagactggtgagtctatgtaacccagcagggagagactgcagcttcgagcattgcacaaat

SEQ ID NO: 61529 - DNA, 8093 bp, Oryza sativa
  unsure (1)..(8093): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtcaaaacatatatttttctttcatcagaatataatcatgtgatatcttgttgtaaagatttaattataatgaattcaacggtgtgatcgaatcgttcatcggataagtagtttagaaggaaaaatattttaatatcactaaatacttgcatcatgattcatgcatggtgtgggagaaagccaatagatggcgagagagagagagtagggacatgagttatatattggtgaaacaaaaaatcaattgttgaaacattgagttatatatagtgaaaaaaaatcagttgttgaaatatttaaattttttttatgaaacataacaaaaacacacgttgaaacatattgctaccgcatctgaaacattaaatttaacggattgaaacatatgtttttttttcatcggaatgtaatgatgtgataccttgttataaagatttaattataacaaatataatggtgtgatcatatcgtagattggataagtagttcatgagaaaaattattttgaagaccattacaacatgtatgtatttgtggagtgaatagggaggtagtagtttatccgtccggtttttattggttgcgtcgaacatatgatcctaagcattttcggaggtctgagcgtcttgctgccggggtccggagctgtagtgccactcagattttctgctgatggcccgatgcgcatgcgccctagcaggctagcagccattcctgatgggccaatatcgtgccatgggccatcgggccatcatcgtgcctacgggccattcgcgtgccgtgccagcccaagtacggcctagcccatttacgggccgtgtcagaccgtgctttctagcatgtcgggccgtcgtgccttaggccggcctgataaagcacaacccaagtcccagctcccctcgcctgcacgccgccgtcgccgaggcccggagcggtggcgtcgaatgggaggagcgggtggcggcggagctcctcggcaaggaggtgtcggtggaggtagggatggcaatgggtcgggtcgggcacgggtagagcaaaaccatgcccgacctgatgcctaatattgcctgtccaaaccctacccactagagttagcgtgcaaaactccgtgcccgtacccatgcccggtgggcgcgggtatgtccggcgggtacccaatggatctcatataaataataacttaaaatatatataatttaagaaagaaaaataaaatcaataatttacgaaattattggttaccaacaataatttgaattacatcacaacttagtatcagttagcattacaaatgaaccaatagaaagggtataagaattaagaaatgagtcaaaattagctaatacatatgtatcgggtcgggcatgggttacccatgggtaaaaaatgaaacccgcctgttgcccatgacgtcttcgggtatcgggtgggcgtacccatgggtaaaaagtcacactcacacccatgcccatcgggtcgggtatctgtggatacctggacccatgggtaaaattgtcatccctaggtggaggaggcggataacctctttgaatttgctcgatgcgggatgcggcgaggcccaagaagagcgtagcggaggagaagtcgaagggggagaggaccgggtaagaggcgaaggtgttgagtagggaggagggatcgagggcagagaggaggtggtcggggatggcaacgataggtcagggacgacggagtggaggaggaggtgttggcgatgaggtccatggaggtcggcgagaggagtagcccgtcgttggcacggccatggcccgcgcagtggttggcacatgtcatgtggacctacatggcggtggatcccacaattttttttgtgtgaatgacaaataggacccatatatttttttaattctaatgctacataagtgacacgtcaacaccacgttgtataaagaccagttcaacaccgtcacgtaggcgccacatcagcgaaatcgctctgcaaaaccgtcaagagagctaaattgcaccggttttaatagttagagggttatgatatccggtgttgtagttcagggatatgaattagactcatccactagttaagggagtcaaattggacttaatccaaaagagaacggcccatgaaacaccaaacggaaacagcacgctcggatctctttcccttcccttcccccgccacgcggccacgccaacccaaccaataagctgtctcccgtggcacatctccccaatcgcatcacgccacgtcacccctctgacgcgcgcgaccccttctccttctccccagttgcgcccccgcttctataacacgcgcctccgccttcctccccgcggcaccgatctccctcccccctcgccggcggcgcaccgaccgaaccgaaccgcgccatggtcaccgcgcgcaagggccgcggaggcagaggccctccccgcccccgcgtcgtcgacggcggcggagggagcatggtgtcgcgcgtggccgtgctcgcattctgcgtcgccgggatctggtcggcgtacatcacccagggcgtcctccaggaaaccctgtaagcgcccgcctccctccctccctccctctctctctctctctctctaatggtgctcgggagcggaggggaattgggctctgcttcggcgagtttctgaaaattgttcgccgttttctctccccgccgttcgttcaggtcgacgaagcggttcgggccggaggcgcggcggttcgaccacctcgcgttcctcaacttcgcgcagaacgtcgtctgcttcgtctggtccttcataagtgagcctcctctcctccctctctcatcccctgcccctgtcgtgtggaatccagtgcggtcgcatcgcatgccattgcgcagaatgcggatcgtgtgaggagtttgtgacactggttttgctcgcgcagtgatcaagctgtggtcgagtggtgggagctcctccgctggccgcgcgccgctgcggaagtactggggcgtcagcatcaccaacactgtcggcccggccatggggatcgaggcgctcaagttcatcagctacccagctcaggtttggttgcagctgcccttttgtcgtctcgcttcgcttgctttgttgctctatgcatttttgtgcagctattgtatctgtaattagatgtttccattttcgttatgggtgataggcaacgcagtagtataatgcctgcgaagtggaatgttctatttttggattgttcaactgtgctaagtaaatcagtggttggaatgttctatagccttatttttgccttgattgatgcgatagatacggtcatttggagaatttatgatgtgtgagtgattattggagaagaaaattaagtttggttgagtgaaattacgaattcagactctctggttctgatatacttggagttttgaatttggttcggtctgaccaagtcagacggcttatgggctgattcagaaatatctgaacatataaacaatgtttagatcatttgtttattagcaatttttatacgtagaaaacatttatgccatgagtattatgcacaaatgccaaaatatgattatccatgatactcttatcgctgtatcgcatggatgggtgaagacagaaccatatttcctcatcaaactttttgattgaactttgaaccatccaatgtacagttatacatcaaaatgtgtttggctcaagcgcaatgtaatttgatttatcttttgaacttattggaacagtcgcaacaagcctgtgttttctgaatatcatttttgtgtctcatttttgtgccgtaataatatatgctgatttgattaaatagcacattaccgctaaggaattatttgctctatgttaacaggtcctggcaaaatcttctaagatgattccaggtgagttgcattgatctatgcatgctatgtaatgtaccttacagaacattatctacatctgaatagttcttctgatcattaatttgagcttgggtgggtatactcatctgagcagtttctgtgtaaaaaaaaaagtacactggaaaattggattttggtttggcaccacaatattggctgctttagctgttagtacgacaatacttgcattttttttgtcaaaaccatatcaatttcatgacaagagcatttccattagtgctgatatttggtggtcagagtggtgtaggtaatagagcaatcagtgttaagaataacttttaacagtagccctttcatgtttcatagtctgtatagtgatgtgcgcatatctctgaccaatgatttaatatgtacagtaatgctgatgggaactatactgtatggtgtcaagtacacatttccggagtacatttgcacctttcttgttgctgggggtgtatcatcctttgcgttgttgaaggtaaagatttaatctatttcaattattcaccaatatcccacgagcctaaagcaaaagcagaaacattttggcactgtttcactccgtagtatgaaagtagaaaagaatatgttttgttccttacagtcatttgtattatgatgaatacaaattagaagagaaaacagccacatcaaagtcactataactaggaatctgcacctctaatgttattagaagctgtagatggcctaataaaattttatgtgtgatgtgctgatgttaactgtgttttcatttctgagtattatgtttgtttcctatgtatcagacaagctccaagactatcaagaagcttgctaaccctaatgcgcctctgggctacacattgtgcttcctcaacttagcttttgatggttacaccaattcgacccaagatttgataaagtctaggtaactacaccctgtccattccatattaaagcattctggaaattttatcatcttcttatctacatggaaagtaatgtcgtgttattgcaggtatccaaagactaatccatgggatataatgcttggcatgaatctctgggggaccatatacaatgctgtgattatgtttgttgctccattactattcagtaattggccttacgccaacggttttgaggcagtgagattttgccaggagaacccagaggtggcatgggacattctcctgttctgcctgtgtggtgccgtgggtcagaatttcatcttcctaaccatcagccgatttggctctcttactaacactaccatcaccaccacccgcaagttcatgagcattgtcatctcctccgtcatcagtggtaacccactctccttgaagcaatggggaagtgttgtgatggtcttttctggtctctctttacaaatctttctcaaatggaagagaaagaaggtcagagaccacaaggaatgagtttaatattttagctcattccaatttgtagcttcgattggacatgtttgttgttgggttatatgggagataattattgcagcccattactgattcaggagaagttttacatcgataaaaaactgagatgtatggtaatagctaaaaaaatgctggtagtttctgttctacaggaagtcaggaagaagatgcaatgaattgtattgcactgagtagtagaattgtatggcgccctgtatttttgttctctccctaaaggaatcgctaattatcaaaacgataattatgtttctgccactgatagtctgatacttcatacagtcacactacgataacttgtggagaaaactactgtacggatttggctgtttaagcagaagtatcaggttttgctctggaggatagctgccttcctagcaggtcgctttatgcgcgccatgctttgaggttatgtttgtctgtttttatttatgtattatctattaaattattaagatagttaaaaatgtgccaccacggcgaccacgcccgttctaaaaacttgggaattactgcattaataataaaagaaaaatgaaatttttgtattgttatatcgtggtaggtctagtttatacgtatgttgtaaaaaaaccaattttatttttaaaatctattgtatattacaactctatctattgagatagaggatgacggttatatatggaatccaatttggattttaaaatctattgcaaaacaaaagctaacagtgatatatcaaatccaattttacatctagggctctgtttagtttcaaagtttttcttcaaacttctaacttttccatcacatcaaaactttcctacacacaaacttctaacttttccgtcacatcgttacaatttcaaccaaattttaaattttgacgtgaaataaacacaactctatgtaagattacgtaggaaaatccactggatatacacaataatccttatgttacaatgtgagttcaacttagagaggactacaattttgatggggaaacaaatctacactacattgtgattgccgattgctctgtattagtaactactctctccgtttcacaatgtaagtcattctagtatttcccatatccatattctagtatgattcattaacatcattatgaatgtataaaatgttagaataacttacactgtgaaacggatgaagtattaagagtatgacctccacttcttaatagctagccggccaaaactgctccatttcttattagctagccggccaaaaaaatatttgtatctctaagattttacttctgtggtagtattagttttgtagttgctgtcgactagtaatccaaagaggattcagttcgaagttcaaatacgctacatgattacatgaaggctccactactccgcatggttgctttcttcgtagtgaagtactctctccgtaccataaaaaaaccaacctaataatataaatacacaacttagtactatgaatctagacacctctgtttagattcattgtactataacatatcacatctagttctagatttgagggagtactcactccatcccataaaaaaccaacctagtaccggatataacacattctaatactataaatctggatatacatctacctagattcatcgtactagaatatattatatccggtactagatttgttttttatgtaatgagtactccacaaggagtacgacattgtgcttactgagcagtggatgtcggccatcatggttggagaactgatgataaaggacgaattggcccaaaaatctgacagcccagcagtgcttaacggcgactaggcaacggattaaaaaaaccctcaaaagcatattgtgactgatcaaaactcaaaagaactgaattaacaaaacacaccaggaatgaggatctttttttaaactcaattcacctaacccaggtattgtggtctaaattgcagtaaaatcacaggggtttcgagacatgacatataacctcaggggtttcgagacatgacatataacctcagatattattactataaaatttcacgaaaccacactagtgatctttttgaatttgatctatcaaactcttaagttctacaatcacgtctcaaatttgtaagttgtttatccataatataaatgttatatcaatgtaagtaaaactttttaattttctttgagagtgtgccacaatttggttaatggcatggtttcctgaaactttacgaacataacacttagggttatatgtcacgtgccaaaataactttattccatgaaatttggaccataatagatggagttttatgaaatttactctctttttataaaaaaaaattcactgggggtggggggggggggggggagaagtccccacctgaattcattaagagtgggcaagggtccagtttagagaactacaaattcagggcattacactttcagagagcagagggaggaagaaaaaagagtaaagtgtattggtggttcttaaatttgttgggttgtgtca

SEQ ID NO: 61530 - DNA, 7668 bp, Oryza sativa
ttttcttattttctttttcttcgttttcttctcattcttcgttttttcctttcttctgctcgagtcacagagaaggagaagaaagggaaaaaatagaagaaaaaagaaaaaggaaaaattttaaatgggacccatttttcagtcaaaatgatgccacgtcattccgtgtggcatgccacatcaacgccacgtaggatcctgaaggggttgtggcgatttgggatctagatgacacactataaaaaattctgggacttggatatgcattttaagagtttagaacctatatgacacaccgctacaagtttaaggaccacccgtgcactttactcaagaaaaaaggtcttccaggacgaaattacatgccgatcctctaatttgagtctttcgctccagagggacgcatcttcaatacacagcactaataatcgacgcaaagaggggcttcgtgcctgaagacaacccagtggtggtgattccacgggttccaaaagcattgcaagtagaatacccaaaaagtgcttggagggaactcgaatcggtgtgggaagagaagcaagctcagctaacgtcgcgtcattaacctgcatattcagcgtgccccagaaggccacagcaaaggggcactggaagcagaggtgaagagctgtttcatcggcagaattgcaaagatcacaggttggggtcggcactatggttttcctgtgcaagttgcgttttgttgggaggcgatccttagccaaaagccaggcaaaaaagaaagggttcaaaggagcttcggatttatcatcagcaagagcaattaatattcagccatttccatttccaaaccatataaattgaggtagcccttgctagtatcagttgctttgcaaagctgctctgatcagaaatcccaatggcaatggagaagagccctcctccggcgccgcacttcctcttcgtggtgagcgggatacagggccacatcaacccggcgcgccgcctcgccgcgcgcctgatggcgtcggcgccggccgcgcgcgtcaccttctccaccgccgtctccgcgcaccgcctcatgttcccgtccctgccgtccccggccggcgaggacgtcgacgacaccggcgtcgcgtacgtcccgcactccgacggctacgacgacgggtacaagcccggggtgcacgcgagggacgactacatggcgcgcacccgcgccgcgggcaccgagtcgctctccgccatcgtcgcggctctcgcggcgagggggcgcccggtgacgtgcatcgtgtacacgttcctcgtggtttgggcccccgccgtggcgcgcgcgctggggatcccctcggcgatctactggatccagccggcggcggcgttcgccgtgtactaccactacttccatggccatggcgaggccctcgcctcctgcgcgaacgaccctgcccgcggcgccgtcgtgcgcctccccgggatgccgttcctcaggtccgacgagctcccctccgccgtgtccatcgtctcgccggagcacaagcactacctgctgctcgccatgctgcgcgacctgttcgaggatctcgacgagctcaagcccagggtgctggtgaacacgttcgacgcgctggagcccgacgcgctccgcgccgtgcccgatctggaggtcgtcgccgtcgggccggtggtgcccgacggcgaagcgtctctgtcgagctcgagcacggacatgttccggcgagacgacgcgagcgcgtgcgtggattggctggacacgaagccggcgcgctccgtggtgtacgtctcgttcgggaccctcctgtcgatgagcaagcggcaggaggaggagatgaggcgcggccttgaggccaccggccggccgtacctgtgggtggcgcgccagggcgccgtcgatggcggcgcgaccttggacagcgcacccacccccgccgccgatgccggcggcggcggcggcgaaggggacgcgcaagggatggtggtggagtggtgcgaccagatgaaggtgctctcgcacccggctgtgggctgcttcgtgacgcactgcgggtggaactcggcgctggagagcatcacccgcggcgtgccgatggtggccgtgccgcagtggacggaccagccgacggtggcgtggctggtcgaggcgcgcatgggcgccggcgtgcgcgcgcggctggacggcgagggcgtggtcgagcgcggcgagctgcagcggtgcgtggagctcgccatggcgggcggcggagacggcggtgtccgggcacgggcggagcgatggagggagcgcgccgcggaggcggtcgcggccggcgggtcgtcggagaggaatctccgggcgttcgcgtccggggccgtgacgcaggcggtgtgctcgagcaggtgattccgccggcggccgccggcgatggcgaactcaacggctggattattgttgtttttttatattcccagataatagctttgtcatttggtgtggcgttgacgcaatcagtatgttgattagtcgacgtaacagcaaatttaattggagatctcattaaattttagatgttgccatatcatctacaaacagttcaataaagggagcaaaatttccctcttcgatctatccatgtggccatgtgcaacctccagattacgaggccttcacagtgcaagcacccaccaggatgacacataggataaaaagctacaaggaaactttctctacagggcaagcaccggtgtgggacccacagatactacttcaccgaatcccccacctccctcagtcaccacgcccctcaccctcttccaactccaccggctgtcccctcctctcctcgacgacactgcatttcccctctccccgccggcggcttctcctttctccccgccggtggcctctcctctcccctctccccgccggcggcttctcccttctccccgccggtggcctctcctctcccctctcctcacggcggcggcagcgaagtaggctggggacgcggcgaaggaggttggggacgcggcggtggatccagaaggctgagacgatggtgcttgcggccagcggttcctcccacgccgtcgcacctcctcgcctcccatgctgcggcggcacgtcggggatgccgccgtcgtgcgcctcgcctcgccgtcgaccgcgccgcccgatttgttgccgcttttgttgccgcgatttgtgtagattagttgccggcgcaagggcacgggaggcgcgagggcacgagctccacagtgcggaaaagcagccgctaccgggcctcgcgagagaaggtaccgcgtgcctcagtttgggtgcgaggtgctcaccatgggcgcacgccctagctccacgcaagcccaattcctacgtggctgcccatagcaccggtccagcatggagcactgtgagaggcctttaagccgccaatttgaatattcctttcatcccttgtctcaaatctgagggcagtaccagtgcaagcaacgcataacgtggctttagctcatccgtacagtgaaatcagtccaaagtcatctgtacagcaacgcataagccatgcagtccacaacgctcgtgatctctttttgatggctagaatatctgccgcacgcgaggcgaaggaaacatatgcgggggcacgctctcagtaacgcggacgcgtgagacgtctcctgcgccgcgcgtccttgcctgcaggcgaaggaactcgcttcccaactaaggcccgagcatctgagcagaggcacgcgttttgtcaacgtgtagatgattatccgagctggaaatctgaaggaactggccacgtcctcccactgtgaagggcctgacattgttttattgtcacaagtgagtatcgctcgaaagccactgtgcagatggattttgataaaatatcactttttaacgtgtggctagacgttataatactactccatttagaactgtatggtgacgacgaactcatcctcgtggcctgccacggtgacggttgcgggcctttcgtcgtcgcatcccacgtatatatatcacgggtgcctgctccatcctcctgttgcgggcgcccacgcggtcgctgcctgtccccacgcggtcatggcgcaacacggctcccacctcctcaccgacagctagtccagccacgtctacaccatcgcgctcctgtcccgtggcgacatctcacttcttgttataaaatcagccccgaaatcgacattggtagctaaacgcggaagaaaatactataggagattcaaaacgatgacgacaccgagacacgatatttggtaacggagttcagccgtagcctacatctccggagcactgattacgggcgctcctccccgatccagcatatacagcgtatcatagttacaatgactcacggccggtcgatgccggcagccgctccctctcgctatactaagtctccatgcggttacaataggcacgcccctctatttatgagggatcctaggatagagtccgactcatactctagtcctaatatcttttacaactccaagtcctaaactttaaccgactacgtacacatattcgacgcaaactctaacaaactctaccttggcgaatatgccacaccaacttgaatctgttacttgctcgaacctccgtgtaccaggacttgagttggttctgccgcagctcacaccgagccgctcgactagcctacgccaggcttgccgccttcaggatcgtgcacaacaacaccagcatacccatcttccatgactccacctgcaacagcactcccttgtaacttgtacaaacatgaacttgtcctctcaccagtcataacagtcttgccgtccttcatgatattcatggtcttcctattagaatccacctgatacaaccaacccgtctcatgtaggctcccaagcgaaatcaaactcttccttagtcccggcacgtgtctcacatttgaaagtagcacctcgtttccatcatacatcttgaacttgacatcgcccactccaacaacacgataactcgtgtcatcgcctaagtaaacaacaccaaaatcaccagatttgtatgaagagaaccactcccgcttcgatgtcacatgataggaactagctaagtccaacatccacgcttctccagacttctcgttagacactgtgagaatctcatgactgctgctatctgaatcatcaccacgagctgctaaacttgcaatgccacctttcctcttcttcagtaacaggcaattcctccttatatgtccaaactcatgacacttatagcaccgtgccctcttctccttgctctttgacacccccgcttcatgatcatgctttgccctgaccagcaaactctcagcctgagaagcctccattgcctcgtttttctttgatcttctcaagtctcgtgcaagcaacgacgaaattatctcatcagttttgacagtatccttgccgtgcgtcagggtagtcaccacatgttcataagacggtggaagcgagcacagaagaattatggccttgtcttcatcatccagtttcacatctaacttacttagatccacaaccaactgattgaagacgtccacgtgcttcctaagatctgactcctcttgcatctgtaaaccatatagctgttgtttgagatacaacttactcatcagcgacttggacatatacaggcttgccaacttgtcccaaatttccttcagtgatttttcatccatgacctgatacatgacagaatccgagagactcaagcgtattgttgcagctgcctgcgccttcatctcctcccacttgccagcatccatcttttccggcatcgtctcctcaagagccttggatatcccctgttgagccaacagatccttcagcctcatctgccagagaacgaaattcccggtgccatcgaacttcaccacctcaaatttggaaaccaccgtcgccgccatcaacgataatcaactcaacagctgttgccctgttaaattgatctgccctgattaattgatcccaccgactaactcgaatagtaccagctggaccgaaccagttttttttctctctccaaaaaaccggaccggtttcttttacttggtcaaccaccagtcaaagaaaaacagatcgaccctgttccccttcttcctttggcttcctcgctcctcctagaaaccgtgcccacgccactttttcccgatgcgccgccgcctcctgctcctcacgccgtcggccctgcaagaagcactgcgccgcccgcctcagaaaccgcctggggcgccgccgcctcccgccgccgtcacttgcgccgaccctgcgaggagccgccgcgtcgcctgccttgggaagccgccggcctaccacctaggagcgcccgccaccgaagtccggcgccggttcctcgccgggaaccgccgccgccgccgccgcaagctcctgcccgagctgcgacgaacgccgccgagtaccacgccgccgtgcgccgcctgcaatgatgcgtctccagccgcccgtgacctcgccgcccaaaccacctttgcctctgcgaaaatcgggtacgaatctcgccctctgctagatgatttgtttcgactgcgttgttacaatcccgtggtccctttgctgcttttattggggaaaaacgtgtccgatttccagtctaaatcgaatccgtatccaactccctcctgtgtcgaacgcggtatccatccagcttgtcttcggtcgtgtccatgccgtgaccgacacatagataactccatggccgagtcttcctctacatcacgaatccgacaaccaccgaaccttgcacgtcctggctcagcccgctccttctcggcatcaccctgatctccgccgccagctcggcttcgacgcaaaacgcgcacaccgccgcgaccctgacctcctgggcttcttcgtatctccagcggaacctagcaccactgccaaacaccacttgccgactacaccaatgactagtgccactgatctgttgtcatcgtgattttcttgatctgtgctagaaacagtagaaccagacctctctagggttggaactagcacatatgctagtctagacgccctacgcttagttctgccatccaccgctaatacgccgcttttgaagcaattccagtgtggaaatacctgtcaacacctccaaaacagcctataggatccacccgctccgacatccgattgaacgccatcaatctagtcgcgagccgaagccgacaagtcgcatgccgtcttcccagccgccgaacgacccgagcgctacgtctagccatctccctgtcgaacgcaactcttcgaaaggcccgggccaccccgcccagagtgttcgaatccaccgatcgagaacgccgatcgcctccagcttcaatcaacccgagcgtgcggccgcacgtctccctgtcgagagtagctcaccggaaagtccgagccacccgcccgaagtgtccgacccatcgattggatcgccaatcgcttctgccgccatcaacccgagcaccacgtctagtcatctccttgttgaaggcagccatcgacggttccggccgccgccagaagtgttcgatccaccgatcaagactccgttgatcgccgccgtgctccaccttgcgccaatgcccctccctgggcattacagcaggctacgcggtgtggagcacctccatcgcgcctctacca

SEQ ID NO: 61531 - DNA, 9038 bp, Oryza sativa
caagtcctaaactgtaaccgactacgtacacatattcgatataaactctaacacttcttccgcgcccacaagcagcaggagaggcacgtggcggcacaccaccgtcgtggttggggagcatgagcaacagcaggatggagggatgagcagacaacggtggcctctttcgactcccacatcgccgcgacattcttgagccttggcgcggcagtcaggctcctccaactccgacacagcgaccggcatgccccaagtccccaactccgaggcaacttaaaggaggaaggtgaggaggcgggacggtcagtggcttgccgatggtatttatagagggaaatatgacattggagttgggagagaagatggggaaggaggctaaagcaatttgatcatgtatagtattctagcttgtagctatgagtaacgagttaagagtggtatttttttaatgatcatttataatacttttctttgtttttcatttataaaatttgaggtaccaaatacacttgaatattacgtttttcctatgctgtgtttcaaaaaatcataagctccaaactaactcttatactactattaattatacacttgctaggccggcaacacgataccgatgtttatagtgataagctaggccatgagctgaactgaaaacgacctatatcgatctgtggatacaggatagaaacagtaggaaagagtcaggccggtcaggtagataatcacagctatatatatgccggcctgcggctcatgttaaaatcttatctcgacggcattgcctccaagcaattaagttcaatctgccaggagacagcgatctccggccgtcgcctagtaagccaggtagaaaaaaattcactacttcaaattcactacttcattcaggagttaagaaaaaatgttactccagctaggatctgcattaggttacttctccctctctctccgaaataactttattttgtaccatcttatttatcctaaattaactcatctttcaaaagcaattatattggactagataaaatgggatacaattatattggatttgataaaatagagggtattctatttttttcacttatattggtatgtgtggtctgggtagaaaataaataaagttattttgtaaaagaaaaaattgtgtcacaatgtgaaaaagagaaggtgccgtgaattcgacaccatggatcaactattgaacaaggtaagtgtcacgtcgactcaacctccacgagatcaagatacatacgtattcaccatttgtccatagatgacagcttgcgtggtggagtaatatggttgtttgtatgcatctcaaaacttatggatcaggagttcaggaccattcccgtcataaaaaaaaaagcacagaaattattcgcatacgcttaattccttttatactcttactactacgatagggttgtcgtaggcggccaaaacacgttttaacaggtgaccgatcatgtcatctgtgactaaagacatgtaaaaataaaggcatgggcccgatcgcctgtaaaaaaaaaagcatttatatattgcaatgcttttatatgtaatagtgacttggatatataccgtctgtacaatgcttttgtagtcataatacaatttacaaattaacactatacaacacaacaaagttcattcttgtttggcatggccaaactcctggattaattcttgcaggcttgcagaaattagagtttgtagattgaattaaaatggttcaatcttttatttgatctaagatatgaattaaatgtcacattttaataactctactctagcagcagccccaactccatgaatttctagagctagaaaaacttttgaccatggatttatcagaaaacatacttttcatgacagcagtactaatgctgtgtaaaagcacactgtaaatctattggtataatatttatacaactaacaatgttcaagctatgcgttggagattattgagtcaacaacacgatcaagtcttgaaaacagccactctttaacttccatgagtcctacaataatgtatggagcatgcgaccttatggactgaacgaaccaagtatacaatatatgttttatgttgtctgcatagaaacttttagaatatttagaggattcaattttctaatttttttttctatagacccctttagttcatatagaaattgtaaatattccatagaattgcatttctacggactaattccacaggattacattccaaaaaaaaagcaagagataagaccttttgattttttttagaaaaaaaattatcctgtggtgtagttaatttcttctcttctcatttccggtgtttttggttactatagacttttttaaaaaatacaactttaattcttgtgtgttttttctatcctacctttcaagggcgataattttgcaataggcacattataatttcttagaaagctccccctcgctccctcgtgcccacacccacactaataatcaataaaatgaaaaaatgtataaatatacttgttatctgactaattcatcattaaaatctacaaaggtggaaatttaaaattaaaatacatcttataattgacacaaattgttttcaaatgtcacttctggcacttcccaaccacgaaagtcatcagattatgatccgacgagtagggatgggcagaaaaagaccgaaccaaaagaccgaactgaaaagaccgagaccgagaccgaaaagatcgagaccgagaaattcggtcatcaattcggtcctaggcagtgaaagaccgaattttgttcggtcaattcggttagtatcctcggttaaccgaatatatcgaaaagacagaattatcaaaaaaacgtctaaatgcaacctacaatccactatgtttaataggattaaactctaattttcacatccctacttcttctaggcatgcaacctaacaagagtctttactcataagtgcttacgaaatttttttgtgatttttgtgttgaaactttccattatttctttgcatatatgaaaatgttgttgaatttcggtcaggactgagactgagaccgagaccgaatttgtcggtcctaacatttttgcgctgaaattcggtcttcacttttcaaagaccgaaaagaccgaaagaccgaagaccgagactaaaattttcggttagaccgaatgcccaccctgttgatgggtgatacccgtagaccgaatatagagggtattggggtacgttggtataagggttcacataatacgacatcaagcaaacaaaagacgaagattatactggttcaggccccttgataggtaatagccctaatccagttgatgtgggattatatgatggaaaacacaggttacaaagggaacaatggaactcgatggatccggcgagatcgtagtcgagttggttcgactagatcctcgacgatttggctcctgcaggcttcgacttcgtaggctgtgggggttgtgttggctctaagattcgatgccttatgtcctccccaggggggtcccttttatatcgcaggtcaggcggtttccaagtagaactcggagacatcagaccctacacgatacattgacgacccagtcttgtccgagtaggactcttttcgtccgtaaactccgtgaaggatttccttagtgtatgtagagagtatccgtatgcgcgtgggcatgccataccgatatgtgacgtatatcaaagggtaaagggtatacctaacccgtaaccctgacagtagcccccgacttctgcttaaatgaactcgtgtaaccattcgcgacttctcgtgtcgaggctattgttgttcccggtgcgagaaccgtggagacaggacgtaatcgagaacaccatgtgaagcccaacggtcacgagtgaatttaaactgaagtccaaaatactgccgcgcgtaacggacccagaaatttccggcggctatctctctcctttccttggaattcgcaccgtcggtagtgcgtctatttaaaggaattttgggggatccattttgaagcccgcctattgtgaagaaaacctcccgcctgcaagcgttcttcgtcttccccgctcccacaagaaaccctagttcgtcgacctcagccctttctccggcgatctccgatcggcgatggatctcggcaaatcatcctccactagcgtgtcgctgaagaagcttcaggaggacggcgcccttccgggtcgtggaaccatggaaagggaagcaggaggtactgaaccccagcccatcttaggtcgcatggttgtgatcgaggactacattctctgcggttttctccctccaccttctgaatttcttctcttggttttaaacttctatggtctttctttgctccatctgaaccccaattctatagccttagtatttttcacatctttgtgaagcctacattggggtagagccctttctcgatctcttccgcttctactacgagttgcgttggatggaatccaacagggtatctggatgcgttggattccgacttcgggatggcctaaaatcgcgttatatccccttccagtgtccctcctctcgcagcaaatggcagacgaggtgttctatcttcagatagaagattcggatcctgtcttcgttgttcctgaggaacaaccagacaagatttcgtcttggaccgcaaaaccccctttgaccccttctcttcagtcgttcatcgatgtggtcgacgatctccgagtgcgtggtttgtcggggtatgaagtcgctgttgacttcattagtagacgaatccagccactccaggctcaagcccacctagcctttgactattctggaccggaggatgcgacccgggtttctcctcggggtatctttctcgcatttatcctgatatgcttgtgtgcgcgctcctcctggctcatcgaaatttggttctcgattcacaggtctgagcaacgaagccgtgggacgtcgtgtcggccaggtgatgatcagtggcccggcgacggcgagtaatgttcccgttcccctttgcgagaagggggcggccgaacgcgatgccgccatcaatgtaagtgtactcagtagtcattctgcgtttttcttctgagatcgctttgtgactttataaagcgtaggctcttcctctgactgacatcatcgggccgctcgcggaccatcaggtggtggcatcattgaaagagaaggtcgccaaggaggcgtctgatgctgctgctgctgctaccacaagtggtggcaatgttccagcaaaggggaggaagttctcctctgtaagcggacatcgtcgcaaggcatcagccccctcggtaagctatcttgttgtctgatcaaacagccagaacaatttcgccttacttcgcatcaactgttctccaggcctcggacgcgtctcccccacctccacgtcaacagcgacttgtgacacttggcgagaagtaagtgggtgaatttaagttttcgtgattttgtccgagcgttgtctgaaccatagctgtctcatagggcggcgcgggcgaaggcggtgcaggatgagtctggagggacttccggtgcgtctcccgctgtagcctcgacggatgtcgtgcttgcgcccgggagccgcgaggtgacaccaagcggcccagccagcgatcccgcggctggtcgtggtccaccggctgtcgtcctcacctgggaggagctccaggtcgaaatgtggtgtctcctcgaagctggtgctcgcggcattggtcgcgagattgcggaggcaaggtcggcggcagcgtcggcaaacgagcgtgccgaccggctggcatacgagttggcggaagctcgtgaagacctcaagaagatgagggagttggtggctggcaacgagcgacaatggcaggggctcgagcaccgcatgtcaaagctcgggaacaatttgtcggaaatccgtggctcgttgcgggtcacctatactggtctgcaccagctcgccgggtagtgcggcatcaagtctaccatcccggcgaatcccgatgagttctcgctgacatcttctctagcggagctcgcggcggcgatggaggagattccctccaagcatgcggccaggatcggagaggagacgtccaacgggatctacaccgaggcgtgccatgtccttgcgtgtgtgaggctggcgcatcctaaactcgatctgcgcgagatcttggatcagggggcggctagcggcacgcgtaaggaggtgatggaagaagtcggcgacctgggggaatctgttctccccctttttgaagagtaggatctcttgtactccttagatgtgctatgtaaaacttcgatgggtttcgatcgcctttgtgcgtgtagtcattaccctagctttctcttgcattttgatcttgagtactttttgtcccttgtagagatgttgatgacgaggatgtccagcagcgtgggcagcctgagtcattggcgatcattccggctcttgcgtttgaaccacatgcgtcgccggacaatgtagaccagatcctacccacggggatagagatggcgacgacttccttaggttagtggtccctttatccctttttgctcctccgattagatcagtcgtgttcttgaaagagaagtgaagcttgacttagttattcccacattgagcatatctcgagagtgctcttgctgggcaagatcgtcgtatccaatattggaagacgaaatttgaagtagcggaacttgagagaacaatgctagcagtaaagaaggagcaagctgtggaaacgctccgaggtcgtgaggtgtggttcaactcgtacttgaagagttgctgcacgtccatggccaaggtctgtagagagctccgagtacctcgtggggatcccgaggagtcggcggccagatacatctcgtggctgaacggggcctatgcttagctcgagggcgtcggcaagcgcattgacgaagccttgaagtaggagtgtcgtcgatcgagccgatatgccggggggcacgtgttggcctgcctatgagatcatcgcccgcgactggacatcgattttctccatgaaggttttgctcgttctcggaggactctggcagagatagaccacctggtgaagtcgatggcgccattggcggagaaggtcttctaatctgtggactggcgttggccttcctggtagcctttgtaccctgtgatagatatcttaggggaaagtgtaatatagccttagacttgtgtaagaattgtaaggagtattttgtgaaatagaaaagaaatctatctttagaaaatatttcttactccggatatcgtgtgtaagagtgtgtcctcagttcacgactttagtcggttgtttgagtcgtacactctccctagcccccagccttgtcaccggaggagttttctcagaggataaggctcttggacctttgacctgccttggttgaataagcactgatcctagcccccagccgtgaagttggaaagttaatttccgattacacgacttggttaatacgcacggcgagaactcttacacgaccaggtcttacatggtctttcgtctctacaggatctgacaaggccttatcggctctgggcgtccccagccgaagatcccttaggttcctcggaggccttgtcaagacggcgtaaagggacatgaggatagatttcaacgttaggtgtcatctgggtaagggatcatcggacaggaacactttgattgtaatatggtcctaagaataggctttattgatgctgtaaggtgtcttacaggtatggatgacattgactcatacatagaatttacgtagttggtcaatgttccaagaatttgccaactcgcgaccatcaccgtctgcaattttaaatgcgcctggtcgcaagacttgtgtgatcgtgtaagatccttcccatttgggtgagagcttgtttcgccctgcttggctttgaacccgtcggaggaagtagtcgccgatcgtaagcatgcgtgctcggatgcgcttctcgtggtaacggcggagggcctgttggtaattggctgctcggacggcaactcgttcgcgatgttcctcgagtagattcacatcgacgtttcactactcctcctgatcctcgtcggaatacttctgtactcgtgtactctgatgtcatagctcgctagggagcatggcctcggaaccgtacatgaggaagaagggtgtttccttgttagatgttgtcggtgtggtgcgtacggcccatagtactgatgggagttcttcgacccattttttgtcgtgtgacatgagcctgtcgtagacgcgggttttgatcccttgtagtactatgccgtttgccctctcgacttgtccgttgctttgagggtgagagatcgaggcgaagcatatcttgattcccagcccgatgcagtaatcctggaaatcggtgctgatgaactgggagccgttgtcggttatgatgcggtgcgatagtccgtatctgcaaaatatccccttgatgaatttgatggcgttgtcggccttgatttcccccgtgggtactgcttcgatctacttagtgaatttgtcgatcgccacgaataggaacctgtaaccgccctgtcctcgtgggaatggcccgagtatatctagcgcccagcacgagaatggccaagtaagagggatagtctggagcacttgcgcgggtagctttgtgtgtttactgtggaattgacaggcttcacatcgctggaccatgtcgcatgcatctttgagggcgattggccagaaaaacccttgtcgaaaagctttcccgaccaatgtccgaccggcggcatgtgacccatagatgccttcatgtatatcaaggaagaggtgtctgccgtcgtcggacgagacgcatttgagaagtaccccgtttggcgcttttttgtatagatcgttgctgaccacactttagatttttgctttacgggttattttctcggcctctgtatcgtcctcgggcaactcctcgctgttgatgaatttcataagtgggatgtgccagtcatctgtgatctcgatatcgg

SEQ ID NO: 61532 - DNA, 1235 bp, Oryza sativa
cgtaaagcagcttttggatctgtggatatcttgtctttgcgtcgtgagagcttcgctgacgtaatagactggtcgttgtactttctctctctcgacaacaatgacggtgctaacggaatatggcgtggcggcaatatagaggaataattcatcattaggttggggagcaacaagtacaggggggtttgataggtagcgcttgagtgcaatgaatgcctcttcggcttcctgtgtccatacaaatttgtcttgtttcttcagcagagcgaagaagggttgccctcgttctcccatcctagcgacgaacctgttcagtgctgccatgcatccggttagcttttgtatttccttgagtcttgtgggcgacttcatgttctcgattgccttgatcttctcgggatttgcttctattcctctgccggagacaaggaatccgagcagcttgcccgatggtactccgaacgtgcacttctctagattgagcatgaggcgatatcgtcggaggttgttgaacgtttcctgcagatcgtcaatcaatgagtcgcttgtcttggtcttgacaacgatgtcgtcgacgtatgcctcgacattgttgccgagctggtcgctaagtgcgccctgaaccgtgcgctggaaagtattccctgcggttatcagtccgaatggcatcttaacatagcaaaataccccgaatggcatgatgaatgttgtcttctctttgtcttcttttgccatgctgatttggtggtagccaaagtaagcgtcgagaaagctcaacagctcacagccggctgttgagtccaccagctgatctattcgaggaagagggaagtgatccttgggacatgccttgttgaggtcggtgaagtcgacgcacattctccatttcccgttggcctttcgcaccatgactggattggctagccactctggatgtagtacttctctgatgaagccaggcttgagaagtttgtcgagctcttctcgtatggcttgttttcggtctggtgcaaatctccgcagtctttgctttactggcttggcatcgggtcgcacgatgagtttgtgctcaatcacctccctggggacccccagcatgtcggacggctgccaagcgaacacgtcagcattgtcgcggaggaaggtgatgagcgcgagttcctatttctcgcttagtgtcaccccgatcttgacggtcttgtcgggattggcactggagagtggaacgatcttga

SEQ ID NO: 61533 - DNA, 1256 bp, Oryza sativa
agcaaaagctgaaaaataaaaactttgatgaaaaaaccctaaaatcagctccaaatttaaggttgaaaattcaaattttggttgataagcataagcataagcaaacagatgaggcccactaatttattttccgatttcatcatgtacttctccatgtgtgcatataatatatataaatgaatactttatactagtgtgaatgtatgattggttgattgactcgattctgcgtcaaagattgcaaatttatcaacagtttcttattagcgattgtatcatattttgatgaagtaaaacttaaagcatgcaccttcagagtgggacacacgaggtattctaatagtgatagatgggagctctccaactacttagggttagctcacattttggcgaaaaagatagaagatgacattgactttctcaagacaatggtttgtcatctgtaatttcgtcagcagaaggtactaggagcgatatgaaattcagacacatcttctgaatctttcttcgcatgcgctgccgtggcaaatttgctgatgctctccatgcctggatctttctcaagtgctgcatcaacaacgaacagacaatgtcagcaacaagatcccagtctgatactactgatccctttaattaacaaattggaggtgtcgaaattgtttttatcagagtaattttgcgtggcagattacctaactgaaaatgctctctcggaactcaactaaagtagtcggaactcaactctcacccagctttttctgtgttggctaatggttgccatgaactttcgcatcacacagagagattaagtgctcttgtattgatcgtcaacgatgccaacagcttggctaataaaaagaagacagcaatacatttttctcagagctgcttcaagaaactgtcgtgttgtccacaatcatgaggaggaccacattagagcattatctcttttattttcttttttaaaaaagaggccaaagctttgctattaacagagaattatcaacaggacagactttgattgtgctcagttgccgaaatgttgatacggactacggaggttttataaattgctgatctctaatttgatttctgagccaaatctgcatatttcggtgatttacatatacgtatttatatcggacgcgaattggggtctgatggtgcccgggcttcagaatttgaaatatccaaattcagctcgaattgaaaatgttcttttttggaaatttttttcatcttctgcgtataccaca

SEQ ID NO: 61534 - DNA, 2530 bp, Oryza sativa
tctacacgtcaagtgttcaaaatcatgcaaacgatgcatcctagtcagcaaggagggaataaaaaaaatatgtggggtccacatgtaattcacatgaaaaatataaaataaaaacttctcccccacctctcccccaagcacacggccgtgacgggcaccttcctctccatcctgagcttcagtcgcgaggagaagggaagcagaggttgaggatgctacagccagcgaggtcgagacggggtgcagggagaccgaggccgaggccgagtccaaggcctcccttcgaggccacgcacatgcattaaatcccttgatcaagatggcctctgttgatggttgttatcgatcagtttcgaccgtcaatattaccaaaatagaggagaactagtgatacttgcaatgcataaatatgttagaataataatattccactagtagtaggtatactaatcttttgtagagaacgacaataaagtggaggagaatcgacatcaatacaaacgataaatcaatcggacgatgtcgagaaccagacttatgtatgaatgggccaagaactcagaattgacacgacaaactaggccaaaattcaaaagtctggagaagaataacagaggaggccgccagccaaaccatgggctggttgggccggccccaggttcggcccaaccagggggttcgaccgaacctccctcatcgccgctggatgcagggtttcttctggacgatgtggattagctcccaatgatggttggagggtatttccgaccattccaaccatcacaatcgtcattgggaggctatataaaccccttaccttctcacttcactcacacacctcaagcaatagctctctcatttctctcaatttagtttggtagtatctagctggtggaataggaatagagtagaaatcaggagtccggaagccttcggaagagttcgggtatggctctagtagcttttctcttctcttttgtaagctttgtacttttattagaatactcttctatatacatttatggtattgaaatattttccgagtatatgagtacctattttacattatgttcatgttatagtgaatatacggctagcctatctgggagatgctttggtacgggtataatatttgcttatgcaattactctatgtcatgacgatgatattatagtagtatctagtagtttagacgtgatgtctagattatggaatatcattatttggggttatatattgcggatgagaggtgggccgctaatggtgacagctcagtacgggtattcctccacgctggtatataatcctaagttaattccctggggagggtattcctctgtatttagctccggttgtatgatcatgacaggctgtcgtaagaaactcggcagtcaggggtggcttctcgaagtaccaggagggcatcagatagagggtactccctccattccataatgatcagcatattttgttgtggcatcaagaccaaggagagacccactacccattttctatttaatccttgtaattaatctccatattaatcggcttggagaaacgaaacgacgttactgccgctgcatgattgcacatgcaagggatgttccgtgctgcatgcagctcaaaaatcgcatggccaactcgatctctgtgataactagttaatccatccgacatgcacatgctaccagtgttaatacgctgatcaaatcggaatatctctactttcgttatgcgctgatcattatggaatggagggagtattagctagtatatcggttaactagaatatatgtataatatgtatattagaagtatagaaatagattttctttctctttctttccacttagcttagataatatattatgagaatgagtagttaatgcttgtgtgtcactctacccttggattatcttaacccctgcttagaatatgattatcacaagtaatatataaattattagttgagttctctctacatgatcttttcacgggataaaataaatatgatacccttggaatactctcgggtgaaatgctacaatggtatatccgtgcgcttgcggatgaactctctaaccataatataccagaagtatttctgcggcattgctggaaattatatttctagtaatgtcgttaagaaataccaacagcctccactaccaccgccgctaccaccgcccgcaatgacagcatcctccccacccacaccatcatcgccatggtcccacccttcataacccacaaagacgtcgaactggaggcctccaggaggacgcgccagcaatgctgcctatgctgctgttgatggtcattagcgatcagtttcttccgtcaatattaccgaaatagaggagaactagttttgcttgtaatgcatatccatgttagaataataatattccactagtattaggttcactaaccttttgtagagaataatcattaaatggaggagaatcgacatcaattcagacgatcgatcaatcggacgatgtcgagaattagacttatcaatgaacgg

SEQ ID NO: 61535 - DNA, 11052 bp, Oryza sativa
taattgcatacctattggagaacctccatgcttttttgtaggacgacctttcggagagttcttcttttgtgcagctttcgctaaaagcatggtcaaccttggagaacctcttccaagcatattaactgagaaaggatgcataacacaatattcataacaaaagcattgtagcaaatgtatgtcacatgcaaccaccatagttcatttataacataatatttgtaatatgtcgtagttattacagctcacaaaacatcaaaaaaaaatcaaatatactacttattacaacccactaattcctatgctgtcgatagtcattccacatttgatgtgctatcgtgtccctcaaaagattcccttgattagtgctttgatcattgccttcatcaccatctggcaggtcaacataattgcttggatggatattatgtggttggttatttaaccattgctcatccccattcagtgatcgaataatattatggaacactgcagcaaccactggtatcttcacttggttattgattttgtggaaagttgcaactttgaggatagggaagcgcttctttacaacccccaaagtcctttcaacatgattcctcaataccgcatggcgatggttaaataactctttgtagttttgaggtctacgccgacctaccccatactcctttagatgatacctgactttacgatatggtgcaaggaaagaattggtgttggcatatccaccatcaaccaaatagaactttccagggggtacttggaagcctttgtttactgcagaggtaagaaccctggcatctgtagccgacccctcccacccagtagacatgaaagtgatcttcagatcaaaatcacaagctatcatcacattttggctaagagtatttttcctatttctaaatggagctgctttgtcagatgatatagatatgggtatatgggtgccgtcaattgcaccaaggcaattctgcagcaaaaaaaaaaccacatatgattttctaaaaatgtaaaacagcatattaataaggatataagtgtttaggtaagaaccttgaaatagggataaaatctaggatctttttctattttccaatgaacttcattaggatttggaggcttcagaaaccgcttcgagagcgaagggacaactgagttgaagaaatgctttacgtgacgatgaaagctatccccactgtgcccaaatttctcttgcaaatcctcaaatgaagcattgtgactaagcatgtataagaagaacgccaacttctcttcaactttaatcctagtatcatcgaccaacttttcagttctaaggtaattggccaaagatataaatatttccggctccatcctgaatgctacccggcaattttttacatgcccttcaagcaactcccgaacacgctcctcgcatgttatctttgatgtatggcatcgcttcttttcccttgctccactagaactcaacaaatgtagtgcagggaaaataaacaacatcatatcatcgtcctcctcttccctcctctttctagcgcggtctcttgctctcatatccatagtagtactatagatagcacacaaattatttacaattttgcacttagcacagcaacaaaagatctagaaagataatcacaaaagaatcactaaactatgggaattaatcttaagaagatccaagttatgaagcatatttaaaaattgatgggaaaaatgaaaagaacaataagaatctttttttcttaaagagtgcacagtgcaacaataattgatggcagtagcacttacagaatgtatgaaaaagcagattacatggcagtagcacttaccaaatttagttgtcaaatttagttacagatgatcttttattagttagcgccgagcatgttcagaattcagaaatctgaaaaatctgagaacttgtatattctctatgcttttttatacaaatttaaccgtatgttgaaaggaaaagaaattttggtctacattacaccacttcttttattttttatatttacatcacaaaatatagataaacaacttaaagcaaagggaataaatagatctagtacctcttggagagggtacaaggtcccaggaaggagagggtacaaggtcccaggaaggaggaggttggtcttctccaactctaatgggtgcacgtgcaatctacaaaacaagcacaacttatacacatcactgacaactcaaattcagaactagaactagagttacataaaacccagaactagagctagctagcatcaaagtaggagctgctgtttttcaatcaaatagaaggatctcatcatcaaatacattataacatgggtacagaattaatcacccaatcagctcatttaacactagacatattagtgcttgaatagctatgataaacatgttttatacaagtatcatgttgaggaaaacaaatctgttagtctaatgagactaaaagctactgttgttagtttaaaataaatcagtttaagtatacattactgtatatactactgcaatttgttgctagtttgtttgtgaaacaatgacgatagaattagtttacaattcagaaatgttaaactaattacagagtacctccatagctctacaatcctcaagattaggacacccaacccttgtaatttccaaacagaaatataaccaacaaccacaagttgggactccgaaagcaccaagaactgagtacttcactgtaaaaacttgtatagtcaattttacaagacatgctcaggcaagcatcacagcatcagtcacactaagcaaaactaatcaaggcaagcatgtttccatagccaccgtacagctctcgctctcaccatctgctgcctcaaagccaccgtgaatcaagaactcaaatcaagaaccagagttgggcggtgcggtggcggcggcaaatcaagaactcatccccacccaaccaagaaaaaaagctccacgcccaaatcaagaactcaccagatcgagcaggatacgaggaggaggacgacgaatcgctaagcgctcactcaccaaaaagctgcacggcgagaagagagatggcggcgacgacaggaaagggagaagagaagaaaaccctaaccctagctttgcaagaggagggaagaaggggaaaggcagcgtgctcaccggagagaaggtggcggccggaggagagagccgtgttgtcgccatcgccgtcgccgtcgcctccgggtcgcgccgcgcgccgccccctccgtcgcgtcttcgttgcgccgccgcctcctctcgaggaaattttccacgccccaggagtagatgattttttcccaggcctagagaagagggaaaccccatggtgggccgggctaaaattcacggtagggcttaaccaaacgcacaatttcgcatgggccgggattttttcctcgccggggtgatccacggggattgggccccgatcccggccgggaacagcccaaccgaacaaggccttaggaggttcgatagtcttgagtgttcgtgcgtggttcacacggttgtttttggtgggcggaagtcatagaggacatgtgtttgcccttggtaagttctgaacaatcgatcggaggcatggagtactagtgcaaggctttcttcttttttttttgtggggtggggtgagaggttggtgtctgttagatggatctctctccccttgagcccaacggctcaagggggccttgaaccacgctctgatcgggggcgcccaacccaatggctggtgggccccgtcaccctgcgccatataaagaggggtggatgacgggacggcacaagacacgaggttcgtcgccgccgccactccaccccacaaaccctaaccgatcgagggggcacagccagtgacgggaacacgccaccgccgcgccacgcctcgtcgtcgacaccgccgctgcatcaccgccatcggcactgagttcactgtcaccgccgtccacgtcaagcccgcgacgacaaagacgatggccggccgcacatcctcctcctcaacattgaccggtcacatccctaaaccctctcactccctcttttttaattcatctattgttgttcatccatccaaagtgttctacctgactagatctaaacctaggtgatccaatagacaaccctaacaatggtatcagagcaaccctagggcttagatcggttcggggatagacatccacatataagaaagaaaatccaaagatcaaaagaaaagaacagcacacgatccgtacgggtcgaaaagaaaagagactcacctaccgccggcgccggctgccgacgcgcgcgggagagaaaagagggggcggcgccgcgccgccggctcgccgggcgccgctgcacagccgcttgacggtggcgcactcactcttgggtgagtgcgcatgtcggcgaaggggggtgcgacagcaccgccgcgccgtgccgccgctgcaccgtgccgccatgccgccgcgccgtgccgccgtcccgctgtgccgtgccgccgcgctgtgccgccgtgccaccgcggctagggtttcggccggtgaacggctagggttttcggccggcggactgggtggtgtgggtgtttttgtttccccgaaagtggcgctcggccgtccgatcgaaaccctagcgatcggacggtcggtgatggctgggctgattttggcccaagagggcgcgcgccgggggctcctttcccggcccaggcccaggttgtggcctgggggggggggagggggcacccacgcgcgtgaaagcatgccgtgggccgaccggctgcgccgcaataagtttattttaggtccctcggccgaagaaaaaagaagtttaacaaatgtccctatttcagaagctttttcaatatgtttaatgattgtgtttatttctaagcattttgaaccaatgtgaaaattgtttagagaatagataaatgtgagaaatgcttccgaacatgtattttgtatattttcatgcaaattacaatagaatttgaattgtttttgcatgttttacctctgtttaaatttgaaccaacgggagaatttttacagagtaaataatagagtttttttattgtttatatgaattgtatatagatcttccgctgcaaatagatgaaattgatgaaaattagtgtttctaaaattaaatttcgaatcaacgggagattttaattttaggaacattaactatatgctatgatgttgtaattttcggaccaacattgataattgcaatgttatagttatggctctatgtgttatgtctattttctgcccaatggtgatgtagacttaatacataatattttttattgttaattttgttctcacaatacatgattatctcaggtggctactccttgatgggttacataaaagatattccgaccctaacaggagataactacagagaatggaaaagagaactcgaccttgcttttatcttgggagaggtggactgggtgttgactaccccatgtcctatagaacctgctggtggctactccttgatgggttacataaaagatattccgaccctaacaggagataactacgagaatggaaaagagaactcgaccttgcttttatcttgggagaggtggactgggtgttgactaccccatgtcctatagaacctgctgaacttttcagaggtgaaaatgagtcaaatgcggaacggcaaaagagagagagggacaatgcttccctcatcatgtcgtatgaaattgaacatgcgaaatggtccttagccaacaagaactgtttggctgcggtaaagaacacgattgagccaagcatattgggctcattcctagagtatgacactgtctctatgtacctcaaaagtataaagagcaagtttactggttcttcaaagttttatgcgacacagctcataaagcagcttgtaacagagtggtaccatggaggtggtgtaaaagaccacattcttaggatgagcaacatggcttccaagttaaagtaaaaagatttgggcatctcagatgactttctggtccatctggttatgtcctcattgccagagaactttgacaactttgttgtcaactacaaagtaagtctagaaaaatggaatcttgaagagctcatctctaattgtgtgcaagaggaggaaagactcaaagagaccaatggtggctccattaaccttgttaaagataacaaggaaaagagccacgggtcaccctcctcaaaagcaaaacagcctcagcatctgcctcagcaacaacagttcacagttgagacaggatcagtgtctccactgcaagaagacaagacattccaagaaagatcgtcctgacttcctgacagtgatcatggcaaagaaaggtgagaacattattacatttataaatgaatctcattatgattggttattctagatctacatggtggatttattctagagcaactattcatatatgtaattgtttaaagggattctgttcgatgaggactacgcaaagaagcgaaagatccattagagttgcaaatggagttgaagcaaaagttgaagctattggagatcttctcctagagctcgcgaatggcttcacacttttacttcgagatgttttatgtccgttctttgcaaagaaacttaataagtgtatccaaattggattttgatagatatgattgccattttggaaatggcaaatgtgaactatggtataataatgcatgtattggtcttgttgtgttgcaagatcagctttatttgttatctctttctgagaatgtgaatgttgtgtccttgttgacaaaagaaaaagaaagcgaattcctgatgtctcatcaaaattatggcactgtcgtttaggccatatttcgagggggaggattgagagactggttaagaatgtaattcttcctccattggagttctcagttttggaaccatgcatacaatgcatagaatgcatcggtgcccaaaacactgtatgagctatggatcctccttgtgtgggggagtcctgcagaggctaaagtatttaacccaaatattgggaaattggatcccaaaaagtaagctgccattttattggctatcctgaaagatcaaagggttatcatttctactgtccaaacagttaaacaaagtttgtagaaacgagatggaaatgattaggggggagctcggtagtacgagaaattgatcttgaggagaggcgggtgtctgtacccgctcccttgactcaggaacctttcttctctctacctgctgatgttgtgcctgcaatgcatgatgttgcggtaccaacacctattgttatctctcctgtggcaacaatgaatgaaagtgaggaacctgttttacaggattcaacagaaattattgccacaccagaggaggagctgcaacagcctcaaacagataatgtgccaaatgaggaggcccctagaaggtctgaaagagtcagaagatcggcaatccgtgatgactatgaagttataatatagaagagtcgcatatggaggatgatcccacctcatatgaagaggccatgagaagcgctcgctcatctgaatggttggaagccatgaaagatgaaatgaaatcaatgaaattaaatggtgtctgggattttagaagaaattcctaaaggtgtcaaaatagttggctgtaaatgggtctacgaaaccaaatatgactgcagagggaatatagaaaagtttaaagcgcgacttgtggcaaaaggcttcacgcaaagagaagggattgattacaatgagacattttctccagtctcttgtaaagattccttcaggattataatggcactggtggcacattatgatttggaattacatcagaaggatgtaaaaagggaatttctaaatagagatttggaggaaaagtatacatggtgcaaccgaaaggttttgtcatgaaaagaaacgaaaatacgggatgccgtctaaagagatccatttatggattagaacatgcttcgagacaatggtacttgaagtttgatgggacaataaagaaattttgggttttcaagagaatgtcgaggacaactgtatttattcaaagtttaaaaatagtagatttattttcctaattctgtatgtagatgacgttctactaactagtagtgatgtcagtctattgcaggaaacaaagaaattcttgtcctcaaactttgacatgaaagacctctgtgaggcttcatatgttttgagcatagagattcaccgagatagaacaaagtatgcattgggactttctcaaaaggcatatatagaaaatgtgttgaagaaattcaatatgtacagatgcagtgctacacctgctcctatagtcaaaggcaaaaagtatggggcatcgcaatgtcccaaaaatcagtatgagctcaatgaaatgaaaataaagccatatgcgtcagctgtaggaatcctacagtacgcgcaagtgtgcacacgacctgacttggcatttgttaccgggatacttggcagatttcaaagtaatccaggcctagagcactggaattagtaaagaaagtcttgcgttatttgcaaggaacaaaaggcctcatgctgtcttacagaaaatcagaatcgctccagatagtggggtattcagattctaactttgcaaaagataatacaaagtcaacattcgggatatgtgttcaccctggcagtaggagctatttcatggaaaagctcaaaacagatcaccactgtaacatcctcaaattttaaactaaaatttgactgcatcatgctggcttttgattaaattagtgtgttttaaaaaaaatctatttgatccttaattggttcaagtgttacttccttagaaccttgccaatttaccctaattatttcctttattccaaaccttagtgaatttgagcaaattctctcaaatttcaaactatagattatttctttagtttaccctaatattagtgaggattttctttactccaaaccctagtgaaacccttccaaattcatagtttaaattcaaatcttttctagggaaattttcaaaaattcctgaaaacactgttcattgcacacaaggtgcttgatgaaatgcccagcccacctagagcagcccaatctacccaatcttttacaaagtttagaattgatcctagggggccacaccccactcaaaaaccgtggatttctttgcttcttcctccccttcacgcgcgccccccggtcatccgacttagccgcgcgccgtgtcgccgcgcgtaagcctcggggccgcttgcgcgtgcccgatcgccttggcgtgccgctagccgtccgacgccctcagactgccattgccgcaccaatattgatgacgacaaagccgggatgacgaccgccgcaagaaatcgccgctcgacaccgtgcgctcccatccaaagccgccgccgagtccgattttgattctacccagggtgaatcgcaccaattcttggattaaagttagatggtggtttcccctctcacaattcaaatcattcacccccgagccggccgttttcaccctcgccgccgccgcgcgtcgcgcccggattggcgccaacacgtcgctagccgtttctacttgcggtcaagccaatctttcaccggtaagtattcaaacgtggcctcccgccactcaaatttatcttggccgccctctcacagcccttgccgccccagccatatctaaagttcgagctcatccatggcgatgacggtgcccgagctcatctactccttctagccctacaaataggacctcaatcccttccttgttcatcatcgatcatcaacaaccatagtcccacaaccccgaagctctgcttcaccaatccatctcatcaatcactttcgcccgtcggtcgaacaccttgtgcgcgatcgacaccacacccctccatccatcctccgccctaaatatcccttagaacaccttatatcaaccatgttctagtatagtagaccctaaccgaagccctgcgtcgagttttacctcgccgcaccaaaccgagcaccgcctctcccgcgttgctctgttcttcaccgccacgaagtttttccggccgcaatccgtcgtttcaaccgatctcggtgagttctttcgtttcaaccatctacatactacctagagtccatttttgcaatcggtttgcactagcatgccaccctctgggctgccgacgtgagcacggccgccgccaatggaggcgctcgtcggcaagtattctccgtgccttgccaaaggtcggcaagctgttggaatccatctaggcactccgtagatgctctagaacccctcccctagccatatctaactcacataatcccaatcgccttcacggcctaaccatgtcaccgccgccctagccgctaggccgctcgccgtcgccggagaaccctagctccctcccctcctcggccgcaacccctttccccctctagcaccgccgcaatcccaaaccctagcgccgccggctgcatttggggatcggccggaggttgaagaagagaagagagagagactgacaggtgggacccgcacatagtaacatttcacatttaattgattttcaaactttagaagcccatatcttttaaaatataaatccaattccagtgaaacttggaccaatattcttctaaaatcattctctatcttttgagcccctttttgttatttttctattttattttattttctctatttttcttatttttggattttatttgaattccttttgaatttgaattttatatgcttaaccctaggtcttgaggattcttctgacacattagataatatcaatcaatctcaggacatcgagcaaggcaagttaccatataccttttgatcatttaagcctattttttacaaattatttatttatagccttctattcaatattctattttatatgcataaatcaaccatagaaacccagataatttagtgttgcttactttgcttacaatctggtttaaataccttatacttagattggggtagtacgtaagatttggttgattt

SEQ ID NO: 61536 - DNA, 1551 bp, Oryza sativa
cagtttctagaatggggacagacctagttattatgttaattagcaatatggcacctctgtatagtggttcttatttttaagtcctcgcgtaggaggcaactatagccgcgaagggcaactttaaccattaccatgtacaagtaaatggtttgtgatactcgagtataaactatatggtatatttctaaaccctgatcgagatgacgtggtgtcatacgatcagttccccttaaatacctcgggaacgccagaactcctcttgctgctgttaacaatacgttcagggcatatgaggatataagtttatggaataggtgccacaattgttaataacttaatactgagctatgactaaagccgatgattatcagcaagtcgtggactgtgggtaaagcgtacatctgctgcagtagaatatccttgaaactattcgaatagccgtactcatggagttgagtaccgggattcatatggtaccctggttagaaatctaaagtctatatgtttataaattcttgctataactcttccagattgtttatttctactttttgcaaagaaccctactatatgccaatgcataacatattttcatgataacttgctgagtattgtgaatactcgttcttgctctcataacccctttttcagatctgggttaagaggacccttatgactattactacgatgaccccgataatttagagaatccttaaaggttatacctccctagtcagaatgtataaaaacttccgctgtgtattaattctagttgatcaattagatgagtacctattattgtaaaacccttagtattgtaaaactttatcgtatgcaatgaagaaccggttatattgtatgtatcgatatctactgatccagggattgatacattaatttatgtcggatccaagttgttagttccgagacccgacaccactgcagggtctactatgtataccgagtttatagcatgctatgaggcaacggggcaggtgaactggctaaagaaattcacacccggtttaaaggtggttgacagtattgagaaacaactaaagttatactgcgatagcgaacccacagtaatgtactctcacaacaatcagtcaagtggtgctgccaaacacattgacataaagtactatgttgtgaaagacaaagtccgggatcaaacaatcagtctcgagcacattagaacagaaaggatgctcgcggatccgctcatgaaaggcctacctcccaacatgttcaaggaacatgtagcatgcatgggtttaagggaagcctaatgaatcctggactatagggcccaaaagttaaagtatctgtttctgaatagagatgtgtatagtgaatagagatgtgtatagtggctgtcgaatccatcagtaattaaccgtgacgatgaatcatgctctatatataaatctgtgatggaatagaaaaagctaaaagaaatagtgagatcaagggggagaatgttagatggatctccctccccttgagcccaacggctcaaaggggccttgacccgcgccctgatcgggg

SEQ ID NO: 61537 - DNA, 2146 bp, Oryza sativa
ctctgctgtgaagacctgaaaacaaataaagtaccttttcagtgatgtaaattttaagaacattttggacagaggacatatcaactacatccattttcccatgcagcagagagaagggggaagggggagggggggggaggagtagaaaatgtgtgctactgcctactaggactaatcatgcctatagccctgtaaacaccatttgttgtgcaataataagatgcaaatggtgtctcagtgctcagcagcctaacctcaagtcatttgcaaaccagctaagcatgctgaatttcagttcccatggtactttaattaaaagaagaagaaactagcatggaataaggttcagaaacccctctacgactgactactaattacctaaagttggcatcaataattaaatatgccaccagagtcatattttagattatttatgtacaaatcagctggttatgaatcatatagaagttgttctgcatagtgtgggggaaacattaagtaatttacaaaaataacaatccatttttttttcaaatgagtcgaaatatgttttgcacaagtgcatgtatacatacatgatagatgtattatgtgaattaggcatggttaatccaaagcaggttattggtcacaagtcataaccagttattttcaaacaagtgcatgcatcaaggagcacaccaaacacagcttgtagtttgcagcagatagaagtgattgtaactgtgttggaaaatgatagtgcttcaaagtgagttggtggcggatcagatggtgttagaaaagaaaaggatacaacagactacgatggattaaacaactgaagtctttcaactgtatgtgcattgcacaacttgagaagaataaataataaatgtcagttactaaacccacagatcagttccttctttctttttatttttatgtgtaatatgaacgcaccaataatatgttttgacaacataatcaaaacccaccaataatatgtgaaaacaatgccagaatttttagatcctcatgtctcagtaggagcaggaggatgtacttgtatttttggatattgcagaatcatcagttaaatttaattatgtgttaaatctcaattattgtttagatgtatcaactacaatattaaactgcaaatcaaaattttcagaaaactatttcaatattgcatgactttcagttcgttatgaacttcatatacaaaaaacctattcagctctcctctcaaattatgattgcaatatcaattccgatatcttatatacactttttcagatacaaagagggcattataatttttagaaaatcagagcaaaatagccgcaatcaacaaaaggttttccatcatgcgatggaaactatctccaggaaagcattaatcatgctattactagacctctattatctctggcattgtgcaatcattagcaagtctcttcacatccccacctgcagtttacactaaacaatatcactatctgagcaaagcaacgattgttaacaacaccgttatactgtcacataaactgttgaacaacaaatagaaaagaaatatgagctttaaaagtaaaatcagatcaaaaacacacatgacaaaggtaaaaaccttttgcacaagtggtgtgctcttgtccttttgaatttctgctgcaacacccttaatatccatccctgcattggtcatgaatcttatttgcaaacatctccaatgctccggaaataaaaaggcgcaaaacagcatgttcaatgtacaaggcccagctttttcaacgaataaaaacagagaggtgatcaccagctgagaaggcacggggtgaactgctttccacaagaacacacttgacacttggatttgtttcccattcatcaagaaatgccttgtatcgaaggtccatttctgcaatcatatgagaccttaaatatgtgagtgaacctcagaaagctaccaatgtactcgatacacagttggtgtgcatcatttcttcagaaggttagtgtcacttatatacaaaatcaagaagggaattgttgagtaaaaaacaagggatgcttgttaaaaataaataaatatgtaatctacttttctgcaagtgaagaggacataactatcaataccataaatttatggtgtatctattag

SEQ ID NO: 61538 - DNA, 3220 bp, Oryza sativa
ctgtcaattttcaaaaacgaaccttccgtctgacctgtttcactacatcgctaagatttgatttaaaaaaaaagaaatataattaagattcataatgcccaaaatacccttgaggaaaccatacccatctttaaccctatccacatgtctctccatgtctctctcctgccagtgagttgcggcggcggcgatgtgtgcagcggggagggaggtggaggttggcgcgcgaagcagggagggaggcggaggttggcgcgcgaagaagggagggaggggcggcgcgacggcagctggcgccggagggaacgcggaggaataaaggaggcgacgtcagaagaagaagagagaagagagaactgacgggtgggtcccacatgtaatagggtcaaatgactaagggtaaaatggaccttttgtgcttcagttaacaccgttagaagcctttaacagaatagggtcataccgtatcttcaattttaaaaagaagggtcaaataagcaaagttgaaaaaagaggatcaaattagtagttagctttcaaaagagggtcaaatgcgcaattgcccctaaaagttagtactaatattataaattatttgacttttttaagtcaaactttgttaaatttgattaaatttgtagaaaaatttaacaacatataaaatattaaattggtttaattaaatcttacattaaatatattttgataatatgtttgttttgtgttgaaaatactgctatatttttccataaacttataatatgaaatgaaggggtactggtttaccgctaatgctaaaagggagcaggtcctaagcgtcatccacaatgcaatgataattaggccattcatagtacagatcctctacttacaggtcactaatatgtggatccgctggtagagggtccatatgtcagtgacacaagttagaggatctcaatccttgcagtgaggtggcgtttggtctaaatacgccactttcgagattcccttccacgtaagcagatgttgttcatagtgagtccctcgtcctcctgttaggatttggtggccttgttagagaaaagtagaaagacgtccagcgaagcagaaaacatgagagagatgttgccatcgcggagctcccatctctgccaccctgcttcgccggtttgccgttgatcttgcctagccaaaggtgcctccggcagggagtgccctcaataactagatctcgcccgatccacctttgagaggttgctgccttgatctaaattgggaggacctcgtcaacacggtgccgcttggcatcctcgctaccgccataatgtggagagaggggagaggaggaggcaccaccttgatccgcactggctaccccgatgtgcgaactgtcatgagtttgtcggccgcaccgccacaaggctatccacctcgctctgccgggccgagcgcaaatgctaacattgtcgacctgcgctgccccgtctactcattgctccatctgctccattaggaagaagggggatggttgaggcaagaaggagtggcaaaaagggcatcgacaagagaccgctgtcctaatctgtgagttgttaggagcttattgggagagggaggtgaggaggttgtcggcatcatcgggcagccgggcaggagggatagtggaaggagatgggattccattgttctgtatcacaaacaggtggggcagcagagaacatctttgatatatttttgtttagaaaaaggtcctttatgtaaagatctaactagaaaaaaaattaatatataacaagggttgaaacaaaatatgcatgggcttaaatgacaaaattgcatgggccaatggaaacacggtgcaccgtcgagatgtgtggttctatttactttcttattatgtagaagttgagtatccagttaggtgtagactacaatgtgagtactcttatctagtggtctcatgttgccagctcggagattctaatccagatcagcactgcgtgccccacgagagcgctcgtgccttgcaggggcacggatgccttgacagccgtgcaggtctcctcctctattgtgcacgtttctttcgcgagatagctagagagagaagttgcggccgaaaagggaaaagaaaatggccggagaggacagagacaggtctagaacaacctttaaacttatcaaaatgaccttaccaccgtcaccgtcaccgggtgttgagctcgctagttggagctgtctagttccttttacgcggatctggaagtatacgacgcatatctagtatttaaacggtggcgatactgatgcaacacctacacagtggtgctcaatgattggatgaggcaacgccaacaacaatgatgcgtggaaggtcggagacggtggccctcgcctatgttcaaccttctcattgaccgcgcggtgcactaggcgagacccagcatcaactccaccaatcgccttcaactgccattgccattgtcgctgggttttaggtaggagataagcaccatggggaggggagaggagaacgatggcggtggaaagggaataggataggtgccagtcggagcccaaaggggatggggggacgggggaggggggaaggggcacgggagagctaataacctagagatggggtgctatgtgcaagcgtgctatattcaagcgcatgccccctattgcttgcctagctgcttaccaatagtacaagcgtgctacatgttagcttatgataagtgttgactgtcaaaagcctagagacaaggacaccgaccctttataattgactaaatggtaagatttgtttgaattaaagaccgtgttttttcatcccatcccagggcaccaaaacctaatggttgttctatactcaacttgtccaaacattcagcacatgtctctcctcacattacattagtgcttgagttgtttaactaggcaagaagcttaatagccgagtaggcagacgtatgaagagaagatcggtccaatgtataatactctagacttattttagtcatcgtaggtaaatttagtaattagtagcgaggggaaaagtctaaagtacttctcgttaagaatagaaaattacgtagtaggagtatcagtgtattaccacgtgataggtaagtgatattgaaagtataagacttctcgattttgttgacgtagttaagagggtagaaattaattaacttatttttattaattttgaatgctaaaaattatgtta

SEQ ID NO: 61539 - DNA, 7813 bp, Oryza sativa
taccattacaaagccgatcctcccatcaaatccggtaatccgctcgagctcccatagtcttataccatgacggagccgatcctcccatcaaatacggtaatccgctcgagctcgcatagttccgtacccatacgatgactaacgaagccgatcctctccatcaaatccggtcgaatctttctccatatccaaaattattgagggatttttatccacttgatcttccttttccttttttttaccaaaattaaagcaatcagcaaaacttgggataaaaaatgacgacgattaaatggttcatcaaaatcgaagcaatctgcaaaacttgagataaaaaataactatgattaaatggagattcaatctgatgaattaaagctgaatcaaaaggggaattcatggggaaaataatgagagagtagtggggaatcaattattgcaacgaataggaggaggaagcatatggggagtaaaatcaacgtggcggcggcgctgggtttggcccgataaaaaaaccgcaaaaaaatatagcgataaaagaaataaacagaaaaattggtgaaagaaaatacgcaaagaggggaaaaagaaaacggacaaagaaaacaggaaaaaaggtgaaagaaaaaaaaagaaacgggaaaagaaaataaaaggaaaaaaacaggaaaaaaaaagaaaacgaacaaaatgtagttttcttttattttcgccactttcttatggggaatcagacttttttattttaggtttttttttctatttttttatttagacggacgaaggaaacatctcttaaaatttttaagtagtaatagatacaagataatgtaattttttttattgaacttgatgattacaccaaggtaatatagaccggtggagaactcatttttattcccggttaaaaacccccactagttccggttataacaccgtgaccaacaaatcgagactaaagatctcgatcttcaagtatcgactgaaataaccggtactaaatttgcatatcaagttaaaaaaaatatgtgggatgtgagagattcgaactcaagatctctcacctcatcctacgttaccgtccctcctactacacacatctaacttggatagatattaactaaccctgtagacatcttaccggtattaaaaatatctttagtacaccaaccgagactaaagagctaccaaccgagactaaagagctagagagctctttagtcttggttagtgttaccaactggtgctaaagatgcatttttagtactagttggtaacaccaactaggactaaaaaagtttccatgaagttaaatttttagaaccgatactaaagcatatttagtaccggttcctaatctaatcaagatatttgtgattttgggtaccacaataaaagattaattctctagtagtaataactaataattactccgagaatgcgctcggcctctgcctaactaggatgtatgtagctataacagaaaccaacaagtttaaaagaaagaaagtacaagcagcattaacgactaggcaaagtttgctacagaacaccgcgacttcgtggttttagctgtaggacaccgcacgaagtcacttttgagggagcgcactatgtaaatgtggtaatttaccaagggacactacatctattaaattaatattttcgtgctgactagacgagagggggcccacttttttacacagcttgaccaaattacccctcttatctcattctgatcctctcttcttccttatctattcccatctctctttcattctctcttttacacgacagcggatgcccacttagcagcggcagcgtgtgtggcctactcggcggcggctgcggcggcctgctcgacggtggtggcaaagcccggagcacatgcagcctactcagcggcggcgacgcacgcggcggtgccaagagcgcggcctactcagtagcggcggccggcggtggccgtggaccacgccagctgcaacgtgcaggtggcctagtgccggacgagcacccgctgctccagcgtgtgcttctccttcctcaacgcgacgacctctgaccgcaaccgtcatagctcgtcgcaccggtggagctcctccacggccgcccgcttcttccccgcatcgtttctcgcgatgatggtgtctttcgtctactcgacagcacacttgaacggcggttcttggccgcggccagctcgtgctcttcgccgagcggcatggaggaggggatagagagagaagagagataggagagctgatatgtgggctgaagggcatttttgacatttcacgcgatttatctctcatcttcgaccggaaattattattttaatgagtaggatgtccaccagtaaatatttaacttttgagagtgtcttccctaaaagtcacttcgtgcggtgtcctacagctaaaaccgcgaagtcacgatgtcctgtagtaaaatttccctaacaactatcaatcgtaatattagatcaccacacatgtccctgttaaaacactcttgaccacatgctccaaacatagatatgccggcaataatcaaatcctgcaaggtgcaagctgggtttctatagtataacccaagtgcgtagccaatggatagttaaatagatagcctgcatgggagaaaaaaaatttctatcaaaaaaacatatcactccaacataacttaagcaaccagcatataacttaggtggtgtttggttggagggactaaagtggggctaaactttagtccctctcacaaaaatataagtccctatacttttgtgagagggactaaatttagtccctagttcccaaacacccccttaagcaaccagcatatagcagtcgcccctaacaagatatatatggttgcagatcttcttgaacaccccaaatccaactagtgaatttgcgtgaaatactaccagatggaataattccttactccacactaaatgggctaagtggcattcaaagaaaaagggtttaattgtcttcttcttcttgtgaataacaataattttaattgccttgtcaattatgtttacataaattatctttggttaacacaactccgcgacgaatgtatcaatggaaaattttaaccttcaaaggcacttttagttttcagagatttgggatgtcactatggacttcacattcaaccgtccattaagggttaagttccatataaactaatattgctcctgaattaaatcaatattagtgatgtgtgataataaattattccatgccagtaattttgatctagttagatctgttctctaaaacatctgcaatagttacctatttatacctaacaacactgtagaggaaagtgtactgttctcgtagggttacatctcccaatcatttgtctttccataatctaatttaatttagtaaccattcttaattatgtaggatccaagacaaaagagatctcatttcatcttcattaggctgtctccggccttctactgaacttgcgtgagcggctgtgaactcaaatacttattttgtattagctgtttccaaacatcatctacagtaagcaactgaaatagccacttactgagtaatactgaatttctaaaccaccttatctttaaggcggcatagtatgtctcacttggcttttttttttaccatcactctaacaacaaaaaccagagcaaaaatagtagattttttttaaaaaaattcctctcgctactgtgaagtacttcattcatgaaaaaaaaactcaatctaaatgggatgtgacatactccatccgtttcacaatgtaagtcattctagtatttcccacattcatatttatgttaatgaatatatatatatatatatatatatatatatatatatatatatatatatatatatatatatatatatatattcatatacatgaatacaaatatgggaaatactagaatgacttacattatgaaacaaaagaaagaatatagtataacaaatctggatacctttatatctaaatccattataccaagttggtcgtgtcacatcccccaattagattgggtcttgttttaagacgtgaataaacactaagttaattagtgtgagccctccttcaatagatagaaattttcctttccaactatggaagagatgcatatgcgtgtccaaacaccaaataatagtacattagcccgggagcaagccattggagcatactccctccgtccaaaaaaaaccaacctagaaagagtttgtttagattcgttgtactagaaagggatcctttaaggttgtcttaaaaatacccaacctaaaaaagatttgtccagattcgttgtgctaaaagagaaccctattagacttgtttttttttatggagggagtacgagactaactacaaaattttcagtctagacaatgaccaagcgggggggacatatgtcgctggactcaaactccacgacggaactggcaaacagacgacaagatctcgaccgaatctgatcgacactgggtaaggtcaggaagaacagtcttactcgtcttttttctaatccaacttaagctcagtgatgacgccaactaatctggaccgtgtttagttgtttaggtgtaaaaattttaaagtacacgggcacacatttaaagtataaaacatagactaataataaaacaaattacatattccgacggtaaactgcgagacgaatttattaagcctaattaattcattattggcaaatgtttaccatagcaccacattatcaaatcatgacgcaattatgcttaaaagattcgtctcacaatttacatgcaaactgtgtaattggtttttttcgtctatatttaatgctctatatatatatatatgcccaaacatttaatgtggtggaatttttaaaagtttaaaggtaactaaaagcaacgctggttgagttcgtggatgcgacactgccatctcgaactcttgtgcactcctctcgctcgccacacgaaacgccacaccactaacagataaaaaatagctggccaattgccacccattttgcctatgcgccatagctgagctgagctagagctctcactacagctagctaaccgagagccacacgtcggtgactcgtgacctgtggagccatgtcgccgacgccgaggccgcacttcctcgtgctcacgttcccgctccagggccacatcgcgccggcgctccgcctcgccaggcgcctgctcgccgccgcccccgacgcgctcgtcaccttctccaccgccgccgccgcgcaccgccgcatgttcgccgagggggagggcggcgacggcgacggcaggctcgagctcctcccgttctccgacggcaccgagaacgggttcgtcaagcgcggcgacgccgcggagctcggcgcgtacatggcgtcgttccacgcctcgggccggcgcagcgtcggggagatggtcgacgcgctcgcggcgcgggggcgccccgtgtcgagcgtcgtctacacgctcctcctgccgtgggcggccgacgtcgcgcgcgaccgcggcgtgccgtccgcgctctactggatccagcccgtcgccgtgctggccatctactgccactacttccacggcctcggcggcgtcgtcgacgagcaccgccgcgaccattcgttcgtcctggagttcccgggccttccgccgatggcggccggggacctcccgtccttcctcaccgaagccaccgacccctccgactacttccacagcatcttcaccacgttccgcgacctgttcgacgccctcgacagggagacacccaaggccaccgtgctcgtcaacgtgttccaagaactcgaggcggacacgctcgccgccgttggggcgtacgacgtgctccccatcggcccggtgctcccgtccggcgacgacgccgcgctgttcaagcagaacgacgccaagtacatggagtggctcgacaccaagccggccggctcggtggtgtacgtcgcgttcgggagcttaaccgtcatggcgaaggggcaggtcgacgagctgctccatggcctcgaggagagcgggaggccgtacctctgcgtggtgcggaaggacaacaaggccgccgtggcggagacgggcgacgcgacggcggcggcggcggcgcgcaggaacggcgtggtggtggagtggtgcgaccaggtgcgcgtgctgtcgcacgcggcggtggggtgcttcgtcacgcactgcggctggaactcggtgctggagagcatcgcgtcgggcgtgcccatggtgggcgtcccgcggatgtcggaccagcagatgaacgcgcggctcgtcgagcgcgactggcgcgtcggcgtgcgcgcggaggtggacggcggcgacggcgtgctgcgcgcggcggagctgaggcggcgggtcgaggaggtgatgggagacggggaggcggcggaggtgcggcgctcggcggcggcgtggaagcgagcggtggcggaggctctagggaaaggagggtcgtcggatcgtaatctgacggccttcgtggagggtgccagaagtgtcatttgaaaacgacataatttgaaaacgttataagatgtattttaatttgaaaacgatttggggatcctagggtcttcccttgttggtttggctgtttgttcacttgtatgtacaacctctactgaactactccctccgtcctatgatataagggattttgagtttttgcttgcacggtttgactactcgtcttattcaaaaaaatttggaattattatttacttttttgtgacttactccctccgtcccaaaaaaaaggtaaaccctggattttcgtatccaactttgactgtccgtcttatatgaaatttttttataattcgtatttttattgttgttagatgataaaacatgattaatattttatacgtgacttgtctttttaatttttttcataattttttcaaataaaacggacggttaaacgttgggcacggaaactagggtttgtctttttttggacggagggagtactttattatctaaagtactttacgcacaacttttcgttttttatatttgcataattttttttaataagacgagtggtcaaacactacaagtaaaaactcaaaatcccttatattattggacggagggagtagctgccaactgggctctcattttttatgggcttttgctatattgttgggccaaattattaccaccgaactgaactacctgttgggtaagggaacatgggctttctctggtgtactttctactttggggtcccgtgggtaatataccatccctgccctcgcacccagaaatgaccagggcccccacccgcttcccctgcgggttagaattcccacccgtccctgtaggggcgggtactcaccgggtccccaaccccaaccccacgggagaaattaccacccatatatccaatcgttcgtaggctcgtagcatgtttgttctgcacaacccagatatctaattgatgacagtttgctatagttttactagctaggctatttggtgagaagccgacaagtgaacggtgcctacacattcgtagcccaataccctacctatgtactcaaccaagttcttctttagtccatggccatgtttggatccggagggctattaaatagccctccggaatcttgctaggcaagagtctaaagcggagattggtggcgtacctaggtagggaaccgggcggcgattgtgtaagcacagttcacttgtcggcatcacaccaaatagcctagctagtatacctatagcatactgtcatcaattagatatctgggttgtgcagagcaaacatg

SEQ ID NO: 61540 - DNA, 1100 bp, Oryza sativa
agcaagattccggagggatatttaatagcccggaggatccaaacaaggcccatgtatacaatcactcctattccttcttcagtccgtatcctatcgctcgtaggcttctaggtggcagcagaggtgcggcgtagggcggcgacatggaagcgagcggtcgaggcggctttagggaattgaggctcgtcggtaggggtgtgtcagggttacgggttaggtataccctttaccctttgatatatgtcacatatcggtatggcatgcccacgcgcatacggatactctctacatacactaaggaaatccttcacagagtttacggacgaaaagagtcctactcggacaagactgggtcgtcaatgtatcgtgtagggtttgatgtctccgagttctacttggaaaccgcctgacctgcgatataaaagggaccccccagggaggacctaaggcatcaaatctcaaagccaacacaacccccacagatctagtcgaaccaactcgactacgatcttgtcggatccatcgaattccattgttccctttgtaacctgtgttttccatcatataatcccacgtcaactggattagggctattacctatcaaggggcctgaaccagtataatcttcgtcttttgtttgcttgatgtcgtattacgtggacccttgtaacaacgtactccaataccctctatatccggtctatgggtatcacccgtcgatagtggcgcgccaggtaggggcacttggtgctcaaggttctactactatgtcatccagcttcgtcgacaacagcgtcaacaccaacctcaaccaagtattccctgcttcaacaatgctggtgtagactcaagtcggcaaaatcgtcttcccggtttacaccacgatgccgatctcagccggtccatcagtgaccggaaacgagaacgcagtggatacaaaccaagacgactccatgtcgaaaaatcctcccgccgaggcagagaacggaacatgaacgacatctgagctcgagaaggattccaaggcgaccaaagcttgtcactccgacaagaaccacgagccgacgaggatgacttccaaagcgacaaggtcctggtgt

SEQ ID NO: 61541 - DNA, 879 bp, Oryza sativa
tactgataatgggaaatggggggtgggattgggattgggaaatgaatgaagggttaggattaaatagaagagggagaatgaatggttaggatttaaagatgggtgggaaatcatttccctttcccatttgccaaacactacctgaagttactgaatttggtcttgttggtggtgatgcaggctgatccagagttccggccgtccatgtcggaggtggtgcagtcgctcctccgctgcgtgcagcgcaccatcagcaacagggggatggccggatacttaagcaactcacagcggagcgacatctccgattggtgatggtgatgcacttcaccgaatcattgccgactttgattgaggtttatctgaagcaaaactgcccgtcaagtcgttcgtgccattgtacaaaaagaaacggctttgaggttaagagtaatcaaattggttaatttttagagaagacggcaagaatgcgttattgtattctacttgtagtgtatattgtactgatttgttcttccccctttgttttgtttttatcgctctaaggagcacatgtaaaagtctgatactggagtagatagttagtaaatgaatacacatgtaaaaggcctctctacctagccacctaggtaacagcaagttcagtaacaggcattgctgacatagcatgaattcccttttgtaagatgacaaaacatgaattcacaagctcaatgatcactacttatgagaccaaatctcacaacacagctaaaaacagccgtttcctagcaacagaagatccagcttaactagcaaactatagatgaatttgcagaactcatctagtcttgcacatagtacccaaaccgagtatacattgtcacacagattacaggg

SEQ ID NO: 61542 - DNA, 1981 bp, Oryza sativa
aattggcccgaaatttagaatcacagggtagcactgaattcatcttagtatagctatagttgcacgcatggtctgaccaggcagccctggcttttgctgcttctcaatctctagccaaagcaagatcacttaagttctggtttaacctttatgcctggagactgggaagctgcttcaatttgaatgactagtcagaacttttgagttttggtggcactgaaagggagatgctgcatttttgctgtttcttcaggagatatttcaatgccataactcttaattaaagagtttatgttttttgtttttaatttacagacactacaagattgtgaagaaagttgtcaacagcaccaaagcaaggctggagatccattacctgttaatactacaaattgtatccagaagctccatgatgaatttgagacttcaatgtctgatgatcttcacacttcagtagcactggctgctatttctgagccattaaaagttatgaatgacttgctgcatactcgtaaggtaaatcgaatgaaaaccttgtggagatacagttagtgactttcagggatctatgatttgatctgctcgcacgccacaagtaaaatactaaaatcatacctaatgtttcaatctttctctgatatttgagcagggaaagaagcaggaaaaacggctggaatcactttctgctatggaagagaaaataaggatggtgctttctgtcctagggctactaccatcaagctattatgaggtgagtgctatgtaacatagcctatgttttatcaactctgcccaagcagtttgaatatattttgttgtctgttgaagaacacactttgtttctttcctctgtgaatatgcattgtctgtcctgatacgatcacttgtatagcccatctcctgtattttgttgtcatagacattatggtattcaataaaccaaggttcagaaagtcacagtttactgtccggtgacaagttgagaaaaccacaccagcaggccgttttattaaaccttgtcttctagggtatattccacccccttaaactccacgcaatgtctactcaagtatccgacctcaaatatgcaaaatcaagatattcaaattttatatcttaaagaaccaaccagtacaacctgtttttttgctaacaaatggaactggattcctgccattttcttttcctgttttgttaagttcctgtttccagaaagtaaaaggcaatagagggtcaggtttggtttaccactcagccttattcaagtttgagcttcaactgtcatactgttgaatagccaggacaaatgtatctcttcaaaacttgtgtttcctttggaaatgaaagagatactgtggtaaccactgttataggtgcttaattaatgtatccgtgcccagaacagggcagctagcgcaatcaaattccaacacggtatttaagttgtactttccataggcactctgtttattataattctactctagtaaacatgactgtgattagccaaaccttttctccttcacacaccggacatcactaacaattctctgttctcaggctctgcagcagctgcgggaaaaagcactaagaagagcttccatgacagaggagcaggtgcttcagaaaattgaagaaaggacttcagcaagaaaggcaaaacagtatgaaaaatccgatgaaatcagaaaagaattggctgctgttggaattgccctcatggacggtcctgacggaacaacttggaggccatctgtacctctttctgagcaaggggtggttgccagtacatgatctgcgcaacaaaagctccggagtgaccatttcaaatacccatcaccacatgatccattcatgaggaactgcgatgttttccaggttttgagagaaaatcaagagaacatctgacgaatcagatggcctgcatgattcggtagagtggatatgagtttctgtctgacagaagatagccaagttttac

SEQ ID NO: 61543 - DNA, 4201 bp, Oryza sativa
ggaaaattcccaagtccacactcctcatctctctctctcgctcgctcgattagctcggttccaagccgagcaggagcgacgcgagcgagcatggcggcgtcggcgtcggcgtcggcgctgcaggccgagcggtgcctcctcgtcggggtcggggcggggccccggcggcaccggctccccctccgcatgcccccgccactgcacgcgccgccggctctgctccttctcccgcaccggcgtcgccgccgatggcccccggccgtgagggcctctcccggcgaaggcgggggaggcggaggcggaggtggtggtggtggtggtctcgcgggcgccctggagaagcgtccggttatgggggtggtggcggaggaggaggatggggaggagaggggagcgaaggtggtagaggagggggagggggatgtggcggcggcggcggcgttggagatgaggtggccgccgtgggagggactggccgagcggtacaagctcatcggcgccacctcgctcgctttcgtcatttgtaacatggacaaggtgcgcgtggtcgtactcccccagtctccaaccttgtttgaaattctgtgcttaattttccgtaggtgatgtctgctctcactgtagtagtaatgaatatgtgagtcatcctcgaagcagaaaacaataagtccataatctgagcatggcacaacgttgtaaatttgctacttgagagtgagagtgtagctctgttttcaggaaaaggaatatggagactcgaattggagtgagaccgctgggttgttgttctaggcttctagtcttgttttactaagttatactcataagagaaaacaaaatagaacagcaccatttggtggtaggcagttagtaggcaactaggcatcataaataatgaagaaagcgtgacagtggatcttcagcatgtattgctattaccacttagaagttgtccatcggtatgttaaatgtgccatatgcaagcagagaacttattagtatgcatggtgcacctcagctgaaaacagtcttcttacttgcttagtgacaggtgataactgttgtattaaacatgacaatacatttggcaagattcattctagcagtcgtttgtactactaactaggccgatgtcattttctcactcgtagttacatgatctcttgaagtttttagttggtcttgatatacacttcacttctgcattagtccatatggacagttcatttttctttccttaggaatatttgctaattgcaaacactccagttttcaggttaacttgagtgttgcaattataccaatgtcacaccagtatggttggaactcatcgactgctggattagtccaatcgtcattcttttggggttatgctttgagtcaactgccaggtggatggctagcaaaattgtttggcggaaggtttgtttgcggtaacaaaaccccccttgtgcatagacaaatacaaaagctacctatgattctccatctgcatgggtgttttaatatcttagcaatgcttttttttggtggttgctgttgcttccgggataagcatgtttccaataataaatgcaaatgatgataatggctatttctttctgcaacccatcttgttaggaattaggatatcttacggattttttgtgtacctttatgggaaagaatgatccgttaagttggtagtaagcaaaattgcaaatagcagtacgaggtcataattttttttggatggtacatatcttcatttattttacccttttccttactcccaattgtttattttaactataaatttgagtaaattcctagttacaatgatttaatagcagcagtaatcaattcaaataaactagaagaaccatatagcaattttaaacttcaggagaatcattctgcctatcttgcatagctcagaggcacttcctataattttatcccttgttctttctcattatcttatctcactccaaaggttcttagtgttcatctatgtattgttttcttgtaataattaattattgttatctcatgtgctaactgtaggagagtacttgagattggagttgtggcttggtctttggcaactgccattatccctgctgtagcagggtttatgccagggcttgtgttgtcaaggattctggtatacctctacttattaattaatctctctatcctataatttgttgatctgaaaagttgtgatacattataatttgtccatgtctgaggaaagcatatgcaagacagtgagggctgctagtttgagaagccactcatcatgcaattaggagaaattgggttctctatgaaaaaataaattcataaacatgcatgtgactactgactatattatcagacaatgaaaacttcgaggtggcggattgctgatgaactagaataatggatataaacagttgtggtgcagagcaaaccaaaataaaacagccagtgcaatatgtcactccatatagatgagattaactagtttttttgccacgttttcagttcagtaccataggagtgttcctgactcgtaataaaaaaaatacaatgtatttcttatgtttgcattatataacatatattctatttaaattgtgttgttctgctaggtaggtattggagaaggtgtatcaccatcagctgctacagatttgattgcaaggcaagattgagtaaacatttttccttaaaaacatccttaccattttcattttcttagtgctaatttggtagccatctaaaatatctaatcatctggacatatgcttattagattttttattagagtgccgccctgtgttttttgtatgatggtaaattttgtggtttgtaaaatctgatgtaaccaactaatgtgtcttcatttttcatgactattgtttgaaattttagttgttcagatgaattattttgtagctaactgtgcagaatagcaagtggtggttacattttttttttactttcagctgttgaatgatacataaaaataatatttcctgcttcttagttcttatggatttctcacagtgattcgtacgtacatttcacaatagtagtccagttgtcattggctttctatatttgagatttttattaaggaactttgtattacttgtatgcataacaggaatcccatagaaatttgactcttcttcctgctgagatgttaattatattaaacataatgtagtaagtacaattgtgcctgatccctaactgaaaaataaaaatagaacaaaaacaccaaactgttatgaccttttggatcctcatggactattgtttcataacttttaactgttatggctgcccatacaggtccatccctgttcaagaacgatcaagagcagttgctgttgtgtttggtggtttgagctttggaagcgtattagggtatgtgttttcaggtattttgtggtacatatgcacgcttgttcacaattctgccagatagttaattccatatacattgtttggcattacagactattgttcgccccacctattattcagaaccttggctgggaatctgtcttttacatatttggacttcttggaattatttggtgaggaaacatctctaataagcagatgaaatattatttattctgtttaacttcccattcatttttttcataggtgtctagggtttcaatctcttaaagaacaacagttaaggggcaatgaagatatacaagtaatacaagatttggggcagagtccttctggatcaagtgacctcatctcgtcctctgtgtctccaaaatcatcggagtcatcattgggagagctgatgaattcactaaaggttctatttttcaccagatgaaatagttctgccataatctctgttatgacctagaagtatattgatggattaagttacaagactgttctcaagttgggtcatttgtgaagtcaaagtatcaaaatcatggcatggggactatgtgatttgatgctctattgttcataaaatataccaaactgaataactactagttcgaatggttcgagattctattcacctcacctgttgcagatgtgatcattcccaaataaacaaatatggtttgcaatatgaccaggaaaattttttagtgcattattatctctagacaaatcttgaagtagagttctttatacatgtgattatgcggccaacattgcaactttctttttctttaggatg

SEQ ID NO: 61544 - DNA, 953 bp, Oryza sativa
ctgcagcactgtacttagtctcagatggctgctctaacttgtttcttgtgtttcagggcatcacaaacactgtaggtgctgtacctggaatagttggcgttgcactaacaggctatcttcttgatacaactcattcttggagtgtatgtcatcatcacagtctaatccatcttcataacctatagtttttcattatgaactgttctaatctcatagttctcttttatgtgcagatatcacttttcgcaccttcgatatttttttacctgacgggtactgctgtctggctagcatttgccagcagtgagcctcaggagttttcgaagtcagaaccggagtcgtcgtgagtcatgacttggatggcaaatagtatatacagttcccagaggggatcagttcaggaagaattttgtcagatgtagtttccctggcaaagcgttggatttttggacattggacaggagaatacagctcattggatattggcaaatttttggccaattttagtttaggcttttgtgtagcgagtgtcatttcacgttctgacacgatttccttttccattacggggagttgcgttgttttctgcagtagtatcccaggtaacggtagaagaagtaaatttgttgtatcatatgacatctttgggtatatgtgatgattgatggagttcattacgacgtgatccttgaccatgtatttagtgaattcttgccagttcgatattatggataaagttagtgttttcgttttttttcttttgcggtggttagtggcttagtgccttgcttatttgagtgttcttttcattgctctgccaaaagtctgcaggattctgttattcctttttgtccagttgaagcctttttccgccgccaaagagtgacgtcaaattcagcttcaccagttgcacaaaataacattacggacctgtacaaaccaaaccatagctg

SEQ ID NO: 61545 - DNA, 5226 bp, Oryza sativa
ccttgtttacattaaatttagctttcagataatgaggaccagcatcacttgtttgaaaataaatttgacccataaatcaccttgtcatcaatgtcagtaaaattccgaacatagcgcactttatggtccaaataacgcaagtacctgccagatatcatgatacatgagataagcatatgaccgtatggtactttctagcaggagaggaaaataagacaagacaacatggtaagagtgtgctgaatgtgaataaaaagaccataaaggaatacggccggattcagggtgtgaaattgttcctgggtatgatggttgagttgctccgttatgcttagctaattgagatgcaacagtgaattggcttgttttcctaacgtcataacaaattaacaaccattcccagagtaccttttctgtttccggcagatctgttgctaagggaagagttaggatcatttcgcacgcaactaccataacagtttgccgtagttctaatgtcagaacatcctaaaccgagctatttagagcgcaaaatgtttctcacagtgtgtccacaaacaaattgtgaatgtacataatacattgtgtaattttgcaatgcacttactgctataaacatgtctcctcatttctccatgtatagaatactgctattaagtcggtgtaaatttgttaacacatccatataactaattaagtacataacgcctcattgggtgagtcaattgcacagcacagtcaacatcactatcactagagcacgcaattcaccaacgggaccaaatccggagaagaatgaagctagggggaacctgtagaggacgtcgaaggcgacgtaggcgcgggcgtggccgatgtggctgtcgtcgtagggggtgacgccgcagacgtacatgccgacctccccgccgggcacccggggctggaagagctccttcctccgcgacttggtgttgtagaggtgcagctcccgggctctccccgcaggcgcgccattcgaggcggaggcgaaggcggaaaacgcggcggacgacgagggcttgggggagtgggagtagaggcggtgggggcgaagcagaggaggggtcagggcaagcgcttggcggtgcggtaggcgagctcgcgacggcgaggagaggaggagagggaggaggccagcggcgcgcctcgccgccgccatggtcggtcctcgaggcacaggaagcgcgacggcgcgaggggttagcggatagcgtttccctcttttcccattttttttgggttttccgccccacgatttaatttcgttccactgaacagtggaattatgaaaaataaaagggaaatacaagtacctcttgatgggcttatttgaattccttattttgttactaaatttatatatagtatgtacctgaagttttagagagagaaaaaagtctagttcaaaatgtgaatccgaagagtatatgacaacagttttattggagacaaatatagcatattaagggtctgtttagatcctccaaaatagtgaaagttttgtcgttttggaccactttttggcaaaatagatctaaacactactagcaaaagtagacaagttggcatttatcatttgggagtccaaagcagcaagttttgctaaaaagagcgttgggagccatgtgggacgcacactgcccctgctcgctctctcgcatcccttaccctcgcacgctctctctcatccgctcccccaaaatttccccatctcgtatgcctcctcctctgccgatctcgctcaccgccaccgctcacgcccgcctccgccgatctcacccaccgcattagtccgaggcggagacggacggctccagcacgagggacttcatgtcgtagtccgattcactttcccccgccggcgggcacgaccccttcaccgactccctgtaccacttcactggatccggcagtggcagtgcttctaggataggcatggccgccttcgacctcaactccggcagtgatgggtggccaggaatggaaagctacgagggcctccttcactccggctcgcaaggacgcgacatcggcggatttgggagccacctttgggctggctcgcaaggaggcgacataggtagatctgagagccatctttgctctggcttggtatatgatacatttgtgtagtatcaatttgtggcttgcaagaagttgagcaacaacagcagcactcgagcaagccgctgcatggaatgcccgcataggagagagagcaatcaataaggtgcaattaatacgggcaaatcaatctataatggtaaaatgcaaaactctaccatgcctctaaacatctattccctccgtccaaaaatataacggattttggacggatgtgacacttcctaatacagtgaatgcagatatactctctgtcatattcatcatactcagaagtgtcacatgcatctaaaatcccttatattttgggacggatggagtaatatatgtcgtgaagtttcggtggttttaataatcgcatgctttgtgttagcttctcgcaggttagttggatgcttttaagcacgcaaatagaaatatctgaaatgaaaatttgaaaagaggatatgtatgaagccaaaacacaaaggctctgatgaggacatcctccactattacccgctggcaaagacgccaaagtcgggcggcgaccgtgtgagcttttgaataatcccaccttgctaagcttgggaggaggaagccaccttaaaagggagagccacccttcccctattggactagtcttttagggagattaggccttttcctgaatgggtgtgcctatgaactgttggggtccgagcaaccttaggttatttgttaaaggggtgggaatgatgaggacatcctccactattacccgttgttaaaccttgctaagcttgggaggagaaagccaccttaaaagggagagccacccacaagtcataaatatttaacgtgtatgatatgatcgaactcaatggattttttaatgattaattcagaaaatggtatgaatagatttgttttgaaaagtgcccataatatcataaacttattctgatagtacaaattttatgtttacctttttaaagtttggttaaatctttttctaaacttcgaaatattaaagacaagagggaatactgttttattattatggccaaatcttccaaccccaatgttgctactaacaactgcctctatcactttcgtggcacgtagatattctggcatgatttgattgacgagtttgaattttatccagttgtctcttgccagtaaggtttcgagtatatatattccggattatcggtccttggtggctgataccggaatttacctgataaacatttaaattcatttttttatggaggataaaaatcagtttgttttcttttcatggacctacctggttacctggcccatctggacccagctaatacttaatgggctcgacaaacgctggaataggtccacgagggtacagacgtccagcccataaaccacatcacgaaccatcagtgagttagctttacggcccatctaatggcccagaactaccttcacttgtccagtgccgcagccaggcccagcccaccgttcactgcgttgcaccgtaggtggggtccgcatcttggttcatgcggcacatgaagaaccaggtctacggagggtcctttaccacaggtgggcccccgtgttccacgccttgcactgttcacgggccccacgctcctcgtgattggcttttgcaccaaaagtggtcgatgcaccaggtctttatggaccgttgctgcaaaaatggtcagcataaaaagtcaattgaaaaaggaaaaaaaagaaagagagaaaaagttactagtagtgacagtcttgcagtcagccaaacacctctttgtttcaacctcacacttgataaggcacagtactcctatagacactgtttttcgatgttaatatcagtggatgattgatgatcaatgtattactactacgacatgattggtaagcattggatagataatattgtactacccagcagctcatgtaagccacaaccaaatctagattttgaattttttactctaggtgttatttcatcatttcatataacacattactttcaaaatctaccttattagctttaaatattacttactaaaatcataggaccgagattcaaatcctaccaattttatggtggaattgtatggaaataagatatactgtaagattagtattgttccgtcttactatgattgtagtagtattgtaaacctttgtcacggctattaatcgccatgcaaaagtatgtttcatatggttttgtttgaagaactcgagattctatgaaaccagctagggattttttttttgaaaaatgtgtctcccaactttagacttgtaaattataatctgaattttataaatactaaatacattacataatataagtcacaaccacttttttagatgttctatgcatgcatgcatgccattaactataacatattcttcattaaattactactttcttaaaaccttcactctcacactctctaactctattggatgtactccatatgcattatacatttattaagataattcaaagtacaatatgataataattatttcttgatctttccatattaagagtggctgtgtattatatagactagagggagtacgatactcgtaattttcgagttaagaatatggactagaatcccaacatttcgagtaaagctgctgccactcattaatcagagccaaagcaggaacatttatcgtctgcaacaacggcagcagagtggttaatgattaaatggacgaggtccatccagggagacaggcgtgccaatcctatcgtctcagcgtctgaccctgcctgaccagacctgaccagaccagacccgagtgactcatcaccagcagcaaaaggcaaaaaaaagccggcccgcccgaccgagccaaagcgcgcctcgtccccaccccctcacctcgccacagttctcgtctacagtatccccccccccccgcccataactacgcgagagccccaaagcccaatcgtctccttcgcctcgccaccaccaccaaccacgcctccgctgccacacgatggacgacgcgtggcccgcgcggtggcctccgcctccgcctccgcctgctccggcgccggcgacgccgacggcgacaccgctgccgagccag

SEQ ID NO: 61546 - DNA, 4224 bp, Oryza sativa
tgctcacatggcgtcgttctactgtgtccgtgtgcagattgacagcgccagtctgcgccacatcctccgccccttcgccgcacagggagcggcgccgccggagcagctggccgcaagccatccgagctcgcagtacggccagcccgcgagagcggcgccgagcacctcgttgcttgctcaggtggctgggaaccatccccatgccacccatgtttcggaccggaaggcgttgtttggcatgctcaatgcaggcaatgctgctaatgtcattgatcttactcgcgcttccccgctcggaggcgcggagcctctgcccaagcatccgaggcacggcttggaagccagcagcagcgttgagcagccctcctgcttggggccgttgtttcagaacacaagtgcaaatgtgcagggtagttttccaggggaatgttcagttaacaatggtattgttccagtattccaggagtctcagtgacatgatttctgtcttcctgctgcagtcttttactgttagtgcttctttggacatgcagggatatcccaaggcgccatccagtttcaggactcgagcacatgcgcagtgcagaaattgccatcccaatcaacccctcgccatcatcctgcgcttctaggggatcagatatgcgtctcctgtctgaatgttggtgggttcaacttgcaacaatatctgcaacctagatcgactaccctctgtcatggtctcatgagggaggtagtcattgaatggctagttacagtaagcatttttaccccttcagaaacctgtgtctgcaatggcctaaatagagaacccagccattgaactatgtacgatgtgtggtgtgcaatcaaaagttctacacccatggaaataaaagttttctgcctcttgcttgtactgttgtacagcatgtagtcctcaaattactgctctgtgttatagcttcataatatgggttctgttgcttaatttggtagagattttaatagtgatggagctcttattcacagttattgttaattattattagaacaattcgatattttttatggtaaaagtgttcccacctgctgcttttaaccattatgatcatatattactttttttactaaagccttctgatgtgcttttgggatatgaacaggtggtgaattctttgtcggtgaagctgggatttttggagttcgttgcttttgtcaccggctgagaatgtctgtggctaagttctgtgaggtactatacaaatttatgattgttacgctgattccccatttaggcactactacagatgttcttactgataaaaggtatgtatatacacattttgtagcattcaggaggacccgcagaaaaagctggtgaaattgtcattatggataatggcatgactattgtacaatggctcaagtactgcatgggggtgagcattttatcttgtttcggttaatctgttaacttttagttggtccaagatatgtagtttaagggtaagtatttggtaaaaatcacatactggatttgcttgtttaactctaaaaggtaggcacctagtacaataatagttgtgccagcagccagtttgatatgagtcacaaagtgaaagttggcattggttgcatttttattttacataatggaaatggattacatctctggcctctacccgtaggcacagccaagcattggttgcatattaccagatagaaataaagtaactctttttttaacacatgtaaaaacccaggctaagttctacataagtttatttctggttgtcctttactgtgtcacatatcatctggaggctgtattagcagcagaaaaaagaagaagaagaagaatgctttagtagtattttctgcattatattctggaaaatatcattaaatgtagtctgtggtaacaggtacatatataaatttttaagtttttctttgtttaagtctacaaatgaggcattgtaaactcctgtattatagccttaaggatacagagatagtttccatcagagattggtaactcacaagtcacaagtcacaactagtacatgtcatgcaatacaactgtgtatttgtattgtgttgcatcttgtaagtattttacatattttgtgaatgaacaacagaaagcttattgaaatacattttcttcacacatacacttccagcctgtcccaatcatataacagccactctatatcaatttttttccttcttgtttacatctaggttggagcatccatttctgacactaagtgggactggccagaatgggcatatatgagatattcttcagaagaatactggactaaaagtctccttacaacgaacaataacatggaaaaaacagggctattcagtggacatggaaaaagcactggacatataaacaatccagtttattccagtgatatccacaatgaggttggacgattcacttctgttgagaagctagtgaataagccagatgaaacattttatagaaagagtgtcggtttacatgaagctttctcaaagaatccagctatacagcagagttcgaaaataaacttagcaaatcatatgatccatgacatgaacatgaactctattagcaggccaagtgaacgaacatattcaacagcaaacatgggaataacttacagtagaaatcatttggcacatgattatgcaaactttctggagaaaaacttaaataacttgtctcgtagtcctggtcctagttctacaagagttttgagcaatgacagtagggcatgcatgcttgatgtacctcacaaaataattcaagatggttcaggtagagcatcaaacaccgaactgaagctggggcaatcatcttatcatcaatctatggctaccctatttccatcggtgcagtcgacaataatcgaatttcagaaacctcagcaccacctgcaattcacaactccaagtgagctttcctgttattagctgcaaatgtaattgttttgttatccacattatcatttgggtagaatttaacttgtattaactattaatatggcacatccacacatgtgtagttctgtttgctttctcgctagatatgcaagagcttgttaattgttatgctaggtgctgactgaatacacaaaacgacaaaaacaccataagaagctgctagtactagcacaatgaatgtgaacaacaacatagttctggtatgattttataacacattaacaccatagaagaaacacaattttgcttagttcttttttttagtgtaaaatgagagcatttcccctgtaatgttcatataatgccagaatcacttggtgcagatgcttatccgaagcaaactaccaaagccaacaaaactatagaaaacattgagccatcatttggtacaggtaataggaaacgatcacttgatgtttctaatggaaccagccattctgaactcaatgagattacagatgatgcagcaaagaattcatttatttcattatttctttcacatcttgagagaaatagtacatctgagtccattgatgatgttctcaacagtaatgagcattaccttcttaaggctccagatgttgcatatagttccgatcgtttaaaaactgcaagtacacaagttgagacaagggcaaatgataatcagttgaagttggcacctgccattattcacacgaaaaggatatcagatagcaggtctcttccagttccagtggcttccaagggatatgttcatcaagatgtacttcatgcaaatagtcaagagcctttaataaatggggactgcctgccacatttgctgcctagtcaacctaacgccggaatctccaaaatttgcgcagaagtttcttctccagtgaattgcaggtgttgtaatcatgttgctgacaaatcccatcttgcacattctgagactggggctccctgtttttatgatagaacggtaagttgatcttacactttctcatagcacaagtaaccactgtcaccactgccaaccaccaaaatgtcttttgattcttcaagcattatgtgcaggccaggagatatatttcttttgaatgtgctgatgacttgtgcacacataaaagtttgagagctaccaattatcagtgtggaagagccttttgttatacagctaatgagtttctacctagctttggccaaaatgatcaatcgccaataggaaaatcaatgcatagatgctgttgcaaagctcaagaagattcttccaaa

SEQ ID NO: 61547 - DNA, 1689 bp, Oryza sativa
cctccgttttacaatgtaagtcattctagtatttcccacattcatattgatgctaatgaatctagatagatatatatgtctagattcattagcatcaatatgaatggggaaaatgctagaatgacttacattgtgaaacggagggagtatttcagttccatcactgctaccaagatttactcttcacatattcaaattctagccttgattctgatcctattggttctaatagatgatagctactgcctagtgtatgtataatgctaatttggcctgaaagcacttgctatttcctgttcttagcaatgctcttaagaccagccttttaattgatttgagtactggaaaatgggcaggcggcctgtcaaacaggttgtatagatgagcctttcttcgttgtttccattttgacattatgcttatgtgtgctgtttcacatcattacaagataaattgatgacatcaatttttgctgaaggttacacttagttttcaaggaaatgagcttagacgtttgtttgatgctatatctatatacacatgtcaatgatagcatacatgcgctatcatgcaaaatgtgctcttgaagctatcgctgtgctccctttcatattcttttatttacttattgcagttctatgggacacacagccaacagcttgactaagaacactctgcttgatgcacctaataatacagaatgtagtccttaccgggatggaaaatgctgctgctctttagccccaaaatgtttggcaggttatggatttacaaagcactgtgttgctagaatcgatcaaactgatcatacagtacaaaagagcaaggatgatggcatgcaagctgctgccagatgttgcacgctaggggagagtgaaaaattaatatgccagtgctcaagcgagataattgctagaaaaagcgactctaaagcttctttccagaatgaggtctctactgaagtattgaaccgaccttgtgttcctacattacagcagctgaagaatgtaacagaagcatcggctgtaggtggccattggccctatgaaactgtaaaagagaaagcgagtgcttgtagagattctggaatatttaaagaactaaaatccggtttctcttctggattctccagcgatgttgtgaccaagttttctgcatcacctgaattgaacaagtatggtcttgaacacaaaaatcttgtgtttgatgaagggtcacgaattgagaaatgttcctcatccagctatttgcctattagtacaggatgtgaagaagcccaaaatagtttttctagatttcacctggagccatctttagtgaagcacaaaaataatcaaatttctgagggaagtacacggaaagaacatgagaatgagggacaatgttctgaaatgtcaaagaaaacacgaacattgaggtgctgtgcaaacaaatcagaatccgatgattgtactaggaaaattgatctgtcatcccgggaaggggattctcaaccgcagcataaggctggtccattttcacgcagagtatcaaaaaccaagaggaaacatcctcccacgcatctgaataaacatgtgaaacggcttcacagcaactgcaaagttctcaatgttgacaatgaacggtcagatgatgagggcatttatgttggagaatcaaattcctctgatagaaaaaagcaagaagata

SEQ ID NO: 61548 - DNA, 4679 bp, Oryza sativa
atctcttaataggatggagaggtgtgaagaatttacaaatgaatcagcatgcagtccttgtggcgataaacacgctgcggttcaagcctgtgtaacaaaatttgaaaggttgtaactccaggtgcattctacagatttcctttgaaggatatgttccatagaaaatatttcgtttttattaatttatcttgcttttacagactgatctgacaaagttctgcataataccttatgcagatatatacaaaggcctagtttagatgcttcatgttgtgtttgtggtatctcaaacctggagccttccaatcagttgatagagtgcagcaagtgctttatcaaggtttgtcatattcccttaccagaacctagtactggagtctattcacatagagccttgcattttttttttctgtaggtgcaccaagcttgctatggtgttctaaaagttccaagaggacaatggttctgtaagccctgcaagatcaatacccaggacacagtaagaaaattcaatttcagagtagtttcatttaaggcatttaatagggcatgatgtagccatgtaggccagaacagccatctttgtgcttgcagattactgtgtgcaagcactatagaatttttcactgattcttttagggctatttgtagaatgaagcttttattgaaatcaagataattacatcaaggtgatacaaccatttagggatacactgctggtatagatgtatggacgctgcactagcatggaaaatacttcagtcaaaattaatcttactaacactaacatcctcattgttagatacatttagtagtgattaattgtatatcggtatctctttacgttttcctttgccaggtctgtgttctgtgtggttatggaggtggagctatgacaagggcattgaaagcccagaatattctcaaaagcttgctgaggggtattgcaactgcaaaaagatcagataaatatgtttattcatcaggaaatgtgaacagtgagtgtacaagcaagttacatggggaatatgtcaggcatgattcatttaatggacacagatcaagaagcttcaatgctatatcttcttttggtataaaagaagcttcaataggtagtgcacgtggggacattatcagcaagtcgtggacctctaatcgcaattccagtctacttggtccacgaacaaggcagtgggttcatgtggtctgtgggttgtggacacctggtacaaaatgcccaaatacaatcacaatgagtgcttttgatatatcaggggcttcacctgccaaaagaaataccgtgagttccctacatgcatattcttttgaacttcattgaaaatatgtttcctgtaaattgaaagtgcatccaatgccaagtgctggcattggccatgggtttcctttcatcctgcacccgattatttagtcctaatgaacttaatcttcattattgctaatgtttttgttgtcaggaatgctcaatgtgtaacagaactgggggctcatttatggggtgtcgtgatgttaattgctcagttctctttcatccttggtgtgctcatcagagggtatgatatccactcataataagctatttgacctatatattatcacattgatttactgtatgctcataagaaatattctgcaatcttggttaaaacttattgttatctcaacactgtaaatctgaatgttgctcatgatatcacaatagggtttgttgcaaagtgagccagaaggcgagcataatgaaaatgttggtttttatgggagatgcctggatcatgctatgcttgatcctaatcatgttaatcctaagaaggaatgcttgaggagcaatgactggacatgtgcacgtactgaggtaatatatttgttttacctttgtactgcttgaaaaattagaatcctaacaagtgacaacttcctttgtcattcttctgaaacaggtttttagaggccgaaagggagactcatttggtgctaatcgtagcaggaaaccagaagagaagtttggtgagtgcagtgtttcccaagaacagatcaatgcttggatacgcataaatggatcgaaatcttgcatgagaggacaggtaacttctaatccttcactgcaatgcagttggttatcttcaatatagtacattgtaatgtactctgctttagcggggtatcaaagtttgcatgtacatactggatgagctgtttacatgtcttcattctcatttttagaaggaatatgtccactacaagcagttaaagggatggaagcatttggtagtgtacaaatctagcattcatgggcttggtctctacacatcggagtttattccacgtggctctatggtaattcatcagttattctttccttagtcgataatctgacacaagaatttagcaaatgaagaaattgttaacttctgcatgaaaatatttcaggttgtacagtatgttggtgaaattgttgggcaatgcgttgctgacaaaagagagattgaataccagtccgggaaacggcagcaatataagagtgcttgttacttcttcaagattggaaaggaacatatcatcgatgccacccgcaagggtgggatcgcaagattcatcaaccactcttgccaagtaacaaataatatgctcatctgtgtcttttttcgtccatctaaaactgaatgtttctaatgcatgttttgttttcttccaatctttgctggatcagccaaactgtgtcgcaaaaataatctcagtaaggaacgagaagaaggtaccccttttctttatttcgatgttgtcgtttcaaaatattcgccccagccctcttttttcctggcaaatttatctgtttctattctaatgtgtttttatcattgtccaggtagtgttcttcgcggaacgccacataaatccgggggaggaaattacctactattatcacttcaaccgagaagatgaagggcaaagaatcccctgcttctgtagatcgagaggctgcaggagatatctgaactaagatagtgtacttcggtcgtatgtttgtagtgctgtttaaacattgtaatgtgcgcactgtatatatgaataaactgtagggacttaatctggcactgataatttagacatccaaacttaaatttagaatggatttagaattaatttagacttcctctcccgtgctcggagcaaaattggaagctacttgccgctgctggagaaggccactgaccttgatagaacccgtaactcgttgatttcccgggacattgttgtcgtaggtactgggaattgtgctcatggaacaagctcataattcatagaaaattcatacacaacctaggtccaatataacaattgaaccttaaagtacaacatcagtaacttggaggtaaaactatcacagaaatttccaacacaaaagaccaattacattcactcgcagtatcaatcgtagcttggagtcaagaaaggattcttctcgtcatagaaagggtttgtgaaatgttgactgctgctaagactgtcatggacgttacccttcactgcagcctgatgctgagagaatgctctcgggttgaaattttcgtcatggctgtctccgaatgcaacccagccatcaccgccgccggtgatgtccctctgcttctccatctcttcgacgtgctccttgaactctttcttcgccacgttgatcacgttgtctccgtgttcatcgcaccatgccctgcaaaaacagatactatcatctcagaatttctgaaccatgtctgttaaatctgaatgatgacggaattgtgaagttttcagtactttgggaagaaggtcttgaggtcagaattggccactggaagccttgttgagatggcctcattttgtggatccttacatgatgccaggacatacattttacacacttccaacaacagtaattgataaaaaattcatttggcaaacagaacagattaaacttacgaaaagtcaagtttcggttggtggatgacaactcagcctgaatccttgaaagctctttctttgtgttctccaccaaaaccttcagtaagttcagatacaaaaagctcagttcagtccagtaattctgaaactaccaagtaccaatcaatggacacctgcacaatctgtttactgaaactaaacacgatggagagatcaaccactttgcaataccttatcattcgctaaatcggaagcagaatcatcgtcgccggtggccgtattcagcttcttcttggctctctttgcatccttggcaacagccgggctcgcctcaagccggcactcactgtacgaagaccgcggcgcagcgtgctccggccgctcaccgccggccgtcgcctcatcgttgcttgccttcttccacttcttgaggccatcgaacccccacgaactcttcttcttgctctttgacgcatccttctcctgatctgtgccttccatggacgccgccgggggctccttgttctcgctgcattgccgccgttgtggaacatcgccgtcaggtgcctcctcttccccttgtcggtcttggcggtgggcatggcttccgacggcgagctctcggccatgaggacggatggggcgttcttgctgttgttctggtcgacgggggctaacggtggcctcgatgcgtccagctccttcttgcctctgctcttccatgg

SEQ ID NO: 61549 - DNA, 6011 bp, Oryza sativa
gccgaaggggaggatggacttgcacagcgacgcgatggtgtcgtgcaggcccgagtagtacgtcggcgtgtacgtgtaccccatcgtcgtcggcgactcgtcggcggcgagctgctgctgctgctgctccggtggctgctcaggcgaggcgaggaggggagcgtgagagagagagagagggagatggtggtgagagagtgaaggggaacgggttttgttgggctacggcccaacggttggggagaagggaggaggaactagccgttgagttgaatctgcagctgcaagtgggcccgttcgccacgaggtcaagaagcttcttcgcctaacatgttgatctcagccgtttaacgactgatccaatggttggtcggggagacatcacgtttaccggagtatccgatactatcatgtaaattaaagagcaagtgatccctctgttccatatttttccctatttaaattttattaagcttgatcgagttttaaaaaaaatttagcaatatctaaaatatcaaattaattttattaaacctaacattaaatgtgtttgtttttttattaaaaacactattatatttttctataaacttgataaaatgaaagaaatttagttagaaaaaagtcaaacgacttataatataaaatagatgaagtaaaaaaaataagggagacgaagatacaacaattcatcaattcaaaacacgaagatcgattgttgaacagatatatgcgtaggcaagaaactgcaatccaatcgtccagcattcacgattgtatgtattccacaaagaaatgccaacgtaatcagataactgtgagtgagttcagtgattttcttgaacggaataataccagtttttaacttttgataagagcgttgagccacaaagctgaaaaccatgctgaaaaccatttgctggatactgctttcatcccatgaatatagcaatatatatagtactatcagataagacattataaaactatgaatatataaattaaattagtttcattaaatataacatcgaaaatattttgattatatgtttgctttgtgttgaaaatattactatatttctctataaaatcaaaacgacttataatatgaaacgtccctccgttttttaattataagtcgctttgatttcttaagtcaaacttactagaagtttgatcaaatttatagaaaaatttagcaatatttatagcaccaaattagtttaactaaatctagcattaaatatatattaatagttttttgtgttgaaaatattagagaaaatgcatgtgcgttctaatgtgttgaagcaattttaatctcacacattatttgattgatgaaaataggagtcctcctatgatttttgcatcatgcaaaacctatacgcatgcatgcatgtattgataacagctagatagacagatatactgacatactgtagtaatgtctggctaaacaatttcattctcagaagatagataggattcacaaaccgcatgaactagacgtacgggctccgacttagggtccaaataggatttagtttggctacatctttatttttttttctctttcataatcggaaacctgactctagtatcataccttctattcatcttcacacatagatagtttttctatctaaaacgaataaacttgtgtgcagatcgccggccatggctaccgtcttcccctaccgttggactaaaaccaagcatctcaccgagcgtccacccacccacggccaccctcccgacgctcacccatggatcgtcctcgacgtccgcgcctacatcgccgaccgccagaacgccaccaccgccaccacctctctcaccagcggccgcaagctccagatcaccatctgcgccgcgccgccgccgctcgtctcctacgtctgcgcctggtcccccaacgccgaccccgccctcgtcttcgccaaggaacccgtcgtcgcctgcgtcaacgccgacctcgtcttcctccgagtccacagcgatcaagtctaccacctggtctaccacgccggcggcggtggtgacagccgccgccgccgcccttcgctcacgcttgtccggcaccccgaccgccccttccatcgctgtcattaccttagtgagctcggcagcattgccatcctctcccgccgccgtgccggtgccggtgacgaccacgacgacgactccaccggcttctatgtctgcagtcttgatcaggagctatggtatgggttacctggacaacgtggccacttcaagctctgcctctacgactccatcgatggcgaatggagccaggagacccttcgtctcgaccagctgcgcaatccgcaggacaaagacaccgttttccattacacggagaaggtgattactctgcacgatgaacaggtagtggccttcgttgatctgtggcgaggcatggtcatctgcaatgtcaacgatggcacctgcaacaacgtcgagctcctgccgaagctgaacggtctccctgccatggataagctgcggatagctcgtcctatgctcagcttgatggattcgcatgtcgtttacatcatgggcaaggtcaatctctccggcgagaaggcggtggtgctcactgttgacatggccaacaagaggctgcaaggggtatctctgcgtgacgctgaaaggatcgtctacgatgataacggttgcagctacaaacagtataccatctcccaatatttcactacatctgcaggtgattgattaatccctggcctgtttttttttcctacttattgcttttcttttggagaaatcttgtgtcgaactgacgagacctcacctgctttcaagaactcggctcgttcgtcatcaacctccctctcctccaagaatttcttcaccaattccatctccttagcctcaacttcctgcgaatctttcacagcaaacaaaccgcatgaaccagagcgcaaaatcacaaaaatgtccgtacgcgaagtttgtgtgtgtgtggtggggggtgctccgttgccggcgctggatcaggacgagttcgtcgtcgaagcgagggcgcgtcgatcggccaccggcaatccgattctatccaaaccatcttccgccgatccgatttacttctcccctccgactccaacttgcattgctgacatcgattcggatctcgatcttctccgactccgaatactccacgctgctctactttaagcccggccggacgatcgccggcgggaggagaggccgcagccatggctaccgccttcccctacagctttacaagaaccaaacacctcactctctgcccgcccagcagccacggtggggatgcggccgatcacgggccccttccatggatcctcctcgacgtccgcgcctacatcgccgaccgccggaactccaccaccgccaccatcgtcttcagcaacggccgcaaaatccagatcacattctgcatcgcgccgccgccgctcgtctcctacatctgcgcctggtcccctgccaccgaccccgccgtgttcttcgccaaggagcccgccgtcgggttcgtcaacgacaacctcgtcttcctccgcgtccatagcgatcaaatctacgatctcatctaccatgccagctctcgcccatctctcaagctcatccacaacccctacagcccctacaacccatacgactaccttcgtcgtatcgacaacgttgtcatcctccctgaccgccgccatgccgccggcgctgatgatgatgacaacaacagcggtcacttctatgttagctcgctcgatcgggatcaccgcttcgatattggccacttcaagctctgcctctacgacgaagacgattccatggactgcaaatggagcaacaacatccttcttcttgaccaactccgcaatgcgccagacaaagatatcgtgctccatttaacagagaaggtacttatcctggatgatgaacaaccactagtggccttcgttgatccctggcggggcatggtcatctgcaacgtgctcgacaacagcagcacacctgggggaagcagctacatgccgatgccatccgagatcttcaacatccacaacacctacacttcatccatttcccgtgacattgctatcgtcaatggccgtctcaccgttgtcaggctgtgcctttacctcgattcagatgatgattcagacgatgatgatgacgacgattgctgcgcttgggatctgaccacatggagcaagccagtcacctgtttggatgatgagtggcgtgaggacttgaagatcaagtccagtgacgtctcgattgacgacagcactcggaacgcctgcctcctgcccaagctggatgatggttgcccaacaacggagacgctccagttagctcatccaacactcagcttggtggacgctcacattgtttacatcatgggtaaggttgacgtctccgatgagaaggcgctggtgctcaccgttgacatggcaaacaagaggctacaagaggtatctatgtatgacgccgaaagaattgtaaacgattttgattatgcctacacgcactctaccatctcccagtatttcactacagcagctgcaggtgattgattaattcctagccttgttttttttttctacttttgccttttcttttggggaaaccttgtgatgaatatgatagtaaacctaattcaaagtagtgataggggaaactattttgatccctcgaggggatatcaatatctttgtcgtttgcatgttactcaaatggttattaaaaaatgtgaaaaaatttgagaagatgtattaacgtgtgatatatcacgccacaaacattcaagttaaaattcaatttttacatctcgcaaggaaaaaaaataaattaaactatacaactagttaatgtatattcacagacaaatttatttttttcgttgcgagatgtagaagctgaatttgaacttgtatgtttgtggagtgatatatcacatgttaatacatcttctcaattttttttaatttttttaaaacaatttgattaatatgcaaataatgaggggatatcctctcaaggatcaaaatccactcccgttgaccgttgtgatagctgatatattgtgtgtggctgctgctttagtgctagctagacaagttgaggccgtaattagtgtgaacctcgccaaactctttattacccatctaatcatggaagccgtcggtgagcttccaaacaagttatagagtacagttccagaaaagttgtaaatttcatgagaattaatgcaagtcatgtgggacacaaacccactcaaatacaactgcggcatattggattgaaaaaagtacgaattacctctctaactatcaaggtcgaccgaaatacacctacaaaatcgaagaccagatattctacacccccaactattgaaaccggataaataccccgtgtctcaatccggagcggtcccacatgtcagcctccacctcatcctccctctcttaagaagctagttggccccgcatgtaagctgctccctcttccttcgtctcctggccgcagagatgcctgtgccgcctccaggctccagggacccgcaccgccgccgccaggcacctgcgccgccgcactcatcttgaagcccgcctccttcagtcggtcgtcgtcgccgttgctcccatccaaccgctggagagagagcgagagaggaggggaggggaggggagaggagagagagagagagagagagagagagagagagagagagagaggagaaaagagatgacaaccggcggcggcgacaccctccagggcaggcgggtaaagcgacagactccttcacttcggccaaggacccccgccgcccgagttccgtcggagtggccccgtctccaccaccgccgacgccgaggtccagacttcgctcccccctgctacgccgtcgccagaggatggatgctgcttcaccgcctcgatttcctccgccgatcccatcgtcaggaggccaccactgaccgcgccagcaccggtctccatcg

SEQ ID NO: 61550 - DNA, 3124 bp, Oryza sativa
gcgcccgctgccgctctcccagccgctcccgtcaacgctaacagcatcaacatagaggatgggagggcgccttccacctccgccaccggctgcccgggcgagctccgcctccgcctcagccgcccgccgctcggggagctagctctgcctccaccggcggccgcccgctctgcctccgcctccgaactcgaaaaccgaggagctccgcctcagccgcccgccgcccgaggagctccgtctccgccgccggtcgccccctccgccttcgtttcagccaccgtactagtgagatggtgaggggagggaggagagagagaggggtggggatctgacagtgggtcccactaattttttttaagagagggaggatgaggtggaggttgagcaggatgttattttgaccggtttcaatagtaggggggcgtagaatgtccggtttttaagttcgggggtgtaattcggtcaacctcgatagtttagggggtaattcgtactttttcctattggattctagattgtctttatagataaatatttttccctgtcagtgcacactatatcaataacatgcacataaaaaaagtgagcatttaaaagaaatggtcggaaatgaaaatagaaacaagatttccgccccaacaaggtagaaagagaaaagaccattttaggtgctattgcatgcgtgaactaaattggttgatactcttttttgtttgctcgaacacattggtgatactctgataggaggacttccattttggtcaccctcgtcgcgtgaagggttaggcatattaatatattatatatgtactcctctgtttttaaatatttgacaccgttaactttttagcacatatttaaccgttcgtctttttaaaaacttccgtgtaatatgtaaaactatatgtatacatataagtatatttaacaatgaatcaaatgataggaaaagaattagtaattacttaaattttttaataaaacgaacggtcaaacatatttaaaaaaattaacggcgataaatatttagaaacggagggagtaatacgtaggctatttgcgctgacacatggggacttttgttttgctgggtgcaggtgtaaagggaagcctgaagagacctttgaagtttcatattcaatatcctcacaagcggttgggtgaaacaatcaataggagcgatcctatggacttgcatgagccattgcaactggatgctggatctgacatgggaactacagacggaactgaaggcagcgataatcctatggacttggaatagccatgccttttgagtgaaactaaatgggcataaattaattagagctgttgagaatcatgtccgggcataaattattatagattaatttgagctgttgaaaatcatgcccgggcataaattaagggtgtgtttagttcacgaaatgaaaatttttgtgtgtcacatcggatgtttgaccggatgtcggaaggggttttcggaaaaaaactaatttcataactcgcctggaaaccgcgagacgaatttattaagcctaattaatccgtcattagcacatgtgggttattgtagcacttatggctaatcatggactaattaggctcaaaagattcgtctcgtgatttccgtgcaaactgtgcaattagtttttttatctatatttaatgctccatatatgtgtcaaaaaattcgatgtgacgtttttaggcaaaattttttagtgtagctatatttatggcgccatatttttcatcgaaaaatagtcggcatgtatttacattttaagtccctaaattacatatgtaattttagtgtatttacaatgtaagtctcaaaattacatatgtaagtactaaaattacatatgtaaattcgaaaattacatactaattacatatgcaagtggggtgtaaatgaggtgtaactacggtgtaagtggctaaaaaaaaatcgactgtaacatatggcgccatatttctagcaactctgaaattttttggaactaaacaaggcctaattagagctgttgaaattttgaaaatcatgcatgccccgttatgtattttggttgttgtgcatgactgcatgtctacattttagatttgccttgaatggatatgtttatgctcttgttggactgtatttgatcgttcagatcgagagttgtctttggagcgtggtgttaacatattgatttcatctataattctgtttcagaaatattttttcgtactctacaattcagaaatagcaggggaagcccactgctttccattttcttgaaaccagaaaatagagtttgagggtggtcgttcgccacgacttgacctccttcgccaacgaaatgtaatcgccaattatgcataacccataggctgatctgatcaggaaagaagattattgctagtggcctttgccagaaatcaggctatcgtcaagcacaagccactaccggcgataatacaaccatagcaattcaagataagcagatccgattttaagcacctccgatcgatgaaatcgatttacttctccccctccgattccaacttgcatcgctgacatcgatttggatctcgatcttctccgactccgactcgggatcctccacgctgctctactttaagcccggccggacgatcgtcggcgggaggagaggccgcagccatggctaccgccttcccctacagctttacaagaaccaaacacctcactctcagcccgcccagcagccacggcggggatgcggccgatcaccggcctcttccatggatcctcctcgacgtccgcgcctacatcgccgaccgccggaactccaccaccgccaccatcgtcctcagcaacggccgcaaaatccagatcacattctgcatcgcgccgccgccgctcgtctcctacatctgcgcctggtcccctaccaccgaccccgccgtgttcttcgccaaggagcccgccgtcgggttcgtcgacgccgacgtcgtcttcctccgcgtccatagtgatcaaatctacgacctcatctaccatgccagctctcgcccatcgctcaagctcatccacaacccatacaacccctacaacccataccattaccttcgtcgtatcgacacgttgtcgtcctcc

SEQ ID NO: 61551 - DNA, 3053 bp, Oryza sativa
agtggcctttgttgatctctggcggggcatcgtcatttgcaacgtgctcgacaacagcacaccagtgggaggcagctacatgccgctgccaccggagctcatcgatgcccgcaggacctacaattcatctgtttgccgtaacattgctatcgtcaatggtcgtctcaccgttgtcagactgagtctttacctcctcgattcagatgatgacgattcggacgatgacgattactgcacttgggatctgaccacatggagcaagccagtcagttcttgtttggacgatgaatggcgtgaggacttcatgatcgagtccagtgacgtctcgattgacaacagcactcggaacgcctgcctcctgcccaagctggatgatggttgcccgacaacggatacgctccagttagctcatccaacactcagcttgatggacgcccacattgtttacatcatgggcaaggttgacgtctccgatgagaaggcactggtgctcaccgttgacatggcaaacaagaggctacaagaggtatctgtgtatgacgccgaaagaattgtcaacgattttgattacgcctacacgcactctaccatttcccaatatttcactacagcagctgcaggtgattgattctcttttttttttttcgggaatacgccagtgacgcatttttcacattatgagaaataaaagttatttacaatcaaagaaagatcagcacgggacaaagttattgattcattcctggcctgtttttttttctttctgcatcttgtttttcttttggggaaaccttgtgatgaataccatagtaaacctgattcaaagttggctctcataggactttttttttatcatatcatactttcataggacttggcgtgaagggttaggcacatgtatctgtaggctatttgcactaacacatgggcacttaatttgttttgccgttttactggtttgcaggtttaaagcgaaacctgaagcgacctttgaagttccatatacaatatcctcacaagcggcagggtggacctggttcgaaaattagagatgaaactgaagatgggaataatcctatggagttggattaattagtatacgaattgcgatacaaccaaccgcatacgaattgtctgtattcaacaacaaatggtagtgcaccagagcaccaatataatcagatgagcgtgcttagtgattttctcaaatggaattgcagtttttctactagaactgagccactgaataagctaaaacccatcttattactagagtcatacatggcttgaacaataggattgagctgttgaggtggataatttacatggcatgtatgagagcaacttttaacaccacttcccagaggcctgcagccttagttttcagttcccacaggttgaaactatctccaaagtcttgctgataccagcaaggaactcgaacattcagacttcaaacattcaggaaatcaaattacaatgacaaatggataagactgattgctaattctgggtaatgaattataaaagaactagattggctgtcgatattcctactcaatttgaaatatcacactccaaaatgtgaacaaggtggtcaggcacatatagttaccgaatttctcattccagtgatgtaaacttatagatgaaggtcacttaaaacatgtccatactcctgaatttcgtattggattattggccttgctataagttaacaatgctaacctacctgcttgggtaaaagggttaacgtctcacactaacagatacattatttaagaaactgcatgttccatactggagtatgattgataggaagaaacctcagaaccaacatctgattgtgtaactcagtatacatttagtgcatcaataacaatgttctaaaacaaggtctacaaggccgcacaaaggaatggatcttaaccttgtactgcttaagccacacaataggccagctatgccatgtaaggcaggcgacaacacataacccttgacatcttttagaatcttgataaaaaatgatcaaaggaattgaatttcctagtactacctgttctgcagtctacaggtcgtatggctcaactcaacagaaaagggaatcaaggcaaaatgtccagggtctccaaaaatcaaattttgtggtgactgcaaaattgacagccataacttattgatctattatctctttatccatttagactagtcaggggtaaactcatcatagacatcaagaaaatttaagtttcaaaatctctacatattaaaatactacacattttgtctcacttgtaatcagcgattatttcttacctcctcaccatttctgtactagagttaagactgtaaactatgctgcgtctttgattaggctggcaatccgtttctatccaaatcatctttcgccgattccaacttgtcttgattccaaatcatcatggttaaggtgtcaaaaaaaatcatcatggttaaacctctccggctcctctactctgctctgctctacttaagctagcccggccgggcggacgatcgccggctggaggagaggccgcagccatgtctaccgtcgaccactacatgtggagtagaaccgtcgcctggagtatatttgttttcagttcccaagtcatgcggataccagcaaggaactcctgcaaatgcagaagggagttcagacttaaaggtttcaggaaaccaaattacaacgacaaatggacaacactgattgttaattcagggttaatgaattgataaaaaggatgaacaagactaattgttgatgctccaaaaatgtgaatgaggtggtcaggcaaatgtcaggaaagtataggttcagtcaattagctgcattacgtctcaagctcaaactcagtcagttaagactgtataaaactcacctgttttcaagaactcggctcgttcgtcatcaacctccctcccctccaagaatttcttcgccgattccatctcttcaacctccaacttcctgcgaatcattcacagcgtacagaattcacaaaccgcatgaaccagagcgcgaaatcaat

SEQ ID NO: 61552 - DNA, 13740 bp, Oryza sativa
  unsure (1)..(13740): unsure at all n locations
cagctgggcggacgacgatcgccggcgggaggagaagcctcagccatggctaccgtcgaccgctatatgtggaataaaaccgaacacctcactctgcgcccgccctgccatggcggggaccctctggatgcacaccagcctctaccatggatcctcctcgacgtccgcgcctacatcgccgaccgccggaacgccaccaccgccgcggccgatctcggcaatggccatcgaatcgagatcaccatcttcaccgccccaccgccgcaggtctcctacatctgcgcctggtgcccgaccggcgaccccgcccggatcttcgccaatgagcccctcgtaggctgcgtcaacgccgacctcgtcttcctccgcctctacagcgaggtagtctacgacctcgtctaccgcgccggtggccgcccttcgctcacgctcatccgggaccccgtcgacgtcgacgccgccagcttacagagggattacctgcgttcgctccacaacattgccctcctccgtcgtgctctctggatctggacctccatcgagtcacaccatctacggcagcttacaaactctgcctctacgagtccaccatccatggcgatggcaagtggagcctggagagcctccttctaccccagctgcgtcaaatgatcgtctataatacgagcagggtaattactctggatgatgatggacagggagtagtggccttcattgatctcaagcggggaatccacatctgcaacgtgctcgcccatggctgtcctggaagttacctgccactgccgccagagctcaccagctctcgaatgagcttctttgccgggacattgccatcgttaatggtcttctcaccattgtcggactgcgtactttctttgattcagacactgattgctggtcctgggatctgtccacatggagcaaaccggtggctcatctggacaacagcaaggactggcaaaagggcttcatggtagattctagtgacatcacggtcgacgccacttgttgcaacgtcgagctcctgcctaagctggagggtcgcccggccatggcaaagctgcaggtagctcttcctacgctcagcttgacggatgctaatgttgtgtacgtcatgggcaaggttgacgctctgacgagaaggcggtggtgttgatggttgacatggccaacaaaaggcttcaaatggtgtctgtgtatgatgctgagaggatcatcaacgactttgattactcctacacgcagtctaccatctcccaatatttcactacagctgcaggtgattacttaattcttgcgctgttctttctacttattgctttttttttcggtaactttgtgttgcatacgacagtaaacctgattcaaagttgtgattgctgatgtattttaaacctgtgtggctgctgctatagtgctagttggacttgttagtttaggctggaattattttgaacctcgctagactctttacctctctaattatggaagcctttggtgagattctagacaagttatagagtacagttccagacaagatgtagagagcacatgacatgcaagctatgtggaacacaaacccagtcaaatgcaactgcattttggattctagattgccttcatatgaaaattttcttgtcagtgcacgctatatcaagaacatacacataaacaaagtgagcctttaaaagaaattgtcagaaatgaaaacagaaacaatttttctgcccccaacaaagtggagagagagaagaccattttaggtgctcttgcattttttaaacattcttgaactaaattggttgatgctctcgtaggttttctttttgtcatactctcatagggcttgggatgaagggttaggtacatttgtgtgtaggctatatgcactaattcatgggccctttgttttgctgttttactgggtgcaggtgtaaagggaaacctgaagagacctttgaaatttcatatgcaatatcctcacaagcggctgggtgaaacaatcagcaggagcgataatcctattgacttgcatgagccattgcaactggatactggatctggtatgggaactaaagacgaaactgaagacagcgttattcctatggacttggaatagccatgcatgcactaaacgggcataaattaattagagctgttatgaatcatgcccgggcataaattattataaattaagttgagctgttgaaaataatgcccgggcataaattaattagagctagctgttgaaaagcatgcccgttatgtattttggttattgtgcatgactgcatgtctacattttagatttgccttgaatggatatgttcatgctcttgttggactctgtttgatcgttcagagagttgtctttggagcctggtgttacgatattgatttaatttataattctgtttcagaaatatcttttccctactctacaattcagaaatagcaggggaagcccgctgctccattttcatgaaaccagataatagagtctgttgcggagagtggtcgttcgccacgacttgacggcctccgccaacgaaatgtattcgccaatacgcatactccctcctatctatattaattgacgttttggacatagttgagatcaaatttttataactttgaccattaataactttaaaaatatttagtttaaaacaactaaaacaacatatatagatttgttttttaaagcactataataaaagtaaacatacatttatttattgtatatattataatagaaaaataaggtcagagatatattttgtaaaccatgtcattgtccaaaacgtcaattaaaatagaatcggagggagtagttcatatgctacagatcgatctgagacgtccaccgcctgatctgatcaggaaagcagattgctcgagtggccttaccagacatcaggctatcgtcaggcacaagcaaatcaccaccggcgataatacaaccaatagcaattcaaaacaagcacagtaggagatctacttatattgtttaaaataaaaatgaataggcgagcaattgccatacaaccaaccgcataagaattgtctgtattccacagcaaatggtagtgctccatagcaccaatataatcagacgagcgtgcctagtgatcttctcaaatgtgactagaattgaaccacagaatatgctgaaaacccagctcattgctagagtcatacagcacgaacaatgggattgaaccactgaggtggataatttacatggtgtgtaggacagcagctcttatcatcacttcccagacgctatttgttttcagttcccatagtttgaactttgaaataagtccagagtcatgcggataccagcaaggaactcctgcaaatgcaaaatggagttcagacttcaaaggtttcaggaaaccaaattacaatgacaaatggacaacactgattgttaattcaggggtaattaattgataaaaaggatgaacaagactaattgttgatgctcctacttgatttgaaataggacactccaaaatgtaaatgaggtgatcaggcacatatagttaccaaatctcattccagtaatgtaaactgcttactgatgaaggtcacttaaatatgtccatgctcttggacgtcatattggattgttggccttgctataaattaacgatgctaacctaccggcttgggtgaaagagttaatatcgtttcacactctgacagatacattatttaagagactgcatattcatccaccaaaactagaaagaaactgcatgttgcatactagagtatgattgaatattgataggaagaaatctcagaaccaacatatgattgtaacttagtatctttagtacatcaataccaatgttaacataaggtctacaaggtcgcacacaaggaaagggatcctagttcctaaccttgtactgcttgagccacaatatgccagctatgcccacattatgccagctatgccagtgatgtaaactgcttattgacgaaggtcacttaaatatgtccatgctcgccttactagaaactattgggaacttatatatgaaggtcacttatagattattagccttgccagaaattaccaatggtaacctactggcctgtgtagaagggttactctgacagatacactacctaagaaactgcatgttcatccaccaaaaaccagaaagaaactgcctgttccatactctgtatgattgataggaagaaacttcagaaccaacatctggctgtaactcagtaccctcagtgcatcaataacaatgttctaaaacaagatttacagggccgcacaaggaacgggatcctaaccttgtactgcttaagccacacaataggccagctatgccatgtaaggctgtaagcactgcaatgcaggtgacaacacaatagcccttgccaccttttagaatcttgataattgaatgtcctgcctactctagtaccacttgttctacagtctacaggtcgtatgactcaactaacagaaaaggaagccaagacaaaatgttcagggtctccaaattttttggtgctgcaacattgacagccatacatttattgatctataatctctttctccatttagactagttggattcaactcatcatagacatcaataaaattaaagtttcaaaatccctacctatgaaattactgtatttttccttactagtgatcagcaactatttcttacctcctcaccatttctttactacaacaagcattgcggaggaaaacaggttcagtcattaactgtagtagggttttagctcgagctcggtcactcaaagagttaagaactagtatctgtgattttgtctgtgtgcttcttctcgaaagcgtggagccaagccaagccaagccaaccaagggattggattccctgcccatcccttccaagttattaactgtaaaactatgctgtgtctttaatctcatagttctaaatgtatctacgacgaattaacaatctcacctgatttatctgcttctcctgtgcctacttctcgacgaatgattcgacagtcttcaaccaccggagaagctccatcttttccttgttcgccatgtagtcgtgcaagaactcggcaagctcgtcatccacctccctctcctgcaagaatttcctcaccgactccctctccctagcctccagcttgctgcgaatcattcacagaagaggaacatcatcacagaccacataaaccagagagcaaaatcacaaaagcttccgtacacgaagtcgcggcctccgctgctggtgctggagccatcggcgtcccggagagtgaggacgtggcggacgacgagttcgtcgtgccaggcggagcagatgaagccgaggacgcggtccgcccgggagacctcgacgatgaggctgaggtggaggcgcgggccgcgctcgagcgactcgacgcggcggaagaggggcgcgtctgggggcggggcggcggcgccgtcgaacatggtggcgtcgaccttgacttcctcgtcttgggcgccgcgggtggcgcgaaggcgcacccactgctcccccgggcggtcctccaccccgaacgatntgaaggccttcggcggctgcaacgcattcgtttctcggcgaatcagagaagacacacacacacagagagagagagagagagagagagctaagatgggggataggcacgttaggatgagaggataccgggtagggagggcggcgttcggagatgtagttgatctcggagcgcaggaggcggaggaggcggtcgtccatcggggagcgcagcggcgcgacgacggtggagaaggatggtttcgccggggaggaggccgcggcggcgagggagagagcccggcggactagggcgcgcgccatgtgttcgagcttttgcctctgcgaagcgtctgcctagaggcgagggttggttgaaggaaggatacgacgacgcggcggcggcggcgacctgacctgggctgcctaacattgcggcccgattctcctttgtggaatagaataagttcactagaggtcccttgatttgtcccagggtctgacagtcatctctgaaccgaaattctccactagctcatcctcaacttaccacatcatgttgagggaattttaagttcctgaggtatctaaatttttcataactcctctgaaaattgcgaaacgtatttattaaacctaattaattcgccattagcacatataggttactatagcacttatggctaatcacatgtgggttattatagtacttatgactaattatagactaattaagttcaaaagattcgtctcgcgatttatgtaaactgtgcaattagtttttttaatctatatttaatgctccatgcatatgtccaaagattcgaagtgacgtttttttggcaaatttatttgaaaactaaacaaggccttaggcttaacactatgaacaacggcgtgctattaggaaaacttccggattcggacctattttcgaaaatggaatctgtcggtcggaattttttcgaaaacggaaacgaattcggaaatattttcttggaaactgaatcggaaatgataagggcagtttccgtcggaactcggaatcggtccgaaactttccgaaaattttctcagaagtactagaaattttgtgactaaaataccctggattctttttttaagcactaaatagtgaataccatggtgtttggctgttatttttataaaaaatatgtgttatgcaaatctaaaattacataagaatattttttgtcctacattggaatttatcaacaacattactctttcaattggatttatcactttgatgggttttttatttcgataaattttcgttaccgtattcgcgccggttcattttcgctccgttttcggtttcgataatattcgattccgttttcgtatccggggtttccgatttcgactctgaaaaaaaatatgaaaacgaaaacgataaagatggtttccgtccgtttccgtaccgttttcactcctacgtgctatgccgcatatgggaggcagtctggtcaccttgcgcccaacagcccgccagctgttcgacgcaatgccccaaccccaacctcttcacctgcaacgtccatctctcgctactcatccctctccgtgtccttgctggacgatgatcgaatatttggcgcagaagcagaacgcactggatgttttcaggagaatgagagcacagcagcattggtcaatacaagaacatactcagttcacatatttttcatgttccaggagaagaacaataagagtacatcaatttgtggatgctttcttggtagaggagtggccaaccatgtaggagccgaacccccatacggtgatgagcagagacaggacttgaagccgctcatggggtcatggaaccagatcaccgccgcgatgctcgtcaccggcaccctcacggcgttgagcacgccggcgaggacggtcgacgccaggaacagcacgccggtgccccccagcaccccgagctggaacgtcaccgccgaccacaccatcaccatcgcgtacgacgcctcgccgtgcctgaacgccgccgcctcccgccgcatcgccgggaagccgccgccgctcacggcgagcccgacggtggtgaacgcgaaggcgcagagcgacaccatcgcctgctgctccagcacgacgtggaacgacctccggccgaggacccggacgaacaccagctccgacagcgcgaagatgaggccgtggagcgccgacccgagcacgtcccagacgagccccagcgcgtactgcctgcccgtgatcccggggtacctgtccgacccggagtccagcgcgatgatcaccacgccggcggttatgacgacgacggcgttcagcgacgacagccgcagcctgttcttcgcgatggcgcagccgaacagcgccgagaacgctagcgacgacgcggcgacgagcgacgccgtggacgccgggaggtaggcgtaggcccaggcgtacatgaggttgtcggcggcgctcaggaggccgagcagcgcgtaccaggcgcacagcttcggcgacagcggcgtcggcgccgccttgccggcgaggtagcacggcagcaggaggagcgccggcagcggccagccggcgacggcggaccacgacaggatccacttgctctgcccgccgttgttgtagtacagccgcgacaggaggctcgacgccgggaacgctgtgagcatcgcgccggcgctgaggacgagcagcagccagaaggacatgggcttgctccggtacgtctccatggaggaggcaaccatcgctgctgccttctgacgcagagagcgatctgctgcctctgatgaggtctcctccattgctgcaacttctactgctgttcatgacagggacaaatattcagaagatttcatcattatctgaataaaattcagaagatttcggattctgtctacagctccagcttggtgaagaggagtattttctgaacaataacgttgtgttaacatttgaaaacatggttagattggtagtaactccagaaataaaacagagtgaatggttgagtgcctagagatttctgcaatactagtatgatccaacaaaataaatttcattattgctaaataacaatgatgttgtttggatcccacaaatccaaaattattttaaaaaaacaaaatataatattacaattgtaccatacttattaatgttttcccaccatatttattaattcttcatgacaattgtaccatgcataataacattattgtataaccaaacaaaccttcttttgtgtttgtttccaggtctgcaaaacttttgaatttttttttggaaataatacgattttaatgaaaaatcgtaaaaaatatatgtcgattaggtgaaatcgagcaccctatcgaacaaccgtagttcgataggacacctatcagttcgacaggtaataaaataatttaaaaaaagagaaaaaaacattgtagcatcactgtagcatcatccctgtcgaacactgcctgttcgatatgtcctcctatcgttctttgcttgcttgatatgtctctgcgtactttttaaatttttttttcttgaccaactaccttgttaaattgccacagttcgacaaatacccgtcgatatgcagatgttcgataggttctcctgtcgaatcgtggttgttcaacagggtactaaacttgcgatttcgcctaaccgacctatatttttgcaattttccattaaaatcgtattatgtaaaaaaaaatccaaaactttcggcatgcaggagacaaataagaaaaaaaaatacgcgaaaatctgctacaggaaaaacacgcacacaattgtcatggccccgcaacaacctcaacaattctcatggcacatcagagtctccaaaatcaagaaacaaaaatagaagagttgaattaggactgcgacatcaactttgcaaagggagtcagcttcaagtgaaaaaaaagaagccttttttttgaagggttgttaatttttacagtagctaccaagctcaagaagcagtaatactctactcccaaataactcagaaaatccttcccaattgaaggtacacacaaaacgtagtgccatggccttcttttgtcctaaaactacgcagatgagcacgaattattcacaccgacgatgagaattggtagaatcaagggaggaagctcactaggttttgctcggcaattaggaaaaaaaacagagaagaaaagaagaaggacagacctgacgctgggacctggacgacatgatgatggcgtccctcaccgtcgccgtcgccgtcgcggtgtggttcctctccatctgccgccgccgccgtcggtcgcggagtcgcggacagctagggaggaagctacactctccgggtctcccagagaagacgacgatatgattattgatgacttgctggaacagccaagccaacagacagcctcctggtgatacgtctacgaaaaccaacctgaactctggtctggttcgtgcacgtcgctcgctcgctcggacgaattttgtttatctataaataatctggtggtcgtagtggcacaaatttttcatcaaagtacggaagtatatttaattatggaaggagaattagtactttattacccccgtttccactgaagtgttgaccgatacggcgcgtttcagcgtgaagaaagggagcgcttttttttgggcgtgtgtggtgtccgggttgggaagctgcccactccacaaagaacacgcgaaacaactgaaaaaaatgttacatctctgaatctcacaaaaagcgatttaaaaccaagtagtactagttaactaattaaggtcataccacctacaactttaattatcatcatcttatataaggaatatcacgttctttgtgtgacgcctggtaaacaaaataatataatataattacaagctgcaactcacaaaggcttcattgcttctggaggtgcgttgttttcgtttcattgagctggttaatgatcaggagttggcaggtgacgaagctttggaaaaactggagtaaacagtcatattatttgggaaatcaaacattaattaaaaacagtcaggcaacaagcccactatataaaatcatatcagaaacaggatggacaaaacagcaacaacaaaattaggatttcccaacaaatatggagagaatgaagtatttgacagatgtactgtatctagagagcacaggacacagacagacaaccataatagtgtaaaatcgctttgcctcttctcaaaatgaatagtatccgacttcagagtggatatgatacatggtttctagcattctcttcaatacacagctcagctaatgatgctgcgaatgtgcaaataaacacctcaactagcatccctctcttatctctaaactgactgaaaaagaatcacttgggtaatgtaataaattgtgcctgtctatttgtcaaaaatgtacactatacaatgtaaataggaaatttaagacagtttggagatcttgtgttgcctggcatcatcctgccatataaatactagattcttgtgaagcagcaaattatcacgacctgtggatctcacccatatatgtgaaaataggaattggtgtatttgtatctgactctgggggataaatatatgttgatatatgtcatctagcaagaggttcaagctggacctccatcacaccagaaggacttgattctgaattcctgtctgtactgtcaggatgcaaaagatcaactgaatcgtcttcctcggtgttacctaacacccagtgccctctagagcttgtgtcgccgctcctccgtttgacctctttatactccaagtaaagtgttataactatagcagaaagcacccacagcatcaaggcccaagtgagctcctctacattctcgctatcatacctatggcctaaatgcttcattccagtgaaaagtgccacaattccgactatgattgccgacctgcctgtgataacatgaaggtattcccagaggacacgattccaggatgaagcctccccattagctggtctcttgggccggaagtaggcatttagtggctgaagacctgccaacagcagagccgtgacaccaaatttaacatgcactgagctgacataaaaacctctgagttcagctgcagcgaaaaggacaccaaggaacattatagcaattcctgagtattgcagatagacatgtatttggtaccacccgtcacctttcaagttcttcaaataccgggcagccagtattccaccaggaagcaagatgccccaggcaacaaacatcataaacccatgaacagccagaacaggacgcaagtcctgttctgcctcagcagaacctctcaacaaaagcacacgtatggggcgactgcttgtgatagaatgcatgttactatctgtaagactgttacctgaccagcttgcacccatagcccaaacgaccttaaggggcgtggttggatcaataatgttcttacactctacccttccactacaggaaggcctaagaggacgagtaaactcaaatgtaataatgccattttctgacctacacctgacgtaggttaagttctcagatgttgggtggatgcccgctgcactctttccatcaatccagtaactcttgactcgcccaactccatcattgccaacccagccaacataagcataactgttcagcatgccactcccgaacccaacagcaaggtacccacttttcttctcacctcgagctgctatagatatagaatcatgggacagagtccagaacagagtaacctgctgatcatccaaaaggacgctgctattatacatgtcactaaggcctccatcaacaacttgaactttccaacccatcttcggttcatacaatgactggtagtagactagatcaggtgtattccgatcaggcagccaaagcagctctgtaggagttgctggtacaccatgagcatcccggctgccagcatatatgacctctgttttattccgcagtgtagcattccccccaattggatccgacgtgatgtaaagtgcaacatcatgcccagcctgcactgagaacttcactggcacacctctctcaaccttcagcagaggagcctccttcttgttgatgtaaatcaccttgtcagggtttggtgggtttgggtagcggacggctggagcagatgtcaccaccaggggtgtctttgcatccgcgatgatcctctcctgatcctccttgttgtcagcatccaatggtccgttgcagctgtccaccgtttccgacaaattcacccttgcaaacccataggttgtgtccctcggccccccatggttctgcgggaggtagtgtggcctcagagtatccggcggccgcagcttcccaatggcccagacaaccgccatctcctccgtggcactcaccagcacatcatacttggtatccccagtgtcaagcttcctctgatacctcacgaaagacactccatcccgccggtgaccgtacaccagcaatgaatcattcttcccctcatcataaaccttgtcagggcacacaccagataccggcgattcatcggtccccagcgtgcactcgctgtagtcggttatgtagtagtcctcggcgaatggcataccttcctcggtgaatccggcgacggcaacatcggaatggatcatggcgggagaattggccttgggatcagcccacccgaacgccatgtagtactcggagcccacggcggcctcgaggccgatctcgactgtgccggcggaggcattgagcgtccaacggagacggtacttgttctcggcgagagggaggcagttgtcgaacatggtgggaacaggctccggcgacggcgagggcgaggcgacgccggaatcatcggtggcgttggaggcggaggcggaggcggagacggggaggaagacgtggccgaggtcggaggaagtgtcggggtcgaagagcgcgaggaggggcgggagcggggcggagaaggggagcaggagggtggcgttgcggaaggtggagttgagcgggtggggcgagaaggcgcggcccgcggcgaggtcggcgagggagtccccccgcgccgcccaaaagcgcgcggagggggaggccgcgaggaggtcgaagcgggtgaggcgcaacgcgcaggagtcgtcgtctgcgaggcggaccgtgccgcggagctggtgctgcagcatggtgaa

SEQ ID NO: 61553 - DNA, 7728 bp, Oryza sativa
atgcttcgtagggaaggtcggaaggaggcagtcgcaaaccacttgaactgttaagagaagaagaccattttatgttctctcgagaaactttgaccattttatgtcctatcaacaaaagtttggtctatctcaaaaaaaaaacaaagttttggtcaatttatttgtttgtttgtttattgttgaaactgaatatcgatatcactttttacagaatgtagaaaaacaaaaaaaaaacgaaagtgataaattcagtgagcacaaaaatcgacagtagattaccttgagctagtatgtgtaaaaaccaggaagattttaatttctatatcatcttcagtcggttattgattttgactctgaggctgccactcaatttctcttatccaagttttagaagatgactattgtaaagcaaatggggtagtattaattggaagcattagctaccgtggtacacatagtatggtaactccgaaagtattggttttgttcaacatagcaatagacgtagatcattcttttgcgagagatgttctgtggctttgcacatgtcatcgtgctatgttttgtgacactagaatgtgcgatgttagaccctggtttaaactagtgctcctatatgatattgcctgtgggatgattatttgaagggcaatgcatgtgcgatgatttgatggttaatttgtaaaccttatttgtagaatagaaacggattaatccactgaataaattctagtgctcctcttgagaaaatttgaactcatgtgtatgaaataaaaatatccctaaaacaatgtaatgtgtctcaatcatggtatcatgaacccatcattcaaattttcactcgagatcgcgatatatgaatggagggggaaaaacctggtaggctcatttggcagctcgggttaccggcccattccccggatgaaaggcccacgggctaaattacacgcgcgtttggaagcccacaacagtcgcgtccacgcctgcgtcacgccgcagccgccgcgagatgccgccgccggccgggccgccggagtaactccggtaaactcaatcgattgctttggagcaaaacttgggactgactacgtgaaagattgtctgctcaattgaaaaccggtaaactctcacccggatctccatgaattggattttattttttcaggaagtaggaacttctgtttttagattggcaaattatgtttgttcacatttattagtttttatattaatattatattttcaagatgataatgaacagattccatgtagacaagttatattgctcctttttttttttgactacagacatcctatgcttggttagagtaaatcctctgatagccctgttttgggctgggacttaatatgtgaaaattttgccaaagctacatgttacatgtatatttctgtaggccattaaaaccaactggtttgagtcagagtttcatatactggaagcaatactggatttacttgataaccaatcactggaaacaatactaaaatgcatgaatatagaaggaaaatcctaaatttgcttaatattttttttctaaaactaatatctggtaactatccaggaattgaattgaatctgtgctgtggaaaactatagtcactgcaatcacatcaatactattataaatagtgtaattgctaggttatcatggcaagtttatttggttgttttacatcaatgaaaaagcagtgcaagtttttaggtcttctctttgtgacaatatatcagtaacatcagaaattgagacattaatcaggtgaacttgttttattttttttttgcagtcaccactaaaatgtaatatcagtgccgcatagaagtgatcatgcatataataagaaattgaagaagagagctatggaacaagtagatcttgtcaactagaatcgctaggtggtggttctttttaattgtttccccttgatagctaacctgtcaatgttgaagtaacattttgtatgatcgttcgtatatgtaggcctatagccagctccaatacctttttttttgcactatatgtggtgcatttcagcttcatgccctgaccattaacatgatctggttgtatgcccctcctgattgaagctagtgctataccaatcaactcccaaggattaattcctattgccactcgttggttccagtccttgcttgttatggtgcatagagcaaggtaatcagtctcataccatctgcttggtatagaactgatcatcatgcggagttcgttcttcgattcaccacttgcgctgagtaacatggactctgaaaatcatgtcaccaaattgggttattttcaggcatgaaatctgtcgtcaatagatattagaaggctgcatgtatgtattgtttgcagtaatcctgttagaacagaaattcttgatcatgtactttagtccgcatgttacatgtgcagtatagaaaactattttttttcttctttcagctagtacaataatggaactgtctgagttgaacattcaaacaattgaagttgatggctaaaatgttgtatcagaaatgtgagatgttgagaggacttacaggcttgcattgcatatttaccaatgataaatgataactcaaatatttattcatattcttatactgcctttctttccaactgaacatttagaacccaaacatgtacatgatgtacattttgcgtgaaggttaacaagcagccatatatatagctccaactgcgaggatataacaaaatcttttcacccaaagaagttaacactgcatttattttttacatgtatatttatttataacatgtaaaaactaggtcctagagacacttgtaacttgttgcacatgtatgttcatttacatgtgaatgagtttattcagcgccgtgttttctaccgaattttgtctgaatttggcatttgtacaccgtgacaagctttatagtgggacaaaggtcgctagctggcaagggcaggattcgatggattttttgttctccaatcgatgaaagattttaaaggcattctttgcttgtccaggagataaagatagaattatgccgtgttcactacattgctgatttcaacccaacaaaacttgataatttggtgttatcaaaatttaatagtttaacaaactacacaagccttaccgttatcaacctatcataattttgtaacttcgaaagttttcgctcacagaaattctgagaatgattgacgtcggtcgcccggcgcgggggagccggatcgggcgctcccccctcgcacccctccccccacgtgtgggcccgcccacttctttctcatttttccacaaaagatgtttcattcagtgtatttataatgtttcactatttatagatctaatgttgcagtgaattaaaatactttttttaaaaaaagaaacccacatattttggaaattctccattaaaggaatttggttattttttgttccaccaaaatgtttcacccagtgtattaacaatgtttcactatgtatagatctaatgttgcagtgaacaaaacattccattgcaacaaaaaaaacctacatattttggaaaccccctattaagggaatttagtttatttttttttccaccgaaaaatgttgcacctagtgtactcatatgtttcacttatgtatagatctaatgttacagtgaactgaaacattctttcgctatttactgaaacattatttttatatagggtgaaataacacccgatttaaatgagtgaaacattttcgatctacttagtgaaacaattctgatatatttgttggaacatcatgcaacatttaaaaataattcaataataagctaaaaaaattcatcggaatatattcatgtgtggtcttattttgaagatttaattgcaacgaatttaatggtgcaatcggatcatgatttggataagtaatttaagagaaatcagtttaaagtagtttttgcacgtaaatcgggcgctgatgtcagcgcccgatttttctcaaattcgatcgggcaaccgatcggtaggagtgccccaaaaattccaccgaaatttaaggctacgttcgttccccagggtttccaactccccaccctcattttcgtgcgtacgcttttcaaactactaaacggtgtgtttttttgcaaaaagtttctatacaaaagttgtttaaaaaatcatattaatctattctttaaaaaatagctaatatttaattaatcacacgttaatgcgaacatcgttttacgtgccggatagcgaacagagccttagctctaaaccaacttatccaatgctaccaaaatttagtatcatatcaaaatttgatattgccgaatttcggtgtggttgatttttcaataaaatagaaaagtccttaatttagacccagaagcttcacacaatctaccgtttgaatatttgcatttaccaaagttttcaaaaaaagaaaatttgaatttaccagcatcggctgcctcgccgggtcaaacgacgccgcccgcatgtgcagagccacgtggtcaaacgacgaagccgacactgtaaacataattacacgaaacttgaaggtccaaaacgcaaaaaaaataaacttctatccgataaaaaccccgggaaagatccacccgacgccccaagctttcttctcctccgcgcgcgggtcgtgccgtcgccgccgcccccgccgcatcgccgccgccgcgctcagatccagacccctgagacatggtctctcgccgagcgatgcgagcgccggagatgctccggtggctcgccgcggcggcggcgctcgtggctctgctcgccgccgcgccggccgccgggttctacctgcccggcgtcgcccccaccgacttcgggaaggttcgaatcgctgctctgatcccatccccctcttcgtcgagctaggaattgctgcgcgcgtgctcgggtttggatctgggtcgttggtcaacggggtgggggttcggttccatggctgggatgggatgggatctcgtagatctggctttgggtgttaggtactcctgattcgattattggtggtgggatatatatctgagcttgggattcacacggttgcaccaacaattcgcttgttccaaatacttccatttggtccatttggagtgtgtaggttgcatgcatcatcaaactcttgtagtaatggtggatttaagccaaaaatagctagtttggttgattttgtataaactttgacatcagattttggtgttctgagtagtaacattaaactacctctcgttaaacgtgtgtgtttccaacaagtattgtattggaataggtgattctgagaaaatccattggtttgaaccaaagttaagctcaataaacggatgtgcactggccatccgagccaagcagaagttccgtctcggaaaaaactcaactcacagtaattgcataccacaagatcatcttctgaagggttactcattaaaaatccattgccattacactaaaagaaggccatcgcttaaatgatctgaactgtaattctttgcttgccttcttttcctctggtgtatctaggtccagtggttattccagcttatctgattttgcctatggaattagatgatcacaaagttaacatagaacaatgcatgggcactggtttctgaaattgggttggtgagtcacccaataatgcattggttcactgcttcatcgatcataattataactattgttctgcttagttcttttccaaagaagattcatttgttagatcagactggtttggctcatcttcctgtttctttgcacttgtagtttcatgtgtacacatgccatgccgcatcttgatatgttaagtccaaataaatgttacctttaacaaggaatagtttagggcatcataacattttatttgtggccaggatttcccttataattgcctttcctgtttatctacagggtgattcacttcccgtgaaggtgaataagctgacatcagtaaaaactcaactaccctatgcatattactcccttcctttctgcaagccagaaactatcgttgacagtgctgaaaatctcggtgaggttcttcgtggtgatcgcattgagaactctccatatgtggttagtaccgggtaactcatattttgaagtttatgtccttgaagtaatatgccttaatctctgtttgccatcattctttttgtttgagctacagtttcaaatgagagagcccaagatgtgccagattgtctgcaaattaactgttggtgagaaagaagcaaaggagctcaaggaaaagatagaggatgaatatcgtgtgaacatgtaagggatatataggtaatgttgcacttcaagtcacagtatcttccaaagtgacatgatttgttttgcaggattcttgacaatctcccgctagttgtttctgtgttaaggcaagataagaacattgcttaccaaggtggctatcatgttggtgtcaagggccagtacaccggagtaagttgtgcactcaattgatgcttgcttgaccttctatttattcatatatgctctggattaacaaactgtgatatataaatgtattcacagagcaaggaagagaagtacttcattcacaaccatttgtcatttttagtgaagtaccacaaggacgatgattcagaactttctagaatagtgggatttgaggtcaagccatacaggttttctttctactttgtgctttgatgttttacttgcatatgctctatataaatgagcctaatgcatgtgttatttatatactgttatggcagcattaagcatcagcttgatgataaatgggatggcgtgaacactcgcctgagcacatgtgaccctcatgctaacaagcttgtaacaagttctgactctcctcaggaggtcgaagctggcaaagaaatcatattcacctatgatgttcactttgaggtactagttttgcatgttttgtttggattctgtttcccccttcatgtgatagttgcctattctcttaatgttaaatttattgcaatgatttccattgaatctttttccctcattgcaggagagtgacatcaagtgggcttcccgttgggacacctatctgttgatgactgatgatcagattcactggttttctattgtcaactctctcatgatcgtgcttttcctgtctggtatggtcgcaatgataatgcttcgcactctatatagagatatctctagatacaaccaacttgaaactcaagaagaagcgcaagaggaaactggctggaagcttgttcatggagatgtgttccgccccccaaccaactctgatttactctgcgtttatgttggtactggtgtccaattcttcggcatgctgctggttacgatgatttttgcagttctgggtttcctttctccatcaaatcggggaggattgatgaccgcgatgcttcttgtctgggtcttgatggggttgcttgctggttatgcttcttcacgcctctacaagatgttcaagggttcagagtggaagagaataactatgcgcacagccttcttatttccagggattgcttttgttatcttcttcatattgaatgctcttatttggggggagaagtcatctggtgccgtccctttcaccactatgttcgccttggtcctcctttggtttggtatctcagtgcctcttgtgttcgttgggagctatcttggattcaaaaaacctgccctggaacctccagt

SEQ ID NO: 61554 - DNA, 12149 bp, Oryza sativa
cttcctcttcctcgtctaggttatcctcatcatcacctgtgccgagattacggtcgtgctctgctatttccaactgtgcagtgaggactacatgtggtggtggagatcttacctcacttcgggatcctcagcactttatctcttcttatatgctgctttctacttcttcacgaagctgcagattactaagctggtgtctggcatcttgtactttgggtacatgttgcttgcttcattagcgttctttgtgcttactggtactatcggtttctgcgcttgtttctggttcacgaggttgatttactcatctgtgaagattgattagttgcaacactacagagcacagcatatgtttttaagccttctgagtcatgggaattgtatgttcgaagtggggatcaatcccctgggtttttttaaagaaattttcagtgaagttacattttaggttttagtttatgaacaatttatgtttgttatggctaaacgatacatcttactgtagtaatttggagtacaagactacaaggatagaacacattgtgatggagttgttttttggtgaaatttttttaatggactggtataagaattcaattgattatgaactgcttgtactctaatcaatggtattattgactctggcaccagtatgaaatcaatatgatgtaccagtaacaatttaatcactgttatattattagaatgaaatgtcccttttgctttcaagtactatccaacctgggtgttggtggtgtgctctgggtgtgtgacatttctcccatttttaattttgcttgtggttggaactttggaggcatcggtatgaaattgctccgcattctgtggcatgatttctcagaccgtcgggagacatggaatcaatatcaacttgccatgatcaatgtctttttcagtcttgtcgtctgagttgccctgccatgtgggcgtccgcatgttttcacgttccacggcgtgtagacggcggcgacaagctggggccagggcggcgtgtttgccgccggcgtcgagggcggtggcgcgtgatgattcaaatttcgcccaatttgcactaatccatggtaccttgttcaggccaaaggctgaacaaaaaagggtccagatttctgacacgaacggcacataaatcaaatcaaatcgcccgtgcttctctctcccctcctcttacccttccattggctccctgggttgagctcggcggcggcgcaatggcgtgccacctgctgctcgtcgccgtcgtcgccggcttcgccgtgagcctcgccggtgcgacggaccatatcgtcggcgctaaccacggctggaacccaaacatcgactactccctctggtccggcaaccagaccttctacgtcggcgacccatctgtaagcctcctctctccatctcctcctttctttcgctccagcagcaatgatttccgacgacgagatgcttgtgcttgtgccggcgttgcagcgttcaggtaccagaaggggacgcacaacgtgttcgaggtgaaccagacggggtacgacaactgcaccatgccggggtcgccggcaactggacctccggcaaggacttcatcccgctcaacgactcacgccgctactacttcatctgcggcaacggcttctgccaggccggcatgaaggtcgccatcaccgtccacccgctgaagcacaatgccaccggcgacggcgccaagaaccacggcggcgacggagccgcacaggaggccgccgctgccgccatgccgggcgccgccgtgtggatggcagtgctcgccgtggccgccgcagctgtcgccatattgccatgattaattaatctctgcacttgtgcttggaagaactcaagaacattggcacattgtgtgttttgctcgcatttttatcagggacttgattaatgtagcaccaaaatcagatttatattcaagtattaattcagcaagaatattggttcatgatagagcatcaggattcaggaaaaaatttccaggcggagaaagcagcgacaggatggagcattggaaaattcatgcatttcacacaacccagttcgattaagcaacatggcatgtattacaggttgtggtgcaagaaaaagatgctagttgaaagaaagaacaaaccctatagtgactgtagaatagaatcccttttcttatatacaccacttactatcctttttgtctatcaccggttggaactccatggttcggtctcggcctgctacttgtttggatcgcttgggccatcatcaagctcgctgttcacaaaggtaagggctcaaattctgaaaggggaactcaggcttttacaatgcgagatttcgtgatctggaatatggtttaggtgcgacggttaaaggaagctcactttggtcgcatctcttctgaagagacagattgatttgtgcttgaagtagcagctgacttgcttggcttcttgaacttgactatgatcactgtcatattatcacagccatcaccaccggatacaggtgccaagcaatggtcaagcaacttctcgcagacagcagataggctatcctcctgtagttgttttcccagtaaattaggaaaccataacataagcatattgcaaaacacaacactatgaactatatatttttagtgcataatgtaaattctgtgaatatcagttgcttacagtgttcatttctttgtgaacaaagtccaccacttcttgacttgacatgcaatccctgtcataagataaatttacgtctcagataaactatccagtgaaactacaaagaatacagaataatccatagaagagttgacaaaagatctagcaccatttcaaaataactgcaggtataaaaaatcagcttcacatctagtatacaaagttatctggatgtttatgtatctgggatccattataaaagaagttacatatcagcatctgcacgccacacagtgcactagtacacatcatctaaaaagaattgtgaattactatctccaagggctgtccaaatggtttaccaatagaagatgatgtcatttctttggacttaccctaattacaactattgtttctttttactaaaaaaatcaaatctgctaataaactaaaactgttgttggaaaattgagttgtcaaaaatcagcagcagctacaccagatggtaaaaatagctaaaattgtttatctcaataagatattcaagagagaatgattggtgcaaaggacataccatatgccatcacatgctaaaacgatgaactcatcatcctcagaaagtttaacctgagcaagccgaataaattccatgttacaaaaaatgttgtccaaagcaaatacagtgacagaaattgtcaacaaaacccactgtgtttaattcaggttcagcagtgacaatctgtctctcggctgggagaaattcattctgcttcaattccatatcccctggtggaaaagcacaaaaggataaataaaaattatgcgtgtagctaaggaattgtttttcgatgagaagagagggtgctacctattgcccttgccaagttcaaacttccattgacccgcccagcaacaatgaaaccaccagcattcagtatcctctccttttctgcatcaagatctggcttgtgatcttttgacaggtcataagcctatgcagaagactgagtcaggacacatattctaacattttcttcacaaataaaaccagagatatagaggtctgactgacgtactcgacccttccttgagagcacacaccgggaatcaccagcatttgcaacaatgagttcatcatttcttatgatagccacacaagcagtgcttccagatgttggcccaggaaaatgagaatgaggaccctggttaagtaacttagttagagcagtttagttgaactctacattcactagaatttcacaagaacagtttctttttaggaaacaaggtcatgtataaaaatatagaactctggagctgatgtttcgtaagttacatatatgctcagtgctaacgaatggtgcatattccctttgttttccttatttgtacaaacatattttgtaataatgtatttcaccaaatgaattttagatcacatgttatcatgcttaaaaataactggacatcaccttctaatataaactagtgttgacctaagtttcagatgcaacgatcataggcactcctgactcaagagcacttctcatattttcaagataactactagagagacatcccttaaggatttaaatgggtattttaagaaagacatccctctctgcagaaaccctaatcacataacaagcaggaccaagcccccttcaccaatccacatacttaagagcagcaccactcaagacaagcctctttaaatatgaattcagaattactagcatcgaatcagtttttagtattttatcccgtcaaatgcttgttctaccaaggaataactctgaagcatcatgacatcaaagatggcccctcaattccatcatccagcaaaaatggttggtaatgaaggaacttttagaatagcagttttacctcctcagtccaagtgtcctcaggtttatctgactctccaggtttcggggaccatattatgccttctaacatgccagtaaacttttgtcccttgtcccccaattcagccagttccctccaccccctttgccctttcatcatctcatccattctgaaagggtaaaaagcggtgcagactcattaaaaccaccaagcatacgatagtttcactgaaaagcacttcatgttcaaaagaggtacatgctacatacctgaaaaatgactttaagacagaagtagccaaatcaccagatgaataagcctcatttttcagtacttgcaagtgtagatgtttcgcacaaaacttagatactgccttccctggaattacaaaggacagtttgtcaagtcacaacataaagagttttgtccatgatgtggataaaaggacaacatagaagcgcattaagttttggtttcaaaaaaaatatatgaaaaagatgaatcaatttaaacctactcaatgcacttctaccttttacaacgatcaaaaagggaatgtgaaaatgttggactgtttgattgttatttccctgttaggttactggactaccaaactcaacacagctaagtttacctaatctgcatgaatggatgagatgatgaataaatgaatggatgagattatcatcaactcaacacagctcaggttacctaatatgtgtagtttgttaggtgaaagttggcgatgcttaattgaacttgctaaggttatgccatcgaaactacagaggcaccaatcatttgcaactagtaatggataaagttgtaagatgatattaattcaatcaccaaatggtaggcattaaatcgcactcgtctttgtttagatctgaagatgcaacataatagcgagttggacatgaacagaaaatcaatgaaaaaacttacctccatggccatcatagacaccaaaaaaggatgtgcattcgtccaggcgtggcagggcagtgtgctgcaatgtaaggatgcactcaataagcgtttaaagaacaggtacagccactaattcaatctaatttcacctgaaacggtccctaatgtcatgccaaatcaatgagaactcaatgtcgaacggcactcctagtgctaatcatcgtgatcaatttatctgccctagtatcggcactggactccaaatgcaagtgacaaggcgcaacaaaaggctaccgtgagtcttatcattggggcaacagaacaccaccattggcgaacgcaattggaatcaatccacgtagccagttccccggaacaacaacttttggcggctaaccaatcaagcaaatctacgagagacaatcctgacctaaaaaacagttgcgaattccgggtcctagggtggtggcgaatcaaccagaaagcagaagccaacaataatgtaatgtggaaggggaaacagagggagggaggaaggaaggaaggaactcaactcaccgcgtcctccatggtcgtccgccatccctgcatggatgcgaggccgtagcggaggcggtcgttcccgccctcgccggagtacttctccgtcttgggcgtgctcaggtacacccccatgtcgccgcccaaccgaatccccccaaacacccccctgcatccaaccagcaccgttattacaaacgcaaaccccaatcacaatcgcaaaaacagtggcgctcccccgatccccgcgggcgatcttcgccacggaaccaaacatcgcggaatcgaagcaggggatgaggagtgggaggaggagggtactcacgacgacgacgacgacgagggaggaggcggcggcgaggcgaggagaggcgaggtgaggaggaagcgaaggggaggggaggaggaggtgggcgagtatttgtagggggcggaagcgacgggaagaggagaggagagccggagaggaggagtcggaggcggaggcggaagggaaggagggagatgaggaggggtgggggattcggggaagattgcgtatctcctttttctattcaccgccaccctcccttctctctctcgctcgccgccctgttgcaatgccctctcctcctccggtagatcaccgatccaccgttttggtggttatcaacagatacatatactcctgcctcagaatttatctctagccttttctttcttttgaaatagagaatttatctctagtaaagaaataatttcttgttttgatttgtgcttctttgttaaaatatatctgcagttattacatcacgatcgtattatcatcgaataactcttgtgagaataatctaatgtttttaacatgagcatatagtttaagaattaatctagtgattgaatagtttgctttatttacttttccttttcttatatcgaagtttacttttacggtatacctataaatgattattgttaattgcaattagatttgagccattactgagtatatatgatgaaataatagtattctcaaccacatccatagtagaggctttactacattcgaattagattgcagccgataattatagttaatattttggttttttattacaattcaaaggcacatataaaatgaattaaatataaaaaaataaagatggattttgaaaagtatctaagaaatttctatatataatgtttcttaaaaaatctatttagttgcttaggaaacgtgcacataataattcagaagctaagaatataggttaaatcgtggcacatttatcatggcaactactagtttcttttggcaacttcttaggtgtactagtttctcgtacaatactcacacgtttattttgttccataaaaacgaaacattatgtactttatgcagcttaattaatagcttaaaacatgaatgacattgatccaaaactaccttccatcatcaaattgcaatgctacaaatgtgagtatctaccttccattgtcaccttgtgcaaaaagctttatctattcacgtggcacggaaaattacttctcatattggatgaacggaaaagtattcattattaacctgtggatacacttctgaacgaaactctgttcatactcgcaaggatcaaacggagtttgacaggatatatagtgattatctcaccgtttgatttgtcaccatcaaactttcaagccccaggtggctaaacaccacacatcaagatagattttttcttttctactttctaactgatgtctcaaaagtattggcttcagtgtatgaacaaaaatttacagctgggatgtcaagctctctgaacatctgtcaccctttgtttgattgatttcttggaggataaaattagataagctaattgtagttgttaagcaaaagcgattagatggtcacacatgtcggcatgtcaaggctacacagcctttttaatggcggcaaaaaatgcaattatgcaaacatcacaatgctttgctatcccactgtacttaacctccataatatataattaaggagaccttaagacagccacacgtcagctaatctccaacagtattctactagtatacattattcttaaagggttaattaaagtcggtacgctactaatcatgccaggaggatactctgtacgtagtatgctcctgtagcttatcataatctcttcagattcagagttcgtttttctctttcagaacaagaagattacggatcaaactcacatagctaagaacttcattaattatgttcctgaatcttcaccagaatcacagtacaatccttcatatatgcacacatccagccagccaattagagtaaagagatctcgccatttttcaggaatatttttctcctgatcatctgtcgcttttccagccattttttcagagttgagactttcagtttcagggtagttttaggttgtttcgtgtgtgcttctgcaggcagagctgggatcctggcatgtgttgccgtgttggccactaactcctgggagcctatggattaattgagccgataacattataataataatcttaaattcttaatcttaatcacgcagctcacgttgggtttgatggtacaagacgaggatcattcccaatgcaaacctgtctgtcagatttgttgtccctggatctcgtaatcttgtaatatatccgcgatcaaagcttttttagtgttcacgaaaaaaaaaatgatctgtacgtgggcactttattggacttagaatttgacattgttatcgcagattgatttgcatttgaggttgctaaatacggtaaactgtgcgattagcatgctaattaagtagtcatatgatctagctggcatgggattagtacgggtagatgttaatgcgatgcttttggttagtttacagccaattggggctcctggtttgctaggctggtcccccaggggtgtacgatggaatcggggacaatgcattttaataaaattaattaaaagagggatatgatttgtgtttttctaaacaaagaggaaaagaacaaggagagaatccgtacacgataccggtgtcgcgtcgatgatactgcaggctcccgtgtccggttttgagggtgctgagctaatcaatcaatccattaaccattgtcagatatcgttttagttttgggttatgtcgagcatgtctattttaactattatttcttataaattcgtatattctaatatcacaaagtttttatttagcataagaattcgtaatttatataagtcttaaaataaacgatttttcaaaagttaatggtaaaaatagacatagacatgtttaatccatattctttcacaattgaaacacatattttatttgtttttgttaacaagttttttaaactactaaacgatatattttacgtgaaaaactttctatataaaagttttttcaaatatcatataaatttatttttaatcttgaaataatcaaaaatcaatgaatcatactctatccgttatatattataaatattataagttgtttgacctttttaagtaacatattatagaaatacatttaatattaaatttgataaaactaatttaatatcgctaaatttttctacaaacttgataaaagctaataaaatttaattaggaaaaaatcaaacgacttataatatgaaatgaaggaagtccgtgctaatgatttctcatttttatgtctctatacttaatctttcatcggactcgttcaacgtgacataagttagattaaagatagaatgataaatcaatttgaaacatttggaataagtaattaaccatcatacaaatcatgattaagccttactcataaactaaccaatgataagtaattaaggctaggcgacgtgtcggcccataccccgtccgtcctgtaataatctcctcggcgcgacgccacgccaccgaccaacgcgacaaggcgagacgacgcgcacgcgacacacagccagcggaagcagcagcaggacgacgaggaggaggaggagatagcttagatcccgctcgcctctgatccccccggatccgatccgagatcctccacccatggcgtccggccggtgctgcacgttcctcgagatcctgctcgccatcatcctcccgcccctcggcgtcttcctccgcttcggatgctgcagcgtacgccgccacgaatcccctttcttgccctccctatctctctccttgcctccccgacgatctcccgctcgctctgctactgttcgtggataggtggatcggggggattcgttgtctcgtgtgcatctggtcgttagaatttcaatttcggggggcgaattttttgcgatctggtaggtcgattttgctcgcatccagtaataataattcgaggatactgggagtggttgcgaatccccgagctccaaacgctgcgctgccagcgctgaatcttgggtggacaactctcgatgtagctctgcttcgtgcaatggctatcctatgcaattgggcttcctttggtttctctctctaaccatttttcatctggagttcatatgaaagtgctactgtcggtttgtgatttatgatttatgttaatccttgcagtgtaagtaccctagaatttctggtaattatgcaatccctatctactgataactgatccaagagagtaggctgaaattttgtcacaagtccatataatctgcctggtgttattttattttaaactggttcttcgatgtattatagcgcatatattgtcaacttagtcatccccaggccaatttttatgctcaagtggaagtgctgcacaaagagcatggggattatgtttgaattttgactagtgataatggcatagttttcttgactctgctacatctgcctgtgttgatatcaaaagttaaaccataggcatagtccgaatgaatcagcgatgaacaagcttttttttttttgtgctgataacactactgacagttctgcattctatcttttccgcccctcgtggtaacatactaatagtgttgatatttattatgtcttaaacagatggagttctgcatctgcttgcttctcaccatccttggctatgtccctggcatcatctacgcagtctatgtgcttgttgctcttgactcagaccagtaccagagggaatatcatacccttgcttaggcagtccacttcaattctgtcaaacctatgctctatccagaacagccaagttctgctgttgaattggtatctggtaacttcgtctgggttttttgatatggcgttgtgaatcttgtgattataaagtagaaacagtggttcgtatcaaggaggacgaggaggcacctagtcatttggtcgttaaatctccctattcatctgttttgtgctaaatgtataattttatctggatctcttgactccttatttcagtctgttaaatgctcaaactgtggtctggtctccattctgtaattttgattcaagaaaataagttgttgagggtaaatattattggtgtttgtatgtcaataccgttgcaattcttgcctatttcgtcatggaaacaatgggggtgattattttgttacaacgacgtcagtaccaccttatatgccagtctatttatactttgccagtgaacttcaatgtttggtgggtttcataccttatgcataaggtattcaagtgcttcaccaatctttgaagaccactctggatttttgcatgatggaaatgttctctgagaattccatgtagaaatagatgactttatcatacttgatctgtagagtactaacatttatccaggccttgtaggaaaacagaaaacagtcttagaaccctcgccctttttcaaaatatgatatgcttgtcacatgctgtaatgtgcaggaaagtttgttttgttcagtactctagtcctctgacaataaattaatcagtgtccctcgtttgatggatcatatcttgctgctgattgtagtaatcacttttcatttgatggatcatatcttgctgctggttgtagtaatcacttgatcctgtcacttgtgtcctctgttatctgcgctttctgaacgacatcttcatactgatgtcgaatcatagatggatattataaaatacatgaagagaatgcttgtttctggtgctgaatgttcgtgcccatgtga

SEQ ID NO: 61555 - DNA, 10729 bp, Oryza sativa
attctctgtttcgttttcttaataatgcagtcatccttaattgggttggacgtcttaattgggttagacgtcatcgttgaccaatacatttgctgtattatataaagatacaactcgttgaagagatatgaggtggatcaaagtatgtgattttagttctgaattgatataaaatgtcacgttcttggggatgtctgaaactctgaattgttgttgtatgtcgatccatcggtgcggcatccagaggctggcatgcaggtcggtatatcaacgattgatctgcatatctttttcataaaattgcatgtctcagactcagcatgctactctaccatatggaggcatggagccttcgtttctggaactgaaacggcagaaaaactcattagtcgtcagaggtgagaagaattcacgggctgcaggttctgggagctatgaacagcgtacttatgaattttgacagcaatcacataggctgtgttaagatccaaagtttggatccaaacttcagtccttttccatcacatcaacctgtcatacacacacaacttttcagtcacatcatctccaatttcaaccaaaattcaaactttgcgctggactaaacacagccatagtctacgtcatgatcagctttgtttcaatccattctggttcaggtgccccctcctcttcatttctgacttctgctccaggtgcccagttatcgacaaaggggacaaatgatctactgaatcgcagcaaaaatctgtttttcaactagttttgttcatttaaatttcaagagctattactcagaaccatggtggataactcatattcatgccaaataatgccttacacacagtaccaataatttataatcctggtgcaagtctaaattgtgatatcactctgactactactcctacagtcattttaccaaccttctcttttgtcacaatccctgcatttttattgagtattggaagctgaaactagtagtaccagtgtactaaaaaacattcggacttatcagagctttacagcttttattcaaagtttatgccactcatgaatttgttccatgggcctgtgaagacgcaatgaatgtaaagtcagcaattaggcgtctgaaattacatgtctgctttgtctgacagtcacaattatacgctcattattttccaaaacactgtgcacacatcttccaactctcattcagtcattctgtttccatgaaggcgtccagtctcttgataatgtctccatgaaaggcttcctatgctgctatcatgagtgcctcgacaccatcagacatcagtgctgcctatctgatcatgtttcattactgactgtacactgaacatgcagtgtttcactggtaccagctggtattgtcaaattcttttttcttccctgaagaaacagtatcgtcaaattcttttgcatctccttaactgaagtccctctatccaaaaaaaaaaaagcttcttggaatgaatccggacaagtgaagatggttttttttgacggagagagtacgttctcccgaacatgagcagcaacatgactgcatcctatagtttcagtgagagaaatgtctggttaagtgccgtgttactatttcatggctcctcaaagctggcagtgaatgggaaacgtgtggttaaacatggagcagacagcagcagagtggtcggcaggtcggcaagtgtccctctactgctgctgctgctgctgcttgctcatcatcaagattcaagaggagcttgacctggacgtctcctctgctccatgtttgtggattgatcagtgggcaccactcaaccatcataatcctaggtaggatttggaggatgagtacactcttttgtgctcaccactgacttggatggcatattctccatgcaactttaaagtcctttccgttagggcaatgcatatggttttgaaaatgtggtcatcagttgattcatcatccttcatctagagaatttgccaatttgtatgcttgggctgtatagtaactatgacatgatctaagattttgcagatatcacacatagataaaggccgtgtttagttcacctccaacttccaactttccatcacatcacatcatatccaaaattttcctacactcttaactttttttttccaaactaccaactttccctaaacttttaactttttttcaggaactaaacacagccaaaaagagagagaagagtttaaatagtggagcaatcaagtgggcattgtttatgcccttgctaattgctagtagtacaaactaaaatagccaatatctgataatctgaacatgagaacggctgccccgttgtgtttcaaagaagagagttggagtacatgaaaaatcttagtactatactaagtacaaatgaactgtacctgtctctagtgtataagttttgatgggattagtacactgtacagtaatcacatcgtaccacaagccaaccctactgattttaaatccacaagggtaggagtgcatgatcagactcaaaaactctggtgagcagtgagctaaataaattgcactttttttttaacattaaataaattgcacttgtgcacagttctgcacttaatatgcaagcatcagataactgcaactagtcttgcatatacggtgatgatagtagcagtacgccagtaccatatgcttgactttctctataattattgacttccacttaactgccgtaggccgtagatgttgcaagatcccactaatggtcaaccagttgaacagaacaatgatagaggtagagtacagtagagtactactagtatactccctccgctatctatatctattataagagattttaacattttacttacactatttgactattcatcttatttacaaaattttaaaattattatttattttgtttatgacttactttattatctaaagtattttaagcacaacttttcattttttatatttacataatttttttaataagacgagtggtcaaacatagtatgtaaaatatcaaaatactttatattagggaacggagagagtattatctctgttaaaaaaactcaatctatctttttagtactgcaaatctgaataattctttattcagattcatggtacttccttttgggttattattatttttttttaacggagaagaggcagtactcggtgcagttgagtgcagcgcaggctggagttgggagttggctgcctgcgatgcgagggcaaagaaaaggaaaaaagatgccgctgcaggcggctgccgccacccaccaaccgcggacaagtggaagccccaaaccccaaccgaaagcgacggcgcgcgcctttggtggatggccgttggcgccgaggcaagcgaggcgcctgtattttcttacatttcagcccttccctaaaaacttattttacgaatgaaccttttaaaaaaactcttataaatgaacccttagaaacttattttacttttgcacctaggtccaacgctatgctgaagtcaatggcgtcgagggagttgacaccttgtcactttgtgtgagcacgcggaccggcattttggcgattgttaagatctctagccttgatcctcggtatggtgaagtgagctatggttgcgtggacacggtcagtcagcagttgtagttgtttcatgacagtccatctggttgtggccgctgccgtgccgaatcatgaccaggatttattagcaccaaagactccggcgctgtgacgttggacctcatctttcccaaagtctaaacttgaaataaagctttgctgatggtgtctatatatgtaaaataagtttatagaaagggggtaaaacagaagaaatccagggcgaggcgtggtcagtggtcaccaaccgcgggcgccgcgactgcctgccttgctgtctcgtgcctgccgtggaaaacgagggaacgggaacccaacccaggcgcgggccccgccggccaccgcgcgcagtcgcagcaacagccagtactctctctgcgcggcggcagcgcatttcccactcggccactccagccccccgcagcatccgcccgatccgccgcgcggctgcttggctgttggctcccaccacaccttggcgtggccgtggcgcgggtgttggatccgtccggtcagcgctggcgtcaccctccactccctctccttccgcccttgcctcctcctccgcctaatgcgatccgacgcgcgccaccaccacctcctcctccgatcccgcatgcgcccggtccaccgcgcctcgcctcgctgacccacgggggccacctgctgctggtggtggtggacggacggagttgtccgcgacggtctcccactttccgcctcttccccaccaccatcgttctccttctcttctccctctcccacctttctccccccgcgcgcccgatccttcccttcccccaactccctctcgcatttcccagctcggatcctcttctgacttctctctctctctccgtctgtctctctcctctttcgaggtcttcagtcttcagtgttcttgacgaccttgctgcttcttgcctctgtttcgcctcctacttgccgtcttcttcttcttcttgctgctgctgctgctgctgctgaatttttcttcggtcagttagtcggtcaggccggtgccggtctgggagcgattccgccggacgcacgcatcaacagtggagggaggggaggggaggagcttcccctttttgatctagcaagtcgtcgtctccaaaaatacacttttttttgttgggtctttggaacaaaagggtctcctccttttgatctttctgtctcatcactaaattagcaaagctttgtgcttcgcggcgatctcttttcagctaattcagtctctgttgatagcttcgttgcccaagagagatcccccatgtcagaggcgagcggatgacaccgcaattcgggtccggttcttccgcctgagctgcagaattttaagcttcctccgtggtgccgccatggatgcccttcctgacgccgccgacgcggcgcagttggcggcggcggcggcgccgccgcagaagcgcgacgagtggagcgagagcggcattgtgcggctgctggaggcgtacgaggccaagtggctgctgcggaaccgcgccaagctcaagtggagcgactgggtcgacattgcccacgaggtgtccgcccactgcgccatggagaacgccgccgccacggggaagcccgggagcagcacggccaagacgcccaaccagtgcaagaacaagatcgagtccatgaagaagcggtacagggcggagtccgccgcggcggcgcgcgccggccccgccgccgccggtgctggcccgtcgtggcggttcttcgcccgcatggacggcttgctcaaaggccccgccggctccggccagccgcaggcggagttgagcaacagcatagacctgcgagctcctcctcctgcaaaggttgaggtcgatgtcgatgcagatttcgtcagtcagttagctgatgcagggccgggtgcactttctgaattggtgagtgcatatgcaaacggctcgattcaagagaaattggacaaggttgagaacagtgggcatgttgaggggagagctgcagagagtgatgtcaatgtgagctctccgaggatcaaggaggcgaacgaggatgccgaggaggtggacaaggtatgggacatgtccaagaagaggaagaacacggagtttgatatcgcgaagagcatcgagttgctggcaagctcattcttgaagattgagcgcgcaagaatggacctgtacagggaaacagagaggatgagggttgaggctgagattaagaagggtgagatggagctcaagaggacagagattatggcaaagacgcacttgcagatcgctaagcttttcgcaaagagattgaaggagtgcagcagcaagactggtggtagctcatctgtaacagctgaagtggacaaccatgccaagaaaggagaaaatggttagtatcaacatgacaatttgcgaataaactggttgtagttaactaacttaataggggtatatgttgttctttacattccatagctatcaaacattccatgcaatttgaagttaagtactcctacttggcatttgctatatctggagttcactaatagattaggaagttccagcctgttgagttttgtctagtgtaattatgcgctacatagtctttgagttccaaatttttggagttcggtacaactatatcgatagaagctgatattttctgagtgcatgttctgaaatacagaacggcttgattgcatgtgtggtatagtgcaaacacatgatgtttcgttagtacaagattttgattgtaggagtgcatagactaaattgcgatctgcaaaaagtacaattacgtgcgacctcagcagagcgatcttccatgttgcaaacacatgttacctgaattacctaaatgatcagaccttacattaaaaagattgtatacaaccgctaagtaataaaattgtaatgaaaatataatcaactgtgctgatggcatgctataaaaatactcctactgggttaagccatgaatagacaaaattttgctatgttctcctactctccttcaaaagcgaatccaaaattcgtataaccctagaggtgtccaattcataaaaatgaaagagcaattgcatgcttgttgaaagtgattctgactgtataatgctaccataatctatacaaattgaacttacaaatattctggagaaaaaaaatactggatcagcctatggatgtgtttaagtgcatctgtgcatatatttatctgatttgattgaatacgctaatattccatatcttatcaaaatggaccatgtaagccttttcatgcataagaggaaattagattatgagaaaatcgacacaggttgctaaatctgttcagcttagcatatattcagaatcaatcatcaagtgatcatgtaccagtactatcagggctaagtattggtttgtgctagtgcaattatgtttactttgtattgataaaaggcaaggttagcacaccaaacaattcaaggattagcatttatgccctcaagttgaaaccgatctgaatttctgaacttttaaatgcttccatcttcaaatacatctcaaaaattatcttttttgatcttcttttaagttgcttggaagtgccaactgaaagcgcggttttcattgtaatcaaacatgttgaatgatgtttacactttctatttcatcttgtttcgctgtgagcagttcttctgacttttgggcttatgaatttcaggttcagggtgattgaaacaccaaccgatcgtccagaatccagaaagcaggcttgtagtttttggtgttcttgtgcaccaaatgtatgtctttgattgatccgacttcaccatgtacgaagagatagttagctgtaaaagtaaaatgcaataaatgatatgattgtccccattcagtgggggattatagaagcagttttagaatcagtaactagcctgaagaaagttgttgagttccttttgttaatattttttgactgacagccatcgtatgtatcattctactttttttagataatggattttcattaatccggcctctagatccacaaatgatatacacagccaaatccacgaattatatacacagccaaatgtatcattattctactatctcattgttgcgaagtgttttctgaagcaacatccaacgataagattcttgcgggatattttattgcgttgataatatggctttggccgtgttaattgcaggattaaaatggttggaacttacactgtcgtttacttttatgctgtaatgtggtattccaagatctcatccgactttgtttgatccagcatacttatcactttatcagatagtgaaaccagatcccatttaattgccctctaatgactccacatccctgaatttatctacacggtcgagattttttttatatatattcatgtattacgatgttgatataaataaaaggtaaaatttatttttagctagaaacaaaaacgttaaaaacgatactaccatttttattttattattttcgtgaatttatcgtgattcgaacccctactgatacctctctctccgtttccaccggtaaaaaatagggaaaaaacagaaaaggctgttcagatttgctagaaaactttcataagtttttttacccctaaaactttcatatttgtgactatagaatcgtgttgagaactcaagatttatgtatgaagaagaaaatttgctcgaaagaaatttttacacatctcatgtgcaagatcctagcactaacaaaccaaaccatatttgaatataagttttatataagttatatcgtagctacagtatagttaaagctaagttacaatataattacacttcaattccattatattacatgcgaaaggttttgactaaaaaaactacggggcgattttttagatacttccaaggctgtttgtcgtgggtccacatgtcagttacatggtacaaattcgtgtggactctctgtgtggctcaagctaacaagcaggaaggcagggagtaattggtccaactccctcttcttcttcctcgcctctcccgaaaggaaaagaaaagaaaagaaaacgaaaaaggggaagaaaaatttctgtgtccgttccatcctagtccttggcaagtcttctcaagcaggaggaggacttgccatggtgttgatttggggcgggaagaagcatcgggctcgccgtctgctcctctgatcggcctcctcagttgacacagcaagatttggtccggggggaaggggagcagccgccatgtttgggtcccgagtccaggatgaggtggagatgcagaggaggactaccaacaggtgcgtgctgccagcttgtgattctttaatcctgtagcttccttttcgtctcttgatgcagaagaggaattcttttcggttctttcaagcatatgtaaggaggaaagtttcaatttatacggcagatttagtttgccccttttaatgtagtagcttgatccgcagttgcgaacaggtggacacaggaggcgatatgttgtcaatatgcaattctggtctaattgttaccctttctgattggaaccacccaatatttgcacaaaagataatacacattcagagataacatttttgcagtttatttttccttactgggttgtttctatgtgtaggatctttcctgatgagagacaggaccagtttaagctaccgtttcaagctgcacgggctgacagatttggggtaaacaggatagatgcaaagactactgagaagattaaagtgataagtgaaggcaacataccatggcaccgccgcattctagaccctgggagtagcatggtgctaatgtggaacagggtgttcctagggtcctgtttgtttgctcttttcattgatcctttcttctactacctgccgctagttcatgtactagatgaaagtaccaaccgttcatgcattgccaaggaccggcgattgagcataactatcactgttcttaggacatttgcggacttgttttacatgctgaacatcatggtcaagttccatactgcatatgtagatccaaagtccagagtacttgggaagggagagcttgtcttggacttaaagaagattcaacggagatatctcagaacagatttctttattgacctacttgcaacgatccctcttcctcaggtaaatagcgcagaagtaatgcttttttggaattcttattgcatttgttgatggtagatacccccagttacccatgcgcaagactaaagttgttcgaaagagtgactatggtgcaaatgtttgtaattgtgcactttattttcaccctccactacatcttttgttgctaaaagttttgtatgccacaaccatccctcaaagtacttttaataatgcccttttgcaatttactagtatttccattctttctttctgtttagaataaattcattagttttcatgactaaaaactaaatcacttcccctgagtgagtttaaagacaatttattttattatttccatgtttacttggaatattttcatgatatagttaactgctacttcgatttataattatccatgttgtctttgccaacattgttctaaaccatttttactttgcactgctagaactacatgattggcatgttattttcccccaatttccagtgtgtggttgatccgctttcccacaactgaataccgataatgtaatcaattgaaacttttgaattctacagtcatagcctgaatctcctggtggtactttctcttgcaggttaccgtgtggattattatgccttcaataaaaaactcagattacaacatccggaacaccacatttgctctggttattatgattcagtatatattcagaatgtatctcattgtaccattaagcaatcaaattatcaaagcagctggagtagttgccaagtcagcctggctaggagcagcatacaatcttctgtactacatgcttgcaagtcatgtatgaccaccttccatcttcaacttagtgttcatcatttttgtgccatgttaatttgtttaaatactaagtgttgtgcaatgtaatctacaattgaaacccaacttaaattttgcagttttttccctgatacctcattcacagtaggaattggacaaacaaaatgagc

SEQ ID NO: 61556 - DNA, 4601 bp, Oryza sativa
caataattttaatatcacagctcttagctgcacttttttttttgaactaatacttcaataatgttcctcctggttctgcagattactggagcaatatactatcttctctccattgaacggcaaattacatgttggaatcagcagtgcctaaatgagtcttgtagttttaacttcataagctgtgacaatactgttctagcagttatcttacttggggaaagaacacaagtatatttgacaattgtgatcccaatcgtaattcaagtgctaaccccccaccatttaattatggaatgttttcaaccgcactgagtaaaggtgctgtttctgctccatttcttgagaagtacttcttttgtctgtggtggggcttgctgcagcttaggtataattaatttttaatatacatccccatcttgaatattaaactttctgtacatctgttgttgatatcttgcctgtgaactattaatctgattatatactttacttggggttcttccatgatttatccattttattcatggttctgtgtgattcaaatacaattgctcatgtttagttttctgctgctgtatgtgctctccttttcagttctagtggaaatcctcttcagacaagtgcatacatcgcagagaacacatttgccatagcaattggtgctcttagtctcgtactctttgctcagctgattggcaatatgcaggtattgtcatatcttttgttctgaactaggggagaaaatgctccaaggacaataattttcttgttactgtttcagtttactgtaaatgtagtaatgcaagattgttacgttctataatatgtgcacataagtggatgtcctatttctgtgatcaatggatgcttcaagtcagaaatttccattttcattgttttaaaatctgatgacaggaacataaaactatcactttgctcataagccattttccacatttgcaaccaattgaggttgttggttcagagatgttgcttacttcctttttgtttgtcatcttgtagacatacttgcagtccatcagtaaaaggcttgaagagtggaggctccggcaaagagatatggaggagtggatgagacatcatcagctccctgatgaacttcaagatcgtgtccggcgattcgttcaggttaaatggcttgcaacacgaggagtagaagaggaatccatcttacaagctttgcctgctgatatacgccgggatgtacagcgccatctttgtttggaccttgttcgacgtgtaagttgtggttatttacttacatttcaactgaattagtagaatgttttagtttctgaaaggttttagatgttaaattttctagtggcattctgtcgtttggatggaaaaatcagtgacaaaagtaccaccagtgctacttcatagtctagcatgttttcttatcccttcctaaaatgcaggtcccatttttctcggagatggattaccaacttctagacgccatctgcgagcgtctggtgtctttcctgtgccctgagcgcacatacatttctcgtgagggtgatcctgtgaatgagatgctcttcgtcatacgcggtacgctagagagctcacaaccaacggaggccgcagcaacttcttcaactccatcatcctgcgccctggtgatttcgctggcgaggagctgctcacatgggctttacttccaaagaccaatgtccatttcccgctttcgacgaggacagtgcagagccttacagaggttgaggcctttgccctgagagccgaggacctcaagttcgtcgcgaaccagttcagaagactacacagcaagaagctccagcacacgttccggttctactcccaccattggaggacatgggctgcctgcttcatccaggctgcttggcggcagcaccagaggagaaagctggcagagagcctgagccggtgggaatcatactcatggtggccagaagaacatccaccagctgacaagcctaaacaggagggcacttcaagcagtaccaagactattgctgagagtgccattgctcaaatgcacaagttcgcctccgcttccagaaggttccgtgccgacgataccgccatccggaggctgcagaagcctgatgagcctgacttctctgcagatcatttcgattgaggctgatgtttcctgctttaaaaaaactgttgtaaaaccactactgtgcactgcattgtattcaatagccatatagtaatccatgtgtatctcaaagatgaaaccaaactggtcctttgtgtaattcaaatatacgcattttaggagctgtgaatcgtgtgcattttgtttgcagttgaaccaacctcgagaattttgaagaaatgaacagtttagtgttttatatattgtcgcgaccgagaaaatttgcattttcccgaacgctagtgtattaatccccgtcccaggaaaagccggggtacaccacacaaacatgatataaaagacacatctttattatatcgataatatttacattattacaaaggcacttcaggcctgacaatcaaaaataaacagcagcggactagcgggcctacggctccatcttcacaggcgctcaactggggtataagccaggactccacctaagacatcttctccaaagcctctcttactgaagaggggaaagattgagcaagagtgagtacaaccacagtactcagcaagtcacaccggcagatgcatgattaatgcaagggggtacaaggggataataataggggttaagttttgcagtaaacagcatttaaaagtcacttagttgcccaaagctattttgtaaacacgatcctagagctatacaatattattaatcaaggccgtgaaccctcacgaacctgccttaacccaaggcctacgatgattcagaccgaactggcaacccgaccctgggtcccagctcgtcccaagccaacccaggctaaccattccacattttagttgttgagcaaattttaagaattaaaacactaacttgggtacattgctcggcttgcccataaccgagggcgcggctattcgaataggttttactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaatcacctaatgttgcctaattaatcagcgaagcatctacctaaatttatactagtggaaccatgaatagagtacccactagttggggttttgtttattctagggtgaacaaggtaataataacaatagcaataataatgtcttaacaaaggtaaataggcatggctaaataaaacagtgataacgcgggaataaaacgataatgcattaatttaaatcaaaataattttataaactgggattcaatatgctcaaggatgatgtgacttgccttgctcagagagaacggccttccgaaccttcggcgacggccgcgaaccacgcttcgggaacctccggaacgacgaagactacgcgaagcacacaagcaaagctacaagcctaaaaagaagcaataacaatacataaaaagaaagcacacggttctttaggttatacaaacattaggagacttgaacgggtcgattcagagctcgtatgaccaagatatgatcatccgaagtttaatgctgttatatggagatttgcggattattgtaattaggttttgcaactataaaacaggtgtaagcgctagcctggaaaagacaggaaggctgcgccgttgacatgcggaccccacatgtcaacctaaaggaccgcggtagaccgggtacacagagacggtccacgggtcgacggaagcggaccccgtgtgtcaaccgaggcgagtggccgacaaacggactccactagacaccacacgggctgcacacgtggaaaccacgcggctaccgagcgggcacactaacacggtcaccacacgcacaagcgaacgactaccgacaccggtacacgggtatcggggtcgacaaccgcacaacgggtacgggggacaccgaaaggacgaggacggggcagcgagggagagggaaccttaccaccacgcgacgaggcgtgggaacgacaacgacga

SEQ ID NO: 61557 - DNA, 5798 bp, Oryza sativa
gaaaccgaggggtggacgaggtggagggctacgtcaccgtgccgagggaggggacggcagcgccggctgacgcacgggcatggcgaaaggggcagccggaggagatgccgccgaggaggaaggagaagccggcgcgggcgacggtgttccggcgaaattcgggcgaggaggaggtgatgccggggatgagggcggcgtcgcggagccgagggaggtggtggcgacgtcgaccggcgctcaggcagggagatagaggcggctggaggcggccgacgcggaggaaagggaagggcgacggcgggaacgcagctccgggggtctccgcgggaaacggagggcaagccgggcaaggggaggcagctgctatgctggaggaggcgacggcacgaccggaagacgctccggcgaggagggagaggcggctggaggcggccggcggcacgggagagagaggaggacggcggggagagggctagggaccacgggagatcgcgggagggggctaaaacgatagaacggagcgagggggttgcattttatagcggagggaagcgagccgagcacgggagagggcggaacggcgacgggaatggcggccggcggcaaaggaaggcggccggacttggcgcgtccgttcccggcgattgggggcgccattcaagggggaattaagggggaaagagagaggagggaaaggggtttaattccccctaatcaatttgggaatcccatgcttgaatcgcgcggatttgagggaggaatggcgctagggttcacgggagagggagagaggacggccgggcgggaggaggacgatgacccgcctgacgcgcgggccccacgcggccggacgcgcggtcagcgcacgcgcggcgcgcgtgtgcacggccggctcggctcggcctggcttgggcgcggcttgggccgggcggccggcccaggaggagaggagggggaggcggcctgggagaaagagggaggaggagggagtgggccgggaggggaagaggggcccaagaggaggagggagagaaggagagggaggagagggagacttcggccgcgggccgaggggagagaaggaggactttgggccagacttggcccaaagggggggagagagattatttttaggtttttctttttaataaactctaataattgtttttgttgcttaataattatttccggtgctctgaaaattcaagtaaaatttaagggctccttttagaccaaggagaatttaacaaaaattccccgggccacattcgaatttttcttgtacgcattttagtgtttgccaatttcttttcgaattttaattaattctattattccttttagaaaataatttttattttgggatgaatttatcaggacgtgacatatatcgtacgatttcacatttcagttccatctcgttttgtttttctcgatctcgggttactctagctgggctgttcttgatggctgccgattgccacacttcacaggagacaattatcatgaaattccattattaggctttcttcgatcacaatcgctctgatcttccgagaatcgtttttggagattcaactttttaatccgttgttagaaagaagggttatgcatatagcttagctaacaatagatagaaatataagtctttgaggtggtatattaagtagtttttatgcctttaattaaattatttattcgtcctataacatatgcaataattagatgttactttatttaagcaaagatcggaataaattttattattatttttattaaaaaaaaaagtaagacaacgaattacagtaagtccaaaaaaaatcgtttgaatttcgaaagagatattgttggctgtgggctaaggtgggccggtaattttctagcctgtgggctgaagggccgcagttttccctcctttccatcgtcttccttccgtgggttagatcgatcgatctggctctctcgcggagatcgagcaagacggatgatggcatccatggcgaagggccgccgcttgtggaaaaccaagcatctcacactgcgcccgccctgccacggcggcggcgatggcgatggcgatggcggtcacccagactggattctcgtcgacgtccaggcctacatcgccgaccgccggaacgccaccaccgccaccgccatgctcagcaacggcggccaccaaatccaggtcaccatctgcgtcgcgccgccgccgctcgtctcctacatctgcgcctggtcccccaccacccaccccgccgagctcttcgacacggagcccaccgtcgaggccgtcgacgccgacctcctcctcctccgcatccacgtctcgctcaaccatgtcacgacctcgtctaccaggcatccatgttgccatcgctgacgctcatgcccagccaagatccttacctgcacgagcccaactgcatcgcgctcatcccccgctcctcccatggcttctacatctccacgctcgacacggatctccgcagtgggattgggcgatacaacctctgcctcttcgactccaccaactccaaatggagccatgaatcgctctctctggatcagctgcgcaatccgcctgacaaaaacgaggtgctccatatcacggagaaggtgatcaccttcatcaacgatccacatctggttgccttcgttgatctctggcggggcatcatcatctgtgacatacttgacaccaaaactcaaactgcaagctatgtgccgatgctcaaggagatcatcaacctccgcagaacccgagcatcgtcgatcaccagggacattgctgtcgtcaatggccgcctcaccgtcgtcaggctcaccactgtctttgatccagatatcaatggttgggactgggatctgtccacatggagcagggcagtggattgtttggagcaggaggattggcgcgaggactctctggtcgaggcctctgacatcttaatcgaccacaacatctgcaacgttgagctcttgcctaagatacaggggcaacctaccatggctaaactccacgttgctcttcccactctcagcttgactgatgctcaggttgtttatgtcatgggcaaggttaacgaatccgatgaaaaggctgtgctgctgtctattgacatggccaacagaaggcttgatgcagtatcagtgtatgacgctgcaagaatcctccactactttgatgtctgctacacgcagtctaccatcttccgatattccgccccttcttcaggtgattaattccctggctattctttctacttgtttttcttctggccaaacctttggatcaattgatagtaaacctgattcgtattgttgtgtttgctgatatatttgaacacatatatgtatgtggctgttgctatagtgctaggctgctagctagacttgctagtttagtcggctgttagttggaggctagtgttagctagactgctagttgagacaacattagtgtgaggctaggtatacttttagtcgtcattcattcattcattaagctgccagattagttatagagtatggttctagataaacaaatcatgaaatgcaagcccatatggcacatgtagccagttaaatgcaagggaatgttagctttcacattgccttcagatgaaaaagaaaatgttgctgtgggtgcatgctgtatcaaaaaacgctcataaaacaaatgagccattgaacgagatggttggaaatgaaaacatcgacaagatttctgccaagagagatatatagcagaccattgtaggtgcttttgcattcttgaaatagaatgaaaacttgttgaattatgtgtaaatggttaagcacatatatgtgtaaattattttgcactaacacatttccctttgttttgctgggtgcaggtttaaatggaaacctgaaacgaccagggaagttccctatgccatatcctcgcaagcaacaggctgtaaatgagccatttcttccggatgctgggagaggtttagaaactgaagatagggatactatggactgggagtagttatgtaatttggagctgaaacctgaatagacataaattgatcacagctgtttattttgcttctagttactacatggattgctacaaatgcagctactctagaagacatcagcctgcatagagaaatttactttggcagcaacaaagagtcgaacttggctatctcaatctttgagcatctgccgtcatctcacaacaattactgtcgtgaaactccatcattaggcttttcttcggccacaattgttctgatcttccaagagattcacgctttatgtgaacacagaaccatttcagattataacgcatttgaaattaattactgacaaaaatgacctgtaaattctggtaaaacactttgactggttcggggatctggagtatgattatagataagagtattattcacatttagacatagaagcgcccatggcctaatggataaggcgtctgacttctaatcaggcgattgtgggttcgagtcccactgggcgtgtttattattttttttctcttttaagactcagaaacagaaaactttttttataatttgtaattagcaaatacaagtacagatagacctacctcattcacctctaatttctgacaagaaactagttagctagtttttgtgagaaagcaggttggagaattgctacacgtcgccgcagcccacccaactcacagtattacggcccaaccaggcctcccgtaacgggccgggctacatgcagtttccattgcgaccagcatgctggcccacggtcaggttagcgtgggccaatttgactggcccagttagtaggcaaatggactgcatgaaatgggccgtagtcctcctattttagctaggtcgacttctttttccgagacatttaacttcttgcaacttttaaaatatggcaattaattatttgtcactcgctgtatgacatgtgggtccagtggtaaataatttagcaccactgcaccactcgtaagagtggcaaatagttaattgttcttctttttcccttttaacacgagcactgctacacgtactaattttttcttactaaatctttactaacaatcatctcaaccgtttgatttaggtagatggaagttattaaaaatctagatgcactcatagcatgacacatcactgttagtaagaatttagtaagaaaaagttagtacgtatagccttttccttttaacactatctccattttttaatatatgacgttgttgattcctttacacatgtttgatcatccttcttatttaaaatttttatataagcataagaaaatataattcatgcttaaagaacttttagtgttaaataaatagagagagtaggttcaccttgaaaaaggaaaatctcctgatcatctcgtctcatctctcatgtcatctgacacattgcagcatgcaagcaaagaagttcagcagcctgtctgatgctgcagctactacgaaaggggcgatttcgcatgcttaatcactgctagaggtgctcaagtgaactggggctgtgtttagattcaaagtttggatccaaatttcagttcttttccatcacatcaacctgttatacacacacacacaacttttcaatcacatcatttttcatttcaaccaaaatttaaactttacgctgaactaaacacagtctagagtaatcagtaactagctacaaatcgatctacactactgatccatcagcgatcagtcgtcgtcaacatctattgatgcaaagcagctggctatctatcaataatctggactgcag

SEQ ID NO: 61558 - DNA, 2125 bp, Oryza sativa
tttcatatagttacaatagctagctagttgggtcgatcggttgcttgcatttcttgcatcttgtgtatatatgcatgggcaagagatcgccaacagaaaggaattttttttaaaggagttcgagaacaactgttcttcaataaacagataatgcgtttttaattgcagttgcagacaatgcaaacttcatttcccctgggcagctagctgatcttgttccataaattaactggacgatgtcctgacaagctgcgaccgacgtacgagcaaatttaattacttgtcgtgatcacaagttaatcaactatgcttatcattgacgacattatgcgcaggttcgtcgtcgcagaacaagttaagtcaaatcgattctactccagcagctgcatccatagatcgatcgatcagtctgatcacacactaaaaagcatctttgaaaaaacgtcatatcatcgcaacagtggtttaatcatgttccccagttaagttgcagtttacagctgatcataccggatgcgtgcagcaggaggactttgtgtcgaaagagtaattgtgtgtcaacaaagcatacatgcactatgacgctctgtggttgggtttgttgttgggtcagtaaacatctaatcaatcaattaattcatcttgctgcatgctgatttaatcttgagctcatacttacgtgttgatatatcgatgattctaatgaatcagcagtatagctagctagcagctggtagctaattaattaattgccgttagcagtaattaggagtagaaggtaaagactcttgcagcagataaagcaatttccaagttaaattaaactggaaagaacctcatttcaagtatgcaagatcccaaggaaaaaggatatatacattgttactgaacagtacttacagctgcactcaaacagcatgcagcttggtcaccttactaacttttttggactgatcaccttactatgatgatattattctatcaccttactatattactgattattattattattattttgtttgtgattgattggtcatttgagatagatcgttgttaattggtgggaatgggcagatagctagattcatgcatgtactagtttctactagctgctaatactaattttaaacaagaaaaaaatgggggaaaaccctgatgctttaagagttgtaactaagtaaaggattaaaaaaccatgagacgcacgaaatgtcgagataaattcggcttgatcgtgatatatgttttagtgcatatagtaaagcttctggtcattctcttagaacaataaaaagaggcaaattctccttgctaggatgaaaaggaagaaacactcaaacacatgatgaacacagcttgatccaatacaagaacacaaagacatactatgcaaaggattaatccacacacaatttatatattctctggggtacctaattaagcataggctcatccaaacatgtatacagatcgatcaaggagatcaattacgtactgaattaatgagatgtatattattgaactatatatatctctctctcaaagatcagggctatatatatgaattagccgatcaaacaattgcactagaaatcaatcaatcgcggttccagagacgcaacaagtactcgatccaacgctagctacctacgacatatgcatggattcatcacgatttgattaattaattaattaattaattaattaattaattaagccgtcatatacgtaatcaggttaattagctcagagcttcagcgacaagtcgatctcctccccattccggccgtagcgcccgccgccgcagccgccgtcggccggtggcggcgctggcggcgccacgtcgtgatcctcctccgccgcctcagccgccgcggcgtggccgtacggcggcgccgtccagaagaagcccccggcgacgccgtcgaagccgtggactgcccgggacgacgacgacgacgacggcgacggcgacacggcggcggtcatgacgatgtcacggctgcgcttggcgagcgtgcgctcgagcttgtgcgcgttctggtggcctcccagcgcctgcgagctgaagaacttgcggtggcagtagttgcaggagaaggcctcccgtgggtcgacggcg

SEQ ID NO: 61559 - DNA, 5887 bp, Oryza sativa
tgcaggatgcttcactggtacaaactcatctgattctgacatatatacatcgacagattcagattgattgattgatcacgactaattaaagtgattatactttgtctgcacatgcattgcattgatcatctgtcagctagctagttactccctccgtctcataatataagggattttgagtttttgcttgcaacgtttaaccactcgttttattcaaaaaaatttaaaattattatattattcaaaattcaacgtttgagtaattagctccaccgacgtgtactatattattacttcgtccgctccaaaatactatgacacatttctttaaatatatctgaacgaagaaatattcaaatatatattttaaaaaaacacaaaagagtttatatcttagaacagaaaagtaatgttttacaagacgagctgatattaagaccagctgatcgatgaagaaatcaagagttgaaaaatgaaaatgcatatgcagtgtttaattaggtaaggtgaaaaagatactatgtagataatgcaagatagctagagacgagacatgcggtgggaaagtgcatgaacattttggaagtgaagctgcatgtgagtgacggggatccagatattcagataatcagatgtgggggctagctgtgcctctttcctgagaaaggccatgcatacatgcagctttgctacctatagctaactatacatgtttttaacttatatgctttggattattcgacatatatatctcctagctatatatctagcttacaactgttggcatcatgatcagtagccaaagattgatattgatcaatctctcaggcccaattcagcagcaagtcgtactattgaaagaacggcatggattaatggactcatgtccatgcgtgagaggtataattaagcaaattcccatttcctttttgctcttttcgcagcatggtcacatgatcagatgatctgcaagggcagctactgtagctagcaagagctgtcacatctgaaatatctaccatgcaattatgaaatgcatgcgagaattggatgaaatggccgacacgatttcacatagtgcagctaggttgctactccacatatggtgagtacttcatccgtttcataatgtaactcattctaccattttccacatccatatagatattaatgaatctagatatatatatatgtgtttagattcactaactttcatatggatgtggaaaatgctaaaataatttacattatgaaacggaggaagtatataactaatatatacacatgcatatatatatatatatatatatatatatatatatatatatatatgatctgatcgatcgaattggtgaataatgctgatgcatcatttcatcgtcactagctagtaggttgtgagtttgtgacaactatagctgggagcagctgctgcatgcatgagcactgtcacgcaagcatggtgacacaagcgatgacgtgaaataaccgtgtgcattgcattcatatttattctactttcaagtgtcaactttgctactgatcgatatcgatgcaccggctcgatcgatatccatctctgggcctagctaattacacagtaacacgcatgtataaatgtcaccgacgcatgcaagctagtgatcgattaatggataagcatgattaagcatttatcgcttgtataacaaatcggcaggtccaagctacttcccccgtttcataatgtaagactttctagcattgctcatatttatatggatattaatgaatctagacacatatgaatatttagattcattcatatctttataaatatgggcaatgctagaaaatcttacattgtgaaacggagggagcaggagagatgaacaaaatctaatatatgcatgcatgtgcatcagtcaagggatccgctagctagctttcagtcagtcaatgttgggtttgcagcgtgtcaaaaaaaaagttgggtttgcagtggagatgtagtcagcatctatcattgacctgatcatattgacctgccaaaactagagttcaattccttagctccgatcccaaacgatgctagaatggcaggttatgttgtcccatgattttcacatcgacaatcttggggagcttatagaaagtatccacgtacatatagtgtcaagaaagaaattaatgttttatagaaccattcatatagacagtgcatccacgtacatatataaatgtattatccataaattaaattagttgctgataagttatatggataaacataagtataaacgaaataacggggctaaatatgacattagggctaaaagcagtggcggaactagaaaattgattcgttggtgtcataacgtgtctattggtgtcatagtatactaattatgtttaaatcatagtgttataatatatggataagcagtttggttataggttctgttaaaagtcgtcggtatcgctcgacaccggtcattacactagaatcgcccctggctaaaagatagatgaatatccatttcctggagacgacaagcactcggaaagtgaatgcatgaacgtttggaagtgaagatgcatgtgcatgacagggatccaagatattcagttgtgtcccttcctgagaaaggccacgcatgcatgcagctttgctacctatagctaactatacaggtgttaacttatatgctttctattcgatatgtcgtagctactcttactatatagtactagtgattacatgatcagtagccgctagtcgattgattgatcaatctctcaggccccattcagcagcagtactcgcactatacatactactgtttgaaacaacggcagtgcatatataaaatacatcatgatctgcagggaagcagtcacaattgaaatatctgctaccgtctcaaaacataattaactatcgagtgtactacatataattaaatctggagatggaagtattatacaatgcagcatgtatgaatatggccgacatgcaggatttcacatagtggtggtactcgatatagtagatctacttagtggccactccacatatggagatcactactagcgctagctgaatgtatgagctctgtaacgcaagcatggtattggtgacacaacatagctaacaactcttgtgtatttttcgtgtcaactttaattactactcactcgcagtgaccatatgattcatatgccgcaattctgatgcgaccggttctggccttctgggttaacaaatgcatgcacatatgtcaccgacgcaagtgaaaggataagcataattaagcatgtcactttttaaaaagtttgtaagctgttggtaatcgacacgtcgaagctattaggagagatgaacaactgaagtactatatatgcatcaatcaatggagcttttcagtcggtcaatgttgggtttgcagtggagatgtactcagcagcattggctactgccggcaccatgcttcattgacctgacaaaacttgttccttacctccaactggtagaatgacaggttacatgtatatatcgccccattattttagaacaatcttggggggctcagagcatccatatatatttatatatggcagagaaaaaaatcgcaactaaactagaacaagtgcagattgataagttatagcgatgtctcaggtgataaatggcaaatgcctgttttatttgggttcagtctcagaaatcacagcaatgtatgcatgatttcttgatcaaataattaaacaactaaataggctgcagtcctatatatgaatatgaatatatatataaatatatatatatatatatgtttaaacaatcttactatgattcatacagatctgataaatactacagcccatgtataattcctaccaccacagcctgcaatcaggtactattttctccaatgtaatttaggtgtttcactaactccctacagaacgcatactgttgtatttatggaagtattacattttggcagagacacaagggtggatttgcgaggatggcttgtcaccagacatctctcaagtatctcccttccatctgcaagctctttacatagctttctgtgtttgagttgtccaaagaaccctgaaaattcaaggtaacattcagcaaagtggagatgaaagcaaagctactgttaaactctaaagagctttcatggcacttcacataattactcataatgcctgcttagaaagaggctaggctaggtgataaatactaagggacagagttctggatttgttttgacctcaatcaagaaagtgcaaactttctagaggtagagcaccactgcatcctcccactaagaattaactgaatctaacaggtaccaaaggtaatgatatacccaaacaatacctgttcctgcacaatggtgtgtagtgtgcggtgtacatctcttgccatgccctttgcatcaccacagacataaatataaccaccctgagaaatgatgctccaaatctcgggagcctgggaatattacaaagcaatggtgaaaaagggaaataaaacactacaccttatattaaacaaaaaggatcatttcatgtaccttctctgccattttgtgctgaacatactcctttgaaggaccctcacgagaaaaggctacaatcaattcagacagcgcaccggtctcaacaaaattgttgagctcatcctcatatatgaagtcctgaacagagaaaatactggtgaggggagttatttaagaggctaggaagttttctaattgccaatcaccaataagatactctcctacactcaaactacaatgcagaaaagttttctgaaagacaaggagagctctgacaaagcacatatgtgcataaccacattgtgcaacatcaatggcagatgtgttgatatttttaattactaagatttataagaatacctatgaccaacagatttcgtatattgtaaagttttttaagtacaaactgcatatgaatatgaataaagtaggaatgtatgtcataccatctttcgatttctgcacccaaagaataggacggcatggcctagttccacaccagtctcttttagagctaatctttcctgccagtgccaaatgcataatataatcaattgaattataagagtcaatatttgaggaaagggggaggaaaaacaaacctgtaagaagcccctaaaaggtgcaagaccagttccaggacctatcattataataggcacagtaggatcagtaggcagtttgaagtttgactgcctaacaaaaattggagcccagctacattcttggctctcttccaagggaatcgagttctgcatacacaatcatcagattaaaatgtttactggtcagcacgaccatcacatacttcaaacaaagtttttatgcttgaccaaatgtatgaccattgttttcaaagtgtactccttcgaaaatataaactctcattatatatgaaacaaatcgacaactacagaatatatgtatcaagaacttttcgaagtctttcatattgctgagggaaagatgcactccctccgtttcatattacaagtcactttgacttttttttctagtcaaactaacttctttaggtttaactaagtttatagaaaaaattagcaacatatacaacaccaaattagtttcatcaaatgtaacattgaatatattttgataatatgtttttcttgttggaaatgttgctatattttcttataaaattggtcaaacttaaaaaaagtttgactaagaaaaaagtcaaaacgacttataatatgaaacggatggagttactatataactatagaattttcagggagtgatacaaggttgagttactgaatagaatgagttgtttagtgttattggcaaggccatcacggtaa

SEQ ID NO: 61560 - DNA, 2744 bp, Oryza sativa
atagaacaagggcttaccttcatccaagtagaacaaactcctttatggatccttccagtaggggtttgcccatacactagcgcacatgttacatgaattcttgttggagtcatcctgcagcaatgtgaatggttttaaatagataggtcaatttgctcaggttagaagggtattattcctgaccaaggtacctcggtgaggaagatatcgagtagtatctcggctgcagtcgaggagcaatggctgcaaagaagacaccaagtggaggctttgctgatgggaactctgtcataacttccaagagactccgttgacttgaaactatccattgagaatactccttctgccaaatgaagctcatgtgaagccaaaactaacatccaaaagcataaacttatattaaaaaccaacctttccagcaggagatgctagatgtcttagcctctcagcatctttgggatcagatgcatgggaagccaaagcaattaaagcactctgcatcaacaaattaaaaaatattaacatcaatacaaatatccagaaaaaatgcatatagaatgtaacaagatagatctgcaaaagttcaccttcttaggaaaactcagaaggtcagcatatctggcaagtgcagtccccacagtacagggggacgggaaaggaggtggcaaagaacccccaaaaagtggagtgccatcctcttggtcagcatgaattgagaataaggtatctggtgaataacctaacagattttctacctcctctacagtctctgtgcagttttctgcatatacaccaacatgatctccagtctcatatctgttaagaaaatgggggtcatcagcagtctaaacaccagtaagaaaaccgtgcctgcaattttgtcaaccaactactaaatttggaaagtaacaaattcagatacttacgtaagaccagtccctgaaatatcaaactctaaatgaatgcaggaccggtaagaagccggcgtgtgaagctcccgccgcacagccacatttgctctgcaaggaaagcatgatcagaatttgttcagaccacacccagtgtcccagtgcagtcaaattaaagaaataatctcatacctgcaaggatgctgaatgtcatatacagcatgaccattactgagactaaaggatttgttgatatgcatggcttcctctggcttgaccaatacaactctatattcaggaatagcagctgtgtagggagttggtgctgccgatttatcatcttcaacacggagcaatttatccaattctggccatagaagttccttcctttagttgaacaaccaaagcattagcttttgttttatgtctcaaagtctaaagttgatatcaatgtttaaaaagtgtgcacaaatagaatcagtgtcaaaatgatgcctgagttcaaagttgagacaaagactaagctaattacggtacgtaccatgcattgaagtcatcctcaatgcattgatcatcatctccaagaccaagaggaacaatgcgttttccacctaaaagagatgtggagaaaagttaaccaccaccaaatgatacagaacacgacagacaggaaaatcatgtgaccagaatgttgcaaagatcaacaatatctcactgaattattacatggtaaacctgttgttcagatctatcggagacaagtccgatttgatttagttgcacacttacactacattaatactagctccccttctgagtctaaaacactctacagaatatcggtagacagaaaaggatgaagacaaaaaaggcacagcattaaagtcttaaagcatatgatcctagtagcaaaccaccctgataaaattatgatgctttccagagcacgttactaactacctacataaaaagattagataagttgtatcccttatcctgtactcttctcatacagtataatttctgacaatgtttagtggcatacaattcttaggtgagcatgaacagtacaggcaaagttatgcctttgtaatatagatgaaaaaaatagtgcattgtagttattcgaacgatggttaccttgttcagcgaggagttggtcaaccacctttccaaccttcagtttaaaaagacaatgtaagtatacaaattgggctctatataaaagcacaatatcaatgtagaagcaccagcaaaccttgttaaaatgctcgtactgcctatttccgaggccaaagaccccaaaccgaagattactcaaccattcacctctctcattcccctgcactccagccaaacaaacaggccgtcaacagaaaatacaacgctcacccatgaaagggccatatgaactgtggatttgagagcaaacctctccaaaccatttatagaacctcgccgcattgtcagttggttccccatccccataccttcaacgagaacaagaatgcaactcagatattcattggaatcaaaattcaaccattctagtttctcctgaattaatcaatatcccgtcagaagtatagtaaaaagtggagatggcacctacgttgccacgaagaacaaggcgatgatctccttcttaagcttctgctcatactcctcatcatccgcagcatactcatcctgaaccccagaacgaaacaggcatgaatcaatcaatacatagaatgcaaaagcacatgaaattctgaagcagcgttagtggcaaatcgtggcggcttaccagatcgagcaccttgaagacggccttgtcgtacctcgacttggcct

SEQ ID NO: 61561 - DNA, 2664 bp, Oryza sativa
gagttgagcgaaacggacggtgatgtgcgatcgatcggtacgtggtgtggtctgtggtggcgcggtgtgagtgtgtgacacgtcccgtcgggttgaggagagcgatgcacgtttcggcgcggccgcgacgtttggtggtgcgagtgcgagtgcgagtgcgagtggctcgtgcgccgcatggtttcactgttttactatagaacgccctcgaagcctctcgccataaccatcgccgtcaacaacaacgtacaacaaccacaaccctgcgaacgccttccagttgctcgtcaccatcgtcttgattctcgagccgtcgagcgtgttcgatcctaccaaattttgatggggggaaaaaactgaacatgttcttaccaatgctattctgttaaattttgctaattctaaaagttttcgctcttcagaactatacaaaattttgataagatttcgaatcaaatatattcaacactacttaaatttgataatatcaaaatgtacctaaatttaatattatcaaatattggtttggttgaaagctcctataaagtaaacaagaccactatctctagattcttgttggcgctgacagtaagtacactaaagcattggtaggccgcgttgctcggtgagaccaatatgattatcacagtcacctcttgttcgggcaaaattccctccacatggagtctttgctttcagcccattgcaacccaaaagtctaacaaatatgagccattgatttatgccttgatcaatgatggaaattgtctcatctctttatgatggaaagaaaaaccctaccttccattgggggagagatagtagcggcgattggggtgaagaagaaactagcaaaacacaagagagggaaaggagaggggagaagatgtgcagtttgttcagcttgggagctcttaccctatcttcatcaagttagcgattagaggctcgaacgtggttggattggcactaaacttggtaagtttgtttctcactttgagcacttcaatctggtcgatttgtataaggatgggttgaatatagcaccggatttgagtggtggtttgtcagctcgagttactgcagttacagcttgcgcaacaattggtagaatgtcagtttgaggggtcaaacagtgtccggttggactgtttttttggatagcttggaagggactcgtataccatcatttctgccaagtttcgtgtaatttgcatctgtggtttgggagaactcacctgagaaccgaagatggcctcttgttagctttgatggttaatgttgatgatgccaagtgtgtaacttaatgttatagctgctgttataatatgcctctagatttttcagagaagactccatgtatatcctaattgattatagttgaagcttggagtggaccgttggttccgtggtttttttatcctcacaccgaggaggtttttccacataaatcattgtgtctttatgtgcatgtgtttattattgttccgctgctgatctgctagtcgaaaccatcctcaaagtttatggcaagataagggtttgattgtgtgaaatatgtttatcagttggtgaattgtaatttgcacattgaagagatgtggttgagctccaacacctcacacattaacacaacccattcgttgttatttgtagcctctcagttaagtaaaagcagatatcttaatttcacatcttgactttatgtttttatttttacgttatttgcaacctctcggttaattaaaagcaaaggccttaattcaacattttaaattagtttttaactttattgttttttctttattatttgactccaccacaatacgagaattcactattgccaaaaggttgggttttttttttcaagttcttgtggtaaccatagatgtgtcgtggttatattcatgccacccagcatgaataatgaactgttccaaaattactttaaatgcatgttgaataaagcatgctcgcaatgcacctgtgttgcaccaacctggccgtactcttttttttttttttagaaaaacatggctgtactcagccgaacaaacttgtgctgtctgagtatattttcgcttggttttcctttgaaaactctgaaataataaactgctaaaaaaatcgaattgcatgtgtatgtccatgctgaataatactcctacatggtagtgattccaatcaaatcaaagagatttaattaagagtcgtgtttaactagaggaggagacctcggccaggtcggtctcgaacgctttgacgaggttcccaaagtattgccgcgtcaccctggtgagcccggcgagcttctccctgtacgccctgtacttgtcgaagtcgacggcggccttgtcgtcggcgccggcggcgaagagctccctcctctccctctcggcgcagccgtgcagccgctccagcgacgcgttggcgtcctcctgcaggtactcgaacagctgccgcttggtgaagtcgcggtccgggtcgaggtagtagccgtaggcgtgcgcccagccgagcacccgccgcccctcgccgacctgctcgtacgcctccgtcacgaagcccatctccgtcgccggcacgcccgccgccgaggccatcgcctccagctccgaccgctccaggctctccatgtcgcggagcgccacgcgcagcgacttg

SEQ ID NO: 61562 - DNA, 2138 bp, Oryza sativa
cgggcacgacggatccgggcaccggagcgacaggcaccgcgcgccgtcgcccaccgccgcgcggacgtacccgcgccagcaggagacgcagtagaagtgggagcaccccgccgacctcatcccgccggtgtcgaacacgtcgaagcagatggcgcaggtgagccgccgccggttgacccgcgcgggcacctcgccgccgccgccgtccgccggcaggaggccggcggcgtcgcgtatgcggcgctcgtccaggaaccactcctcctggagcaggacggccctccacctgtacagccggaggaggacggcggcggcgcccggcgagagcgagagcacctcgcacaccttggcaatgtcctcctcctgccgcgcgcgtacgtcgtcctcggttagaacaacgtacgtcttctccatcgccggcgcctccgtttcctcgaccacctgcccaccatagtcgtcgccatcgtcatccatgtaatcgccgtcgtcgccataatcctcgtcggagtcgccgaagtagtcgtcgtcgacgtcgctgtagccggactccatgctagtagctgtccgagatggcgacggcgaggacggattaattatcgatcagccagggtttaattaaccctaaccctcacaatttggcctcgcgcgcgagcctttatcggatcgagatcgcctcgtgataataaactgtttcgtttttaaagattgcttgctaaaataaatcggaatcgccttttttaaataaataaattcggaatcggcttcttagctaaattgtacttccggatattgcacgcgtgtttctgtgcggctgttatgggtggccgaagattggaaaggcctaggcccttagcccggcccattactgagaattcgattacggcccctttgttctcatgttattaggacgtcttttatacaagtacatacaaaacataacgagcctagacacctcccggtaaaaaaaaaagcaatattttaaattttctttataatctatgacgtgtgattttttttcatataataatttaagtgattatgaaagcaccttcaaaatccaaatcatcacatgctgtttttatgttttcaaattaactttttaatattattaataatcaacattttaaaagtttaatcaaatcgcatacaaaatgtcaaatactaataactgaagggagcattggtgatacacgcttataattggtagccaatgagcctttattccaatttaaatagagtaatacctagagaatttcgtgctataatctttataattttgaaaacattatttcacttgatcattttattggcagaagttagggtttatccaatcacttcttttttttaattccttctttttcatttatgggacttgttggctgtgtgcacatggccacttgggtataaggagcatattgatccatgtatttttgaaagaaataaaccatagtatttgttaagtgtaccttataaaatatgaattcctaattcgtaaaaaatgttggcccaaccaatggatcaaggtacaaattttcctgatgtaattgagtgatcatcaagtattctagtactacaaaagtgttgtcgttaatttgcacgtgatcctacgagctgtcgtcttgatgaagaggctgaagaggatcaacaggatcgtcggagctctcggccggacctgtagctacggcggctgcggcggcggcggcaacagcaggtcccacctccaacaggccgtcctggaacgtcttgacgaggttacggaagaagatcttgcagacgccggtgagcccggagagcttctgccggtaagccacgaccatgtcgaccatctcgccggccttatcctccatcttcttcttcgactcctcgccgtcgttgtccttgaggatagcgttcaacttgatggttcgttccacctcggcgaggagctcctccctctcgtgctcgcgcagtcgtgcagcttctccagctgccgctcggcctccccctgcgcgcactccaccatggtgcgccgctcctcgtcgccgtcgagccccgtgcccaggtggtagtacccgtacgcgtacgtccaccggagcagccgccggcactcggcgatctgctggtacgcctccgccaggaagcagagctccgtcaccggc

SEQ ID NO: 61563 - DNA, 13741 bp, Oryza sativa
ggtacctcctgtcgatcttggtgaggttgacggcggcgcccgccttctttttcttggcctcgtcgtcgtcgtcgtcatctacctcctcttcctccagatcccaactctcgccgtcgtcgtcgacgttgctgtccacctcgtcggtgtaatcgtcgccatcgtcggtatagtagctttcgtagctctgagcgtcgtcctcgccgtcgctcgccatgcctgcgctgcgtgctagcaatctaggtcgacaactgattctcagggtcaaggttgaatttttgtatgcacaattttccgtctattttttccgctaaaaaaattccatctatttccgaccccgagttgggatcagtctcgaactcagatcctgaacggattcgcttcttaacaacaattttaagttctcaataactttagtcaattcaaactgagtacggtttatttttcgttcaacctctctttgaccgatttcgtaaccaagattgatccctgcttcaaaacacaacacagtgctgtaaaaaaagaaacaaaagctacaaatgacttgacatgcatcacaaaaaaaaaaacaaaaaatcagacagcacagcatacaccattaacgtcagaatgtatgattggttggttaatggaagaaacgtccacaaactttattagtacattataaatacctatcacaaaatttattatagattgttattatctgtctcttctgctcccgtgctaagaacaggacaatgctgattgagctttactttactagacataccaagaatgccaatctctaccgtcggaaaacacgatttgtgttccgaacaaagccgcaccggcagacatcaccggcgccggcgccgccaccgccgccgcggcggccattgtgagaccccttgcactgtcccaagcaagcactccacatcatggctctgccattactccttcccttgctgcttgcaccgaagaggatccctgcgacgtgcatcccctgcatctccagcttcaccctgccatccttcttctccagggatgcctccatgaccccgatcatggggtcaccaatggcggcgtacccttgctcgggatccctcacctgaatcaggaccacagagaccatggaatccttcgtcgcctggtgcctccggtcgccgtcgtcgtcgccggcagccgtggacgaggcagagtcagccgtcgaggccatgcgaatctttaggccttgttggaccagtccttccatcttgtccatttccatgaagaggagagcctccaagaagtcgtcgccggagctgagcctcgccgagcggcggatgactttgccgggattcttccggccggcgatgtccttgatcggcatcatctttgacagtaacttgcacaggttctctgcgctcgtctctgtcatcttgtcaagaacctagagatcacaatgccacagattgtcgaacgaaaacaatgtgcagtgcaatggatgatagacttcattggcatccatggatcttgacagcgatcgaggtggctcacctccgacgcggtggcggcgttctcggcgacgacgggctgcgacacctgcagcgccagccgctcccagggcatgcccaccacccgtttgatctcgtgcaggtagccaccgccttccagcctcaccatttcccgcacgccgccgtggccaccgacggtgacgcgcttgttggccgccgtggcgccgatgccgctgcaggcgctgctcacccgatctctggtggccatggcgccgccattggcgctcctgccgtgctcggcgagcctactgccgagcctcctgatctcctcctccaggaactgcaccctccgccggtactgctccgcggatgctctagtggtcgccgccgtcgcgccatcgacgacgttggcgcgcgcaggcggcggccgcggcgcgcggcggtggaaggagaggcaggacgcgagggcggagcagccggtggtcgccacgggcggcgccggctgcttgttgtggccgccgggcatgccaatcttgccgatcgatcggtgtggcggcggtgcggtctccgacccgctcgctcgccggcgccgtgcaatttgacgcgtttgtttatcttgtataggcgccgcgccgcggctagctagtgaggttagttgcgatctatgcgtggggaggccggatcggatcatcggaggcgcgattttggagtttgaattcgaaccccaaactccaaaggtgtttgtcttggccaacttcatcttggagcagcaaatattgcgttgcgacgtgacgacgcggtgcattggatcgtgtgttgtacagccgcggtattcattgcatatcagttatcaccagtacaaatccattggatgtatccagtatccgtgcctgtaagggcctgtttagttaggctgtgtttagttcacaccaaaattaaaagtttagttaaaaataaaatgatgtgacggaaaagttggaattttgtggataggaaagttttgatgtgatggaaaagttaaaagtttaaagaaaaatttgcaactaaatacagccttggtgaaatgaaaatttttgggtgtcacatcggacgtttgaccggatgttggaaggggcttccattgtaggagtaattacttggggcttacgtgtatactaccgtgcagtaccgcactgctgctgatgccttgttgatacaactgtgggaacagtttcaaaagtacgaagagaacaaaaatctctaatattttgtatgtcgaagtttagaggttgcgatcttgtagattttcggtctcatcatttggtttttttccctaacaagtcaaaacggtttattagggaaaaaaataaatttataggtaaaattatatatatatatatatatatatatatatatatatatatatatatatatatatatatatatatatatatatatattgttggtgacttaaaagttaatgctaaaaaagaaattacgttgaaaaaaaatctcaaaatcaatgtcaaaattaagtttgaaaatttaaaatttagctttctatttggctgattaggccatccaataggagcctttcaataatcgttttagtctcatatgttgattttattattttagttcttattgttgtatgagtatttgctctctttgagataattttataataaatggttgtaccttctttgaagcaaaggtccgaacttttatttcattatcttatcttaggccctgtttagttcctaaaacaaaaattttcacgttgtcggcttgtcgcatcgaatgtttaaacacatgcattaaatattaaatgtatgaaaaaactaattacatagattgcgtgttaattgcgagacgaatcttttaagcttaattgtgccatgatttgacaatgtggtgttataataaatatttgctaatgacaaaataattaaacttaataaattcgtctcgcagtttcctagaggaatctgtaatttgttttattattagactacgtttaatactttaaatgtgtgtccgtatattcgatgtgacaactaaaccaaaaattttccacaacaaaaaaaaaggccttaaaataagacaaaaagtacaaatacatttactactagtagtacatagtacacacgatgataggagatgtgaccgtatgagtggggccgtgtttagttcccctccaccagcttcaaactttcaactttccatcacatcaaaaactttcctacgtatataaacttgcaacttttttttcaaacttctaattttcttcaaacttcactctttttccaccaactaaatacagcctgaggtgagcttcctaaaatagggaaaaaagaagataaaaagaaaaggtgtaggacacatgggctttagtgttgcaggactttggtccttgtgggccttgtaatgctgagctcaggctcatccgacacgtgtgcctcgcgggccttgcaatgctgagctctggcccatcacggcgaagacacatgcgccggggagcggcggtggaggggaggattgcccgccgcgccgcccgccgcggccgtcttcctcctccctccatctctccctcggaccctcccaatggcggctcctcggcgcggagtgcagcgagcaggcgcagcagcttttgtgtgtgggcgaccgccgtggggctgcacaaggccgcttcccgcatccctcgagggctccgacgccatcgatgatcgcccgcaccaccaaccccaactccggcgaccggccaccgggccaccaagtggtactgccatactctcctctcctctcccctcccgattgctggtcatcgatgatgagcaccaagctctccgcctttgtgtgtacctgtaccctcgatttttttttttgttggaaggactactctggaaatcccattgttgactgttgaggatactggctcttagcatatgcttctccaagaattgttcatgtttgatgcaaacatatcttgtgtttctgttcatgtaattactggtaacttgatgccttgctaaaaaaagagaactaattaacctgagatagttttaagtaaacgtatggatatgtttctgctcccaacatctatgtccttataggaagctttattgttttctggaacaacactgctttagaatcatttagatgccaatatgccataatcaacagagatgttttggttttgaccacctaattcgcatgaaagatgaaatatcttagggcggggaatctgggaacaatgatgcttttcagggataaatgttcaaatattgatgaaaggcttggttttccattccacgaggtgttgttttcttgtgtcctactattggacacacgtgtcactacttcttgttatgttctgaagccttttcaacaatctgaattccttgaatttgagaataggaacatccaagacaagtgcctgacttcctatcttactttcaaacatgttggcttcgtactttggcagatctgctcttactccagaagcagcatgaatccatttttttcaaataaaaatgtatctgttcttccaatgcccatagcaattggtagcctagtaatggatgaacaccattccagatgaagggcttacaatgtccatgatactatttcattaacaatagttttgtagagcatgccgtctcgtttttatttatctcctgtaatttaacctataacttaattgccgtcatatataatatcatttgccatattattttacatgcatttggcatgaattcatccacgccatgtataatatgttccgttttgaacaatccccttcaccgtgtcatgctgtagtgtttatgtgcatttggtatgaattcttccacaccatgtattaacattcagttttgaacaatccccttcactgtgtcatactgtagagtttggcatagagcattagaggctcaatcatggtggaaatgcagcaggcgtggtgggggagcttggaagatgcaatgggggtatggtgggctagtggctggaacagaacggtacatacacatctcaacttcatcagcactttttgctaaataaaatatgtcgtgaggttatcagcttttcttaaacttgttttcccttgatccggggcctttttgcacggtaggaatagagccaggttctgctaactggcagtacctaatctaaatgcaaaggcaggcaaattctttgcgtattcccgggaaaagaacttgtattgccgcagcacagacaagaattaaagcaagaaatggtattcttctagctagaggccggaatacataaattcatcagggaaagaaacacgtacaagaattgctagcaatagtacattagcactcaagatactaattatcactagacataacagctaatttagagaagagagtataattaagagccaactaatttagtactaggaggtaattatgaacgagggctatgaggaagcaggaagctgaggtcctcgccttcgtcggcggtggttgcgacggtagcggtaggctctccttgtactatctcttggctaggggaataaggccccgactttggctctggctcccgctccggctccggctccggctccggcatctggagcttgtcggccaaggtcttggcgcccttgagcgagagaatgagccagacgaaggagaggaactcgccaccttctccgaggctcttggcatgtaggtatcccctacacatgctggcggagtagaagagcatgcccacccacacacggtacatcacttggcaccgtgttctgcggcccatcttatccatcaactcctctgcgagcctgcatgcgtcatggacgagagggtacttggggggagggggctcatccaccctgatttccctctcttgttctcttaccatttctatgtcgatcgcagcattgacctcagcattgacctcagcttttgccttgtcgatgatcttctttgccaggatgtctcgtccgagcttcttgaggctatgcggctgctgctgctgagactcaatatccttcaagatgagctcaacctcctccattgcctgcgtgaagaggtgctgcctgctgccggtcatgagcatgtcagggcggaggttgagaaggtgggccatgtagtccgatatcgcctccgtgcactcgagaaatttcctgtcaatctcgtcgatggtgttttcagccatcatgcggcgcatgcaaaggtcagtggcgatgtgccagaggatgacacccctatcaaaggacccacgcaggctgccctgtacctctaggccgcataccttgcgcaggttctcattgagcacccagttgcggcgccccggcgcgaagcttcggtagctggtgaagtcgagacccttggcattcgcctccactaggtcggagaagatcaacccggccagcatgtggtacaggttcttgcgttggcaaacgaagaatccctgtgtgtagccgacatgtgcggcacacttgagcaagaccccagcaggctgtgtcctttggagagctgaccggatgaggttattgtattgggggactgtctcgcatagcgctgcgacatccgccatggacatgagcttgaacagcagctgccggatgggctccgcaaggatgtccagcgcggcggtgaggcagaggagcacgtaggtgatcttcacgtcgatggtgttgtggtggcgcttgctgctggcggcgaagagcacgatggcggtgatgtgaaggaacggcgccaacagtatgtggtaggccaggtatgcaggggtcaacaccacgttggctctggtgtagatgagcgcaaacgctctgcgaagccaacgcttggagcccttctctgctctagggcttagggtccccagcaagtctccctccacctcctccttgctgtcatcttctcccatcaaggattggcattgacggcgacgacgttgttcctgcttgaggtcagagtcggcagctagcagcgacatgtcggagagtatcagtaggaccttgtctctatctgtcaagatgtgctgctgactcctcttgacaacgtcagtgcctacccctggaggaggggtctccttctcttttttcagctggcagcagcggtcgagtatgtctctcttgtccttttccagctcggtgaagcagtatctccacttgctgacctccttcctgccttgtaccatggacgacacagctgccagccggttgatgctggctcgtcggagagcccacggcttctcggtgaagctgaacaccccaatgacgaagagcaggacggctgacaccagcagcttcctgtcaccgccattggcgggccatgacttgtagaaggcgtatatggcgaccgtgacctgggacaccagagtcacagtgtgccgcctccacagctcgttgtcctcgatggtgtaggcagacatctcctgctgcccgccaaggtggatgaggaggaccggagcccataggacctccagggcgctgccattgacacaatgctgtttcgcggcggtggtcgtgttggcgtggcggttgaagagggtggcaagcgcgtagatggccagggcgtcgctgctgatgtaggccagccagatgaaggtcctgaaccagtgagggatggtgtacttgcgcatgggggcagccagcagaaggaaccactggatgcccaggctgcacagcaccaggatgcgcagctgccactcgtcccaccactgcacagcggctgacacattcgtcattctatcatgcatctaatatctgtttgttactattttttttgtttgtgcatcgtaggttcccgacaatggacggttagtttagcacacctatatatcagaatgacacttgttgaacacagtttttctgtagcccagctgaagacttgctttgctagtgaagctcactttaattattactgctacacatgtgcgtgtgggagagagctaaagtgagggataagcattacatgataaaagccgaaaaagagaatgaacatagagaaaaatataaatgtacattacaacttttatcgaaaataaaggaaaaatataagatgtacattacaactttagactttatttatttacagtcatgcgctgcccttcgcgcacagctttgtatgatctctgcaatattcctaaatcttcatatgttagctagtgtggagctattgatgatgtctaactctttgctttgtttacgaggtggtccttactatctttgcatttgcatatttgcgtgcatgttagcgaaataaaccatttgttcttcagccacccaaacatcatctgtcttatcaaaccttcaaaataagagggacttttgttcatcttgcaccgaaaccttttcccttgcttgttttcctcttccttcttgtcggtctgttttcctttttcttttctccttctttctcatttcctttttcttttcttgggccacacctcgttgaggataagattttcttgggaacagttctgttgagtgagagcagtgcaaacacaactttggttcatgttctgctagaaggctagtacagtgtaaacacaatcttggttcatgttcataattggagatattactgctgaaggaggtgcccgcaaggaattgcagtcctgcagataagagatgccatttgctagttgcctccttggtaaaagtcttcacttgagtttatttatttgctttcctcttttccttggctggatttcccacaagtctcgttttcttatcagcaaaaccttttgttgacaaaaggtggtgtgattgtttaagtggggtccgaatctttttcttcttaaataaaggagtggaaatggaatagtgaaaggaatagtgtctctgttaagctttccttcatttatgttcctttcttactcgatgctgttgcctaatatatattcccttatttttatattaaaatgtgcatccaggccacacggttcaaattcttttttttagaacttcaattctaaattggtagtattaattggtgtccactagtaattttaagacacacgcgctcagtgggtccatatatatgctccgggaattttaattagccgtgtgtgaagaacatgcatgtgcatatgatgtctgaatgttgttgtgaaccttgtgtaaggtgtgaggattagtcctcttgactttgtttgtttgggctgtgtacatttaagttggatgtagaggttaggtttttaatccattttctaaaaaaatgtgcatatgatgcatgcgagtgtattttctgtaatatatttgtatattattgaatttggaaaaatgagatgacttgaacttcataacaatatatagatgagtgcgttgaaaatagacgcgcatgtaggtttcattagattctcacgtttgtaggcggatgaaaggtccactattcttctgttacttttgggtatgcggtggctaatcaccgagctactccctccgttctttttttactacttgccatataaaatactggcacagtgcatatatttaataattgaatttcctaatattatcttcgtaaaaattactgtattaaagatataactagataaacatatttttcattataactctgtcaatatcatttatcatattttaaatcttaatatgcatatattagtgggttaatgtatagaagtttgactacacattttctatttatgaaacgatgtagtgatgaatgcttttgtgataatgcaacgttcatgaaatatgtcagaaagaataaaatagcataagaaagtaaatagcaacaagactgaacgtgcatgagcatttgcctttttctttcagcatgtgaacttcaatttagtcaggattatcatggcaaaagaaatatcacttcaccctgccaagaaatagataaattatttgttcgccgcaaaattaatatgcgaaacagctaacggtcctagcgcataagttcggagcatatattcttcttctttccttatggcactcattagcaaggtagccaagaaagctctatataaaccatgtgcatcaccttacactgcctttaacctcctttctttccctaggacctacccctcccctaccctcttgagctttctcaaataaaaaaaaaggaacacctgaatttttttggtgattcaaagagaaaaagacaaagatttgatgggtaacatgcttttatcccctgttaatttcttgtgaccattatttttttctgccttggtttttggatttcatacagaaagtgtgttggtctgtgctaatcttttcctccctctgcgacagcatcttcgagctctaccatgatggcaaggcccggcgctgtgaagaatattgaaagctgggacgagtttacaaagcattttgtgaaatcagaggacaagctggtaaacatatatacatatataatccaatccaattcagatttacatgtgatgtgatcgatcgacgcattcatgcatgcatgaaattaatatattgaaatatgaatgatcaatcaggtggtgctggtattcatggcgccgtggtcggagccgtggaagctgatgaggccggcggtggagaagatggcgtcggggctgaagagcgaggaggccgaggtgtgcacgatcagcgtcgaccggttcaacacgctggggcggctgctgcgggtggaggcgctgccgacgttcgtgctggtgaagaggcaccgggcggtggctcgcgtcgtcggcgtcaaccgggacgatcttcacagcagcatcaacaagcacctcgcaccaccctcttcttctccacaacccattaatatttcttagtgctgttgatgattcttggttgattgcatgatataatcgagtaatgccatgcgtcttaattatgagttgtaattgtttatcacatactgtatttgagacatattcaaccttgtttcgagaaaaaaaaatggagatgaaaaaaaaatctattcatacttatagattttctttgaagaatttgtcttgatagggttgacacgcagttagcacgagagaacttccgtagcttgccttctgtacctgtatggctgtatcgatatgtatgcgtgtcttctacgcagctaagatatgaaatatatcatatgaggctgtggagaaattgactaatttatactcctacgagaaaaataattaatgctttcagaattccatttttcagtcttatgttaatgctatgcttgccaatttaagcactttgccatttttattcaagaaaaaatagtggatgctatgccatgtgtacccataaaaattaattaaaatgagaggaattaatgtaaaacaaaatattatatacacataggatagtatattcatctgattcctaatcctaattctcttcgattgattgcctccatctattcctaggagcctattatatggttctattctagggatctccaccactcagctccaaagagattgaaccatagatccgtggaatagaaaatttcagtataacactgttacattctagtgtttttaagtgagaaattaggaatttaggggggtcaccccccaacataatatagcttcgccaatggaggcaataaaaccatagatccatggaattagctagggaataggccaaggtaatacaagagaattagggcttgtttagttcccaagaagttttttccaaaaacaccacatcgaatctttgggcacatgcatggagcagtaaatattaattttttaaaaaactaattgcacagttagggaggggaatcgcgagacgaatcttttaagactaattagtccatgattagccataagtgctacagtaacccacatgtgctaatgacgaattaattagtctcaaaagattcgtctcgcggtttccaggtgagttatgaaattagtttttttattcgtgtctgaaaactctttccaacatccgatcaaacatccgatgtgatacctaaaattttccttttcgcgaactaaacagacccttagaagaattagattcaggaagtagaataacatgagaggaagtacaggggaaagacaaatattccctccgtttcatcatattataagttgtttttgacttattttcctagtataaaaaatatttggttatagaaaaatgtagcacaaaattagttttatcacatgtaacattgaatatattttaataatatatttattttatgtataaaatattgatatatttttctagatgtttggtcgaattttaaaaaattaaaaaaaatcataacgactcgtaatatgaaacatagtattatgaatataaaataaaacagagagtactataaatgaaagtttgttcaacacattatcacaagaacaacagatacaaccgacatgaagggggattggattctctgacttacatatcaatgtcttaaagttagataaaagtaaatcgaaaattaaaaaccgattcccacaagagctagtatatgcaaacacgcaaacaaatgctcaacacttgcagcatgaccggtccccagcagcgcagtaaaacaaggaatgattacaacacatgttaatgacctacgtcaaaagacagcacgtataaggagactcatctgaagtagggttattgtttgattttacttatttaaccagagttcaaacaatcaattaagtgttgagatggttaatctatcccgagcctcatcggttgacctaataagtcaaaacaaaagccaaaatttaaattttctaacttgattttgaagttacattttaagatgttttaaacataatttctttatagcattgggttttaaatcactatgaacaaatatataaaaaatctacctacaaaataaattttattacctaataaactgttttaacttattagaaaacatagtcaacggatgaggctgcccgttttctaaacagaggcagtacatagttgtacaagagacgtatcccgtgtttagactttctctatactatattcattctagtatatatcagtacaaattaggcatacataattaatttgatattgtactgtacatcgacgaaattcaagcaaaaaaacaattgatcttgcaatcaatcgatcagttagctcttctagctaaaaaaaaaaaaatcaaccgtgcggaatcggcgcgccgccgccgccacggcggttcgtgtccggcggcggatcgacgtacccataatccgtctcctgatcaacagcgacgccgacgacgccgcgcactggccgcttcgtctccgtctccggcaccgcggcgtcagcctgcagattcactccaccaccacttgtcgtcgtcgtcgtcgttggcgacagcactactattgatgcaccgagctccaccggcggcggtggcggc

SEQ ID NO: 61564 - DNA, 5535 bp, Oryza sativa
  unsure (1)..(5535): unsure at all n locations
cgccgccacaagcagcagccgcattataagtaggagggcgatgacgattagtgatatgaaacggttgggtaaagctcgcttcaaattcagtttatgcatgctatttatgcttgtgcttaattaggaagctcatcacaagcgcgtggcctacctaattaaatcaagctgatcatcaatcacttaattaatttaattcagagatatatccggatgtttaatactcctagttgcttcattgcggcaagaaaatggatcctcctcgacgtccgcgccttcatcgccgatcgccggaacgccatcaccacggccaccgagctgagctcagcaggagctccattgaggagggcactgacgagacgaggccatcggctctgaactttagggatcactgatctcacgcgatataaaacttaaattggtcctagggagatcacgaatgtgttcatttcgcgttaagattataagtaggtcaaccagcgaaccaattataggcaacctcatttccttgttgttttgtgcttaacaccatattatgaaactttcatcatttctccaatccttcttatccacggctcatttcaatgcaacttctaatgtttcttagccatgttgcttcttttgtttaaaggacaaagtctgttttactcccataactatcagccgagtaagaggttttagtactcaactataaaatcggatattgtatagacctcgcaatgcaactgtccaaaaatcgaacaagttcccctcgaatggcaataaggttgtttttgcaaagttggcatccaaataaattactaatatacttttcactaacatgtcacgtaatttcaataagcaagatagtaataataagtaaaagacacagtaatccatcccgttccagatgggctgaaaataaaactttaactggcgggccgttcgacttatgggccgattatcgttgggcctggacggcccatggataaggacgatccccatctctccggattccttctttccttccttattggggaaaaataaaaaagaaaaaaaaagatatggtacaacaaccgagagctcgctagtcgtcgtcctcgaaacgctcgcggcgactccggtggctgccgcgccgccgcctccggccgccgtaccagcctcacctcgcttcggtaatccctcgcctcactccatccatccccattccccaatctctccggctcctgcttgcagtagtccgctactcctacgaattcgccgccctcctctacttgttgatttggcctcttggtatggaattgagatcgcgaaatggtgcctccatccttgctggctgggcttgggtggtcgatttttttggggtgcttggtggttgatttggtggtaggatttcgtggtggggggcttaggtcattcacggtcaatttcgcatcggcgatgcgtttttcagttgatccagtagtttgtttcctctactggcgaatcgtgacaaatgtgtgacttgtttgggatatgctacggcaactcgaacctttagtcggtttgaacgctggtccgctaatccacttctcagtttcttttttctttttaatttttgggtctgtttttgtggatcagtttctactgattaggcagatctgaaccttgctttgagaccaagctaaagtttttctctttggacggattggcgcagagaaattagttatcttgtttctttttctttgccaaatgttaattaaccgcagtgaaggattagcctagtaacagtatcccatgaatgattaagtgcatgacttaatgacaaaatattttggtgctgttattttgttcttgtaaagcatgatgtttagaatagccatccattcctgttctatatcctatgctgtcacgtagacatgatatgttctccttccctgctgaaaaataggcttgcaatcagttagtatttgcctgatgcttgtttgtttctttcagatggaggatggagtgtctacttatactgttgatgaggctcttatttccatggggtttgggaaatttcaagcatttgtgcttgcgtactccggaatggccaagatatctgaggcaatggaaatgatgcttttgtcatttgttggacagtcggttcaagctgaatgggagctttctgcgcaggcagaatctctcatcacaagtgttgtttttgtaggtatgcttgtaggagcatattcttggggcatagtctcagacaactatgggagaaggcaggtcctttactatttacattccactgtttgtcagatttatttgaaatcttcattacaaatctctctccctaacaaatatacagctattcccctattactgttaattattgcatatttatcttctaatagaaaatctaggtattggcattttaatgagtcatggtgctcttgaatgatatcaaatccgtattatagatatgatagtaccactcttcaccctatggctttactanatacgatgtcttctgggatagtcagattaatgtaacccttgctagagcttctttgagagactgagagcctgagagacaagagcttgtgtggagtttggatgtaggcctgcaaatccccatatactagactgttcccacttttcagtgacaatgagtgctacaacccagctgattaaccatatagcaaattgacagagacaatatcatggttaggaggaaaatgtgcatgacactagatgacaatctgaaattcattttacttggggattcttctggccttccagtttttctaaaaaagttccaagatactccttttaaattttctgttcatgcaataacaagaaaattacttggatttcataaggatcactcacagaagccctctacagtacttaatcaccttgagatgatgttttcatacattgctggtgataattttaatagccagttctctcattaatctaaaagtatactaaaaatacgcattttacaggatgtaactttatttttctgactgtattcccttgatacttttccagggttgggttcaatttcacagcccttgtaactggtggggctggtcttcttagtgcatttgcaccaaattacctttctttgatcgtgctgaggtttatggttggtgttggactgggtggtggaccagttttatcttcctggtttttggaattcattcctgctcctaaccgaggaacttggatggttattttctcagcattttggaccattggcacaataatggaagcttcactagcttgggtaaatttctacattttgccaaagtaatactactgtttgcaatctgccttgggtcatagtggttcaactgatcatacaagtcagttaaacagaacgatgcaacatatgattttaaaacagtcgctatatttattaaaacagtggagattgatgtaattgaatttctttggttctgcactgcagcttcgatgcatgtgtttctgctaccctgagtaaatttaacagtgataaaatattagaatagatcagatcccaggaacagaataggagcttgcatttggttagtcagtgatgatttatgcatttcatataatgtaatggaaactgcaatgaacaatatgttgccttctagtatgtactgatgtatgctccaaactgtcattctaattttgtaggaacttattatttgtttaattttcaggctgtaatgccaagtttgggctggaggtggctgctagcgttctcatcgttgccatcatttgctctactactgttctatccactgacactggaatcaccaagatacttatgcatgaagggcagaactgctgatacggtgcaggttttggaacaatggcacgattaaaccgtgtagctctcccttctggccatcttatgtctggccatcgaatggagctccatgagttgacagattcctcagagacatcacagttgctttgtgctaagaaaaccaacctggttgctcattttagcaaaacgaagattgggggccgcaatgcgattttaaagcttttgtccccaaatttaattagatctagtcttcttatttggacggtatttattggtcaagccttcttatacaacggtcttgttctattaacctcggaattgagtcatggaaataagatttgtggatcagaggggatagtatcaatgcaaacaagcactcaatcgatgctaatctgtacagaaacgtgttcatcactagctttggaggtacatgtgtttcccccttaggctttaccatatttcttgagaatgttctacttcatgtaatcacattcatatcacactgttgcagaggttcctggccttatactatctgcggcaatagtggacaagattgggcgcaaactctcaatgtcctctatgctttatatcagttgcctgtgcatagctccccttatggtccctcaaacagagtccctgacaactatcttcctgttcggtgcacgcatttgcatctccgcaagcttcattgtcttgcacatctatgctcctgaggtttgcttgatcactcccaacatccccaatacttggttacatcgcttgcaacaataaaaagggaaataaaatcacaaaccattgcctcatgtattatcttctttccttgcagatatacccaaccgcagtcagggctaccggagtcgggtttgcgagctcaatcgctcgtttcggtgggatcttgtgccctcttgtggccgttggtttggtgcacgcgtgccatcagactgcagccatcctgatattcatcacggtgatgctcgtctcaggtgttgcagtctcatactttcccctggaaacaagcggccggaaattgagtgaccacatcgcggcgtaagagctaagttgcgagcagaatctgacagtgttgcaagtgctagtttctttagctatacaaaattacaggattgagctcctagaggccattcagattttttttttctttcagttcgtttaaagatcatatatatagaatagaaatgaaagatggtggatttcagattttaaatgtcattacattgttttaaccagacatatgtaaactgccaaatcgagatgcttgctttgctctcttgaaatgggatgatcaatatgttttgaaggaattatagtgcgtcgatcccccttacgcctcttttctttttgcaacagtactgtatagttttacatggcttataatattatagttcaaaaaaaaattcctcgctagaaataaaaagtgttgttcagaaaacgttcggtacactacaggcaatagggggaaaataccagtaaaaaagtggtattgtactatttttttcttttcttttttattttggctgctgcttaattaatgggccgtgttgggccggcccactgacagttggcacggccccacgcgaggaccagatttccaaatttcgttgaaacgaaacgaacggcttcccgccactctcggcttcctcttcacgttgctttctcccccaacctctcctcttcctttttccccaattagccatgagagagagagaggggaattggtgaggtgatgctgcgtgtgggggatgatcctctcc

SEQ ID NO: 61565 - DNA, 3145 bp, Oryza sativa
tctagcacttttttaaagggttttcttatattctcttttctctaatacagaaatcttcgaggaaatgccttcagcggtggtgttccttattcgatatctcagatgactgatctggaaacgctgtaggaacttttcattcataccactatattagtattttcagttgttttgttttcctgtacttacgcatgattctgatatctgttttgttgataacttgaaatcttttttccccatggattacagaaatcttggtaagaatcaattgagcgggcagttgacagatatgttttctcagctgccaaagcttacaacaatgtaagcatgatttataagtttttccacacaccaaagaaagaaaaaaataagagttctctgtactttttctattacatacctacataattgtaatttcgcgcaatgcaaagtaatcatggtgccaattctcatgttacttctattgcccaaatcttatatatcagttgtgtcttcagggatttgtcattcaatagcttctcaggtaacctgcctccgagttttcaatacctcaagaacctcaaaacactgtaagaaactgaattttatgaactatagtaattcatcgataagttattttggatgctcaattgactgccattgtttccaaaatatatacagagatgtggagagcaaccaattcagtggtcatataaatgtgctggccaaactttctcttgaggatctgtaagtgctattcaagtgaaaactgcatccggaactactcttatcattgtccttcaaaatatattattcctaaatggctcacagcggcaataccgaagtattgatgttatcaaatatcaagagctgttaataaaatttatttttttaggcacaatgcaatcgttatttgttttctatagcttaactacattacttaaaactcataagtacaatctcaaacgtatgaattttcttaagcacatcagttaggaactaatctagaatggttttcctccttttgttcccaaggaatgtgaagaacaacaagttcactgggtggatcccaagtaaactgaagagcattgacaatttagagtaagtgggacatccagtcaatatgcctatttttgttgcacttgtgaaatctgatagttctggtcacatgatgaaggactggtgggaactcttggtcatctgggccagctcctcctggcatggagaaggagtcttcggcaggaagctcaaatggaagggatgatagcggaatcaatggtttcgccattggagcaatggtgatagctgtgcttcttgcagctctgattctcttgtctgtgctgaggaggaatcattcctctcccgtctcatctcattactacacggatgagtcaggtcagaaccaaccatttaccccgctagttgatgactcgagaagtatttatgcacactgtatctcttgaattatagaaaactacgtgggttcctttcagccgtgcatcattttgtgatgtgtagggaactacgaataattaatgtgatatgtgattctggtaatttaagtttgagacgtgcactaagagttctcatcttgcttcattttctaggccgtaggaattcttcagcagtcaacatgaagtcactggagcattccccatcgatgggctgtaagacaccgcctgctgttcctcgcaagtcgatgagtgacaatgagtttgagaacaaactgaatcattcgaggcgaagcacagaccccatcagcttgatgaatcattcatcatcagacctacaagcagctactggcaacttctctagtaacagacaactaggtcaggggacaaccggttgcgttttcagggcaaaatatgctgatggacgggtaggctcctactgtttgctttctaagatctttccaaataaacttgtttacaggctcaattcaggtaatcatctgagtaaaaattgaagtgacacaaagatcatgtcaaatatgcatgtaaaacacattgcagtaaccaaattattaaactgaactagatactaaggtctcaaagaagaatgcttgaagagttcaaagaggtcatataccttgaattatgtgtgtactagctcatcaattaccatgaacaaatttcaggtactggctgtcaagaagtttgatccattgagcttctcaggaagcagtgacttcatggacaccgtcaacggcattgccaagctgcgccatacaaatatctctgaacttgttggttactgctcagagcctgggcactacatgctggtctatgattaccatatgaatggatccctgtatgatttcctgcacttgtcagatgactacagcaggcctctgacctgggacacccgagttcggatagctgcctgtacagcccatgctctggagtaagttgacaagtaggagtaacattgaatcctagaatccaaaaatacatcaatttgaattcatgtgtaagattgtatccctttcttgtcattcattcaggtacctacatgaggtctgttcacctccagtgctccacaaaaacataaagtcttcaaatgtcttgcttgatgctgatctcaaccctcacctctcggattgcggcctttcattcttctatgaggtttgcatgcagagtggctcttctttaacaattgatgaacaaagtataataattgtaagaacaatgtggtctaacggtagggaaatctctacaggacgcaagtgagaacttgggacctgggtacagtgctccagagtgctcaagaccatcagcttacgtgatgaagagcgatgtctacagcttcggagtcatcatgctggagctactaaccggccgaaagccttatgataggtgaattaagggggcaaaaagataaaaccttgaaattcactactgatatccataatgtgatgcatcatctaatgtctgcactctgcacattatgcttactttctctatgtggctgtctgatggttctacagctccaagccaagaacagagcagtgcttggtcaagtatgtggctccacagctccatgacagcgatgcgttgggatcactggcagatccagctctacgcggtctctacccaccaaaggcgctctcccgcttcgccgattgtatcgctctctgcgttcaggtgagctccttattgtcgaagagata

SEQ ID NO: 61566 - DNA, 1809 bp, Oryza sativa
ttccccctcttttacacccatgtttaagcccttgatggttgatcttgcatccactttttctcttgtttcaaatgaggaattggtggtggcttatagttagcatccacagatgatctaggtgtagaagtagaaaccctcggtgaagaagtggcactttggttcttaataaacttggaaccaggaaggtgatagcggctttcactttgagtaattgtatacacagttttgtctacagcattctccaaattatgcactttcatgcttaatactgacatgttctccactgagttagacatgaattcctgcacagtgaaagaaagtaagcaattaggacaatatttaggacccccccccccctatactttcattacataattgacttgtgcagtgctctttcctacacgatattatggaggatagcaaaagacaatcactggtatgagttgaagatcatgatgcctattgtcattatcaatttccctttttgtttaatctggcaatggacttatatatataggtaactgaaatgcacagagcttattgattttcaaacaatataatttccctcataactttaatcaaaaccttgctattacattctgaagaaaaaccattgctgaacttaacaatcagatcacatatataaacatttttccagaaacaaccaaactatagagagtagaataaaaaaaacaacacaaaataacaagaattacctgcaacatatcaaagatatttgcttgcttcctctccatctcttgaagctgcttcctgatatgagatagttctttcattgcacccaaacagcaagtatgtgtcccatgtgaagtgatatctgtaacagtggagtctatgctcttactcttttgagccctggggaattgctcaatgtctcttgcagaatcacaatcctcaacgcattcctgagcagaagtgacatgctttgtctcacaactcctgctggctacttctgacatagaggagcaatcttgtttatcatccatggggtcatactcatacttgctgtcattgtctacgatttcatatggacttctatttgaaccctttagcatggaaccattgccagacaccttttcttcaaaatcaactaatggtatcatattctgcttaggaacagatatctcaacatgccaatcgctcaacttcgagcgttgctgatttgcagcattattcagggctattttattgatagacagaggagatctcttctttgatgaagtaatagaattgccactgattgcagaaacagaagatgcaggatcaactctcctgaaagaagtgtctcgtgatccaccatcatttatacttctaccatcatgatggtcaccaaagaagttttctgccataaatgaaatcaataaacaaaaaagggagaaatttatgtggctgctgtaaacttcaaacagattctatgttaagctcgtaaaggactaacaagaaaatttaagaaaagagaccatagagatctggaaatctggggaaaaaaatcctgatccttggacagacctaagcagtagatagacttggcatgcaacaagcaacattgaatagcaaatcattgataaaccccttatcttttggggtcaatgcactagttctcaagaaactaaaaagtattatgagagtacaaattgctaaaaaaaacaaagggattagtattgtcaacaagcttcagaaagtagtatccaatctcttcttttaatttgcagaagtcagaagatcacaccaggccaaaaatctacttataaggattgtaataccttttgtggatgatccagcttctgatgg

SEQ ID NO: 61567 - DNA, 4019 bp, Oryza sativa
tccttggagtccaatcactactcttcagggcatccataatacttgttagagcagatgttaaagactgctctgtagaagcaccttcagcctgaaaagtgggacagcagaaaaataagaaatgggtataaagatcaatctcctggttttggctaacacttgtaggacgaaatcaaagatgaatatgactaatctacttccaagaaggaaaatttgatctatgacaccaaaaggatgaacatagctaacacaattatcctgacaattgtattgctgaaaatccatagaaagagacagccatattaacagtctcaagatgaaactagaagtttgaaataaaaatagacactcgactttttgagaactcctttttttatgtgaaactgactgagcagtcatataataaagtactcctggctcattatactaattactccattgcaattacttatgctaagctacttaaacaaccaccagagataagcatggaatgcaatcaccttaaaatactgaaagcacattaattaggtactactagataagcttgaagcgaatggtgttgatgatgcaagagcaaaattcagacctgaataatacttctgatcaactcaatcactgcaggctttgccatgaaatggggattcttgagcagtttaacaacacgaacaagcatctgcggcagaacagggccagggaagtaattgctctcgtcaataaccttggccaagcaagacgctgccccagcctgaacatacctattctgctcaccaagtgattcaaacaagggccgcaccaacgcaaccaatgcagcgccaccatccccatagcctctagcacacaatgcgagggtaccacaggtatcaacacaggcgtccctcacaacagagtcagcatccttgaggcgcttgacaatgctggtcaccatcttcgtcatgtgaggtgccactaggcttccatgggaccgagccaatgtgccaatcaccttgatgcactccttcctcaccgcactcttctgctcggcatcggtgtcaaccacgcaagacaagaagggaccaaccatgtcaggaggcaaggtgtcagcggccttctcaagctcatccaatccaatctggtaggtgtccctgtctgcaatcttgttgatggcctggaccagcctgtgctcagctcgaacacggccttgcctttggaggtaaccgcattggacttcatcttggcagcctagaaggctagaacactcttgctgcaagatacacagctgaggcaccaacttagcagagagctcagtagctcagagtaacatggatactgaggggaacagtggcttctcccattggggaatggaggtcgtgtttcctgtagattccccacccatcacctgatctctgaaagaacacgtacatgaatgtgaatgaaggaaccacatacagttgatgaacaaatttgaaattggagcaatcaatattagaatgagaaatttggagctgtcaaaattttgaaatcgtacacagtaagattcagaaagctaaccaaatcaggaggaaatgaacttagcccaaatcaatcaagggaaaccaaataatgcaccaaattcgagatgaatagctattgcggcaaggctttcacgcatcaatctcaagcttatacttaattagacgcatcgcactatgatcatttgaacagttaaaccctagacatcggtgcgcaacccaaacccctccgccgagctccaaagctactggctaacggagcatataattttggagcaaattaacataatcacccgacgcgttctcaccaccaaataaaaaatttgcacgaaaacaaatcgaacaaccaccgaaaatgccataaaattcgaatcctccccttccctcccaactcccacatcacagagcacattagcacacacataaaaacaaacccaaaaaagaagtaataaacgaaccaacgagcaaagctcaattcaaacatgaaccaaaacaccagagggctcgcgaacgaactgtacgtacggttggagcagtgggatctccttgctcgagtcggaagcctcgcctcgcgctcgcggccgtcgcctcctctcctcgcctcgcctatccagaggggagagcgatctgctcctggaagaagtagagagattttgaattcgaatcgcaacttgaggtaaacaagtggggggagtaaaatggcagcttttttttttcttttactcctccctaccttctctctccacgccgaggagaggaggacgccgagagcgccaattccgaggcaactgcgagtagtagtacaagtctttgctccctctctgaccacgacgttttcaaagcggtgtccacgccttgccgtaccggccccaccgggaccacatgtcagtcagtgtgtagttggtgagtggattaacgaaaggtaggtgggcccacattgcatcttgaggcgcttttgggtgccgggattcgaatttcgacggcttggatcggggccaggcgttgatctacgcgccgtcggatggacaaaccacgcacgccgtcggcgtgtcagtttgaatctgacgcacccacactgttacgctccgacgaccttgccggatattcgcacgcacaccatgaaattgacatgtgggccggaatgcattggcccacgctcttgctaccgtccaggtgcaggagccttgcgggcttggcgtatgtggatgacgcgggcccacgtcaaagcgacacatttttgaagtggtacacgccaacgaactgggcgggaccgcgggaagaggcttaggccctgtatagatggggctaaaatttttaagtccctatcacattggatgtttagaaattaattataaatattaaacgtagactattaataaaactcatccataatcttggactaattcgcgagacgaatctattgagcctaattaatccatgattagcctatgtgatgctacagtaaacattctctaattatggattaattaggcttaaaaaaattgtctcgtgaattagctttcatttatgtaattagttttataagtagtctatatttaatactataaattagtgtctaaatatagggactaaagttaagtccctggatccaaacaccacattagctaagttatcgtcacctaataatttgacggttatcatatttaccataaaaaccatatagttatcgtgatgtatactgcaatttcaaaaaccgagaaggttattgcatgtgataatcatgataacctcacgattttgtaaaccctgtaggtgccatgtcacattgtatctcgatatcagctatatgcatggccaacttacatggcctttaacttaacagcgatttcaatttttacccttcaaccgaaataccagatacaatgaattattcaagtgtcaaaaccggtgcaatataggtaatgatggtataatagcgggtggttttatccaacgtgacaatttgatctaagtcaacagcgctaagtcggtgtagaatacgagaggcagaaggcggatgcttacagggagattgacgccggcgacgccactcgacgacctcgacagcacgaaccctagcggcgcagtacaagcgtccttgaaagctcgggggacagacaggacaggaagagggagaataaacaaactttcttgcttagaacttggacacgacacggctccggcacaatgtatatgggccgcacctagaccataatcccgtttcgaatgggctgcaaactcgaatgggctgcaaacttgaacgggccaccctatctatgggccgattgtcgttgggaaatgggcttacacgataatgggccttgacggcccatagagaaggcccataagaaggaatggctcgcggaaaggctcgggctctccgctctcctcatcttcatctcctccggccatccccttctcccctcatccgccgcggccatggccaccgccaccgccaccgccgcgctcgcgctcctctctcctccgctccccgcctccccgacccctcctcctcctcctccactccgcgccatt

SEQ ID NO: 61568 - DNA, 2564 bp, Oryza sativa
ggtgtactacatggggaaggcgaagagcaggcgcgaccgcggcgtggtgccgctgctcgagagcgtcggggtgcggctctcctccgcgaagctcatcgcgccgtatgtttcggcggctggtctcccggtgctgatcgatagggtgagatctaccacttcattttgagctcaatttgcttcaataaatttttgtgtgagtgcatttgatgatcatttctgcccagtacaaactgcatagtatgagtggtgaaattcggtgacattacctttactgacatgactgaatcgttttggatgtgattggccagacaatgcactctagctcttgcctttcactctagtttaattgctcaaatagtatagtccttagctgtaatcctgcatcttagttcagcaaacttttagaagagtgaagagcttgatctcaagcatgtgaactactcctacctctcttcattcttgccacaaaccacaagagtactttcatctctttttacgttatggcaaagtatttacagggtaacttactgataattgacatagggatacacacaggaatttatcattgaacacttaactctaaaatgtgatgatgtcaaaaatatatgtgatattttttcccaggatagcggtatttatgtttttaacagttgtcatttcgctagatagttcactaggtatctgactaactgtattcattgcttatggtttgtttatatacagatcaagtttttgaaggaaattctattttcaagcaatgtctatgaaacattaataagtagaaatgctaaacgcatgatgatgcacttatcaatacctgcagatgagtcactccaaagtactttatcatttttcgaaaaagtaagtatcacagccctattagttgtttcttgcaccagcttccttgcatcttaagcacctacaaaaattgcatcttttattgcagatggaggccaggtatggcggtcttaatatgttgggacatggagatgtgtcgtttccctatctcattgaatcatttccaatgcttcttctctgctcagagaacaatcatcttaaaccattaattgattttcttcagtacattggaattcccaagccaaggattgcatctgtgctgctgtcatttcctcctatcatcctttctgatgttgaaaatgatatcaaaccaaggattaatgcatgggaaaaggtatacctagaggatatattatgtttgtcttatcttttggagcctgcggtataggtgttgacctgataataagtgagtcatacaatattaccacattccaaaattttctaggttggcattgaacaagaatatattggtaggatgttgctgaagtatccatggattctttcaacatgtgtgctagaaaactatggccaaatgttaatgttcttccaaagaagaaaggtaactgacaaaagagttctcctactaacttggcttaagatcctgttcatttgaggacactgtccattgtgtttgttgttacctgaaatggtaatgaggttcttgttttcagatttccagtacagtccttggtgttgcgatgagaagttggccccatattctgggttgctcaacaaaaagaatgaactcaattgtggagctgtttgatgatctgggtatcagtaagaaaatgttggttccagttgttacatcaagtccacagttgttgctgagaaaaccaaatgaggttatgcaggttgtacctgttcttatgatttcttctaatgtataaactccactggaatggagaagctatattactttgttttagaaaactggaactgactattcttccttgtatctcagattattctctttttcaaagatatgggtcttgataagaaaacagtggcaaagattttgtgtcgttctccagaaatatttgcttcaagtgtggagaatacccttaagaagaaaataaactttcttattgactttggtgttcccaagcattatctccctcgcatcattaggaagtatccggagcttttattgttggacataaatcgcacaatgctccccaggtatgactgcagctccttctataattatttactacaaatggcttattacatgtttatactttatagttcttgtgaacatgtaactgactttaactcatctatggtaagtagtttatactggtcagccgagctacaaaacccttgggtaatgtaatgtatatctgttggggccctcataattttcacctatgcttgggaaaatcttatgcatctcttgcccttaaacacatagtttcacaaatactccttcaaacataaggaccaaaaattgataagtttactgggcacttaaacccaaccagaactgacaggttcgaacttcaacatgttggctatcactagtattgaccaagaaagtgtgtcgttagcacattactatgcattagaatatgacatgtttcatatgatctgttgtgccatgataggcttaagtggaaaatgcagcacgacattggcaacgctatgtgcttctcagttatgttatgctacttccaattcttctgcaagatgcaatgtgttattgg

SEQ ID NO: 61569 - DNA, 1526 bp, Oryza sativa
ttcagttattcactggaagggaggataaagccgcggttttgtgtacttcagagtagaaagatagactgcagtctgacagacatgcttgcaaaaaatgatgaactttttgctgaagagtacctgggagtaggaagatcacttgagacagatatacaatcaagcgaaggtgtctagttttggggctcatatcaagtgttaactgtgttacaatacgtatgttaattgtacagcagcgtgcttccatatgaggaaatccacttctgcagtgctcaagcattgtgaaggtaatacatgactggtaaattgctgtagaaaaatagcttgtacagatcgaccgttgtatgtggacgttttcttattccagcaaggtgtgtttagagtggcacccaatgtatgtatataactcacagaacataattagacatacatgttaatttgtttctcatgttgttctttcaggtctggaatacagataaacaagggggttcagaaataggtggtggataacaatctgcagcagaaagttcagggatgtttgacacctttgtctgaaagccaatatgaattatcacagccacaggccacaatcctcaccaggttcatcttttgagcaccccactggccatggtcttttatcgtcccgttctcaataaattgaaccctctccaatctccatggcctcgacactgttcttcgtttgcacaagttcgaggccttctccactgggatgcccccttaatgccaccagacagggtatgagggtaaactgaagttcaacccttacaattctgcaccagctgatcatctgatgaaattttgcaaaatctgcaattatcaggattgacgagagaatcaaagacctagcgtttgaacagttagttacctgagcgagttgatttgcactgttccttgaacacacaagtgccaatggcagtatgttgcatcttcatcccctgcaaacctacaagggagaaaaaaaatagttggcatgtattaatcggaatccgagtctcacatgtattaatcggaatccgagtctccgactcggatttgtactagctctcctcctataattcacgcgccaccgcttgcttgcattgcatgcgttctttgacacaaggacaacgtcgcagattcgcagccaaggacgtcgtccgtgatggcgctccgaccaccgcggccgtgtccggccggcgtgcagcagcggcagcacgacgtcgacggcgccggcaacgccaagacttccccggaacagaagctcgagttgctggacctgcaggaggaggacgacgagctcatcttcctcgacgccgacgacgaggagggacgccagctgcgcgagaagctggagtcgctggagcgggagttctgcctgctggatgagcagcgggacaacgcgctgttccagattcacgtgctggaagagacggtgcgcttccgcgaggagctcgtcaggcggctgacggcggtcacccccctcgtcgtcgcccagctcgacgaggtcgtcgacgagcaccacgccgtcg

SEQ ID NO: 61570 - DNA, 10398 bp, Oryza sativa
  unsure (1)..(10398): unsure at all n locations
ggtggtgcgcgacctgttccggctcgccagggacatggcgccggccatcgtcttcatcgacgaggtggacgcgatcgcggcggcgcggcaaggcggcgacgacgacgacggcggtgccaggcgccacgtgcagcgcgtgctgattgagctgctcacccagatggacggcttcgacgagtccaccaacgtgcgggtgatcatggcgacgaaccgcgccgacgacctggacccggcgctgctccggccggggcggctggaccgcaaggtcgagttcacggcgcccgagagcccggaggagaagcggctggtgctgcagacgtgcacggcggggatgagcctggacggcgacgtcgacctcgacgccctggcggcgcggcgcgacaagctcagcgccgccgagatcgccgccgtgtgccgcaaggccggcatgcaggccgtgcgcgacaggcggggcgccgtgacggcggacgacttcgacaagggatacctcgccgtcgtcggcaagaagcccggcgacgccgccaccgagttccacttctacaactgatcgccggcttcgcttagcaacacagctcatatctttacgcctttcactaggaaaaggcattgtatagctcctgcttgggcaacgtctcaaatgtatacaattattctgtaattcactgaacaaatttaagatagaaacaccagcaattttaccttcttttcagaacactaacagtctcttgtatttcctttgagaatacttggttcatactacataggagacaacgtcaccaggttactcatattcccaagtctacttgcaaacaaaatgcgtttaaaaatcaagtaaattcatcattgagacgttagcatttcttcagaaaaatgcatgaaataggaatcatccaaacagagcattaaaccctaaagtaaatccatcagaggcttatgcgtcacgagtttattttgagttaccaacaggcaaactccttgtatgacataatataagtcgaaagagttacatgaagcatcaagtgcatactcgtaggagcatacttcttcaagcattgatcgctgagaacaaattatgacaaaacaagataaaaacaggagtcctccttgcaagttcagacatccttcaatactctttcttgccaaagtttttgcaccaaagttgagatgggatcggccggaccgggtgatgtgggcgttgctgcaaaacattagatctgtcagcacatctttccacaactaaaagaacggataagatcattaacaactgcaaccttacttaatggaaattattatgtgtgaaaacatatattccaatgaatgtacggggggaggaaacctactagcaagatttcatgttttgtgataagtagaggaaaatgagatatacagttggcatgcattggtgttgacatgatacacgtcaagctttacaaaacaatgatatgcaaatgcttatgttttgcctatgatttttgattcagatgaattcatttactcttcaccaacagaaagcaaacactatccacaaaaaaagttacacattgatgtacagaaaaacaagaataattgtaataatcagctgatggcaagtcgacaacatcatcccagtgcttgtataattttttgatgaagacaactttgaaacacatgacatgaaaaaccgaattattatcaagaccatctaccaaatgtaaacactagatcatctgtactttatcgtgcaagttcctgtggacaatccacaaatttatttggaaatgaacatcagcgcatataccactacaagatctcttagcaacaaacctcctgagatctagttgcaaaacaaaaacagggtatcctagatggcttcatcccaccagtagcacacctactactgaatggtcataatgcagccaggaacatggaataaatccctttccaagtagggggttcagaaagaagcttttctcattgttttgaggaaatcaagaagaattactaaatgactcatgaaattatgtatttactgacaaagttggcctttatcgtagtttgtctaataagcgaggaataataatcttaaccaccatatggtatatggtagaaactggtattcaagaactgattacagaactccattgaatagattcagctaccactagaacatattagcatttgtttgcacaatagtacaaaactaactgaacaggcatgcctgtcacgtgcatagaacaaatgtgctttacaacgggaacaagtaatttcatttcaagttttgtctagattaactggaaaattgcacgacattttttgttttatatctagcatttctcccagttgccctatctaatgtcttctcctctaacaagaaaaatcaacaattcaacattctattgcactttactacccagagcaactcaaaggtattacacgaaaatattactcaaacatttcatccaggtttgagttaagcgtattccataggttcccaatagagctattaccatttcttcttctgcacaccgagttcctgatatgcacaacaacgtaaatcttgttcatattcgtaatgaccccaacaaaaatgtttctgccaccctatctattgtttgctcctcatttccattccccacggatcacatctcccggctagcgatttcggatcagctcgaccagatacgcggaaaggacaagcatggcgcgtgactagtactacgtggtagggtttggatggcggggagacgtacctcgagctcggcggacttcatggcgatggggatgcagacgaggaagacgccgaacatggcgatggcggtgttgcggcgccagtgcacgggccggcagtagggcccgcccgtcatgctccataccttctgccggaagtcgccgcctccgtggccgtgcccgccatggtcgccgcccatcgccgccgccgcttgtgctgctcggattcaatcagatcgggatgcgatgcgagtgtggtgttgagcctgacgggggaattggggattgtgttgtggacacccttttttgcactggagtccctgctaatttcgcaaaattacattctataactactttaatagagaagttaaaaaaaaagaatgtaaagaaaactctcaaaattgttactgctagaattcgaatttaatcctagacaatagaggcagtaatgacacaaaagagttttcgtgtttggggaaaaagggatatcatttgcgaaacttggttgatcatgatggatcatctgtttgatgaagttataatcatgacacaactgttacgatatttgctattttatgactaattctattgatctttgtgaatcttttgaacagtaaaaatccctccatttatacaggaacttcttttgtcttgttgaccacaaaagtaagaacggatctatctattttattatctatcgactattagcatctgagttgtaaagagacaatcggactctcatatcgctaggagaattgaatccataaaactgaaagaacggtgtcacctatatcgtaatacactaatcttatgtgatacatagtaccatgtctattgcctatgcatatttaccacagattttgccagatgccatcgaaatcaattgaccacaattgtaatactatagctccattctaaaggatcgtccattaaaaaaccattttcaccccttattataggttataaatttagcttttagagcctcggagaccaccaaaccgtttaggatttggtttacaatttgaaactctaacaacaccttggctaggaagagaccaaatttgttactatctccgttctaaaatatcaggaattttgctcatgttagaacggggcagtatattttgtcattgagaccgagacgtgaaacctttgtgatgaagaagacattttatcacaagtatgataaagaaccataagaatggttattttgaccaaacaatggcactgtaaggtaacttatgatggtcacaaaccaaataataaccccatatcactgtaagttgtcctcatatcacaagatagtttatactttaggtatgacaccaccaggcaacatgcggccgcaaactaaacaaaatccttactgaactacccatgctcaaaagataatatctcgaagccaaaaggcaaagagttattccaaaacaatttttgatgaccattgtgatatgaggacacctttccttgcgtagagactcaaacttctgcagtgaatcagataacactgcgagacaaatagttgattgccaacaacagagtctcctttgtcagggcaacttcattggggtaacaaaatcgaaagtaatttgttacatataaacattacaaagatttgattcaagaaaacaaagcacaatgagactagcaactgtgcttttctaatcctgtaagaactacccaacactttgacttcttcaacaatagcacgtgtaaatacagtacattgataggggggaaaaatcatcaaaatggtacaccaaatcagcttgagcagccgattcatcattgcatacttaaaacctaggagggcttgttgggatccttgaagccccctgcattatagctgttcgtcttttccgatagtatacaaatgggccacttattagcagcattccagccatcataacctgtaaagaccataaacttccttaaattaccatgctataagaaagaataaaaacctgtcatagataatcatgatatgattaagagccatgaagatgtttaatttaggaagaacaggaaaatgaggaatgaaatagatattttggattaggctcaaagaacatataaattgtacacaatacaggacaagactaaaacccttgacacactgatcacacatatataaccttaacagaataaagttttgtcagaaacgtacactttgcttcatagggtacacaagtatagatagtattttcacaagaaaaaaacaagacaatactcacaactgaatcaaccagaaattaaagctccagacaggcacatactgacagaaaaaagggtggttcatgtgtttgctcctgtttaagtgtgataggttaaatctcgtcccaacgttcttaaaaaaatagataaatatttcacagtttctggctttacactatctacttccacagttttaatgtaatcaaaaatttatgctggagggaataaattgatggcagacagccagacaggcataatctttatagcaatatgaacagagagaagttctatgatttaatacctcaaaaccaagaacagataacttctcttcatcctccaatggtacacaactcctgtaagttgtgtaatgctttgaaccacctgacgtggatgcatcgtccagcaccttccgttgcttagtattatttccttctttggtaacattttgtacttctacacatttcaatggcaagcggtagccggtttcactgcaacagtacttctcatcgctctaacaaaaatgaaaatgaaattgtatgtcagcatgccatttcaatagttgatagttgtcttcaacagaggtaatttgatattttcagccctgactcaacacaaacaaagtattcaactccattacaaatatgaaggaaaaagcaaaaatgagcagcagctgaaagcaggcatatctattggtggtcagggaaagcacagtgcacaaagactctggcacatgtatttgcgaatataactatacaaattaggtttcctagtagagtcatctgcacgacagcagaaatcccaacataagtagcttctaagcttcataaccatggaaaagacactgagttctgaatgaacacatggtccaggaaaactaatcccaccctgtaaactaattatccaaaagctacgaataatcagcacagtccagccaattttcagatcacatcttctaaaaggccaggaaacgtggtaataggaagttaattacttgataggacagtataaggagttgcgggggtggggactggggataagagttaatgggtgtcgattctgaccaataaagataaagtgcactgtgcgagacatccttgttcttacaaaccctgttggcctgccccatcggctgtaatataaattccatttgttattcaatcaatatttgtaggttggtgattttgggcataacataaatggaatcatttatatgtaaggctttttcctaaactattaatgccccgttgacattctatgatatgcacaaaaggacatataactataaaaggttcatctcccactcaatggaaaagtagaaaactctgtttatgtatcttcaagatatacacctaagatcatgaataacataaagatgagaaacaaagaaatcgttgaggtaacttaaaaacataatatatgtatttccctcaacccataaaatttgcccctttcttttttgatacactctaacatacaatattgcacctttaatgcatcagctagagcacaaaccacaaagttacgattctataatcactagaaaggctgaataagactcaactttcctataaatctttgcatgaaagaactaaatttcattatgttagaaatgctatttattatagaatcatcaacagcttgaaagagcaacaaagtcctttattttgaatttattccaacaaagccagcaagctcacacatggtagcaacccctcaatcatattacacatgaagcaagttcgctgaatccattatcacttggccatatctttattgtgcaaaccgatacagtgattaaggagatgaactaaacatcaccagctaaataaatcctactgtaaaaggattatcttcttcaataatcaataccatatcaatgacactccaactaataaatggcatcaagaacttggacctgataattgatatagtgatatgtgccatccgaagactaactattaccacgcaaaccaaaacgaaagtcaaagaagaaactcagatttgaagcaaaacgggcctaactttaatcaagatccgatcgtttcttaatgtgcacacttcttcagttgtagcaatccaagaacacggattattcataagctacatcgaaaaataaattaggaatatagtcctgaaaaatcccaaatccaatccaattgcaggactgcaacatcgtccctcttgtttcaccctcccaagatcgattcccccctccacggtgagccccaagatcgaatgacaagagtcagagcatagaaccggctgaccttctcggagtattggcaggggacgcagggcccggatggggagcaccggtaggaggagttcccctgcgcctccacgaacccgagcagcgacctccgccccccggaggacgtcgtggcggcggcggccgcggcggccatcgcgatcgccggagggatccagcacagggcggccaccgcgaggagcagcagcagcagcagccgccaccgccacgaggtcgtcgccggcgccttgttcgccatggctgcctccgccgcggtttcgctctcgctggcgcggtggtggttgccttttgttggaggttggagagatgcacccgttaacccgatactcttctcgggtcgggactcgcgttaacgggtctgaacacgcgaacctgacagagcggggttaacgggttagaaacctaatgggcgctaagtgattcgggttaacgggtttgaaccctcgaacccggatttatactgttcgtctagttctagtagtcttcgtgtcacgcagctgaaccaaccggccgccgccgccgccgccgccgccggcaatgttccgccgcctcctcctccccctccggcgctgcttctccacctcgacgtcctcgagcgcgacgccaaccctctactcgagcggcaccaccccggtgtccatcctgtcctggggccgcggcgcgtcggggcagctcggcggcggcaaggaggagcgccgcctctacccgtcccccgtcgcgcacctctccctccccgaccccgcgccggtgctctcccccacgcccggacgcctccctgacgccgccgccgcggggacggcagcggggggcgtggaggtggggatctcctgcgggctgttccactccgcggtcgtcgtcgacggcggcgcctgggtgtggggcaagggcgacgggggccgcctcggcctcggggacgagtcctccgccttcgtcccgcgccacaaccccaacctcagcgagctccgcgtcctcgcgctcggcggcatccactccgccgccctgaccgcctccggggaagtcttcacctggtgaggaaaccaccaccacattgctcatttgaaattccttttggtgtgattagataataataataataataataatagatgcttgagtgagtgagtgctcgctggatgaactgcaagaagaatgcattgcaaatttattggatttggctgctgcatcactcagtttactgtagtctgcaggggttatggtggatttggtgctttggggcattatgtttaccatagggaattgttgccaaggaaagtgaatggtccttgggaagggaagatatcacacattgctaccagtggagcacatactgcggcaatcactgactcaggttggtccagttcatggttaatgctgattgctgaaacctgaaagggtgaaagacattgtggataatcttccactgcctttcacaattgaatgctttggaatattggcattttgtgattgtcagaccgcctcagccctgatcttgtggcttttgtgaacaggtgagctctacacttggggtcgtgatgaaggcgatggtaggttggggcttggaagtggaggtggtcctggtgaagctggatctctcagtgttccttccaaggtgaacgctctgcctgtttcagttgctgctgtggcttgtggtggttttttcactatggctctgacttcagatggtcagctatggagttggggaggttagtatgtataaacacttggaatattttatctttttctcttattggattagtgtttcttctctttagcaaccagcaatgccttacagttcacattaacgtgcaactgtgcaaggtgctaaccgggaaatgttgtggcaatatacaagtttccctctaactagctggcatctacattccagatcctttgttcatagactgggcataaagttattagggcttgatagttttactataataatctcaagctaagcagtgtgtattgaacagagcatctgacatggtactccatgctttcagttggctcttagtgaacctatccaaaatgcaaaaccaatatctcaagaacaaattgatttgatatgctttcatctattctccactgatcgtggttctagaatctcctgttttaatcccatcaatttttataaaagatgcaagtggaatcacatatgtttttaatgcaagtggaatcacatatgttgggtctagaatttctaaaccttgagttaaatggttaaggaatgccacctgaaatgtacttcttgtcaaactgtgtagatactctttaatttaattttctacatgctttttgtctaacctccatacgatttccagcaaattcaaacttcgaattgggtagagggagcaattccagtgactggaggccacagcttatccctagcctgaaaaatctccatgtaatccaagtagcatgtggtggatatcattctttagccctgactggtaagttattattacctgcaaattctgttgctttcctgccactaatagaatgcaattttggctattctcctagctaaattcaaaactgtattatactgttgaaacaagcatttgcaaccaaggtcccgacgaacattcatacagaagtgaaaaataaagaaatttgcattttaaaatattatctaagtgagttgttgaccatacctaatgccagttttgcaccatgcaatgatgaccttcaatcagataccatgtctgataatgagtcaagtttcttttggaactgcaacaaacagtataaggcaataatagttagagagattttttcactcataaattgcatttatagaagaaagtatggtggttattgtagcacacaactaacgtcttgcttctttggctgtattcagatgaaggtgtcgttctctcatggggacatggtggacacggccaacttgggcatccaacccttcagaatcatagagtcccactagctatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 61571 - DNA, 761 bp, Oryza sativa
aaaaacttttcaactaaaatgttataggtcgcgttgagggctacaattttgatataaagcttgtcttcattagagttcacatgaaaaagttataagttattttttaatataaagtttttagaccgtcctgtttaggtaccggggtgacacaactgaacaagttggaggaactaaactagtaatctacaagtttagggaccgggatgatacagtcgaacaagcttgaggacctgaacggtcgatttgcgagtttagggaccgtgatgacacaacggtacaagtttagggaccgatgatggactttactctatagtttaaacaattaaatgtgacgatttattaagcatataatactatgtttagaaaaaagtcaacatcgtcgaactagaaaaactgagtttgcaccctaaaaggaaaaaaaaaactgagttcggttccgtgtcgaactcggtctcttcccgcaatagcgccgacccacctgatcggactccgatcgcccccgcccacccataaccctaaacccgccgccgccgccaccgccaccgccactgccgtcgaaacctacgcttcgaaaccatgtcggccacgacgcgcgacgacgaggcgtgcccgtcgacgaccaccaccaccaaatccacaacggacgacgagccggcggcgccggccgcgacgacgccagcggtgacaacaacaacaacagtcattcacgacgacggcgcccctgccccgccgtcgccgaagaggcgcaaggtggcggcggc

SEQ ID NO: 61572 - DNA, 5896 bp, Oryza sativa
catcatttttttttgggtgctcgtgtatttcagccccgtggccttgtgttggtgcggtttttcggctgcatctaagccgcacaggacggatctaacggccgcgagacatctcaaatcaaatgggttcggagttttgttctccgagccccgtctcccccccgcctcatgcacacctcgccctgggcgcgcacgcactacgtaccaccggcatgagcaggcaggcagccgcggcgcgagtgatctccatcgcgtagtggccgccttcgttggtccaaatgcgacggggaacgtgcgctgcgatccacgccacgacgcacgccgcgccgctcgcgggcgagggatctatgctatgccgggcgtcagtgcaagcgaagcgatcgaaggtcttccggcctaaacaccagcgatgacgagcatgatggcgtcaatgcttgctcgctgcttgatctgggccgcctgtgctgccgtcccatcgtggtcacgtcggaaacttgtgccacggaatgatcgatgatcagcatgagccgggcttccgtcgcgtggatccaaaggtgttcggagttttttgttttttctacgaacccaccttcaaccgcctcatcaaggcctcgtccgagcgccgccgctgcatcgtgcatctcttggttcggaaccctcgtctctggcggacgcgtacgcacacgaggtgtaggatcggacacaagtaaccaagcctattaagggggggtgaatggtagggaaaaccaaatacctaaaaacttttagcggaaataaaagttaccctcaaatcgatggaaatctcgacgtagtcctgtcgccgccgcgggttgaaccgcttgcacgccgccggtcgaaccgcttgcacgccgccggtcgaaccgccgaacccgatgaaacacaaatcaaagaactcttaaagtagatgacaactttattacttctctgtatttacaaagtgcacgaacagcactccttacaaaaatctcgactaaactcgaaaccctaactaaactagcaactcaattgctctcaaaagcgataccgggaagcctcacgctccccctctatttatacataaaaaacctcctactcaaagtaggtgtagaactcctattcacaatagaactcaataactcaatttcctttttctcgaaaactacagccgcgccgcaccgaagtcggactcctcctgccgtcgcagcgaaactccagccgccaaccgagccggactcggtctctgtgttgtgcctcccaggccaactgccaatcggacatgcaagcccacgtgctgacgtgcatagccttccatccaatctcagcacacagccacacatgcatgtactaaacacacgtgtacagcacacagccacacatgcatgatcaacatacatgcatcgataccatccatatgcatgctacagtaccacgtgtactgtagcaccatatacccttttctcgatttctcactccaatctccttcgcgaacaccggcacttgcacgcacacctcgtgaagcccgttgtaaagatctctcccacatggtgtccatccaccgtgtgccatctcatatccaacttcgtcacccggtattcttgaccgtctggacctcaactcctccctgagtttagttccgatccccaccgttgaccgaagttgacctccaagaatccagactctagtcaccttctcacatggtatcccgaccgcactagacctctgctcctccctgagcatagtcccggtcctcaccattgaccaaggctgacctcaagtcacctgcacacaatcagacaaaacaaccgtttctgggcacagatatcacaacctgacccacattagtcacacgcactcacaccaacatccacacatctctcaaaccaattctttgataaaatcatttgcacagccaattgttcatcataaatattaattatgacaatgatttaacacgaggatcgagcaggaaacccaagccggcgtaccgaaagaggcactctagcatggcaatcccgtcagcgagcgatacacgccgcggcgccacgcgcgcgcgcgcgcgacagcccggttcgcgccctgagcgcgcacgcagtacgtcgcagcggcatgatcgccgtggtgcagctcgccgtggcacagcccaaccgcccaaataaaccagacggccagatcgacgaggaacgcacgccgcgacgacggacgaacgccacagtaagcatagtagcaaccaatcaagaattgcagctaactggtagtaacaacattcacatggatgactatatgcgacccaagatttgcctctgctcatttcatccttctcactgccgattagtatattggccgttcctctatttagggaatatacatgattaaaagaagaagctgcaaatggaggaaacaattttgatccctcgagagaatgtcgctcgtttgtttaaagccatccaaacaattactatgaaaaattctaaaaaaaaattgatagcactcatacaatataagtatgagccggtttctgcaatcgcacactgtgctcatctgggccgtggcagatcaatggacgcagtgggttccgagagacgcatcgtgcgttccctgcttcgatcggaaccctcatctccggcgggcgctggtacgcgaggagccacccacgcgcgcggccaccgacacgcgccggcatacaggaagaagcaccaaccctgctggctgctgccgtcatggtgatcctgtcagcgagtgatgtgaacctgattctcgccacgccacgtcaagccgcgcacgcccatgacagccggattcgcgaccatgctcaggcaggctcgcgccatgatcccatgagcacgcagccgcgcaacgtgcaagatcgcacaccctgacaaggaacgctacgacgaaccgccacgcgccgacgacgacgacgcacgccgcggtactggcgtccagaacaacgctcttctcgacccacacaaacgagaacgatggcgtcaatgcctctgcccgtacgttttactcagtaagaacaccacagccatgcctctgcccgtgccaccgtctccatcgtggcctcgccctgcgacggttcaacatgagccggtttcccctcgcattttgtgctcagctcatcactggtggcgtagatccaaggggttaggagttttgttcgccgaacccctttcaccgcctcatcaaggcctcgccggagcacctccgcgtcgtgcgtctcctggttcagaaaccctcgtctcccgcagacgggcgtacacatgcacacgaggagcacccacgcccacgcagccacggccacaccggcgtacaggaagaaagcacactagcatggcgtacgacagtcgacagccggttcaaccgcacaaatagaccagacggccagacgaggaacgcacgctgcgacgacggacgaatgcaacaatgaactattagtactagcaaccaatcaagaattgcggctaactgcttcttgaacaccagagacaacgagcttaatctgatgccgtcaatgaccgccgcttgatcagctgcgcacaaaagcctgatcgagccccaaggggggttcgtagctagtttaaaacgccgaaccccatgttttccttttttactaggcaagaacgccaccaccggcctctgaccgtgccacgccggtgcacccgagtgctgccgtcgcatctgttaagaattggttggattgccacgtttccaatcaaacccaagccagcacaagaagcatcacatatcagcaggagcagcagaagctagcacttggagacgatcgaacagaagaaagctaacgcaacggacggagaagctatgccgggcgccatcacaaacaaggtccgcgtcacggtcacggtaacaccggtatacaggaagaaagcacactggcacgtgcacgcatgcacgatgcatgatcacgcggcatctcccacataaccatgaactgattactcctatatccgttccaaaaaccctggaaagggacagatcgcaggcatagttattagaccggaccggtgatcaaaccggtaaggcactcgggtcattggtttattgctcggaccggtcaaaccgccggtttaaacgggttcaaatagatgtttgttatattggtttcacaacaagccgcatagactagtggtggaggctctccatggaagcatggaggttttgggttcgaatcacaagttctgcagctttttccgtatttctctccaacttcacgtgatgcgacgcgttccagcggtcgaaccacaccggtttttgtccggttctgcagtaaaccgcccggttcaaccggtttctcgccggtttgattgcagaccgatcttttagctggaccggaccggccggcgccctggttctagttttttctggtcggaccgctggtccagtccagttctaataactatgatcgcaagtcagaatgcatattagaacattaaaaagatctcgtcctgatctgatgataagttcataactgattctggtaagagtttccatattagaacatcaaagatttttggtgcttgtgcgttcactgttcagacgacggggaagggcgatacggagatgaggggtgtagaggaagtggggcaggcggccggacaaggtgaggaaggcggtgacggaggagtttccctgccgtggaacccgccgaagctccatcgccggtagtgccgccttgcctaagctttgtctagatttggtgtgagagatgactgttagcttcaagcgacagcgacatgaagaggagcaaagtagggagggggaagatgaaggtgagggcttgatggagacttgggagagctctccctcacagccgctcggcctcgtcagcttcctctaccatttccgccattcaacttcctcaagggagacgacgactaataggcttgcaccggtgggtcgggttccctgctatcccttctccttcccttttcgccgccgccaccacctcttgcgacctccactagaacaaaagcttcgtcgcccgtgccatcgaggtgttctccctatgctcctcgctcctcactgtgacactaagatggggaaggaagaagataagggagggtaaaaggaagaagataaatctgataggtgggtcccacgtgcaaaggaggagatggatggaaaatgtaacgagagtgatacggttataattttgtaaaatttcagtagcaaggctacgaataattaaacaaatagaaaatttgtatttgcatggatcgaattaacccttaaaaaaattgggaggtagtagtacataacaaatcaccacatgacgtaacaaatcaccacatgacaaaaacctgtcctagactcccaagtacggagtagtaccttagtacaccaccatttcataagccttgttagcactattagtctttacctgtgtgacaggtagggtagccactactaccaaatttatcacattttactcccaaactttcctcatcacattttttttccaaccatgcatttccccatgaaatatctcacttctccacgaatcttgtcaattttttaacacttttgtgcagaaatgaaagaatcttgagtagaccgttcaattttcaatcagaccgactgagttttgatcaattttgtcagtctgtcgaatggccttttagtctaaattcgtttttgtcatgaaattttggaacgtttatattcaaatatctgttttctcaatatttgcccaaaaattgacaaaagttggtgaaaagagccgcttcaggcagggttctccagttcgttactagtaggatataaaggccaccgccaaggcgccaccctgacccaccacccccgtccacggctcgttccctccccttctcgccttcgactaatcccccttctcgtctggattgcgggcgtcatggcggtg

SEQ ID NO: 61573 - DNA, 2969 bp, Oryza sativa
  unsure (1)..(2969): unsure at all n locations
ttgttttgatggcttatgggattgcatttctattcaatctgtttctgtatctgtttggtagcgtcagatcagttttagaacaaaatttcggcccaaaaatggttgccctgtccttttgttttgttgatagtccaccggtttcttctactacctgtggactcttaatttttcatagcacccttctgctccttttgttggtaatttcactaatttgtatctcttgcctgctctatttaagaataatctcgtcatactgtttactcacgtgtattcttatttttattgtgaaactgaagtgtttacatgaggggaattaatgtgtacttattggtaaatttgtatttgctacaatcttttgtctattaaagacttgatggactcatggaagggtgcagttatctgtaaattagtttagtgtctaatgtttgtgctctgttttagcttgtttatgctcttcttaattactgattctctgctcatattgttatgtaatttgggcagtcagtcaaaaatttttcttgtaaacttgaaatgaaatgttcgtgaacgttgctcatgtaaaccttcatcctttctgaccattatagcatttgatatattaatttgggttgtgttaatgctcttagaaattagttggtgttttagttgtaaatgttgttatattgttatgttttgactttctatactgatgatttaaactgcagttcatgactaagaacagaagagttattcttcctcgctctttcttataacatattatctatgcatgtaccacatctgtagtttcctgtttgcatggaatcttgatcattgtttgtttacagtgactacttaattttgttaacttgacaccatgtgatgtctgaaatgtgtatttggtatttttctgtactgtgtagaatattttgtcccttttgttttctgttaagatctcattactgtagaaagtttgtaagaaatgccctaggcgtcatctatttctggctacaccctttggattgatggcttggtttgtaggttctctttcattggtagcttctctctgttaatgtactcttaagatgtgagcaacatttttgctgtttcagtttcttgaaaaaatgcgagcacggataaatttgtgccgtgcattggataaattggattgttctttacactgcactttgtttagttatgtattcgagcgcttttgttttggcatagctgatattttctgctgcaggctaaagaagcaagaaaactttgggagcgcgggaacttaaatggtagcaacaatggttgcaattccaattcaccctcgccttctgagaaaagaaggtttgctgaccctaaagaaaaggtaaaagtataataaaaagtattgctggcttacaaattattgcgttggataaaatgagacatatttccttccccattgttttgagtcatatgtgactctttgtttttccttttcagatttttcagaaatttgatgtagaggcctcctaccttactgggaatgaagacagtgatagcaagtacagacgtttggttgatttattcaaccaaatgatctctctgatggaagccgttgaacatggtctgtcacttgaagattctaaggacctcgaacgtgaaatgaaatcaactattcacgagataagaaaggtccgtcagactataagagtgatgggtggcaaagccccaaataccccaccagagtttctattcagagatgtcttagagtaaacattcttcgtgaagaggtttcggctctctgtcgtgatttctgttgtgtcctgatttctgtacatgaatgaatttgtttagttactgactcaaagtgttgcctatgattcctggtagtttttttggctgggtttttttaccaaggctagcagagggtggtctgctccagtagttctgtcccagaccctctatgattctctctcttttgctgcactcttttactcctttcatgtaaaaactctatgatacatttgtagtaatggaaatggggccatgcagcccttgataaaaaaaaaatgttgcctatgatttctgtgcatgactatcaactggtgcagatgttgagttctttgttactcgatttctgcatacttggataattcttactatgccactttggttaatgcatggttttagctctcttagtctgataaacactaagttttggagaacgaatgcacatacaaatgccttttcttagaacacatacagattgaatgtacagatgctcccaacaatgcagatactggaatttaaaattggttcctgtgttaagaaagttctttatgtcctatgttgacatgggcgaaaatcccactagttctattgaaattatactgtttcatgtacattttgtgccttggctctggcgtttctttctttgagcctcatcggttagcttaataagtcaaagaaaaaaccaaaatttaaaatttcaaacttgattttggagttaatcttaagatattttcaacgtaatttttttagcgttggctttttaagtcgctacgaacaaatatatataagttttaaatataaattaatttttattccctaataagccgttttgacttattagggaatatgggcaaccgaggaggcttttcatttcacagataaacgacccaggtctttgtgctcggtcaatcattggcaaataattagtagtactacagaactacagataacaaaaaaaaaaatcaatagaatacacttcgaggtatcgccaatgtatcatagtggcactgaggtgagggctataaatggaatatttaatggctctttgttgttcctacttgtgctgttagtactttaaatgtcattaataccggatattaccacagcagttcatataagatgatagtatctccaaagttttcgtcaacatcctctcggtctatccaggannnnnnnnnnnnnnnnnnnnnnnnnnnnnnnnnnnnnnnnnnnnnnnnnnnnnn

SEQ ID NO: 61574 - DNA, 9132 bp, Oryza sativa
  unsure (1)..(9132): unsure at all n locations
aaaaaagtcaacggtgtcaaacatttaggtaccgagggagtattacgtaatctagtgaagcgcctgatccagttgaagcgatgaggtgggatcaccttgatttcaatattgaatgcttgtactcgtgatcatcagcacaaactgcaataaccttgtcatacgcctttccccgttcaaaaaaattgcatatgaagttgtgcattggtatgactgtaagtctgtaaccatcctactatacattatttatatgaaaatatattaacgatattagatgaagaagaatttgttttcattatagtcacacatttgcgcaaccacaactgtcatttatatttatattatttagcttgatttacttttttaaatatatgataaaaaatcattaattcaccacaatttattgcaaaatttacatccacgtgataaactaagtttacataataataataataataataataataataataataataattattattattattattattattattattattattattattattattattattattattcattgtcttcaccgctgcaccagtcgccgcgttttcacctcttccgatgttacatgacccccttgttctccccttagttttcattggtgcatctgctttatagctcgtgcatataggtacatttcatcctgtatatttcaacttacataatacattaaaactgaagtttaaaagccatcctcaaaacagggcaatttcaatggtattttccaaacactggttctgctctttaaataccaagcaaattaaattgactactaagaggctagaataagtaaacctagagtccacggtgtcacaggctgtttgttatgctgatcttttctgcttgtattcaagcgtcaaagagttctcttacccaaattctgttatgctagtagaatattaatcagtcctccaagttaagagtcatatcaaacagggaaatgagaaaggattatattgcaccttgtacttctgttcatcaggcatccaaagtttcaactatcatatattccatttctccattcacatggaacaacaaatatatatgtggcaatgtgacgcttgcagcaagcagttcagcatgccactgatgctgtctgaatatcttgattaatctgaggatgatgcagttcatgcatgccgctgatgctgtctgaagatcttgattaatctaagataaagatgtacgcagttcagcttaaaaacaccagtacatcatatacaatctcagatgaatcatacgtaatggctattaagactttccatgattcactcttcaatgaccattccatgtatatattttccaataccagtctcagttattaaaatggaagcgactccggctcgggcgtctgacgagagggggttaaaatcgggcgttgatgccagcatgacgtcagcgccacgcatgcgtgcaaaactattttaaactgatttttctcttaaattacttatccaaatcatgattcgattgcaccactaaatttgttgcaattaaatcttcaaaacaagactacacatggatatattccgacgaaaaaaaaattagcctactattgaattatttttaaatgttgcacgatgttccaccagatatatcggaattgtttcactaagtagatcgaaaatgtttcactcatttaaatcgggtgttgtttcaccttatataaaaacaatgtttcagcaaataggcgaaaaaatgttgcagttcactgcaatattaaatctatacatagtgaaacattataagtacactaggtgaaacatttttggtggaaaaaaataaaatgaattcccttaatagatggtttccaaaatatgtgggtgatttgttgcaatggagtatttcagttcactgcaacattagatctatacatagtgaaacattgtgagtgcactagatgaaacattttttgtggaacaaaaaataaaccaaattcgcttaatagagggtttccaaaatatgtgggtgatttgttgcaatggagtatttcagttcactgcaacattagatctatacatagtgaaacattgtgagtgcactagatgaaacattttttgtggaacaaaaaataaaccaaattcccttaatagagggtttccaaaatatgtgtgtgatttgttgcaatggagtatatggtggagatacatggtggggccaggagggagacaatgcgcatcaggagggggagcgtccgatccggctcccccgcgccggtcgcccggtagctatcattctcgtattaaaatccatggttgtgaaagaaacatttaaatatgcacattccaactaattagaagaggtggtgtcttttcacgctcataaattcttgaggttaatgggctaacggcaggtcattttaatcaaaatatcaaattcagaaacagggcagtgcgaccatagatttgaggaaattgtgaaccaatcttgcattcttcgttacctaaatttggtcatagcgagtggtaatagcaacatacagtaaaaatgtttattagaaggatttgatcaccttacggtactgcatgctattcgcggcagtcatgtagcattgcaggagcactgccaccagcttcacagttcatggaagaggtgggggccggggcttgtcttgggtagccataaaatatttctgtgagaagcagtaatccttgggtctctactgtagctatcacctgcagtacattcctgatatcagtttcaaattgtaaggtttgatcttgttttctgtttaaaatgaggcatcttcttctttatatgcaacttcggcaagtgcctcgccgttggaaaagaattatcgatttcaaattccttggtagattgtacttgatacatgctcttagtttccttgggctaatgaggcaatctgatgactcattgtacatagtaagctaaggtgattacaaatatactggtcattatctgaaaagcgttgttattatccaaaaaaaaaaatcgtatcatggtcagcgttaatattagtcaacctgtatgtctgtgaacttggcaatattaacgctgcctaatatatctatcaaacagttctaccctttttgtataataatataagacagttctaccatgatatgatatgatacaacgttaatataagacaatttattatgcttgctgtgatatttgccatctgaacttttgttgaacacatcaaatgcctaggaatgtattgagtatatcaaaataggtacatatacgtcatgtgtcgatctgatttttactcaatgacaactattttgacatcatgtttcttattaatcagtaattttaggcatccggtaccaatttcattaatttacttggcaaattatgtagtagcttacagtaactgctcatcattttatcttcatcagcattgtaaaaatttctatgtaaaatccatctaatggagcaacatttttgattaactgcaaaatgttaagaccaatcatcagaacatatgcagtataatatccccatttaaatagatttttgtgtcagttttgacaatttacctttgaatcaaactgtagagttctcatgctgaataatcgcacatgacctgaaaacgtgagagaaattagcatccgctagctggttatggagaggagcaataggagtgcacgtcgtcgttgccgtggccgtcggttcaaatgctgcaattaccagatttagtcctcccagacctcaaatgacgccgacgaggatgatgttggggaggtgcgcaggaaggatggcgtgtattctgttagatttaattgggtaattaatctatttaaatcaattaaatcaaataaatttcaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttgattgatggttgtgtagtggaggatggttcatggctagttgatgacaattagttgctccattcctcttcctattccatgactcttactcttcatcttccattcctcttataaaatgagaatggatttgatctcccgcgagaagaagaagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacgtgtcgaacactggagacaaggagaaggagactcctgtcaacaccaacggaggcaatactgcctcaaactccagcggaggaccattcttggggtataaccttattacattatttcaattagaagttttactgtaaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacatattccacccctaaccatccataggtgaattggggataggaaaaggcaggggaagtagagatacggtggctcaggaggaaggagatggggaggaagacgaggaggccgtgacgacggtgacgagggtaggcataatgttactaagtcacatcctctaccataatgtcattattgtaatcactggtatgtgagttctaccctcctactaccctacaagtaagtgcctataatgaggatgtgaatccagggggaacatatttaatacatagattatcccaaacccaagacaattccaactcagtgcactgtacatacatatataaagtactggatacaaagaacaacaggtaagataacgcaagatcaaaagaatgagttgctttaccaatacaccatttgtgtcacaaaaattacattttaatagagtgaacaagaggcatcaagaaaagaaacaagagaaagataatcaaagtttgaggacctattaagagatacaacctcattgtagtacactaataagccaaaaccaaatccaaaaccgaaatttgatttttcaaactcaattttgaagaagattttaagatattttcaacgtatttttatgggatgtgtactgttttatgtacattgctacttcctctgttttataatgtaagtcattctagcattgacatctatatgaatgtgggcaatgctagaatgacttacattatgaaacggagggggtactctataattatgtaatgcttcagagtttctatgatggtattccatgtttttcaacatttgggatgttgcggtaaatccaaccttttatggatgttgcagtaaacccaacattcctactgtatgacacgagaagtcaagtgtgtagtgatgtatttttttgtcgaactcaaaggtagtgatgtttgaagcgtaactctctaccaccttcatcattttgcatccattcacaaaaagggtatgcatggaaacaatggggtggatggcactgtgagagagatgaagatactggtgtacatgtttgcaagaggtaagttcccaacactcccctctcgttttctgcgtacacactttttaaattgctaaacggtgtgttttttttaaaaaaaattatatacaaaagttatttaaaaaatcatattgatccatttttaaaaaaaattagctaatacctaattaattatgtgttaatggaccgctccgttttccgtgtatggaagcatgaaaagctgtattccacgttgatgtttatacgcaggcagtatcagggcgcgcgagttcttcaatccctggtgtgacagccttgtgaagtctagtttctttgcgccaatgaattgagtgattttgtaaaatgtggttaattttgctgattagatttctcgcaatctcatcatcacaaaatgcactcttatcgcatcggagtactccttctgaagataattaagctagggatagaatctccaagattgtagaaatgaatgtgatgcaaggagcatcttggagtggcattaaggaatgaatgcaacaacaatttaatgtcctgcatgcaaagcaatgcgaggacaatagcactggaattatgagatgtgctgcatcacatacagcagaagagataagtacactggcatcaggtatgcagctgtggtatgtccgtatatatgtggactgggaaatgggagctttatatgaaatattgcagaagtattttcccagacagtcattagtaatgacaagcaaatattgaaataggtatgtgcaaccaacaagtatgatttccatgcgctcatgaaaatcatgtggttatactacacaatatgattttataaaagcagcaaagagccggaaaaaaacatgtatgctctgtacagcagtgcatctagatttttgcagaaagaatatagaatgaataggccagataaatgaataccccgcataattatatctcaggattttgtttagtacgtgcttctgttttagaaaatttggaggttctcaaagcaaacttagttatcttacaccattaaatcatccgtatctttctatctagtattgaagcagatgtgattcaatagccccccattaacaaacattggaattatataagcaagattgcagaaatgtgcacatgcagttgtgcatcgaagctccacctgtgtttatcttgtagagaatgaatttggtaattttaaatagcacgggccaaataaagggttcgcacattcattcacatccccatgcccattcccactacataactcaaacctaccaattcctatttgagccacaaattgcatatttgacgccgttgactttttaaagtatgttggaccgttcatcttattcaaaaaaatttaagtaattattaattcttttcgtatcgtttgattcattattaaatatacttataagtatacatataattttacatatttcacaaaagtttttgaataagacaaacggtcaaatatatattaaaaagttaatggtgtcaaatatttaaaaacggagggagtaatattttatacctctgaaaggtctacacctgatcttatccgttgtcatgttgacaatcatcgtcttgttggcagggcgagcccttccttttgctactgagaatccttcagtccatctgaaatattgatgtgcaagctaattgctgtgttctttcctcatggttgggaacacaacccttcaataggaaaaacggaacagaccattagcacgtgattaattaagtattagctaattttttttaaataaaggatcaatatgatatttttaaacaaaccttgagaaccaacagagcctgcgtacatggtaaacaaacgtagacgtaggtcccacctgacagtgtctctcttcttttcttctgtttctctcgatttcttcctcgttctctccgattccccttctctttcccacgcgcgcgcgcccgagcaggagaaagcgaggcgcggccggcgcggcgacagcgaccgcggctgccgcggcggtgggggaaggcggcgagatggaagagggcgccgcgggcctgacgaatcccggcgcggcagcggcggccacgcgagccacgctcggctcggcgaggcggcgaccgcggcggcggttcggccgggcgaaggcagaggcggcgacgtggggtggaggcgctggtggagagcaggaaccgggagggaggatggcgcgacggcggcggcggcgttcgaccgagcgacgcgctggcccgagtgcgcgaggcgtgctcgacgcggcgtgacatcggccgggagagagatgaagacggcggcgacggtggtttcggtggcggaattggtgtggcggcgtgagctcggtgtttgctttcggtgtggacgacagacacgggctctcgtggcgcgtcgattggctcagtggactgggtgcactggcggcggccatggtgagagaaacagaggaagaggagcgagggggcggtggtctgggcggcgccgaacggcgtgaacgcggcgcacacgttcggtgtggacgcgcggctgtgggcgacggagcgcgagcacgcgaaggcggtgaactcggagcagccaggcacagggcggcggcgtcgtggaggagcatgagcccggcgcatgcttttggcgtggacgcacggctgcgggagctcgagcgcgaggaggcgacggtgtggactgggagcagcggcgttgccacggcgtgtgaaggacggtgtcgacgacgttttgccactgtgggcggaagcttctagggcaaggaggagggaacgcgaccggatttcatcgtggtgtggagcggagcagtgcggcacggctcggggcggcacacgggactgtgcggagggtgtgggggcgtctcggcatgctgctcgcccggctcgacatttcgtcgagcaggtggcgggcacgtgcggccggccggctgacttcaagggggagagggagtgggccggcctgggtgagggaaagggcgggctggcccaaggaggaaaagacagaggagagggagttggaataagttcactttaggtccctctatttgtcacctagtccgactttcgtccctgaaccccaaaaccgggtatgagccgtccctcaacttacaagaaccggacacataaggtcttatggcggtttggatagtggttttggctaacgtggtgcctacgtggcgggtttgactaggtctccgtcccaggtggcattgacgtggcgcttacgtgacaattataactcagaaaaataatgaaaaccatgggcccacatgtcagctacacaacaaaataaatatggtggggcccacatgggccccacatgtcattccctatcccctctcagctctctctccttttctcttccccatcgtcgccacagnnnnnnnnnnnnnnnnnnnnnnnnnnnnnnnnnnnn

SEQ ID NO: 61575 - DNA, 13295 bp, Oryza sativa
ccgtcggccagcaggggccataccggctggggcacgaaaggcggcggcgctgccgcctagagctcgatggactctttgctgccgccgtcagtgacggcggcgaaatcggcttcttctttgcaggtagaagcagcggcgggaacgaggtgttctccttctccggcagcggcggcagaggtggtggtagcggtttcttcttcagcggcaggcagtggtggcggaaacagcaacgccttcttcctcggaggcagcggcggcgtgaacagcagcggcttcttctcctcaatcgacggcggcggcggaggcgggacgggagcgacgcagaggcgggaggggaggttgagtgtggcgtcggggccgcggaggcttcttctctacccgcctcgccaccgcctccacctccccttcctcctcaccgaccgccacgcggcaacgcgagggagagggatggaggcggcggcggggggagctcccatgcgcgtcgtgtgagtgcggcggtgacggcgcgcgaagccggcggagagggaggcggaggcggagacggcgacatgcgaagggggagttggcggcgcaaatcgatgtggcggcgtagcaggaggagtcagcggcggcggggctgaggtcgtgtagctctggccgccgctccctcctctcctgtctcccgtcgactcccgcgggctctccgccgctgctccggctgccatcgtgccgccgcaccggccgccatcaccccaccggcttcgcgtgccgccgctggccaccgctccggccttctccgtggaaactgcagggcgagagagagagagagggagaggggatagagagaagaaagaggagtaaggatggcatgtggggaagaggagagagagccgagagagaggagaggaatgacatgtggggcccacgtgggccccaccatatttattttgttgtgtggctgacatgtgggccccatcgttttgaattttttttagctgacatgtgggcccatgatttttattattttttcgagatataattgccacgtaagcaccacgtcaataccacgtggaacggagacctagtcaaaccagccacgtaggcgccatgtcaaccaaaaccgctatccaaaccgccttaggagcttatgtgcccggttttcataagttgggggacgggtcgtacccggttttggggttcagggacgaaagtcggactgggcgacaaatagagggacctaaagtgatcttattccgagggagttggactacgggaaaggaaaggtggtccaaaggaatagggatctttcttaatttttctagggaatttcagagatggacttttggagagtatttgatggaactgtaaatggacattgggactataattttgtggggactttgtacgtggaattagagtgaaatttgtgttcaaagattgtaaagggactgtggactctaataataggtttaggaatttgttggtagataggacttcagatgattggattttgagatcgttaatggcacaacccagaattcaaataagaaccaaatttttgaaaataattttgtatttaaaataagattttaaacgggagcaaaaatgagatcttacacgtcgctagctgccacccgaccagattcgatcagggtggcgtggatctggatggggctccgccaccgtcgccgccatcttcgctaccaggtgtcgccgccgccaccgtcagcccccgccgccagccacccaccggccagatcatgccagactcggcccgaatctggccaccactgctaccgccaccctggatagcctcccccggccgccgagcgcggggtgggcgagacgaggccccactgccgccatccttgcgtctgcgtggctttgccggcgcccgctcaggcaacaacgagggaagaggaggaggaagcggggggaggaaggtggcggtgaggcgtcgcctctcatgccgcccaggggagggcgacgcgagagagaagttttttaggattcgcaaaacattttataatataaaacaaagggggtatatttaggggcatgctgaaacaaaataattatgatatatattgccagtaggttacaaagcttatacaagagaccagcataaatgccataaacaaacattatagtacatgacataagtaaaaaggattaaaaatttcaataaatatcaaagcaagattgaaacatcgcaaatcaactctatgcatgagcatcagaccattgacatgcatggttgaatcccgatgataacaaatgaacaccacatgcatcgtcaacgcgttgcgctaactgaagataaatcatacacgggagtggattttgatcccttaaggagatgcctcctcgttgtttgcatgttactgaaataggtatgaaaaaatttgaaaaaaaatctaagaatatgtattaacatgatatatcactccacaaacatgcgagtttaaattcaacttatacatctcacaacgaaaaaaacaaatttgactgtgaatataccttaactatctagttgcgagatgtagaagttgaatttgaacttgcatatttatggagtgatacgaagtatatcacatgttaatacatattctccactttttttcataaccaatgaggggacgtcccctcgagggatcagaatagtttcccaccatatacgactatttgacaaaagtttttataatactagatcactgatctagtttcttcaacacaagcttcatcttgaccttgtcgaaaacagcaatcgttcttgtacctacctccaattccttcggtctcatcacgaatgccctcgtctcttgatcatatacgctgacatactcggtgaactcgccttccaccggcggatcatcggcgaagattttctcccagacatgcgcacgccacagcctccgctcctcctgcagccgctgcgcctcctcgaactcgtcgacgtcgtactccacctcgacgaagccattgctgccgtactcgacgcggacccagctctggaagtccctgaacttggcccaggtggccttcaggatgccgttgatgtgcaccagcagcgcctccggctcgtcgtagtagatctccgggaggtggtcctcgtcgacgtcggcgtcggggacgaaggggatgtacctctcgatgtccggggcgtcgtcggtgcagagctccgttcgggcgaggatccactcgatgttgtcttgcgacagccgcatcgtcgccgtcctcctcctcgccgccatgatttccccgcggcgataaatttctgaacaaactctcagttcagtacttcagtggcttatgtaaaaaaaaaaaaacgggccggtccgtttccgttttagtattgccgaaaccgaaccggagtaatcactgccgcccctgcccgtgtcacggcagatggcggcacgttcgcatctcaactgtcttctgccgatcgtacggctccgcacacgggggtcactggataagaaaacatccgaaattttgacaaacggaccttctagaaaacttaattgaacgaaaactaatttaaagaagggtttgttgtaaagaatgatgaagcatgaccttggcgtgctataacgttggtgctgagatcttgttcgacgtggcacaaattcatcgaaggagctcgcgttgaccttatgtacaatctaaaatcacgccgagctactgtaaggaaatctagcccagtggttaggcttttttttttagttgcaggttaatttctggttttgaacccatcagtgcatctttttttcagcttttttcttacatattcgccgtgaatgctttgctatattttttttccaaaacgaccacatattttgtttgtaaatttatttgatgtacattaatttgaaatggacaaatttacgaacttaaattataatgttattagtcttagcaaaaatacttagctcaataattataatttacatttttgaacttggaaggaataaaagtgaacatatgtgaaatttatagttactaagccaaaaggctttcaagattaatattgaataatttatgttcttatatttaaaattttaaaagaaacgtaagcaaaggctaagggagaggaacaccataaaagcaattatttgatggtaggaggccaggaatcgaacccttgaaaccccccccccccccgtctttttttttattgaactgcatgctcttcattcccccatgtagtgtgagattcaccgtagacacgcgcatacactactatacacttaacactacactcgcacacactttaataaacggaaacaaacgatgtatccatggtcttattaaaattctattgaaagcatatatgtatatgggtaatatttctgggcatcaggatttgaactcttatagttatgggtggagtcatgccaatatcacatcactaatgtctgtctggatgtaattgtgtataattttgacgttgaatgcccgatgctattaggctgttgtcaatacatttagttgcattaattgcaagattaaataatgagaaatggctatctcaacattttattaagcactgtgtttctttacatcccagtaaacgtcatcaccagttaagaattcagcaatgcaaaggtggaaaagggtgttattactcaccgatcgagtagacggtcgcgtccctcggtgaacacctatcaaatttctagggtttcgtccccccgcgcgtttcaaaatcgcgaaatccgtcggcgccattgcacatctcccaaatcgagtggaggaaatgggttccccgtgccgctctctccgtttcgcccctctttcccctgccttcccgtcggcggagctcgccggcgcgaccccccagcgccgccgcttttgttgttggttggtacgtatgtgtttgagaaatgtgcctttgctcgtgtttttccaccacagattccgaatccggtgctggaattcggccaaaccgtgaacgaatttggagccaatttctgcctctccgattcctactcttactaggacacatacacggcccgctataaatcgccgacgcttctcccaacttggtgaatcgaattcgaaaccatggcagcggcggcggcgaggtcgaagcagctccggatgccgcaggagcacatcagctggatccttcaccggagggagccgtcgttcgacgaggccgacaaggccgcggcgcgcagggagctctacaccgacgaccacgagctggtgcggagcgggtggttcgacgacctgctggcgctgcagcgggggttcgtcgagaggaggaaggcgagctgggccaggttctgcgagatggcggcgcgggtgcgcgccgagttcgaggccaacgggttcgtcgaggtggacgacggctacttcgatcggcaggaggagaaccgagctctcgtctgggagaattgcgggagagagttcgctcagatgctccgggagaacaaagacggggagtttggggaccgcgatgatgaagctgtttctgatgacgaacaccaacacgaagatgaagaggaagatgaaccacatgatcaggaatcagagtcagatggtgatctctgaagtaatatggatacgagaaattatgaaaaaaaaaacatgtaagggaataatgattcacgattatttttttgaggggagaatacattattcatgattcacgatcagtctaagtcttaattatgtgattcttgactacatgagcaatctttcctaatttatggtactttgacatttgtcgctgcaaacttgcgatgacgttttgtggtcacgatgaatgatgctgttggtctcccaagtcgtgaatattaaatatgttcatctaacagaaagtctaattcttgacacaaatgaactgggcacaaattctgtttgtttatatccacaaaatcggccagtatcagtagtacataacagcatcagcattgaggagcatacaaatcgggcgccgatttttaaaaatcggacgctgtttcaccaagtaaatcgaaaatatttcattcttttaaaaaactagaagacaaccaaactatctcatgaaacattttgcaacaacttatcaaacaacggtttccacaaaaatcgggcgttgtttcaccctatataaaaacaagagaaaattcgatcaatagcacagggaaaaaaaacggtaaaaaaaagcacaaaaaatttcctctttcaaccagaaacacacgtcactaatttttcttcgatttgtagcacttccgtcacattttccgtccaagtccattggttagccatgattaggagcatcaaaagacgaaattaccctttattctaagaaaagtatgggtgggtgaggtggccggaggaggcgcaggttgtggcggcggtgttggggtggctgacagcgatggccctcacatcccgccgccacagtccccatccccaagctcattcaccgccgtcgcactaccatccccaagctccgctgccaccatccccacctgagctcgtttggcgccgactccttgcatgctcgtgtcccatcgtcgccgtcatcgtgttctgccgctgaaccgccatgcccgagcttgtgttccgctaacgcccccgtcgccctgggttcgcatccagttgccagcacagtcgccccctatctcgtgtttcgctcccgtgcaccgtcacccataagtttgagttccaccgccgaacaaccatgcccacgaacttaccacgcacagtcgccatgcccgtgaactcgccacgcgcagtcgccatcaccgtcggaggcgcttagccgtgttgcaccatagccacccaccgatgtgctggcgagatcgacgggaggaagagaagggaaatatggaatagaagaagggcaaattagtctttttccacccaaatgaatggcaaatgtgacgggagtgctacaaatcgaagaaaaaacagaggcatgtgcttctagtttattggggaaaaattttgtgctattatttggtaccaattttttttttgttccatgaatcaaattttctcttaaaacaatattcagtaaatagcgaaagaatgttacagttcttaaaaaaagtgaaacacggtcagtcactaaatgaaacaatttggttcaacatatgcaacaaactattttaaaccattacaacacttaaaccttgtatacataaacaaaccacgtgtccttcaagataaaattattaaaacaatataaaaaatcccctacgacatttggtacatacacagtgaaacatcacgagtacactagctgagatattgttggtggaacaaaataatgaaatggatcctcctaatagaacgtttccgtaatatgcgggtgatttgttgcaacagtacacgtggtgggggtggcacgcgaggcgtgggaggcgcgggggcccgatgggaaggattttcccgtcagcatgattttttgacatagcgctggtcgagtaggaagctttgcaaggttggctcttagtttctttccctgacgtgcggattgagaagcagagctgaccggcagctgctccggagaactctaccgctgcacaatgcttcgacgaaatgctgtgggtgaggttttgttgattgcactatatgaaggtatccacgaaatgctgttagggtcattggaatcggagtgaatgaactccttccttctctctaatactccctccgtttcaaaatacaccattgactttttagcacatgtttaaccggtcgtcttattaaaaaaaattgtgaaatatgtaaaactatatgtgtacatgaaagtatatttaacaatgaatcaaataatatgaaaagaataaataattactcaaattttttgaataagacgaatggtcaaacatgtacttaaaaagtcaacggtgtcgaacattttgaaacgagggagtatgtgactagcaccagtctagatctgaagaaaccagttcatccctctgtttttctggtgcaatgggaagtttggccgccttcttagcgaatttctccttagttgcaacctgcgacctattagccatttcaagttcatttcaagttcgaaatacacggatttctgcattgtattccctggtgcaagtccatttccatcaaacaactgaaccaatcaaactttttcttcaaatttctaacttttccatcacatcaaaatttttctacacacataaactttcaacttttctatcacatcgttccaatttcaaccaaactttcaattttggcgtgaactaaacacacccaaagtccctattaggacattgccccagccaccatatgtgaatcatttgcacccagaattctaagttggcatgcctcaaaaagaattcatgtgaatcatttgcctgggaaaaaaaaatgacataacaccaccacccctgcaccgctctagcagaacatggcagcaatggcacagaaaaaaataacttctgttgttcaaagctacagtactacagccaatcaatcaatactatgagagtcaatctgcaaggagtacaaatttactgcccactttcggacagaagaacgcaaatgctgtagcactaacagaagcacctctaggctctctagacagaaggcggcaaatgctgtaccactaaaagaagcacttctaggctcagaagaatgcaaatgcagtaccaccaagcaccactaagagatatctggaatttctaatagattgggaggtattataggaggttcaccttcgacttttcttttgatcatcgcacgaagtgatcgcatcttccgaactaagttcctcatcagtaagcagttgtccaagatgtcactcctcatagcattccccttgatcatgtccttggtctctaattggagattgttcattttattgtaaagcccgactagctcaatgtattcgctgtcagtgacttcatttcccgtcataaatctcttgtctggctcataaatcttctgattggactggaaagctccaacttcaactggttctttatagatcgagcaattggcagtacctgatcctttcttgggggtgttcttgttggggtttctctgtccccaccggaccatagcttccttagcctgcatgacaatcgttagaaaaaagaattatcgcccaaaatccaaatgttgaattcataagcacaggaacttacggctttctttccggcggcattcttaacggcgcgcgcagccgcaacggcggcgctgacggcgaccttcttgccgccggcaggctcttcatcctggagctcgagggcgccaaggtccacgccaccctcggcgtcgtccaccgcgacctcgagccgctcggcgtcgtcctcccgaccgagcccctcgccgtagaggcgcgcgcgaccaccgacaccgagtccgggcagcgggagcccctcgccgtgcgcgcggaggcggaacgggagcccctcgccatcctccgcgtcaccgcgggcctggaggcgaaggggcgaacgggcgcggccgcggcgaacgggcggctcctcttcgtcctcctgcgcgcggtcgcggcgtacgcgcggctcctcctgcgcgtgggcgcggggcgcgagctggtacgcgcggccgcagcgcacgcgcgcctcctcgccatcgggacgggggccgcggagtcggcgcccctcgccgttgtggttcgcaccgacgcggacctcgtcgtcgtccccgaggcggcaaacgaacagctcctcgacaaggccgccgagcgggcgctcctcgccgtcgtcgagcgcggcgaacgggggtccctcgccgtcgtcgtgcgcggagcgatggccctcgcggtagccgttcgcgccccggtggacctcgtccccgagggcgccctcctggtcacgcatcaattcctcgtcgtcgtcgtccttgaggcgggcacggagcgtgagaagcacgcggccacggcgcggctcgtcaggatcgtcgtgcgcgccgccgcggaggccttggtcgtcgtcgttcgcgcagctgctctgcctctcgccgcccacgcgcccgcgtcctcggtgtcgctcgtgcccgtcgtcgtgagcgcggccgcggcgcccctcgtcgccgacgtcctccgcgcagaagccgcgcgtctccacgccgtagcgcgcgcggccgcggagcccctggtagtcgtcgttggcgtcgtagtagaggcgcgcgcggccgccgagcgggcgcctctcgccgctgacaccgaatgcgggaagggggagcccctcgccgtgcgcgcggcggcggagcagcccctcgtcgtcctccgcgtcaccgcgggcctggaggcgaaggacatccccctcgtcatcgtagcccatgcggtcgcggcggaggcgcagtgcgcggtcgcggagcgggagcacgccccgcacctcctcgccgagcgcgcggccggggaggaagcgcagcccctcctcgtcctcggccgcgtcgtcgtcgtacgcgcggccctggggagcgcgcacctcgccgcgccgcgcttcgtcgtcggcgtccccggccgcgtcgacctcgtgtccctggccgcggcacccctcgtcgccgacgtcctccgcgcggaagccgcgcgtctccacgccgtagcgcgcgcggccggggaggaagcgcagcccctcctcgtcctcggccgcgtcgtcgtcgtacgcgcggccctggggagcgcgcacctcgccgcgccacgcttcgtcatcgtcgtccccgcccgcgtcgacctcgtgtccctggcgcacgcgcagctcgccgtggagcgcttcattgtggtcgcccccgagcgcgagcgcttcctctggtgcgaggaacgcgaggaggacgccattggcgactcccgctcgccccttctcctcgtcatcggcgtcggcgacagccattttcgtcagctcgtactccggagtgtggcggatatagcaggccaaacgggcggcccggcccagcacggcacggcacactgacggcacggcccactagggcacggcccgttaggcacgactcctgtagcgggccgtgccgtgccggcccacgtgccaaggcctcggcccaagcacggcccaaggaggtgctgggccgtgccgggccggcacggctactgtagtggaccgtgggctggtagccggcccactagtacatgtggcccataaaaattgaaatttgaggggaaaaaaaagaaaaaaggcagaaaaaatataatataaaggaaaacattataaatatatgataaatgtgaggaaaatttaggaaatatatcataaaatatatggtacaaataggataaaatgtggaaaaaactaaaaaatatgagaaatatatgggaaaaattagaaaatcgtaggaaaaataaatgggccggtgggccgtgccatgcctgggccgtgccgtgccggcacgctacagtaaacgtgccgtgccgtgccggcccacgggctgaggcgtcggcccaaacacggcacgggataacgggccgtgctggcacggcccacaggctggcgtgccgtgccgggcctgggccggctacagtactgccgtgctcgggccggcccagcttggcacggcccatttggccaggtatagtggcggaggttgaaggggaagggggaacggaggttgaagcggaaggggggaaaccgggccaattttataggccggtgacggaagtgtgggccgaaataaaattttatttaaggactaagttcactgcaggtcccttaacttaagagcgagatttttttggtaccttaaccacaaaaccaaaaatatctacccctaaacttactcaaaccattcaaaggaggtcccatggcagtaatatcccactttttttaatcttttgtcttactaacatgtgggctccatattttttgttttaatttttaatttcatattttacttccagtgccacatcactgtcacgtaggacgaggacaaatcaaaccaaccacgtaagtgctacataagccaaaaccgccatccaaaccgtcgagcgaccttatctgcaccggttttaatatttgagaaatctgttgtttctggtattgtggttcaatgacgaaaatcaaactcgctataagttaagggatctaagatgaacttatttctaaataggttcggcttagagctcattcgccttgctttgccctaccaccaacaccggctcactagcagttgcctttagtcgtaacctgagtgtttgtcgcattgcattgcgttcatgagatatctcattctatactagtttccggaggaaatgtaatactcacttcatttcaggttataagactttctagcattgctcacattaatataaatgttaatgaatctagacatatatatgtatttatattcattaacaaatatatgaatgtgggcaatgctagaaagtcttataatatgaaactgaggaagtatgagatagaaattaatgaaaagtttcctttgaatctttatcttcccttaaatcgttatgttttttcttacgatcaaatcaaatatttaattattcctgtgttttttatattttataatcatctcgcaatggccagccatgcattgctacccccaccataagggggtatttagttcccacaccaaactttataccatctcacatggaatgtttgacacatgcatgactattaaatatagaaaaaactaattacacagattgcgtgtaaattgcgagatgaatttttaagcctaattagtccatgatttggcaatattgtgctacagtaaacatttgctaataatagattaattatacttaataaatttgtctcacagtttacatgcggaatctgtaatttatttttttattagtctacgtttaatacttcaaatgtgtggtggtatacacgatgtgacaagccaaaactttacacctgtaaatgtaaacaccccggcgcaaacatgtcaaacgattttcctttttggaaactgaatcacgatgatttgaaaccttcgtgactggccgcccagccagcccgatatgcgtcacacattaattatagtatttgagaagaattttgtagtaatttgagctcgaattaactactccttccgtcccaaattataaggtgcctctttttaagaaaaattaaactcggtaccttttgagtaataaccatactaactatatctatactaagtattacatattatatcactagatttatattttaaaatactttcatataatgctaatttcatatttatcgagatcataaaatagaataaaatactagttaaagtatgttattgaagactgtgtaaaaaatatataggtcttataatttgggacggagggagtatattaattaacacaggtttttttctacaattaccaaattatagtactatatgatattttt

SEQ ID NO: 61576 - DNA, 9633 bp, Oryza sativa
ttctcagcggcccgaacttgtatacatcgcccgtgtcttgtgtgtttccattctcgcgaactttccacagaccgagagcttagaacctcacccagggcccccggccgaaccggcaaaggggggcctgcgcggtctcccggtgaggagccacacgttccgtcatctggcgcgccaggtagggggctctgcgtgtgtttttccaagctctcgcattctttcgtgtgcgccaagcttttcctgttcagcccaatggccgaacaagcaaaggcgcacaacctctctccgagtgttagcggtgacgacggggagccgaacccacgccgtcgagctcgtactccaccgccccctccacgccaaagtcctagacgggaggaggcgctcgagagggtcgaaggatccgcgactgcgacatccacgggtgatggagaagggcgccgagatggggagcgtcgcctcctcgtctacggcgatggcagcacgccccagggcgcgctccaagctgcgggcgcgctcctacgtcacccgcccgtcgtccctgacccggagtctccagcccaacgttggctggacgacatggccaacttggtcatgacggcacggcaacgcctaggtgctggtgggcgctcctccgccaccaagacctctggcgctgctaccaccggctccgtgtcgtcaaggcggagggcgcggcgagcggcggctgttgctcgccattcggctgccactccctcgtcagcacctccgacccgggaagatcagtgtggggggccagatgcccgcatcggtatcgagcaccggcgtaatggtcgacgtgctgcccacgcaacggagggcgcctcctcgtccggagtgtcacctcaactcggacgcggggatcagccctccgtgcccccggttggtggtgtcggctgtagagcctttgtggcgagcgtttggaacgtccgttggccctcaaggttccggcccaccatgtcgcgaccgagaaaattgcattttcccgaacgctagtgtattaatgcccgtccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaagactccacctaagacttcttctccaaagcttctcttactgaaggggggagaaagatagagcaagaatgagtacaaccacagtactcagcaagccacaccggcggatgcacgattaatgtaagggggtacaaggggtaatgatataggggttaagttttgcagttaacagcatttaaaagtcacttagttgcccaaagccattttataaagacgatcctagagctacacagtattattaatcaaggccgtgaacccacacgaacctgccttaacctaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtatatctttacccacaagacacatcttcctcacgtgtaaccacgtgccacataccaccatggcatatggatggaagacatgacatagtttccaacccatcctggccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatacaccccgagcccagcctaaaaccattttggggattttgaatagagggggcggtgtgaatccaattccacaataaaccaacaattccaaagtgtccaggtgatatgaatatcccaaagtctagagttgtaaaaccacctaatgttacctaattaatcagcgaagcatctacctaaaatttatactagtggtactaagaatagagtgtccactagttggggttttgtttaatctagggtgaacaaggtattaatatcaataacaataataataaggtcataacaaaggtagataggcatggctaaataaaacagtgataacgcgggaatttaaataaagcgataatgcaatagtttaaatcaaaataattttataaactgggattcaatatgttcaaggatgatgtgacttgccttgctcgctttcccaaacgtcggcttcaacttccacgaagagcggatcttccgaagcggcagcgtctacacgaccaccggaaaagaaaaggcttttactctaataaactccatacaacaagcaggaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgggagagagggcgcgcagaccgggtccacgggagtggggcccacgcggcagcctcacggtccacggtggaccgggtgcacgcggctgacgccggccggtgccgtgggtcccacgcgtcagccgcacccgcgggcgcgggcggctgacggccgggcccacctggcagccgcggggcgcgcccggaagcggcctcgccggcacggccgacgggaggcggcgcgcccgcgccccgatggtcgccgccggcgaccaccgacgcggcggagcggcgcccgagagagagaagggaagggggaagcgaaaggagcggtccacggctcaccccgggtcgacgaggacggcggaaacgacgaccggagcggagggaggcggcggcgcagctcgggtcgacgaggacggcggcgttccggcggtcggcgggcgaaacggaggagtggacgaggtcggcgaggacgcggcgaagccgaaggaggcggcgccgaggtgggaggcggtccggggtgacgacggcggcgggccggagctcggcggcgacgacggagagagagagcgacgtcgcgagctcaaatccggcgaggaggaagggcggcgagaggcggaaccggacggaggaggtgcggggagggtttaaatagagccggggcgagagagggtggccggggaagggaggaaaccggcgcgggaggtcggccgccatcaatggcgccggcgagatttgcgggggcaaatccgcccgtttgaacgcgggagagagagggagaaatggggggaaagagagaggggatcacggggaataattccccccactttaatgcgcgcggggactgcgggaggcggcgggattcgcggcggcggccgcgctagggcgcgggcggggcggcgggagcggcgggaggatagggatgacaggtgggccccacccgtcagcgagggtggcgggcgggcccgcccgtcagcggcgcgcgtgcggggagaggccgagtgggccgcggggaggaggagagagagggaaggagatgggccgagccggcccaagagggggagggggggaaaaagactttttagggtttttctttttataaaatcattttaactttgtttttttcttaataattattatttgtgctctgaaaattccactaaaatttgagggctccttttagaccaaggaaaatttaacaaaaattctccgggccacatttgaatttttcttgtacgtattttagtgtttgccaatttcttttcgaattttaattaattctattattccttttagcaaatgatttttaattcgggatgaatttatcaggacgtgacacaccatcgccgaaaaatatgacgggagcgtcaaccccgccgagtttctcctggtctacacgaccgggatcgaggccgccgggggtgatgacagggtcatggcgaatttctttcccatggccctgaagggacaggcgcggggttggctaatgaacttgccacccgcgtcggtccactcctgggaggatttgtgccaacagttcaccatgaactttcaaggcacatatccgcgcccaggtgaagaagcggacttacacgcagtacagcgaagggatgatgagtcacttcgctcgtacattcagcggttctgtcaagtccgcaacaccataccatgcatccctgcacacgcggtgatctacgcgttcaggggggtgtgcggcacaaccgcatgctcgaaaagatcgcctccaaggagccccagactaccgcggagctttttcagctcgcggaccgagtggctcgtaaggaggaggcatggacctggaacccctccggttccggtgtggcagcttcggccgcccccggatccgctgctcggacagggcggcgtgacaggaggaggaagaagaggtcagcccattccgacgacgagggtcatgtcctcgccgtcgagggcgcttcgcgggccacccgaaaggggaggcctgcgagcgacaaaaagaaggaggccggcgctcccagcagggagcgcccaactggcaagtggtgtaccgtccataacacctcccttcacgacctcgcggactgccgcgcagtcaaaagtttggctgagcggacgaggaagtgggaggaggagatgaggcaggagcgccgagagggcaagtccccggcggttccttccggcaatcggcgaagtgaggccaagcagaaggcccccgccaaggacatcgatgacggcgatgatgacctaggtttccaagagcatggggccaccattgccactgtcgatgggggagcgtgtgctcacgtttctcgccggagcctcaagaccatgaagcgagagcttctggccgcggcccctactcatgaggcgacacgccgggcgcggtggtcggaggttgccctcacctttgaccagaccgaccacccaccgtacgttgcccggggaggacagatcgcaatggtggtttcccccactgtttgcaacgtgaagctggggcgtgtcctcattgatggaggagcagccctcaacatcctttcccccgcagcctttgacgccatcaaggccccggggatggtgcttcggccgtcccagccgattatcggtgtgacgccggggcacacttggccgcaaggtcatatcgacctcccggtcaccttcggtggatccgccaatttccgcacggagcgggtgaactttgatgtggcggacctcagtctgccctacaacgcggtcctagggaggcccgcgttggtgaagttcatggcggcggtccactacgcctacctccagatgaagatgccgggccccagtggccccatctctgtccatggtgacctcaaagtcgcgctcgcttgtatggagcagcgcgcggaccacctcgccgccgcgtccaagcccgagggtggcgacgagaggcttggcacctccgtccccgccgccccgaggcagcggatagtcacatgcgacgaggtcccggtcaaggaggttgccctgggcgacggcccgtccaagaccacacggatcggtggtcttctggatggcaaataggaagacgcgctcgtctccttcctgcgggcaaacgctgacgtcttcgcatggagaccggcggatatgcccggggtccccagggaggtgattgagcaccgtctcaccgtgcggccgggcgcaaggccggtccggcagaaagtgcggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatgctctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgtgcaaccaagagaccttactctcggatctagcagaaacttttgagagtctccgctccgcccgcataaagctgaaccccgataagtgcgtgttcggcgtacctgcgggcaagcttctcgggttcttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccggaccgtttacctggacggaggaagctgaacatgccctcgctcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcatccccaccctgcgctggcttggcccgggagagagcagggaggagaggcccccgagccgaacggtggcccaaggcccccgacgaccggagctggccctctgcccgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcctgcttgtccgacgacgccaggagcccccaacccccaggacggccccgaggccactgtgggaaggccgcccctgtcgttctccgaccccgaggtcgtcggcacagaagatgagtgcgccccgcgaggccgcttggacgaagagcgccctagggatgcggcccctagcgaagaggatcggccccaccgaaaggtgcagcggcccgtctactttgttagcgaggccctccgggacgtcaagacccgataccctcaggcccagaagatgctttacgctattctgatgacttcgaggaaactgcaccattatttccaggcgcatcgggtcacggtggttacgtcttaccccctcggccaaatcttgcataatcgagagggtactggacgggtggtgaaatgggcaatcgaactttctgagttcgatttgcactttgagccacgccacgctatcaagagccaggccctcgccgattttgtggcagagtggaccccggctcccgagcccgtctcagtccccgaggccagctcgggcccctcgcagctgcctcacaccgcccactgggtgatgcagttcgacggctccctgtctcttcagggcgccggtgcgggggtcacgttgacctcgccgagcggagacgtcctcagatacctggttcgccttgactttcgggcgaccaataatatggcagagtacgagggactccttgcgggactcagggtggcagctggactggggatccgccgcctcctggtgttaggcgactcccagctagtcgttaaccaggtctgtaaggagtaccggtgctctgacccgcagatggacgcttacgtgcgccaggtaaggcgtatggagcgccattttgatgggatagagcttcggcacgtgcccagacgggataacacggttgccgacgaactttcacggctcgcttcctcgcgagcccagaccccaccgggcgcctttgaagaaaggcttgcccagccgtcggcgcgacccgaccccttaggggagacggacgcgcctgatcggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaatggaatcctcctgaagtgcattcctcgggaacaaggcgtcgagcttcttgccgatatccatgaaggcgaatgcggagcccactccgcctcgcgcaccttggttggcaaagcctttcgtcaaggtttctattggccgacagctctcaatgatgcggtcgacctggtccggcgatgcagagcgtgtcaattccacgccaagcaaattcatcagccggcccaggccctgcagatcataccactttcatggccatttgctgtctgggggctcgatatcctgggaccgtttaggcgggccccgggcgggtttgagtatctgtatgtcacgatcgacaagttcactaagtggcccgaggcttatccggtcgtcaagatcgataagcactccgcacttaaattcattaagggcatcacagcccggtttggagtgcctaaccgtattattacggataacggcacccaattcactagtgagcttttcggtgactactgcgaagacatgggcatcaagctctgcttcgcctcacccgcccaccccagaagcaatggccaagtggagcgcgccaatgcggaaatcctaagaggccttaaaaccaagaccttcaatatcctcaagaagcacggcgattcatggatcgaggagttgccagcggtgctctgggcgaaccgaaccacaccaagccgagcaaccggggaaacgcctttcttcctcgtctacggcgcagaagcggttctgtcacgaccggaaataacccaacgggcgttcctgacgtgcgtgcattaatccttgtcccagtaggcaaggtacaccaaaagttgatacaattcagagtttaacaagcggaagcgtaaatagataacttattacatgggcagcgaaggcccagcacacacaaagacaaacgggaaaccgtggaagactagggcgacgaccacaggcgcttgacggcaggcacgagctaggcaccaaagccttcatcttcaaggaactcctcttctgggcttgggaaaaattgagcaagactgagtacaaccaccgtactcaacaaggcacacccacaagtgcagaataaatgcaagggagtacaaaggaattatactataaaggggttagggtttgcattaaacagcatttaaagatatttagttgctcaaagccattttgtaaac

SEQ ID NO: 61577 - DNA, 4103 bp, Oryza sativa
  unsure (1)..(4103): unsure at all n locations
ggctcaccccgggtcgacgaggacggcggaaacgacgaccggagcggaggaaggcggcggcgcggctcgggtcgacgaggacggcggcgttccgtcggtcggcgggcgaaacggaggggtggacgaggtcgacgagaacgcggcgaagccgaaggaggcgatgccgaagcgggaggaggtccggggcgacgacggcggcgaaccggagctcggcggcgacggcggagagaaggtgcgacgacgcgggctcgaatccaacggggagagagagtggcgagtggcggaaacggaggagggaggcacggggaacgtttatatagcgtcgggagtgagagagagcggccggaggggaaggaatcggccgcggaaatctcggccgccattgatgcgccggcgaagatcgcgggagtgaatccggacgaatccgagggagagagagaggggaaagagggggaaaagagggagggaatcacggggagtgatttccccctctttatggcgcgcgggaacggcgggatgcggcggattcggcggcggcggcggcgctagggcacgggcgggcggcgggagcggcgcgaggttggggataacgggtgggccccacccgtcagcgagggtggcgggcgggccggccgtcagcggcgcgcgcgcggggaagggccgatgggccgcgggggagaggagagagagggaggggactgggccgagccggcctaagaagggaagggggggaaagaagactttttagggtttttctttttataaaacctttttaactttgtttatttcttctcagttattatttgtgctctgaaaattccactaaaatttatttacgcattttaggcttttaggaaatatacaaaaatcctccaagccttatttgacttttaaatttgcacattttaattgttggaggctttcacatggattttaattattctatgcacaatttcgaggatgtattttagagtcgttttgggacgcgacaaacctaccccccttaaacggaatctcgaccccgagattcggaagaactggcgaagagatcgggatgggctgccttcaggttggttgccttcaccggtggcagcatttctcctggtcgtcaccatctgaaaaccccacacagaaccagcaaacagagagagctaacaattaaaactaaccacccacgactactataattcttgaatttattactgctattaaatgggttcattaaagttcaagttgcttaggcaaataaagtaaagacaggctccgacatagttataccacacaccggcataaccatgccccacacgacccaacaggaagacaaacgaggaagaacacacgcgcaagcctactaactgctcgtctaccgctgcgacgggccaggacggaaggtgagcaacaacgcatcctccgtgctaccaacgccggaggcttccccctcctggggaaccacgggcgcgggctcagcacgaggggtctcgacgaagcaagtccatgccagggactgacgaacaagctcgggcctggaggtgctcttgcgggcggtgatcttctggctgcggcagacgcggcgacgcttggggcggcagacctctccctgggcgatcttgagctgatgcagctgcgcctccaccgcatctaggtccttcttgagctgcaggttctcctgacgcagctccaggatcttcaagttgttctcgaccatcccgcggcgcaccatctgatggaagtcgatacgagccgcgtcgtacgcctccaccatgcgcgccaggtgcacgatggtagcgtcatcctccgagctagcatcccggaaggtggtgtagtcgcgggctcctccgcgacgagggtggtagcggtagggcgagtgctgcaactcgtccgggtagcgctggtgaagagtgccgatggcgaggagagcggcgttctggcaagcggcggggaaggaatctccacccgcggtgactgccagcgaagtccgctcgggagagccagagaggatcactgcagtgacctcccaaccagcgtggggctctgcatcgtcaccctcctgctccggaagcggcctggcttggtagtccactccatgtggataccccaggacaacgcacatgccccgcagctccaagacgaagccagtcatgtccaaaccacgacgggtgacgctgccggccatctacaaacaaaaacaaaaagaaaaacaacattttaaaggtcagtttttggcgataaatgaagcagcaagacagagagagactagacagttttcacaaataacaaaggatttttatttttgaaaatattgctaaggcttgggatctacggctcgtcctagggtcaagggggctctgataccaacttgtcacgaccggaaataacccaacgggcgttcctgacgtgcgtgcattaatccttgtcccaggaggcaaggtacaccaaaagttgatacaattcagagtttaacaagcggaagcgtaaatagataacttattacatgggcagcgaaggcccagcacacacaaagacaaacgggaaaccgcggaagactagggcgacgaccacaggcgcttgacggcaggcacgagctaggcaccaaagccttcatcttcaaggaactcctcttctgggcttgggaaaaattgagcaagactgagtacaaccaccgtactcaacaaggcacacccacaagtgcagaataaatgcaagggagtacaaaggaattatactataaaggggttagggtttgcattaaacagcatttaaagatatttagttgctcaaagccattttgtaaacacgattctagaactatacaatattaattatcaaggccgtgaacccacacgaacatgccttaacccaaggcctacgatgattcagaccgaactggcaacccgaccctgggtcccagctcgtcccaagccaacccaggccaaccattccacattttagttgataagcaggttttaagaattaaaacactaacttgggtacattgctcggcttgcccataaccgagggcgcggctattcgaatagattatactctgatcagaggtgtacaactttacccacaagacacatcttcctcacgtgcaaccacgtgccacataccaccacggtatacagacggaagacgtgacatagtttccaacccatcctagccatagacaagagtaccgacccaatcccgcctacggccggaacctccgggacaggcaggcaggactgagcccctacagcagggcaccaaccctgtgccatgacatctcgactaccgggccgcagctcgtgtagccttcatttgccctggagaatgtccatcgacccccgacttcatccatctccttccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgaacccagcctaaaaccattttggggattttgaatagaaggagcggtgtgaatccaattccacaataaccagaccattccaaagcatccaggtgatatgaatatttcccaaagtctatagttggaaaaccacctagtgttacctaattaaattgcgaagcatctacctaaaagtaaactagtggtgccatgagtagagtgtccactagttgaggttttgtttatcctagggtgaacaaggtaataataacaataacaataataataaggtcataacaagggtaaataggcatgactaaataaaacagtgataacgcgggaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatacaacagcagaaacaaagcagaaaaatgagttcttgacttcttaaggaaaaattnnnnnnnnnnnnnnnnnnnnnnnnnnnnnnnnnnnnnnn

SEQ ID NO: 61578 - DNA, 2009 bp, Oryza sativa
agggtttttctttttataaaaccttttaacttggtttatttcttctcagttattatttgggctctgaacattccactaaaatttatttacgcattttaggcttttaggaaatatacaaaaatcctccaagccttatttgacttttaaatgtgcacattttaattgttggaagctttcacatggattttaattattctatgcacaatttcgaggatgtattttagagtcgttttgggacgcgacaggttctcccatccgagctcaccctgaggtcccctcgggccaccatgtactgcgaggctgttcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggcgtcccccggctgggctccgttcggctagccacgggcgacggcacagagctgcctaacccgtggaacatcgaacaccttcgtcgcttctacccctaagggggatcaggtgtcaggtttcgggctcgggccaaccccgcacccccctcgggcgtgcagggttggccgggggctaccacatatgcatattcttttttctcttatatctgtatttcaataaaagcattttcaatttcctaaaggctgtatctgtgctgttattttcttttgaagaatcttgacttgaaataggtcactcgtgctcaatcttgccctcgggggctcgggtcggctaaaatcgccaaaaggggcccagaaccaagccatgccccggggcgtggtgaactccgggggggaatcggcaaaaacccacaatcgggtcacccataaccctcggtcaccacgctcccggcctggccagtctcgacacgtggatctccccaggcactagccccgacccgcgccttttgaggactgggacctgggcacgagcccttagtcaagctaagacacaaaaggaccacggcacagatcatcctcatcgcatacacatagcaaaataaaattgacacagaaatttctttattttgattgcagattaagtgaatctatacaaaaaggaggcccgaaggccttcgaagaagaaagaagaaactatttaaaattggcgggggcctgggggctcactccgatgcacccggatcgccagcctcgtcgccactgtcgcccactccgccgtcatcgtcctcctcgtcggagttgagggagaacgcgagctgaggggccgaaccctcgaagctgtggacgatgtggtcggcggcgtcccggacctgcgcgcgcgcgccgtcctcggtcccgggagggaactcgtccagcgccgtccatggggagaagtcggggtccctggcctggtaactcgccagtacgagctccaccgctcctcgggcgaggtccctcgaggatgacttaatcgtcctctcgagctcctcggggagccgttggagagtcccggccatctccgagaggcgctgggcgaggcccccctggttggtggcgtacttcgcagtccgcccgccccagagacccgcctgccgcccggcgcggtctaaacgggacacggcgtcccgaagcatgccgggccctacctcgcctgccaagcggagggcctcgacctccctggcggacgagtctggcgcgccctgcagatccgcgatggtgtgttcggcagctgcgaggcgggcggttaagtcgctttcgcccgcggccgccccgccgctgcgtgccctcgcgtccagctccttcacccgcgcctagagctcagcggcccgctggttcagtgcggccctctcggcgcgggcaccttccagattacggcgcgcctgctcctcccgcgctgcctcgcggagggacaggctgtccgccagccgctgcgccgcggcctcggcc

SEQ ID NO: 61579 - DNA, 9821 bp, Oryza sativa
cacctccttggcaatctcccccagcaccttccgacgggcttcgagctctgaggcatgccggcggtgtgccttgcggcccacctccaccatggcctccaccgagcgtcgcccctcttcgacacgcgcccatgcggcgtcgagctccgcccgctctgcttgcagggcctccacctgggcacttaacccgtccaacaccgtggtgtttgcgacggccaaggcctgcagaaggggctctgcgctcagtggggcaacggaagacgtggggaagagccgcctcggagaggatgccgcgcggctcggtccgccgatggacgtgccggactcggggatgtcccccggacctggtttgtcctgagcgtcgcacgagggagtgggcccaagcgatgcgcccgcggcctcgtcgcgagctgcctcggaagtcgtcatcgcctcggcctggcgaagtcttgcctcctcccgagcggtttcttcagcttggcgagctcggacggccacctgggtagcttcctcggcttcccgaaggcgatccgcggcctcttgccggtcagtttcacgggtcgcctcggaggatgtcgtcgcctcggcctgccggagtccggcctcctcccgagcggcttcctcggtctggcgagcccgggcggcctcccgagcggcctcctcggcttcccgtaggcgatccgcggcttctcgccggtcagattcccgcctccgggcctctgcggtcgccggatcctcggcctcagactggccggacttggaatggcgggagggacgcgacgggatctcgctgaaacagaagaaagaccagaagacaaacaaaatgggtgagtgaaaactcgcgttgagagaatgaatacagccacgatgggcgtgggacgaacctgcgagggggtcggttaaacgaccaccttggaggggaaataaggtttccccgggatggttctgtcccccccatcttgcggagccgtttcttcttccgctccccctcgggctgcgacgtcggcacggcaccctccgggcgcctgctgctggcacgcgccgccccgccccctcggggaggagatgggggaggggttccttcctgcttcctcttcccccgggcatcggcagggcggctgctccccgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttggggaatgagtgatgcctccacggagctgagattcagcacccgttggaccactatcttgaagtcctcaggagcccagtcccatctgaccctctggtgggtcctcatgtagtcttcggacccggtgtactcccaggcgccccgggcgcgccgctggagcggcgcaatccggcgacgaaggtagtcgccgtacaccatggcccctatgagcccctgggatcgcaggcccgccaggcggtcgaggacggcgtcatagccatctcccagatctaccggcgtccgccagctggaggcctgcgccgggggctggctcggaagtcggaggcgcgcttcgtcagcgaggggggtgtagaaccagttgctcttccagtcatcccacttcttgcggaggacgcaggggatgtagcggttcagcaccggcccccgcggctggaagtagcagccaccaaccaccgacggcggcgacaccgactgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccattgcaaaagggaggaagaagacggaccgccccgggtagcatggcgccgggcgtccctcgcccagcgtgactatctcccggccggtggcagattccggcatgaagcggcgcggcagcccggcctgcctctcgctcacgatgcgggaaggcggcagcacgctaccatcgagcagagcggagccccgtgccatgacgccggaagaagagatgtttgagagcgagcgcgtgtggcgagggtagggcacaggaaacaaggagttagggcgcaagcggtgaagacaaggagaataatggcgagaggaaggaagcaaatctcttcctcggtgtctttatacccttgccaacgctgtgcccggctcctcgcttctcgcgcccactatctcgctccctcgtttctcgcgcccacgcttccactaatcccattcgcccgcttgcggcgcatgaggtggatatgcggctgtggcagtcgagatggaacatatcgtgcgcgcgttgattacgctcgccgaccgaagcgccatcaccatatctcaaggtaaaacgaaccggctcgtcccgattcgtgtgctactcgagtaatgtggcagtcttgaagagaccgctcattattggcagccgagttaccattgccgatgtgcgtgatttgcgaccgttgggtttctgcccaactgtggagaccggtcccacctgtcaccaggccttaggaagtggcgtcacgcccgaccgcttccctcgaggagggcgatcgccctggcataacgccgggggctactgtcggtgacatgggaccgggagtatcatgactagaggcttgggcaggagcaatcacccacgaggcctgaccccctcgggggggggggggtcgggcccgagggtgatgtggccgcctccctctttgtctccccgaggggtcggaccgctcccgtttcggccccgaggactgaggcgccccgaccccttgtggattttgcgccgcgtgtatgggttaggtgagcgcagagcggggctcacctaaccgcatttattgcggtttggacgagcgcgtcacgctgcatgtaacgcagtgcagcgtgctcgtttatccggtctgtgactggtcacagaccgatcagatcgtgggttacgtggcgacaggcggtctgacgcacgcctcgccccatcccgtcaggatgagagcctccaagcactcgtccctagccggagccggcgtgttacctcctggagatggcacgttggtcccggtcagatatatgccaggcttcatcctaaccattacaagcaagatattgtatgaagaagggcgaacatgcagattgataaactgacgcgtggtggacaagaatgaccgatttgtgaccggtctgacactggtcatgtcgtcggcagacagccatgttcccacgtcgcacctgcttccggcgaaagtagaggtaggtatgggccgtcccatcagaagatcattcggacggcaaccatacaaatctccgtccatttatgaagagaaggcaaatcaagttggagaaaagagaggataagtccccacacaaaagagagagatggtgcatgtggtatccccttgagatataaaaggaggaccttgcccacttagagagagaggaaaaagggatggagaacgatccgagactgggattcggaaccagaaagggagagagttagagttctctggctctccagctctttgtagcttcttcatacacagatccaccaaaacacaggagtagggtattacgcttctcagcggcccgaacctgtatacatcgcccgtgtcttgtgtgttttcattctcgcgaactttccacagaccgagagcttagaacctcacccagggcccccggccgaaccggcaaaggggggcctacgcggtctcccggtgaggagccacacgttccgtcaatatatatatatatatatatatatatatatatatatatatatatatgcctattcctatataattagaaccgactactcggcaggggtggatctagaaaatagagtagctagggtcactactcaaatatggtggtgtgtcaatacagtaatccttgtttctagagtgtgttagcaaagtgattagtaagaaatcatgggtgtcagctgacacctgcttacactatagatccgtctctgttactcagcatgcattgagtcacatcatccataataaaaggaaatgcctctatggtcacaataaactctaaaacatttgatttttctgtatcttctctccaaagccctaatacgtgtccttgaacggcagctgttggtgccactgcatgcgtgagccgttcggtgaggccaaggcagagcagctttgttcgtggcatcgatttctgtttcccaaagacaaattatacacacatctagatgagaagaacttgcatgacgatctacaaatttgtgcaagaattattttaccatggatgaaaaatacgtaaatattagaaaatgatctaatattaagtataattagaagggggtgagcttttaaagccaaatcgtctagccaatcaccttatgaagctagccggaagaccatgggctgttctcatttttccatggatgcgtgaatgtcatcttacatacgtgccgtgggggagatcggtagcatgtgcatggcgaggagcaatgtcttgtcactcgtgtggctggactcgtcgaacaagaacgtagtcgagaacacgacgggaaggagcgacacgggtgaagagagggagaggggctgactgacgtgaggacctactaatttattactccctccgtattataatgtatgacgccatattttttaacaagcgtttgaccactcgtcttatttaaaatttttatacaaatataaaaatacttatgccatgcttaaagaatatttgatgataaatcaagtcacaataaaataaattataattacataaattttttgaataagacaaaatgtcaaacgcttgttaaaaagtcaacggcgtcatatattaaaatatggagggagtattattattatatctggctgtcatgtaggtcctattgagtttttttttctatttttgtttttttcttttagtgtcacgtaaacatcacatgggttgggaggggaataccaaatccagcatgtgagattgacgttacgtagaacaaaaccattgagggattagatttatactgattttgatatctgggtgacgttatgtgtttggatttacggttgagagacaccaataaaattggacccatacttaaggggcataaagtggacttctctcgttgggagttggtggtctagcggtttgtggtaaaaattggaaataagtctattttgcctccctcgtgtcttgtccattgtagaatcgtatctctcggctctctcaagttcaaaaactagtgcaaattaactttgatggttttgatagcagtattgctgatgttgcaggttgacttagccctgatacgctgacgtggcaacccaatctttaaaggatttgaaaatagaagtgggtcccacatgtaagtgacaaggagtaaaaaataaaaaacggtgggggtccatacttctcctttttgaacagcgacgcgcgtagtagtgttgagtatagatggccaactgggctacccggcacaacacggcccaagcccagtcgtgcctgggccgaggtaattagtcaggccggcacggcccgatcgacacgccgggccgtgccgtgccagcccacgggcggcatacacagcgcaagcacggcccaatacgactcgggtcgtgccgggccagctcgaaggcacgatcccccatcgtgcttttccacagaaaaagtctatttttcattcctcaactctgtgggctatgttcaaatggttggagaataagtctatccgtattcctatcttctttgggccttgctttatacagttatctgagtctattttgcatccctatattttttttttgttcgatcttgccgtgccgggttggcccaccgtgctgagggtacaatctaggcacgatccggctgtcggaccggaccggcatgggcactaccctagtcgggccgtaccatacttgggtcgggccaaaatggtgtgtcttaggccgggccgcgggccttagtccatatggccatccatagtgttgagcacctcgtcgcgaactgcttctgtaacgcaccgttcttgtggtttgcctctcctgtccgtcagcaccatcaccttcggggacagcgacctcaccaccgtcaggaagctacccagctattaaggagaagaagtgttttgtcttcgtgaagaactgaatcaatataataagcgagtctttttttcttatttatgtggaaatcaattgctgtagcatgctttcgtggagattgatgtaacgcacatcgacatgatcaaactgaacgtgtaggttgatctgatgctgtttagctatatccaaacggtaccctttgctgttgattatctgtcgcttaatttgttataagttagataatggttttttttaaaaaaaaacaggaaaatattattagaaacatagaacatgagttattttacaattgataggagagaagtcacattgcatacttctggcatgacaatggccctgtttgaatccaagcgataatttttagccctctctcaaatagcccaaatagccccaaaagatccaaaagggtgagctatttgaggactatttggaaatagcccacccaaaaaaactatcccacccaaggggtgctaattggagctattttgggtggggcccacagcttttatctctcccacagtcgcacgggatcagaaaaaaggtcgcgcatcctctctctccgcacgaccgcgcgcgcaggcgcgtagcattttcgccgccacctccttcactcctcgccgccgcctcctccactcctcgccggcccccaccagcgccaccgcctccccccaccagcgccgccgccgccccacctccagtgccgcctcctccccccaccagcgcgcctccccccaccggctccccgctgctagatttgttttcttctccatggaaccggccacaccaagacacatgcacaacagatccagtggaaaaagagagtaaagggggtagttatgattgggaaagtgtactaaaggttaaatagctcttgcatccaaacagctcaagggctatttcattggagggctattccttgagctaaaaaatagctctcaaaataactctcggctacttctccaaacagggccaatgtctccaaacagggccaatgtctagtatatgatttttaatgtacacatgtaacgacgtggagggcgggtctcacatatcggtgaccacgtgcctctaactttatactccctccattccataatataaggcacaactacattttggatgttccataatataaggcatgcatgcatacaattaattaatacttcttcttcattaaattattactttttaaaatcctccactctcaagatctctaattctattggatgcatgtattacatttattagggtgattcaaactaagagatgataataattgtttattggtctttaggttaagggtggttctgccttatattttaaaatggatggagtattagaatagtactgaagccattattataacatgagggggccagaacaacgggctaagtaatagaaaaaaaatagtttaagtacaaaaaggtttggcttcaaacccctattgataataaagtactctatttgtaatattacgatgtgtcccattctgtactatttttttatattttaggacacggtagtatattatatgttttgactattgttatcaattgaataatttttaggtttatcatgttacccctagcaaaagaatacataagaaaattaaaaaaataacataacatttgttgatcaaatttaacttacggttactaactatatcgtaaatattgttgattttatttgatcggcttaaaactaacaaattaaggcctacataagttggtaaacaaagaaattacaatttggctagcaaaactgtcgttctagcaaaatttctacctcgtaaccattattataggatcgagtgacctgcagaccggccgagttttggtcaaccgaccctagtaggtcaaatagaccatcaaacgtatattcgattatttgatttccgctgatgtaatctaccattcacccttctctggtaggctttgttacctgtgttcgatcttataattatttcacaaaattagagtgaacctgtctactgtcggagtttggagcagtcgaaaccttcacaatttggtgtgtttacatactgttacacatgcaccctgagcaaacaccaggctaaaatggcgtagactccaaataccaaagcatggctgtcatactcatacgtgatttactagtacaggatgggacctaatgtactaatgcctgagataatcatgtcgatgcctgagataataatcatgtggttaattaattagctggtacttaaaaaaataattttgttggaggagaccaggcctctgctcgccacccctgtggctccggcattgcatcagagcatctcaatcgtccgtcaacaataaagccccggccattgtacaacgcaagagatagtatttttcagcgagctctttccctccaataagtctatttcaatttgattataagtaccgatacatgtgtgtcaagatttattaacatctatgtaaatatgggtaatactcgaaagtcctataatatgaaacggaggaagtatattcttacaatgtaaataatttctaagtatttatgcttatcctgctgaccatatatatatatatagaaaacattatatactatgacatattgctatctaagccttattgattacaattttatctgtaatctttttcgtttaatgcagaccatatctccaataatgaattcgcagcgatgtccattatgagctgtaatctttttcgtttaatacagatcgcattattccacatatgagtagcagcaatgtccatttataaaagatcaacgcttcggccaacgacattagcctagagagtacacccaatcattttagcttgcaatcgctctcagaatttccacattaaactagctaggatgaagttacaattcggtgttctattgttgtcccttgcccttgtggtgcagtgctcaggtatgtatttttttttccatttcctactccaaaacggaaatattagggaatgacctaatatgtatattaaggaatgacctaatatcaaataattagaaaggatgaggcttcgaatctaggtcgtctagcccaccaccttatggagctagccggaagacccctgagcatttctcccatttcctgttccgttgaaccgaatgaagtttgaaggattttttatggattctaaattttagatttttttttgtatgtattgtttagaacgaaagatatgattacagcaagtcatatcaaaaagcatttgcattcatccatagttccatcccttaaaaaggaacatgaagtttcacagaggaccctattaattgtttttcaaacaaccaagtgttagaagtaggcttctttctgggtgtgtttagttcacgctaaaattagaaatttggttgaaattggaatgatgtgatggtaaagttagaagtttgtgtgtgtagaaaagttttgatgtgatggaaaagttggaagtttgaagaaaaagtttgaaactaaacaagtgctctgttaaatttttttattttctgttgtagatatggcgaggaaggtgataatggcagatgaagaaccctcatcgacgaacccccaagattcgtcgtgcggatctatcgtcaatccagggccgtgttttccatcgtcg

SEQ ID NO: 61580 - DNA, 14395 bp, Oryza sativa
cgtcgtgcaaaacttactgtaaaatccaggttcccccaacgctgatggcaactgtacgcctgacggatgcaagtgcacctactgcttgccgccttcacctccaacaaaacaaggacgatagatgaattcagtccaaaaaggaataattcttgtgtggctcgtttggtttgtatgattaattcaagggaatttggtaggacaaaaaggcctccaaatctagtataactaggattcaaccccgggcatgttgtggggctggtagggtttactagctattttaatatccacaaatatatcaaagggatcgaattttcggaatatttcagaacttcacatttttaagatttggataaatttcatataaaaaattgaagattaaaaatttaggtgaaatagtttcatgttgggaggttcaaaattttttaatttcccaaaaatttcaaaccaaataataaacgctggacacaagaagggctcgtgctcgtagtcgtgggaggcaaggatccaccacggctcctccgcctcctgcagctagaccatctctctcgctagaagtagggtagttaggagcttagggcagttaggggcttagggctacagtctgctctattcaaagattattttttgcaaaatcacaaaagccacctcatgggatatgatgcatgagtagtttagtaccatcttacctattttaggagagggagacctccttataagagaggatgtgctctactagccacttgaggcatgtaaggtggagagaagagggggaacacgcgcttgcttgcctcgcttggcatggcggcgcgcgttctgccaaaaaattggtttctcactcttgcgcacatgccagcctctttttgctgcgggaaattcaaatttgataattcggtgcgtgaaacggcgtggagtcccaaaattggttcctcactcgtgaaacggcgtggagtccggataagttacgcgcgacttatccggttcgaataatctggtgcatgaaacggcgtggagtccgaataagttacgcgtgacttatccggttcggttatgcggagcgaagttttgttttgctgcgagaaattcagatttgtttgttttggaaatactcggaataatccggtgcgtgaaatggcgtagagtctggataagttgcgcacgacttatccagttcggttagatcgtgcaggcgtcctgatcaagcgtcataacatctctatataagttaagccgccgcctacacgcaacacacgcgaaatcaatctagggtttgcctcctcctctgcaccgcgctgtcgctcgtagtctactctatcccattcgccggtgtgcagcggcgatcggaagaaaaggtctccggaaccttcgctttcgacgtcctgcaccaggagaaaacggtaataaggtttttgggaagcgctttacaccactgctccctgttcgaccacaacgactcgtcttccttttcgctcgtgtgctgcgcgctaccgtcaaagcccggaaccacgagtacttcctgctgggcaaccgttcttccagtaccctcggtacgtgtttagcatattacgcatattcgataagtttacatatgtagatcttatgatgcgtttatgctagtttaaatatgcaatgttatgatttatttatggaataaattaaatcattatatgttcataaattaaacataaatatctattgaaattaaaaattaaaacataatggaaaaaaaattgtaaattgtaacgttgagctctagagttagagttaggaagattccgataacgccctggctcttcacacgaggattttcaccggtggacaaaccagccatcgctgtcatcttcatgctcgtgtcaacgcgcctgctgaacttattctaatagacctagtttgattcaaagtttaaattttggttaaaattggagatgatgtgactggaaagttatgtgtatgacaggttaatgtgatgaaaaaggatcgaagtttggatccaaattttagatctaaacacagcccaacttaattcagaccaacttttttcagccgccgcggcggcatggccatctcgatccggcaatgtgtccgtgtacacgaagtgcagcaaatctcatccttagttctgctgctgcaaacctttttttttttgccgaagaaaattctgctgctgctaacaattaatcagccatttgattatggtatagcacattattaagtagatagataaagtatgaaccaaattaagttttagtgtttagaacttaaaccaagagagaatctatgctatatatgccactgagtttgtcccagtttaatgattttcaattccattgacattgtcttttctataatataccggtaaatttattaattattttacaatatagcatttggctaaaccttgtttccaaaaatacctaaaatacccttgtaaacatacaaagttaacaattgatttttcctatcatgtgtttcaaaacaatcatgatttcattagcctttttacacaatgtaaaattttgtgtacatgtttcgagacttttgcatttctatttttcttataaaatataatttatctgttatatgttacatggaataattttgtgttgatgtttttaacgtaattcatcttttatatgctacacaaaatatttttgtgccattattttttttccataagcaatttctagatatatcatataccacacaaaaatatgtttttttaaaaaataaatataccaaaagatttgaaacttatatacaaactttcatgttgtgcgacgatgctacataaaaaaaatcatatctttaaaagtttctatcagaataaatcaattgttaaccatgtatggagtatcttaaaaaaatccagatcaataacatattatagaaaaattgataattttgtttgtatattatagaaatggacaatgttaatggtaatttgttaaactgaaaaaactaagtggtatagaatggtaaatcgttgaacagaaataaataaactaagtaatatagactaatggattctctcttaaatctttgcaaagtactagagcatatttctgtcgtcaagcaaagctagacttgattgaagttaggaatctggcatctcctgcactgagagctaggaagcaaagcaaagcactaagcatatgagcaggcttcagcgtgtccaggcaaaaaaagggagcacgtacggctatttacgtacgcatgggcgatcatctataaattaacaacggccgagatatagactatagtattcaaactgcatgcatcgatagacatatattcatttcaatcctttcttgtgctctaggcgtgtcatcgacatgaggccgctgagagattatcaagatggctctgctcaatacaggtaattcaaacaacgtatttgaccaaactgtaggtactaacactacacgtacgtctttccctaatatgcattattcaaacaattattcgatgaaacaagtgttatttacaatagcagctagccgcccaaatctatttatatatactaacgaaatgtctgtgcattacaacagattttcataaaatatatgaaaatatcgaacaagatgggtaaatatttctcaagaaaacatatatattttgtcgctgagcataacactgtacatagtagatttgttgcagcaagtttagaagctctttgccttgccaatgattatagtggttcaatcatatgtgtatactttgattgcctcaaggtggtgaaaaaaatgtcattatagtattactgcattccaaaagaaactgatgttgaatctaggtagttgaatttgggaggcatacaggctacaaaatcagtcactgacaacaagagcccataagtcaatgatggaagtagtatagacatcataacggtctccacgtcgtaatccatctagacctacgccgcgctaatattacctacattaacgattttcacgttgttatccatctgagacttaccctatctactactcccttcgtttaagcttataagtagttttgactttggtcaaacttaaactatgtcaagactaagagagtgtttaagattaaagcagtgtcggagccaataattttgagcctgggcaaacctaataagagaaaaactatatatagaaaattgtactatttatcatatatgtaagttaagttaattagtgcccagcgataatttatcaatgagatgatggctgtttatcgtcagtgagttagactatagggctgcaactctttgctttggcctcatggttacaaacgtaatgattttgtccttgctttgcttgtttgttggcaaaacatataattaacatccactagaaccaggaagcaaggtaattaggttcaaattaagtagtaaatgatgtttatgccatggagcaatgtgttgttgtgtggtacggagcccgggcacctcccggtacaagccgaggcgccctactccaccacggaagtaaaggattaagaagatcgaaaaaatacgcaaaacaagtgaaccattaggatacaattaactaaccagtgggtccaattatcaagcaataaagttatagctttctaataaaatctcgtacagtatatattaatgttgcagttgtctgaaatgtctaaataaagttgcagtaaattgatgattactacaaatggtcagttaaactagattataagagaatggaggtactagattatttacttaatgataattaaactgctaactaggtagtaatatgtgggtttatgcattgcatgctcagcagctcattggctactcgtgttcaagaagcgtggaacaagtgggagatccagtgcctagtgatggcgagcttctccctgcaggtgttcctcctcctgtcggcaccatttcgcaggcgccacggctccaggctgctgaatggctcgctatgggtggcgtacctgatggccgactacgtggcgacctatgtcctaggccgtctgtcattcctgttggccgcagccggtgacacgcggcatcagttggcgctgttctgggcgccgttcctgctgctccacttgggtgggcaggagacgatcacggccttctccatggaggacaacacgctgtggatgcggcggctgctggacctggcagcccaggtgacgatgtccgtgtacgtggtgggcaagcagtggaaaggggatagattgctggtggctcccatggtgctcgtgttcgtgttgggagcagtcaagtacggcgagagaatatgggcgctcaggtcagccgccgcacgggcacccggaagtagttccattgctagccttgctgctcgcacctacagcaatattgctagtttcattactagccttgctgatgtgctgccggaatcagggcgtggtgtgatggcccattatagaagcatggttagtattagttcacaagacaaggtaagtatcgagagcatcctgaaggaggcctccatggagttccaagcaagcttggactttttcatggacgtgagcccttcaaatgtaagcggttcctactcgaggtaccataggatcaagaatgcgttggtggagatcaagtcttcaaagaatggatacgggatggcatacaagctggctgagatgcaggtctctttgatctatgactacctgtacaccaaattcggcacagttcgattccaaaccttcccaatatcaaaatcaaaatcaaatccaaccatggcggcggcgctccaatggcttgtctctcttggcctaacctctgtggctcttgtgttgttcgctagggccatggccggtaacactactagtagtaagttcaaatatagtagacctgatgttctcatatcttacatactgctcgtgggcgccattgcaatggagatatcctccatcttcattgcactcaccacatcatgctgggcaggcatcgctgtggtcaagcatcttcatctccatgtaggggagtggtcagggaagctggcacaatacaacatggttgatgcatgcgtccaggagagggagagacgacgacagacagcagctagtggcgccgtagggaagctaatccgctggatcctggcaccatgcgacagcgagacaccacaaccacacgtcgttgtctctcttgaggtaaagaagctgcttctgaacaaagtgcttgaaatagcgaccgatgtagacaacaaccgctgggacttcagtaggttccaaggccagtgggctctgtgggtggccaacagagtcaacggcggagacagtgatcctgctgctctaggcccagctcacagggcactttcggctagcaagatccaagagctggatttcgtgtccaccgttgttgcttggcacttggttacgaccatatgcttgctgcccggcgatggccctggcgagctcacaaaccctagcaaggacttgtccagttacatcatgtaccttgtggctaagcatgggatgatggttgatagcaatggacacatcgtgattgctagaagccgaatggaggtgcaggcatcttcgcaaatgcttgattttctcgatgagcttcacgaagatggcttcatccaggaactccgtgatggtgataggcaatataactctccggatatgatcgtacgtcatcggagtagacctgcacttaccacagctcgcaaggtctgtgtggagttgctcaatatcccagaagcaagagatcgatgggagctgattgctgcggtgtggacggagattctatgctacatggcacttaattgtggagctaccttccatgtcaagcatctcaccactggtggagagttcctcacacaagccaagatgctcctcttcgttatacgattgccttttcttatgaagagtcctctggaaggtataataatgcctccatttatgtgagttgttatacatatagaaacactactaggaaaagcattatcgcaagcggccgaaaacggtcttcgcgggcggggcggccgtccgcctgtaagaaaacgactgtgaagatcgccgatcttcgcaggcggggcggccgtccgcctacgaagataattttcgcaggtggacgttggctagtccggtccgcctgcgaaaatatgaagctgccacctgcaaaaaaaaaaatccgcctgtgaagataggtagaaatttttgaaatttaataataatttgcccgtaaatttaataataatttacccgttaatagaaattcttgcaggtagattattatgtacatatattggaagattatcaaacatttggtactaagaaatttacatatattgcataactcaaaagtgttaccaaaatatatatattataatatttttttatattgtgacttcaaatataccatctagttacattatggcatagcagtgttccactcccaaagattcttgaattcgtcacttgtcgctagagcaccctccagagtttaatggctaaatgaaactgaaaacataccacaaagttgagtcaacgtttaatgaaaaatgaccatagcatataaccatcagatgccacacgtacaaatgcctatttactgaattttgaaagaacaaatcaatgttccccctccagctccaatccaacagaaaggagaatgcagcagtctgtacgtagcgataacggtggtgatgttgcagcgcgaggcaaggaggtccaatgtccagaatgtcaatttgagctgaatagggacctgcattgtgtctatgcatgctgaactgcaacattggtgagagaaatgaagatgaaccaaggtaggtgctgcatttttggcacagtggagattttcaaattacctggaagttcaatacatgcgcaaaattctcttaagattcaggaagcttgcctagcagcacaactcaagcgagctggatgagttttacgaaaagctaaaaaatctagataacaatgtcaattgcaaatggaagagtgaaatgccgttgcacaactcaatggattgcctggaatccgaattacaatttacaaaccatgtgggagcaggcactaacctggggccttctgcactggcaaatccaacgtcattgcccctccacaaccgctgaactcctagttgtgacctccgtgccgtcgttccatcgagcaagcattttatcgatcaccttcagtgcctgcataacgcggcggcgatgcggctggcggcggtggagcggccgatggtgtagctggatcgattttggcgcggtggagcggccggcgcgagctcgaaggttggcggcgcgcggaggacgacggtcggcagcggcggaggacgacggtcggagggcgatggtcgcaggcgggcgaggccggatgacggcggaggcgtgtggcggcgaaaaaatttggcggcctgacggcgccaaaatttctagggttcccgcctggacttagaaattttggcgccgtgggtgggcccttatatagggaaacgatcttcgcaggcgggcgatccgcctgcaaagatgatcttcgtaggcgggccgtccgcctgcgaagatcgtttttattatcttcgtaggcggacggtctgcctgcgaagattgttacagaggtgaatatatttatttcaaaatattttttaatttatttttgtaatttgaaaatgtctacagtagttgtaataaaaatgataattgtacatacaaatatacaaaccttaatattattacttttcaaatgtaaatcttacttaaatgtttgaaacattaatatgactactttaaattttttaaaaaattttcaaacaatggtaagtgcacataaaaaattgctactaaattttgaaacctcttttaaaaaaactattaaaatataaaaaactgtaaattttaccctacaaatggtaattgcacataaaaattagtacaaactaatatgcaaaatattgagtacaattgttcatcaatttgcaatatgagcacacatatccccttacatatcaccattacataactaataatttcgtagatgcttacatgccactcaacaatcattaccctttaacatttttgcccacactgtccgtgcgcatgtaaggcttcacggtcttctgagtagatgtctcgatatggagacaaaaacctcggccaatgatacatccattcccgactttccatatctctaaaaaaaatgaacataaaatatttgcactattaataccaaatttgcagggtttattgaaaaaaacatatcgctattcaaaactaactgaaggttaattgtaaattaataaaaaaagtttattttattttttttacacagacatgccaaattaatatattaggaaaagctaacaaaatcttatcatcgacatattacaaactaatataattattttttgattgcaccaaataaatagacattgaaaattttattctctctcatatatatatatatgacaagaagggctgggcattcggtttaaaccgaggattcggttcggttcggctcggttacatggagttcggttttcgaaagaacaagaaccaattggttttcgtaaatactggaaaccgctaaattcgggttcggtttttttggttcggttttcggtttttaccaacaaaaccgatctctacacagctcagtaaaaaacacatccagaagaccagaacaatattttaccatagtacatagaaacaaacaaagtaaaaacatagtacatactacatagtcctgatgctgcaatttaccatacaaacgaacattcaccacacatccatagccataaacattcacaaaaatggtgccggctgcatgctgcttagggctccttgcttcacccaatagtgctggctgccatgccatgtgtgctgcttgctttgctgctgcctggagtggagaagaagaaatactcagctgctagtatatatactcaatcatttggttaggaggagaattatatataccttgcatactgctgcttctttcaactaagaaataaactaacaattttaggccttggtagcattagtgtcctctgtaatgtcttggccaacaagttctatgcataagaagaaacacagttaatataaataataaactaacataagaagtaaactaattgcatcttaaaatgtttcaccttcttcaagcttggacaaatctttggcattttcttcaacactaatagagttgcaaccacgaagccagtcatttgcacaaattaggcgctcaaccattgttggtgttagtgagctcctaaagtcatctagtgttcttccacctgcactaaaggctgactcagaagcgacggatgagatggggattgctaggagatcacgggccatacgagatagcaatggaagcctagttgagttgtccttccaatacttaaggatgtcaaatccttttgtatcctcctcattgtcttctgaaaagtacttgtctagttcagatttggcaatgctccttgaagctccattgttgctcatttgttgtgcaactatagacctcatgagcctcttgcttgttgatagtgatccctgaatatcattaggtgctgctaccggctcattaggagtatatatttctttgtattcatgaaatagggaatgaaaggaattgaccactgttgtccacaattgctctcctatttcatcaccaaacatgaccatagttgccatcttaatgtaactattaagtttataccttggatccaatgctacacagaagaaaacaattaaattcagattttgaacccccggccctatctctccccaatatttttggtacttcagtagcattctcttacccatctctgcacacaacaaatcctcactgttgcaccactgtctcagcaaaacaactacaccagcaatttcatggaagaatgtgtgagatgttggacgacttgttgctgaaacacgaagagtcagttcatagaaatgttcaagaaattcagccatcttcctagctttatcccaatctgatttttcaggaactcctggcccatcatgaccttctaaatctagcttgtaatatgggtcttcatcactgtacctttcaaatgccttctcatattgctgggcaatattaagcatatggtaggttgagttccacatagtgcaaacatctagtgtcaaaaatgctttggtttgtacttttgccaactcagcacatttcttaaattttgccaacctagctggtccggccttgacaaacttaatagcagcacgaacacggcaaatggatttattgatttcttttaaaccatcagccactatcaagttgataatatgtgcaacacatctcatatgaaggaactccccttcagcaatgcatccttttgattcattcaataccctcttcatgtatttaattgcattattgttagcactagcattgtcaaccgttattgacaaaactatatcaattctccactcagataagcaattgtctaaagatttcccaatatcctcccctctatgcccctttactaggaagaagcctatgatttttttatggagcttccaatcattgtcaataaaatgtgcagtgacacacatgtagttttggttggtgttagcagtccatgtgtctgttgtgaggctaaccctctcacaattttccttcaaaaatttcttaagcttcaatctttgcacatcatacactttgacacatgctctagtggtagttcttctagatggcaaagtaaaccgtggacatgctttagccaaaaacttcctaagacctggacgttcacttaagacaaaaggttgttcatcttcaattatcatttcagcaaaactattcctcaagtcttcaatatcaaatttccatgtggaacaagtaccaacactactaccaccacttccaggagtaatttgcaaagtgcgttggttatcaattactggcttgttaggattctttttgcagattttcaagtgatttttcaaagatgatgtaccatttgtcctagggtcacaacgaaacaacttttgacagtatttacacttagctctctcctctccattggaaatttttaccttgctgaagctgccccatacatcagatcttggaacaatagcctttcttttcttttcctcttcctccgtggctgcatgttcattctccgtggctgcttgctcctgctcctcttcatccttgtgctcctctaaccatgcagcaacttccctctccactatctcttcagtgtcctccatctaaaaaaaatatttacaaattacaatccaaaattgagccagcagcaggcaacagcagaggcagcttacattggaggactcctcggttgttgctgccgtcgtataggcaacaccagaggcagcgcataggatgggggacagagggaggacgacgcggcgagccggcgaggatgggggacagagggaggacggcgcagtgaggatagggggggtgtcggcggcgtcgcgcgagatggcggggtgtcggcggcgacggcatgggatgcgtgagactgtgagagagagggcggcgaggggagagggcgcggcggcggcgaggggatgcgtgagagagggcggcgaggggagagggcgcggcggcggcgtgggatgcgtgagagagggcggcgatgccggcgaggggagagggcggaggggatgcgtgagagagagggcggcacggcggcgtgggatgcgtgagagagagagggcggcgacgccggcgaggggagaggacggagccgcggaggggatgcgtgagagagagggcggcggcggcggcgtgggatgcttcacagcttcaggggagattgggagaaggcagcggtaggttagggttagggttagagagaggcaaggcccatgggccggctgggcggctggcggtagggttgtggcgcccggttcggtttttttgggcgaacggttttcatacaactaaaaccgaagccgatccgaattatgcggtttatgctaatctttgaaccgaaaccgaaccgaattaccgaaaaaccgaaaaattcagttcggttcaatgcggttcggatcggtttttggttttcggtgtttttttgcccagccctagacaagatctagatctatatctagaactaggaggtggatgtgatagcaaaataaaaaaaatgagaatttatgttaccacattaaaccactacaacaagagacatcaagtattacacatacatctaacatcaacatatcaaaagaaagtaaattaaaaaacatggaccttttccttcacaattttgcatgcataaatccatcacaaattgaggtctaaaagttcaaaacctcccccccatatttaagtcactttaggagagagaaactttggggagaatgaacagggctcctcgaggaggaagaagactatataggggcatctttgcaagcgggccatataagcggcggctgcgaaaatcgatcttcgcaggcgcacgtcgcctgccgcctgcgaagatagatcttcgcaagcgtcgcttatatggtccgcctgcaaagattgatcttcgcaggcggaccgccccctccaccctgggtatcgtcttcgccggtgggattttggcttcgaagaccatacccgctgtaacaccctgaaaattcgaccaacgaaatcaaaactctaaaaatgcggactttcaaaaactttttaaaccaattgcatcatgccgactttattcgcctgtttcattggattttgatgtcggagtctattaatcgcgaataatgaataactagctaggaacaaaccataaaataaatctagttgactaaataaataattaaaatataaattaaaataaaggttaggtgggtttggaaataaatatcgcaaccatattagcaataattaaattttagtacgatggaataaccctaattaaaataaattatataaacagaatatgagtgatattaaattaaggaggattttagttaggataacacaaatgtgggatgtacttcatttaaacaagatttagaaattatgaaatcaaatttattttgaaaataacctaaaatcgggaatattaggaaagtgcactattgattgcccgcaaggtgttcgatgtggtccctagcattttccccttctctcccacctctcccctagcccagccccctcctctgccccgcgcgccgcgcgcccggccgccccgagccccgtgccgtcgcaccgccgtcaccatcgccgctgccgcgccgcaccgacgtcgcgtcgcctcgcgcctcgcgcccgcgcgccgctcgcccgttccatcgccgcgacgcgagcctgccgcctcgcgccccgcgccgctgctgtgagccgtcgccgtcgcgtcgcccgtcgccaccgcgtcgctgtcccatcgcgccgcgcaccgtcacgtcgccactgccgagccgtcgccgtcgccgtcgcccgtgccgttgccgtcgccgccacgagccctacaccgccgtcgccatcgccgtcgcgccgcgccgtc

SEQ ID NO: 61581 - DNA, 6569 bp, Oryza sativa
cgtcgcgtcccgcccgagcccgtaccaccgctggtaccgcgccgcgccgctgtcccatcgccgcgccccgtggtcgcacgcgtcccgtcgccgctgcggcgccgcgcgccgtctcgtcgcctcgcgccgcgtgcccgccgcctcgcgccccgcgcgctgcagcgccgccatcgcatcccctcaccgccccctctttctccccctctcacaccctataaaacccccaacccatctcttctcccccacacccattcccctccatctcctcccttttcgccgcgccgccgccgtagtgccgccgcgccgccgttcctgtgccgccgcgccaccgttcccgtgcccccgcgccgccgttctcgtgccgccgtgcgccgtcgtcgccgccaccgtcgtcgccgccgccgccgtcggtgagccgctgttcccccccccccccctctttcttttgtcgccgcgccgctcgggtaggagggagagccgagagagagagggagaaccgagggagggaaaagagaaggaaggacgagagaaaccgggagggagagagaaggacaaaagaaaaagaaagagaggaagagagaaaaagaagagaaagaaaagaaaaggaaaagagagaaaaagagaaaaagaaaaaggaaaaatttagggggaaatttaaaatatttacaaatattagaatttaattgtaggattaatgaaaatatggttagataaactcttactaattaaatacctaaaatactagcatttaaatgtaggattaaggaaaatataattggataaattcatatatattatagataacttttagtaccctccataagaaatcaattcgcggtattaatttagatgtaattaataattaaacaaatgtatgaattctcataaattattgtggattatttctgggtaatctctataaataatcgatcaacggtagcgattcggatttaattactagggtgttagccgtgtattatatttaatcatagactaaattaagtcgtataatattataagataattttaggattccgtccgacatttagctcgcgataagaaatttctaacctaatatatatggatataatgctagggtagattaaattaaaaacatacgacaacaaaatattgtaaccgcaaaataatttaaaccaaaattggggtttgccatagttcgcggatagtaaaattaataaaaaggaatcgactttcgcgttcgacttccatttggatttacttggatttttatttgaattctaaccgaattcagatcaattttcgcacgtaactatagagatcgagggagccgcggatccaggtgaaggccaagacccgcaagacctcgagtaaggcaagtcatcactattccttgaacatgttgatcctaattgcgaaattgttttgtttacaaataaaattgcatgcaatgatgaacatcctatttgtgattatgccatgccttgattattgttaatccttaaatctttgtaaccatgtttacgtatgagtccctagtcaactatgacaattgcttagaaatgctattcttgaatcatgcatactcatatttatcaaatgctatatgcttggggcaattacctttgagaaggtaattgagatgcggcatgtggagacatgagcgccacattgccatgatgttgatgacatgatttgtgaaagaaaaataaagtaaaacaactgttttcgactggggcggctggaggacttgggtggtgtccggaaaaggctagtgccgtccctggtcaattaaggaccgagccatgaagttaagcatgaaacgacccccgtacaaccgcatttctcgtatgggtatagacctagcggaatagatagctgagcggaggcagtatccatgcatagtggtttcttgatgtgtaaggtaggggctctacggtggggcagccattggtagaaccgcgaggcaggtgtctacagtggtgtcgccatcagtaggactaccatgtgagaatttaaacataattataacttaatgcatgtgtgagtctttccttcccgggtgtaccagaactcctctcactgctagaaaccgtgtacgcctagagtgtatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggtgattgagcaccgggacatgtgttacacttggctagactctaaattcttaacttgtgtgggaggggatattgcatgatgaattttatgctgttggagccacttcctgagaggcgggaaggtggacgtcctcagaaaaccatgacgaatcaatggcgggaagctatccttgggatcacaatggatggtggacagaaccgtcgttgtttaaatacaaactctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagcctcggaggatccctatgcctactatcaggagggagatgaagacgatggcgtccagtaggtcttagtacggtcgttgcctgtggcaatggcatgccgctgcctgaattccgctgccttatctatttctgcttttggatgtattccggacctctcggtccgatgatttaagactatgcctgcgggcctatgatgtaataattcatattaaacactcgtgtatgtgcacttgatattccagctatgaattcgtgtgtaccaaactacttgatccagggaaatggtaccgtttacacgattgattcctgttataaaaacgggggtctacagagctggtatcagagccatacgactgtaggaaaagaccaaaaggcgccccaccctttttctaagttggccaagggagaaattcccatctagtaatactttcaaaaataaaaacgctatgtttacaaaactcggcacaattttcatcttactcttaactattttctttacaaaacaagttttactctcaactgactttgggtttttcttaaaattagatggcagattcggattcacccgctacctgggagttgagcttaccccaatcggaggggtatgtcattgtgctgcaccagatgttgaggcgtctgcgataccctggttttccgtcataccgagtgaggcagtgtggcccagtttgggaggctcgggtcgagattcacccccgagtcccttccgagttggactacagctttcagacacgtcaccaccgagacctgccagagaccgcgatgcaggatgccgcccgggaggccttcctccgactcagctctatccaccgagccgagttagtgagtaccgagtttgctcaccacccgttccgggaggagggcaactcagtttgcacagttcagaacacgccctgctgctacaacccgatagtgactcggttgtcacgatgggctgaggcagtagatgactactacgaggaggctctgttggagattgacgaccaccagagacgtatgggagagttagagactgaggtgaccgacctcacagcgcagcagcttcagttggaggaggagcaccaggcttggggcagtgagatagactcactgaaggcacagctccaggtccacggcgaccagtaccagcagttgtctgaccagtacaacgatcgccgcgggatgatggatactcttgaggagcagctgagagagagtcaggagcacgtcagccagttggaggagcagcttcgagcagccaagatcagcactacaggggcttctacttccacagcagcaggccgtgaccgctacttcttcctcaccccgccgtacccaccagcgttccacgctctcctgggagaggctagtatgctagctaccgagtcagcaccctacctagtggaccctacagcagcacagccacctgttccggagttggtgcacactccactggtccctacaccttccccgcagctgggttccggtttggagactccgatccagatcgactcggagacagaggagaccgacaccgagccggagatcgagccagacatcactgatccttcagaggatgaggctcctgttccccgcatcaccttccttggaggccctcgcaccctcagcactgctcgcaagagcacacgacctccgggcaagaggcccaagccagatccagaggccactacttctgagccgtggggactcaggtttgcgcgtgccagcgaccaccctctacctgccccaggatcttgcggatggctggaggactagactgacggactccttgcagcttcgctctcgtatcagatggtttttggatagtatgcgagacaccccctcccttacctagattgtcgagtagtttgatgattagttcgttgtatcttctggatgaactttatttggactgcgtatgtatgcagtcgattgcatcatgattcatgtatcatttgtgaaactctgtgatgttatttatggtatccattgttgttgtgttataaatgagtttattccaccatgcttgcaaaacaaagttcatatcaacacaactcccttaataggataaagccataggagctagttagaaaattaggatacttaccccatcaccctacacagatggcaagccgtcgtcgggcaacaaccagcaacgacgaaactcagacacctgacctaaccactctggccggagttatggccacccaaactcaacttctgcaagctatcgcgaacaactaaggcaaccgcggagggtcaagctttggagagttcatgaggaccaagccacccacattcgccacagctgaagaacctatggatgctgaagattgtttgagggtcattgagaaaaagctaactcttgttcgagtacgtgaggccgataaagtgatctttgcggcaaaccaattggaaggaccagccggagactggtgggatacctacaaggaagcccgagaagacggtgctggagaacccacctgggaggagttcactgcagcatttcgcgagaacttcgtacctgctgcagtgatgcgcatgaagaagaacgagtttagaagactgcggcaagggaatacaacagtgcaggagtatctgaacaagttcactcagttggcccgctacgcaattggagacctggcagatgaagaagaaaagatcgacaagttcatagaagggctgaatgatgaattgcgtggacctatgatcgggcaggatcacgagagtttccagagcctgatcaacaaggtcgtcaggctagagaacgatcaaaggacggtggaacacaaccgcaagaggaggcttgctatgagtcgcccacctcagacagtgcctcagcgactcaagggagccactccgtccggatggaagccccctgtcgtggtgaccaaccgtcccgctgcacctagcaacttcaacaggccagttgcacttcagaaccgcacccctacaccaactttggctgcccctggagccaagaagaatgtggactgcttcaactgtggggaatacgggcactacgctaacaactgccctcatccacgcaaaacccctgtccgaactggcgcgaatgcaatgactgttcgcggcactactacccctactgtcgggcgaggcctattcaagactccgcaatcgaacaggaccaccactggatttgggcgcggacaagtgaaccatgtccgagctgaagaggcccaggaagatcagggcgtactaatgggtatgttctctatcaattccaccccggttaaagttctcttcgattctggtgcatcgcattcatttatatctctgaaggctagtcaaaagcacaacttgaccctcgtgggacttagaaagcctatgatagtacactcacctgggggcgagataactgtgagtcatgcttgcatagacgtaccaattctccttagggatgtggtatttccctccaatcttatggtgctaataccccaaactcttgatgtcattttgggtatggattggttagcaaagcatacaggagtaattgactgtagacgtagagaagttaccctgaccacaccctggggatcggatatgcgagcaaccatggatcaagatcctaggctaaccgaacgtgccggaggtatatttaccatgctacccctaaagggaatgcccgtagtgcagcgatttcctgatgtgttcccagaagatttacctgggatgccaccagatcgtgacatagagttcattatcgacctgatacccggaactacccccatatccaagagaccatatcggatgccggtcaatgagttagaagaacttaaaaagcaaatcagggagttgcaagagaagggatttgtacgccccagttcgtcaccttggggagccccagtgttgtttgttaaaaagaaagacggt

SEQ ID NO: 61582 - DNA, 8181 bp, Oryza sativa
cagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagcctcggaggatccctatgcctactatcaggagggagatgaagacgatggcgtccagtaggtcttagtacagtcgttgcctgtggcaatggcatgccgctgcctgaattccgctgccttatctatttctgtttttggatgtattccggacctctcggtccgatgatttaagactatgcctgcgggcgggcctatgatgtaataattcgtattaaacactcgtgtatgtgcactatatattccagctatgaattcgtgtgtaccaaactacttgatccagggaaatggtaccgtttacacgattgattcctgttataaaaacgggggtctacacccgcctgcgaaaatttaacccttacgacgtcgaaaataagttttctagtagtgaaatagagttggaaaagtaaaatcagtccttaaggtcatgtactcttatgtgcatggccattggatcgatatgcgccgagattcgtgcacatcaggagaaagtgctgtcatgtatatatgagtacttgtgaaaaagaaactatatgcatggaactatatgcaataaacgtgaattaatactactagtgccaaaccacatgtttgcacgggctattattacatctatctatatctattatatatactaaaattccgtcaaactttatacaaatgctatcaaaccatcacatgacattctaataaattaaaacaaattctacaaattttaagaaaaaaagcaaacatataaccattgattttcacttaaattggtgaaccctttattttggaccattatattaaatctattaaaatctcctacaagttttgagaaaaaaaagcaaaacaaattttcacttaattggtggatccgttatttttgaccattagattaaatctattaaaatccttcattctaatctctgataaatggattcaatgcatatggatcgagaagaatgtacatatatatgtactacccgtaaacaaaacagagaccacccatatatatgccgtcatatttttcgtgaaaaaatagtcaacatgtatttaatacagtgtaagtccgtaaattacatatgtatttacaatgtaagtccgaaaattatgtatgtaagttgattaagtataatctaatgaacatacatataaaacacatgtaatgtaatttagtaggagagacaacacatgtaatgtaatttagtaggagagacgtgtgcgcgtgtgtaacatctgaaaattaactattttctaatcctgcgtcatgccgattcttatgtttttaataacctccaaaacctaggaaatacaattagaggtaacttcctaaaactaacttgcataaaatccctctttggtatttaatttcttttgtggttttcatttaaaaatatattttgttaaattgaggtatttcttgattgaattctatttttgaatattaaactttctttcgactaaaaatcttttattcaaattatttgaaaaccttttataaattatggtccaagaaaacctccaatattgcccttgaacctaaaccaccataattccaatttcattggaattaatccttgaccaaaacctttgatctagacctatctctaattctcctctatccaaatattttataaatccttctatatctattccaatggtcaaatttctatctagtctccaatttaatttctatggctttactccaaccttggcacaagaataatattcttagaataattgctcttgtgctaagaaaatagattttatccttctcatccaaaatccaaatttcctattatcctcaaataattctctaaaatccatgccatatattttggggctaaaatcctatttattttcctcccacattcccaataatatattcaattttaggaatcatactattcatgctaatatatatccctctctcccattttgagtgcatcaaataaattccattatattccacctccaaaaatattgcagtcaaataaattagaagatcttttgaaattcatctccatacataaatctctccaaattcaaatcctctccaaaacctagccatccaaatctcctccaaaattcaaaaacagtttctattcactttgggccgaaatcctttttcttctcccctcagcccatctccctctctaaccgcccaagtcggcctagccagcccagccgagccgccaccctctccactcctctgtgggcgcgcatggcgcatgcgagcgcgtcaccgccaccacatgccatgggcgccgccactgccgcggtttcaccgagctgccgtcgctgtgctgtgctcctcctcctccgccgcccaaccatactgcagccgccacgtacgcgcgccgctattgtcatccaatgggagaacgaagccggtgctgaccccatctcctccacgccaccgtcgtcgtgtaccccttgctctcctcctccgcaaccgacttgatccaccgcttctcaccgcctataaatagccgacgagccctccccttttctccacacaagccgagcctctcgagctctctctctctccccccatgaccgtgttagagtatatggtagttaaagttatattaggatatgattgaattatgtggacttctttcatatctgcaatcctttcttacctcctcctcatatactcctatatatattggtccccgaggctcaatacaacatgtttaaaattcgtagtatctctctccctgcactattcaatatggtatcagagcagacgatctagctccgctcaaaagcttccgccgccgctaccccgggagtagcgatctcccgggggcggccagcgtcttttttcttggtcatcgatttttctctcattgtcattgttcgtctgccctggagagattgatctcttggcgtcatgtcgtcgtcatggtttgtcgtcgaaggatcaatcttgatctcctcgacgcagcctcgtgtttagttgccgtgtgggaatcggtctcgacctccttgggcggcatcttttgtcattcgcgtcaagcagcaccaacagcaatctcatcgtctaccgtctactcatggctctagctgttctgcacctgtgtatgcacgcaacgagcatgcatgctcgacgtctgcggcggcacatatgcatgcatggcttgagtcaacatgctgcatgtgagctcctccatgctaccaggaacatcaacgccgtgagctcgaggttcagattggttttggcgacatatattgctactgccgccaatttttctttttcccgttcagagaatgggtttgcgtcgcccaccacctcgtcaacatctacgcgtctacgacattggcattgacttcatcgttccgcctcgtgcatcttcggcttaatcacccgttcaaccgcccggctacaacgacttctgcaaccaatcgtcatggagcacatggctatgccatcaagcttcgggttgctactgcatcgtccccttgggccgcagtgccgccgtccatggtccacctccactagttgttgcaatgctgagaggcgttctcctcagcatggcctcaccgccgatgagttcacgccgctgcatcgacataagagatgcagctgtgttgttccttcggaccacagcctcgtccctctcgtcgtcttcatcgccgttcgcgtttcgatgccctcgtcgtctgcactggtcatcgtcagccactcgggtcttcttcgtctacttcgagcatcgtcaccgcatctccaagctgccactatcaccgctctaggccggtggtccagctacctctacatggccaccgacgttgctgtccaggctgttggtcccgttacttcgcctttgtcttcgtccagcatgtctcatcaccagcatcgccgtatcttcctcgattacacttcgctcttctccggcaactgagtgctgctacgacaattctctctctacactgttctcacgccgcgactgtcacggaggtcttctctgctagtcttctccgacattggtgtatgattcacggtggtctcctacctcatccacgtgatattggcaacaccgttacgcgcgttcgtcttgagttgtccgagggtctggcaaacccggtatgacgtctcgtcctttacggttcgactatatcggatcttcggcgtcatctttctcaacgattgccatgattgtgtcaccgtcttcatctctagcgcgtcctcgtgcaccttggtccacgacgccctcccgtgcgtctatgactcctccttggtgtcccatacgcgcctcgcggctcggctactataacaccctgaaaatttcaactttgaaatacgaaattaaaaatttggaataatcaaaaatctttttcaaaatacattcatgccgggattaatttatttcgatctgtcgttttccttttatgcgtgggctaatagacgaacgtctgagaatatgtcggtatttgatttcaaatattatttattcaaagaactatgattatgagatatcctaatctttgcatatgccaactattttcgaaaaacccttctctatatttacatcaaccgaacccgacaaagactctgttatcttctcgtcagaattggctacatcggctaaccttgtctgactttgtctcagccgatggacacgatagccgactcggtcaccaaccgattcttgctctgttttggtaaccgccagcttcctccaaatccgcttcgattccatcttcgaatccaatacttgatttaccaaatttggtcgttaacaccggcaaaccccgttcgagccaacactgtgcgaactcgaaatcaagccgctcctcctcgggtcgagtaggtggcgacggtcgctcagcgaccacgttcgacagcgccgtgttttgacggccgccacggccgcactaccacttcatcgccgccacgtgccccgacaaggtggacgacatttccgccgccaatacgcagccgtcaccgctcccacctacacatgcgcattttttgggatggaatgaatgcgggcagcagcaaacgtcccttccccagactctatttaagcgtcgtcacgggtgagcacgcaaccggtccctctccattctctcttcacctcctcctcgttttgcttcccctcagccactccctcccgcgcacacgctgccgtctctccgcttgctccaccgcggccggctccggctaggcctcagttgagcaagaggacggataggccgccccgccgtcatctgaaccccgagaacgactaacttattgaacggctaacctctaacatctaacattcgacccattgactcactaacccgctgacactctaacttactgactcactgacctctaactcgctaacccctaaccctaacttgcactaacccgctaacatttagtccttaacgttgtgtgttcgtttgttaccaccaatcgaacacgtggtgtgtgagggcgatccgcgggtcgaccgtccccaggctgtacatcgacgaccgtagttttgtgtgaggaccaccgctcggtgtgccgctacccggctgccgcatttctcgtctaccgttgttgccgcggcgcggtgacgttgtgaggcgctacactgtacccgttccttgcgcggccgccctccgcagcaatcgccgctgcgccgccggccatgcatgcgccatgcagctagctggctgtacgtgtgcatgcatgcaagcagttggctgtacgtgtgcatggatgcatgcaagcagctcacatgcatgcagctagctagccgtgtgtatgcatatgcatgcatgcttgcagctcgcccaaacccttcgcctcaccatgtgcacaccctagggaaaccacaaacacctgaggattccattttcgcagccaaatgccgtcgccgtaggctccggccgagttccttgtgccacgccattgccgtcgcctcacccgagctcccttgccatcgccggcctcccccaaccctgcgccatctcccagggcaggcccgaccccccccccacaacccccctgccccggccgcagtagcttcgatggagctcgccgccggcgcagccaagcgctagcccgagcaaacacaggcacatggcaggagagagagaacgagagaaggaagcgcaagaaagaagaagtaggagagagaggctgactcacgggtcccacacccatttaaaaacaaaacctgcacgtgaggagttaagggcggtcccacccgtcagacctttttccttttcttcgatttaaaactttttcaatctttcgaattccgtatctcccttgttttaagtcggatttgaacgaaactttcgtcaaaatctttctaaaatcaagatctacgcaatggcactggtttggttatttttcgattttttctggaatttttggctctttttgtgttagcgagtagtttgtgacgttattattcaaccggacagggtacatctgcgaggaggaaactgagctaattgagaacgaacccccaattgagcaaggcaagtcactacgccctcttcctcgaatatgttgatcctatttttataaatgtgttgattacaaataaaattgcatactaattataaaatgtgtacctacatttgtttaagccttacctttgatattgtttatccttatgtatttacacaccgttgttacctgagtgtattactttacgtgtgattatttattcactgcttagccctgcttacatagacgttatacactccatatgtgtgatatgtggatgtggttatactgatcactcgatgggagtgattgttagagatcgggtggagacataagcgccacccacagcatgaaaacctttgcgaaaactcaaaaacttaattaaacaaaaatgatttcgattgggcggcacgaatagaatatgggtggttctgggaacggtaagccgccgaccctggtcagttaaggaccgagtcaagaagctaagcaagaaacgaaccgagtacgaccacacttcttgagtggggttagacccggtagactaggttattctcgtggggtagcaccccagacatggtaggttctggatatcggtatggaaatgtgaaagtgtgtggttaatgacgtcaaagctttatatatgtataatgtaaccttcaatctcaggagcgctaggactcccctcacaaccggctcgaggtaggaatgtggcgccgggggtgcaatggggagtcatagtccttggagcgggtgccgccatgcgagggtaactgaaaaaccgggccgtgacaagtctcatgtgttgggtgcgtcacggagtgtgggattaaaagcgtacatccactgcagtgtgagtaaattaaactattcgaatagccgtgctcgcggttaatgagcgccgggacttgtattactcttgactagcctcgtcaatttgtaatattgcttaaaatatgatgggtgtggaaggtatgaccttgcccgatgtgcggaaaggtcgtagtggttaaaactgtggaaattgaatgcgagggtaaatcggaccaagcgaggcttggggaagggggatgagccctcgcaggttaatgacaacttcaatttaacgtggttttcagttaaaactgctatgtcataggtttgtgaaataatttgtgaaaactagctttatgcaagtaaaccaagccatccttgaacccctatgaacattatatgcattctgtagtggtggcttgctgagtacggttggtactcactcttgcttatttaaatcttttagaaaaggtgttggtgtcgatctgtacatgtgctatgctggcaaggagtaccgaggacggcggaatagggacctaggttcaccagtcgatgcgtgtgggataaaatggaccgccgctgcttcgcttccgctacctcatttatttgtgttggtattttgtgttgttgtcgaccatgcttggtctattcggatcccatttgggctacccttgtattattaatagattgtaagatctgtatgacgatgtcagcttgtgatatacaactgtgccatgtgtgtaccatctactaatctgatgagctactgt

SEQ ID NO: 61583 - DNA, 10864 bp, Oryza sativa
ttgccaccaccctacctaggtgcgccgcactcgcgaacaccattcaccgtcggcgtctccacctcccaaccacgggcgcccctcctctgtctcctcttgtttgctcggcagaaggaggaagagggaggaagacgagaggaagaagaaaagaaagaaaaataaaaagaaaagaatattccttgataggtgggcccttacacagatgctatttaattcaagggttaattggatccataccattatagattctttagttttgaaatatgtcattactattcaactatttagaacgatgtcattataatttttcaggtaatgaaaatatatcactacataccctttaccctttcaatgtgtttaacaaaattcttagaccaaaatgccatcttcttcttccttggtctgcttccatctatcctgttcatcttattcctctcgattcatgttgcgggttcagtgcaaggggttgccgatcaggacgggctagctcaagtcggctttaccaaagatcgttcaccatcgctatctttactgcactcaaggatctcctgcagtcagcctttagttttattttgattttgtggcaacaaatcagaaaccaattagcagaggggaagcgtgttggattcatccgttgggctgttgctgctcctgcttccatcttcgcagctgctgcagccagtcagagctacccgacctgcctcctgttcatcttcttcctcccatttctcgcacatggttggttttcagctgctggaggacgtactcgtagttggttgcctgctgctcggcagaagctagtggaacggattttgggatgtttgaccaactcaattaggcacatagaaaagatcgatgttcagtttgagattacacaagaaaaaagccactctgtcagatcatgcacgtgtggtgaagccgccgaggcgaacaacaccagctgcaccttccacaacgacgcgtcgacgacgagctccactccttggttggccagtgaagggaagaagaggaactagatggcgcagcatgacgctggcatcatggctgagagaggaaataggaaggaagaagacagcttgccagattcggatccagaaggggaaaaataggaggaagaagatgaacaggagatgggatgagaaagatgagggcaatttggtctaaaaattttgttaaacacatccaagaggtatgtagtggcatatgtctaatacctgaaaaattgtaatgacatggctctgaatagttgaatagtaatggcttatgtcaaaattgaaaaatttataatggtatggatccaattaacccttaattcaaatcctatttttagaagcccatatctcctaaaccgtagatcccatctcagtgaaacttggacccaaattcatctaagttcaaaccctacattttgatactaaatttgctaatttaagattttatttgaattttcttaatttatttaaataccatttgaattatatatatttgatttaaacttatatttgaattttcaatttaaacttatatttgattttcaaatatttccttttatcccaaaatacctattagccactaaaaagccgtcagttggaactttacgccttccatagggacgttcgtgtggtctatgggcctcgacgtcataccgttggttgtaaatcctggtagaaccaaatccaaggtcaaagtgttgctcctcgcaccccacgcctcgatgcatacagtggtcggagcttcactattccctcgacctccacaacacgctgcacagtaagctctcgggctctgtgtgatcctagccgctccgtcgccactcacagctgtcgaactaacacttccgccccgctaaacctgcaccagcctcctattcctctagccgatatgttgtctgttgacaccggctagagaagatacaaaacctagtcattatgctgcccaactctagcaacgactagcaaacaaccaaaccctagccaatatattaccctaccttaataacagcacaaatagttaaaccctaattgccatattatcgaaaatccacacccgttacaatatcacccatttaccatttcccatattctacctcacctgaaccatacactctccaactacctagaatctatacatacaatataaatcctagccgatatgctatcctactccacaattggctcaaatataaccaaaccctagccattatactacccaaacctaccaccagctaatattagccacatatctgcttaaccagttctattatccagtatattccctactctccaagcaaccaaagcccacacatgaaatttaagcgacattagttgcttaattccctctccaccttacacccctaaccttccaaacctatatatgatatataagcctagtaatccctataccttacaaaggaggtagattataccctaaacctagcctttctcaccattcatcattttcttgttattttatggcttttattgaatttggctcttcctcttctttagtagagtttattatattttggaggcaacctgtggcatttcaaggatcgggtaatcaagttgcttatctcgaatttatttgcattggagcaaggcaagttattattcctccccttcgaacaaaattatcctatattctatatctccattatcttatgcattagtcatacatgattttgaatgcataacctgaacatagaaaactagatatatgctagctttgcttagccctacctagttagactatgcataaaatataatgaacttagattggaacggtacgctagaaaagaaatatttcctcgtggctagtactgtttcaatcgacataggccttgccaagtacgtgtgaagaatgaacgagtacgaccacaattctcgagtgggtatggacctagcggattaagttatctagcaaaggtggtacctctgtatagtggttctatatttaagtcctcgagcagggtaattgtgatatttaccgaggtgcaggtaaatatattgattatcttgcgagctatacttttgtgaaaccctgattgcgatgacgtggtgtcatacaatcagttctctctaaagaccccaagaacgccagaactcatctcgctgctgataacgcacgttcagagcgtatgaggattagagtttatggaacaggtaccactgatgttagtaaccgaaaagctgggccatgacaagactaatgtgtttggcacgtcatggattgcgggtaaagcgtacatctactgcagtatgaatattcttaaaactattcgaatagccatgctcgtggttatcaagcatcgggactcacaatggcatcttggctataaacttaattccagattttattaaataatgttgcatttcaaacattctaggttcaatacttctacattctcggccttctgcaagtaaacctagccttactcaaatataattattacatgtattcattacttgatataatagcttgatgagtacattgtattcacccttgctttaacccttctagagttgatttgaagttcttacttaagccgggagttcaatcatataagttagtcccatttaaacttagtttccaagtctagcatagttagatggtttaattttatagcaaaatagtagagttggttcattctatagcttctgctgtaatagttagcaacaatcttgtaaataacctattatattttgtaataaaatatcctttgaaaccttcttcaaatgtatgcaacgaagatccagattgttgaacttgtatcaatctattgatccagggcttgatacaaaacatgtcggttaccgaatcttaaattttgagacccgacagtgtgatgtgtcatgaggtcaaatccacgtacaaatctaatgaaattacactaagaacaacgagaaactgcacgcacgaacctctcccctacaagaataaagagtgatcagcaagaaacaagcacacgagccgcacgcactaatctcgacgcaaaatcataggctgaaaattcgacagatttggcaaaaaaaatatctatcgacgcatatatagcaaaaccgctgttttgcccttaaaaatatcccaaagagatggcaattcacttggtcattggttcttttcacatctaacttgtgcttaatgttgattagctgatccatctttgttaagtatgattcgctcgtagacctctactcctgtcgtaaaaacatgcctggcgtcttgcatgttgggaatatatgatatgcacacacacatacacaccaactaataaatatgatcaaaattttttgaagaatatatacgtacattttcaatagtattatatatacatgtaaagtctcatcgtcaaatttagtatacatacataaaaaaaagataaaattctgacaaactcaaaattgccataatttttgtttctttacagctaaaatataataaatttgaggttaaaattttacacataggcataatacttttgaaagtatatgcataaatttttttagattttttcacgatatttgttagttggtgcacatgaagcgtgcacgtgaaatttatgtccagatgatatattcccgtcttgcctatcaatatataggtacggtcttttaatttcaaacacaactaccgccaccactttcttttgagaatatttcaaaaccaaaaaagatttatataatatgcttgattttcatatatcaaaatctaagtatttaaaaacattaaaagtatagtaatattcaaaccttgtaaagtgtaagatcgaatcccaaataccaagccaaccagagggaaggtgaatggttgtaacaccaaaaaccaaaaactttaagcggaaattaaagttaccctcttttcgatgtagatcgccgccatcgccgctgctgtcaaaacgccgccgccggtctgaccgctcgagctccccggtctgactgcccagtcgccgccagtctgaccggtgtatattcgccggttggaccgtcgcctctcgccggttagaccgcccgtagtacttcggtctgaccgtcgagatccagaacaacaccggtaaaaacacttgaagatatagatcaaatcacacgactttattgcataaactagtgtttacaaagtgcaaccacagcactcctctccacaatttcgactaatatcaaaaccctaactcaaagctctaaaagcttgatctaaaactccatataactcacaccaagagacaacaccctgcccctctatttataccctcatcacggctgcccctagccacgaatcctactcatacaagaagtcctaatctcataggaaacctcccatacaagcaacaaactcaacactatccaaatttggactcctaccaaatttgactccgctttccatacacatacaacaccacgtgtacgccatatggaaaccttcacctctacatgcattgttctctagcctgagcatcccgcatgatatcctcgaccgtctagacctcaacttctcccaagcctagtcttgatccatcaccggctatactcccatagcctcaagcaacacttgcacgtgaacaacaaagaaactccatatccgagtgcaagttatccccaacttgactcatattagcataacaccagtatccacacgtatagaaaccaacttaaagtcaaatccacaaaggaaacatccaaatccaaatccaacaagaagtcggctcactctgtcaactctgcctgtcagaccacgtgccggtcggtctgacacctccggtctgaccggccgccttagcccggtctgaccggtacacaaccgtcagcacaaacactattcaccgtctgaaaacatatctccgtattttcacaaacacttacctttgacaattgttcatcaccaagatcatcacatgatccaacaatctcccccttgatgaatacattggcaacgtctccaaaatgcaatttagtgtttttgaaaaacgaaaacaaaaacgaatcaaaaagctcagacggctcaaaaatcacaaacgtgacgaaaagaaaactctcccctttttaaaagaaagaatttcccatatttgaaagaatttcccatatttgaaatccaaaacttcaaaatcaactatttttaaaatggaagcaaatcaattctccccctttcaagaagcatgcattttgtatgtttctccccctttgacaatgatttcatcaagaatgcaaaagagaaataataacaaatatatcacaaatgcaatatttttattttctaagttttttatcatcgagagctttaaagtataccaaaagcaattcatgatcatgttttgcaataacaaggagataaatttattaactagttaacaagcatacactatagtataaacatgaatcaaaaatattacaattaagctcaacttagcaataaagattcatgatttcaaacgatttataatgcaacgtattcacaagcatataggttgaaaaaataaacatctatacatatacacctgctgcatttatcactctttctcaaataagctttagcacaaaacaatcaagagaatttttaacttttatttgagcttctttttgctcatattttttctctcaagactgtttccaaggattcggcacccattatttttgctcacatcgaatacgtcctcaagactgtttccaaggattcggtattcattattttctctcatagatattttttattctcttgtccaatgaatatttaaaagctatttgaggaataacaaatccataaagcatatatatataaacattcatcattcaatcaatatgctagcatcaatattgcatattttcttaattcaagtaaaataattagtgtcatgcattatctcacttaaaagcaatatttaagcttcatgaaaagactaaaatgcatacaagctaacatagcaataaataaatctcaactattttgctagcatgcacaagaatatactagaggtataaaacaaagctctctttttatcattatatttattttcatatttctaaacaaatgcataaaaaataaacatgaatacatgaaaaagcacaaactccccctcaaattaacctccaatttccctcgaagaaaaatcaagaagaaataaaagatttgaaaaagacatccaattgccaatgatatcaccaaggttctcatgaattgacatatattcatttgaattaaccaaaactactatctcacaaactagcacatgaaaagctaataattgagaaagtagaacaaaattatgtcaatccaaaattaccttgatgttacctttaaaagcaaccgtcatctcaacgttgaacactcatggggagtatgcccaaaaatacctacgaaagagaaaatgtcgaggcctccgtgttggggttagaaataagaaattttggaatccaacactgagtcacacgaccaatagaaccagtaggtacatatgcacgaacaaaatcagaatcagacttacctgaaaacttaccttgaggcttcacaaaagtccgatttaaattacacgcaaaatagccctgaggccggtctgaccgtcgctgtccctgcggtctgaccggacctggctgccagtctgaccgtcggtacacttgcagtctgaccgctggccgtgaccggtctgaccaactggtcagtgtcgatctaaccgagctcctcgatccaaaacccgatttttgccaccgttgtttagcaaaagcaatttctctttcttttttctgtttatgagcaagtctaaaacaaaacccaaccaaatgtccatcttttccaaaaaaagaacaagtatacttctcacgacaagaaatttttgcagtagatggttttgaaattgatggttttgcaaaagactttttctcttgaatcattgaagaaagagaagccaaaatttcaccgaatttaaaaatcgttttcttttgttcgggttttgtcaaaacagcacctttttcagttatgctcaaaacagcaggttggtgatttgtaaaataggcattagtattaaaacctacaccacgattgaaagtgctcacttttgattgatccaaaatcatgttaagtttctttttaccatctgaaaacttttccaaagaacttttcaaataaaaaacttcttttttcaaattaacgcaattttcacaatcaaccaaaacacctttatttttgcgacacttagaacaagaaagtacttcatcttgttttacaatatttttgtcacgccccaaactagccccgagcagaggccagtataaggcgatccaaattaacctgtatgcctgtaccagtcccaggaaatagcgctggtacaacaggaagacagaatatcacaacaacagcggtctctttattaagagtaggattacaaccaaggttggaactgcggacagaacccgagttcgcaacaacattacaaaaaggcggaagcggaaagcggagactagccctaagccacaagcaaagccttggggaaaggccgaaaccctactactgctcgaagtctgcttgctcctggaagaactcttcatcagccgggtccacctcttcgtcttcaagaactgggggggtttaattatatagagcaagggtgagtatgggagtactcagcaagtcaggggaattaagtgtttaatgcaagcttcaagggaaagccagttgtttttcacaattgattttagtttaagactttcagaaacatctaagtgagtgcttctcaacggcgcggacgagaaagtgcgtctcatccggccggagcagtgaaaatgtgtcgattgattcttgtcggcacgagaggctcccagccaatcgtttaccgacccggctgctccaacagccacacgcgagaggctccctgccaatcgctcaccagcaccggtgcaccaacagccacgaatcaaacacgtcggaacaagaggctccctgccaatcgttcaccgacaccggctgctccaacagcctcgaatcaaacacgtcggaacgagaggctccctgccaatcgttcaccgacaccggctgctccaacagcctcaaaccaatcacaaaagggaaaaactcacacaccaacagcaatttccaaagtgttcactaaaactacgctaaggaatcacctcacatcctcccatgaccgtgggcacggctgttcgaatagttattaacctctgcagaaggggtacactttacccacacgacgttactaaccccgaatcacccagcccgcgactctcggtcacgtctggcgaccttgaggctttcacgacaaggcatttcgaaagccgactcagggtcatcttatgccaactggaggggtcccacggaccaacaccaggttaggtcccagaccatactgtgccaggaagcccaggggtcctccccgacaccaccccagcgaatccacttgtcccttggcagcaagatttccctggcctagctaattactcagccaggggcgtcccatatcacccatgtggtcgtacttgacatatgctcggatgtaattcccaaggaatcggtccttagagcgagaacggacagaccgtacctccagtacgtcttccgtaccgcgagttttagaaactcactttattttcaaggcaccaacccaagtgtcgggttttccaagcattttgtaaactcaagttttacccaggtgatcaattttagagtttgaggggagtctcgatattcgtacgcgaggtgcgaataccgagatttcacctgacgggtgtcaagggtgttagggtattcaaatatcaaggaaggtgaatgcagcaaatgggtagggcctgccggttgtattgcaaaccgaggccaagtgccaagtgtaacctagttaatgcatagtttgcggaaatcaaaatacttaatttaaactataggttcaattgatcaaaggtgacttgccttgctcgagatcttgagcttcttcctcgaaatccgcgcactgcgggtcttcgggctccgagactacacgcagaacgagacgactcaacaaagcgataaaaagaagccctattaaagaccattaagcatgccattggatagatctcgatttttgagaaattttggaagtggaacggagtcaatcggacgatcggttgagaagatatgaatttccgaagattaaaggattttctggaaaaagaaaaggaattattaattccctggaaaaagaaaagaaggagggatgcaatttagatttcattttgggcggctaagggcagcccaatagaatggaatgtacgcggccgaaataatgggccgacggtccgaaggagtcggcccacagccgagtggcgcggcctggtccggcctcccgagtgactcggggccgtccggcctcccgagtgactcggggccgactgggccggaccgagtgactcgggccgactggacacggaggccgagtgggccaaggaggggtgggaggccgagtggcccgaggccaactgggccgagcgggaaagaggccgagtggccgagtggagaggagggggccgatgggccgcggcaggccgcgacctacgcgggcggctggtccggtggaccgtgtccaccgcgcgggcgctagggcggggcccgcccggtagcggcacagtctacgcggaccgagcgcacggaggggaaaagagggagtgtgccggctggcgcttgcgtggcgcctgcgtggcggccacgtgggccggccgggcgaatgaggggagaaggcccgggcgacggcggcgacggcagaggggctcgggcgacacggtgcgaggccggagaggggaggggagcgcaccgggatggagaggagagatagagggagtgagccggcggctcggttcgccgggagaaggccgacggcgactgacgacgacgcgcaacggcg

SEQ ID NO: 61584 - DNA, 2673 bp, Oryza sativa
cggggaggcgcgatggcggccgggcggaggggaaagaatgcggccgagcggcggagaggattttatagggggcgctaggtcagttcggccggggggagagagaggtggtgcggcagagaggcggtggagcgcggcgaggggaccgcgctggcgctccggcgctagcggccaagcgcggcagcggtgacgccggccagtcgggaaaaaggaaaaaggggagaaaaaggaggcttgcctcctagccgatttgggtaagggcgcgcgcggggagagagagagggaggcgcgcgctcggctcctaggcggcacgcgggcgcgcgagcgtcagggccgggaacggcggcaggacggaacggcgccgacgggaaccgttggggagaagagagagagagaaggacgggcaagggggactgggccgaggcggcccgagaagggagagagagagaaaaaggaggccgaagggggaaaaggtggccgcgcgggcggctgggccgagggggggaacgacttgggccgaaaggggaccggcccgagggggagagggaaaaggccgggaagaagtcggcccgagagcagagggaggtaaagtggactttaccagagaaaatgaaagagggagtttgagggctcggattcgaaatccgatttcgcggttttctccgggattgaactgaaggggagacacgagaccttggcacacgacaagactcaaccgaagagcaaactttcgcaaatagggtttttagtaattaggttttcccgctaacgccgcgacaaaacgggcgttacaattttccatgtactcaatacgtcctaaagcatcttacaatttcatctcattcaaaaaacactttgagcaattttgagaaatcaaaacatccttgtgttgtttaatctttttcgcacacaaaacattgaacaaagaacttgcacataaagcagttttatattttttcaaaatattctttgtcaacattaattcatcaacaacacgagcatgcaaagcaaatccaagagcaagagaagatttaaatctcaaattatgatcaaaattgatatctctaatttttgaaatttcatgcattaaaacttcataatttttacaattatcatcatcaggaataagtgattttaatctagcaatttcagaattaagagattcaatgataaactcttgttttttaatcatcttctcacatcttttatttttggagctaaaagtggaaattacttcttcaaaaaattctatggaaggacttacctcattatcttcaatttctgactcagattcaccatgagccatgaagcaaaaatcagagatgtactcttccttgtccttatcttcatcacttttaatatcaccattgcttgccggttcaaaagcagcatagacttgatttagcaccttcttgagagcctccttggatcttcttcccttgaatgttgtaacgggcttgttgtccttggtcttgactccattgtcatctttcttgtctctccccaacttgggacaatgtgagcgaatgtgatcaagctccccacattcaaaacatcgaattcgacctcctcttttcttcaacctaacattgttcatagctcgagacaacttgttaatagccaaagccaaatcctcctcctcgaatgattcgagttgatcatcggacaaggcattaatggaataaagagagacagagttcgatgaagaagcaccaagatccaatgaagaaaccaaagcacttgacttagaatcaaccttttgagaaagaatattcatctcatgggttttgagttttgtgtaaagagaatccaaagtcaagcaaaacatatcaactgattcttgaatcgaagttactttcatctcccaaattgacatatcaagtccattcaaaaagtggcgagaaacttcaaattgagagtaattaacatcataagaagaatccacagatcgaagattactcaaaatcttattgaatctagcaagataatcatctaaagcttcttcagatttcttctctaattttatgtaatcctttttgaaaatatctttacgtaattctttaatgttggaagtacgttgatgaaaattacgcaaagcgttccagatctcattgccatttttagatgtgacactcgatcaaaatccgagcgagaaattccactcaataaaatatttctagctttgcaattattttcaaacttagttttcaaagcagtagtgttaatttgatctggaatttcatagggttgagcaaccttaggccaaatgtcataatcttgagccataatataagattgcatcttgtcacaccaataaggaaaatcgacaccattgaaaacatgtggtttggttgaaaacttgtcagccatggcttaaaaactttagattggtaaaaatccaaagaagaagaacaaggctctgataccacttgtaagatcgaatcccaaataccaagccaaccagaggggaggtgaatggttgtaacaccaaaaaccaaaaactttaaggggaaattaaagttaccttcttttcgatgtagatcgccgccgtcgccgttgctgtcaaaacgccgccgccggtctgaccgcccgagctccccggtctgaccgcccagtcgccgccggtctgatcggtgtatattcgccggttggaccgtcgcctctcgccggttaacc

SEQ ID NO: 61585 - DNA, 2812 bp, Oryza sativa
ctaggttattttcaaaataaatttgatttcataatttctaaatcttgtttaaatgaagtacatcccacatttgtgttatcctaactaaaatcctccttaatttaatatcactcatattctgtttatataatttattttaattagggttattccatcgtactaaaatttaattattgctaatatggttgcgatatttatttccaaacccacctaacctttattttaatttatattttaattatttatttagtcaactagatttattttatggtttgttcctagctagttattcattattcgcgattaatagactccgacatcaaaatccaatgaaacaggcgaataaagtcggcatgatgcaattggtttaaaaagtttttgaaagtccgcatttttagagttttgatttcgttggtcgaattttcagggtgttacaaacctaccccccttaaataaatctcgtcccgagattttcttaccagttgccgaatagatgcgggtactccgtcctcaagaattcttcgccttcccaggtggcttcgtcctcagtgtgattactccattgtaccttgtacatacgccacactttgctcctagtcctctaatctgcttcatccaatatccggatcgggtgttctggatatgtgagatcattgctaatgtgaatctcttccagcggagcttgttcttccggcactcgtaagcatttctttaattgggacacatggaagactgggtgcacatcggcgatatattctggtagctgtaactgatatgcgacttctcctcgcctggcaatgatctggaatggccccacatatcttggtgccagttttcctttaaccttaaacctttttgttcctctcatcggagaaacctttagataaacgtaatctccttccttaaattccaggtttcttcttcgagtgtcggcgtaactcttttgtcgtgattgtgctacttttagacgatcacggatcaagcgaaccttttcttctgcttcttgaataatgtcaggcccaaataccgcccgttctccagtctcggaccacattagcggggttcgacatcatcgaccaaacaatgcctcgttgggtgatatctttaggcttgcttgaaagctgttgttgtaggagaattcggcgtagggcaaacatctctcccagtccttgctaaaatccagagcacaagccctcagcatgtcctccaggacctggttggttctctccgtctggccatctgtctgtggatgataagcggtgctaaatgcgaggtaacttcccagggcttcatggactttctcccagaaatgtgaggtaaattgtgtgcctcgatcagatataatcttcttaggtataccatgaagacacactatcctggtcatgtacaactcggcgagttttgcactgctatagtttgtcttgacggggatgaatcttgccgtcttgttgagtcgatccacgatcacccaaatggaatcatatcctgttgcggttttgggcaatccaacaataaaatccatgcctatctcatcccatttccattcgggaatcctgagaggttgcaacaaacctgccggcctctggtgttcagccttcaccttttggcatacgtcgcaaagtgctacgtattcggccacatctctcttcatgttgggccaccagtagccctccttcaaatcctggtacattttggtacttccggggtgtaatgagtatgccgactcgtgagcttcctttaaaattaatcccctcagtccaccctgttcgggtacgtaaattctctttttataccatagaacgtcttttccgtcggttgaaaattcttttgcacgtcctgcagctaagcgttccttcacctctcggacctcctcgtttccttctgggcttcttctatttgggttctcaaaagaggttgaatgtccagggtgtttatccgtccatgaggcactatatgtaggttcagctgagctatttcctccctaagctcagggaccatcccttccattctcagatgattgtaatggctcttacgactcagagcgtcggccacaacgtttgctttgcctgggtgatagtgaacctctaaatcatagtccttgattaattctaaccatcgtctttgcctcaagttgagatctgactgggtgaagatatactttagactcttgtggtcagtgtagatatcgcaatggtttccaattaggtaatgtctccaaatctttagcgcatgaaccacagctgcgagttctaggtcatgggtagggtagttttcctcatgtggtcgtaattgtcgcgacgcataggccacaacttttccgtcctgcatcagtactcctcctagtccttgccttgacgcatcacaatatataacaaagtctttcctgatgtcgggaagaactaaaataggtgccgaggtcagcttttctttaagctgttcaaagctttcctgacattgttctgaccatacaaacttcttttccttcttgagtagttgtgtcatcggtcgggctatcttagagaacccttcaatgaaccttcggtagtatccagccaagcctagaaaactccgaatttcagtcacagatttgggtgctttccattccgtgacagcctccactttagcagggtccactgctactccaccggctgagattacgtgacccagaaaagcgacttccttcaaccaaaattcgcacttgctgaattttttgtataacttgtgctttcggagtttctggagaaccaatcttaagtgttccgcatgttcttcttcatctttggagtagatcagaatgtcatcgatgaatacc

SEQ ID NO: 61586 - DNA, 1172 bp, Oryza sativa
  unsure (1)..(1172): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggatcgtcctgcgtggtggagacagtgcggggcaccttatactttctccgtcccaaaaaaacttaatttctgggttttcatgtctaacgtttgaccattcgtcttatttgaaaaaattatgaaaaaatttaaaaagataagtcatgcataaagtattgtttatgttttatcatctaacaataatgaaaatactaatctaaaaaaattccatataagacggacggttaaacgttgtacacgaaaatctaagaattgagttcttttggaaaggggagtatgccgcaaggcggtggtgacatggcaaaatgacctgagacagcaggggtcagtgatgcaagaaaacagcagcatggctcacggccttgctgtgcctccagcaatcgacgtgtggggagatggtgggagtttgggagcaagttgggcaccggtgggaggttggtggtggggcgctagaacggtggtcgcgtgcagtgaagttcttcggatggtggcagctgatggtaataacgaggatgcaacgatatgagggctggatcgatgttttttgagcggaagcccagctcaattctagaccgacagtggccacacttttaggtgccacaaccccccggaggcgttgctctacggcttcctcctctccatctgttgaaatttgtcgtgtgaaaatcttatcctggtttctctggacgtacgacagcgatgtcctcgacgtcctgacctccctagggcatcgttgtgaaggtccatttcctatcattctcttcttcaaacgatttgtcctcttacaacagtgtttttgaccaccaaattaaagaaggccacaccggctgatatgtgcgttgttttatatgagtaaaatgcaccaacggtccttgaacttgtca

SEQ ID NO: 61587 - DNA, 7642 bp, Oryza sativa
gctttggctgaacttcattaattaaactagctgggtggcccacgcaattgcgcggctagcatccatataaaattatatatttttttaatatgattttacttaaaatttattaaatagttatctcgttgtcttaagattttaaaagaccaaaccttatcatccttgtgtttctaattttatagtttttaaaagtcacaccagttgctaccccttacttctgtcatattattctttattagcttgcttgatctaccactatttctattcattcttctttgaacctttaaaaattggatgttaagacttatagtttttagagtttattgtcctgttggtcttcttttgtataatttctagaaatcccgtcaagcgctgtcattatactcctctacgatcgtccactgcatcttctctttattgtcattgctattttaaaaatcgaacataattattgtttaggttcatttttctactttccaaaagtttcaccaaaacgtcaacgactttgtcactgtactcctctatggctccccgttgctgctcttctttattgtcattgagatttttaaatcaaacatggttatcattagggtttatttttttactttttagaagcccgaacctttaaaaatttgaccttatagttcttagagtttattgtctcattgggttttatgtttttttatatttttttagaaatcccgtcaaatgctgccactatactcctatacgacccgtccgccgcatactctttattatcattgggattgtaaaaatcgaacataactatcattgaaattcattttttaatttctagaagacccatcaaccatcggcggctctgccattgtagtcttatatgacccacccattgcctctcatttttattgtaattgagattttaaaaattaaatatgattaccattgaggtttatttttttactttctagaagtccccgccaacccccatgaccgattgcttcacgacctgtccgtcgtacttccttttaatcgtcattaggattctatttggtgttttattaatagtttttagatgtctcattaaccaccaccactctattcctctataggcatattacttaattaatctcgtcatgtgttttagatactcttttctttcaatactcaatagtcttaatttttttatcaccaatcttagttatttataaattgtattcctagttaaaatcttatttttcttttttctaatttcagaatttattttattttttgtattgtgttcttttcatatttttatttttttattttcaattttagctgtttcaaaattgtatgcctactttaactctctttttaatttgcctaatttcggatttttattttatttttttattctgaattttaattaatctactattcggttcttatatgtactcttatttctatattacttatatttaattcgaaattttagttaattttaaattgtattcctccttgaactcttattttattttcttttttctatttcctatgttttttatttttattctgaattttaattaatctcgtaatggattcttgtatggactcttctttcaatattccttgtttttaattctgaattttagttatttttaaattttattcctacttggactctcttttttttgctaattttggattttattttatttttattccgatttttgattaatttcgtattgggtttctatatgtactcttcaatattgcttactccgtttgaatcttcagaacatgtcaatatattttgccaatcactttgcattgcttaatatatttatcatattttattcagtcatagatggacggggaattctgtaattagttttgtattctaattacctattcagctccaacacatactatatgcaggcaacgtgcatgtccgattcctcgtcaattaaaatattgtaattacttctcagtttcctattatgatagaataggcttagcttagagcagtagtttctattcatattcatattcttcaaattaatctacaccgttaaaatctagtcagtttgtgatctaaaggtttaatattttttgttttttctccgattaatgtgggaatttttagccccaacaacgaacgtggtaccttcttttaagactgttttaataatataacttgttgggtggcccacgcaattgcgcggctagcacctaaacaaaatcatatatttttcatatatttttcagtatgattttacttaaaatttattaaataactatttcgttgtcttaatactttgaaatatcaaaccttagcatccccatatttctaattatgtagtttttaaaagtcacaccagctgctacctttgtcatatcgttctttatttgcttgctcgatctactactatttatattcattttctttgaaaccttaaaaaattgtatcttatagtttttagagtttattatttcgttgggtttcgtttttataatttatagaagtcccgtcaaacgctgccattatactcctctacagcctgttcactgtcttttctctttattgtcattgggattttcaaaatcgaacataagtatcattcggggttcattttttactttctataagtcccatcaaaccgtcagtggctttgccattgtattcctttatggctcacccgctgcctccattatttattgtcattgagattttaaaatcgaacatgattatcattggggttttttttactttgcagaagttccaaatctttaaaaattggaccttgtagtttttagagtttattgtcttgttgggtttcattttttataatatttagaagtcccgtcaaacaatgccactatactcctctacggtccatccaccgcctacattttattgtcattgggattctaaaaatgaaacataactatcgttggaattcattttttgttttgtagaagtctcgcgaatcgtcggcggctctgcaactatactcctatataccccgctcgctgcttctcatttttgttgtcattgatattttaaaaataaaatatgattatcaatggggtttattttttactttttagaagtcccggcaaccgccttgcccgtttgcttcacggcccgcctgccgtccctccttttaatcgtcattaggattctatttggtgttttattaacaatttttatatatcgtatcaaccgtcgccattctactccttttataggcatgttacttaatttatctcgtcatgtgttttagatggccttttcttttaacaatctttattttttatcaccaattttagttatttataaattgtactcctaattgaaatctttttttcttttctaattttaggggaaaaaatgaaattttaattaataccgtatagtgttttttgatatttttattttttttttttgaatttaagttgtttcaaaattgtattcctacttgaactttcttttagtttttctaattttagatattattttataatttattacaaattttaattaatctcgtattgagttcttatatggattcttctttcaatattgcttattttcaattacgaattttagttaattttaaattgtattcctacttgaactcttattttctttttctaatttcagactttatttttatttttattccgaatattaattaatctcgtattgattcttatatggactcttctctcaatattccttatttttaattccaaatttcaattatttttaaattgtattcctacttggactctccttttcttttctaattttgaattttattttatttttattccgaattttgattaatctcgaattgggttcttacatggactcttctttcaatattgcttattttaattccgaatttcagctatttttaaattgtatttctacttggactctctttttctttttctccgattaatgtgagaatttctagcctccacagcgaacgtggtgccttctttcaaaactgttttaataatataatagatagatagatagatagatagatatcgtttgttcctatgtcattatctagcatgttttgagggatcaatgattaaaacgatggagaatgttagtcatcgttctgctacatcgactaatttttgtaatagaatgaacccttctccacttttataatagaatgaacccttctcttctcttacgtaccctcttcctcttcaatctaaatgtgtggattgagttgagtgtggtcaggacgtcacactcctgtttgttcctcaatagtttttatgttgtagacacgtggtatgtttttttccatgttatagcctcataaagattatggttttgtaaactttttctactgtatcaatataaaccttgtaccatcttgtgcggttttgtaaaaatatttattcattgtacaacaggacgaaaaaatatttattcattgtacaacaggacgaatttggattacagcgtagagtggaaaattctgcatattgatgattatcaattgtacctgttgcaatgccgtgtcggcatgggttatagcaagaccgactaataataaagctggccaatggaaaagataaactccctctatcctatgatacaaggcatattaaacttgacacggtctctacaacttatctttgatctataatttctcatatattataaggtttgtaataacaaaattataagcatatgaaaataaattcaaattgccaatccaatggtataatttttagcaagtaaaattcaattcatattatactaaatgtagatcaaaatgttttgaaggtagaatcttaaaatgcgtggacgctttatattatgggatggagggagtaatagattagttacacacacacacacatatatatatatatatatatatatatatatatatatatatatatatatatatatatataccatgtcaattgtcgcatcttcccttggataatagtagagctcactttctactattagctcatcttaaagccaacatatataatagattagtttataaggttggttataattttcttcttctctctccatctctcacgtatttgtttttaaacttgtgataagattagctcttacatgagagtcaacactcttaattttttactacctctatcttctatctaaacttataaacttataggaggtttatagctccctactaagtagacagcaagtggccgtataaaaagtccaacttgagttcgtcgcgattccagtagtttgaccgggcctatttggttttccctgacgccgatgcaaccttgacagattaaaattaaagttgtggtctagcagtctatggtattacataattgtttccaacattgctcactctattacacaagtgggataagagttgtaattgtgtacactaatcgatttattttatgaacaaatcatgcattagcaacttgcagattcgaaactgaaagcatatttatggatatgtacggctgataagttcttaaccgtcccggtgggggaacccttgaacaccaatccaatataagatatcttaatctttcaactattaaaatcggtgcattttagctttctcggtggttttgagggtgccttcggtgacgtgacgtctacatgacggtgtgacctagtctttatcccacatagtgcttacgtgacattagaatttaaaaaataagcaagagaattgtcgatagaattaaaaaaatacatggaacttatttgtcattaaaaaaatattataagacccactgacatatgggcccccatgtcatcacttctcttcctcctccctctctacgtatatgaagacttgattcacctaccacaaaagctaaactaggatgagagcggctgcttctttccactccccggcgaccacccataccgcttcttctttgcctggtcgtccaacgaccctgagctgccgccaatcatatcggcgccggacatggacgcaatcctcggtggcgcgctcatcatcttgtgactggtgttggtgctgtagtgctgcatgtaaggccggatgcggcgcgcgcctgcttggctcggctcggtttagctcgttaggataacgagccgaacgctaagttgttagctcggctcgtcttgttggtaagctcgagccagctcgttggtaaaattgcaaggctgcacttcagtaagcagctagcacatatcaagccagccagcaagatggcagaaacgcataaagcaaatgcatatccataatacgatgttccaatccatagcctatcagcaattcacccaagaagtacaaaaatatcaaatagtaactatgcaaaattgcaaatgtaacaagccaataaagcaaaaagaaaaaagcaacaacagatcaagtcctcagtattgacgccaatgaaagaaggaacaaaacagcaggaatacaggcttgctcgacgttgacggtctcagtactgacgccgacggcagcgaggaaattaaggaggcttagggtcttcgatcaaccatttgccgatgcaccttgattagaaacttggtggcgccgatcccaatacctccaggatgctagggatgttcgctcgtcgcgcggtgcaatgggcattatcaccaccaaagcagtctattcctcttcccaaaattcgccggctctgtgccacaatggcaagtttatttgggacaacagagctccgcctcgagtttaattctttgcctggcttattgccaaggatcgcctccccacgaaggttaatctccataaaaagaacattgtgcaatcccccaaatgcaagctttgcagcgatgaagacgaaacggtgagtcatctttttcttcactgtccgttcgctgatgaattctagagatctctcaacattcaccccggcatctcacgcgtgcaagatctctcaggtctagtcgctcctaggcagctccccgctaaacacttccaagttttatatctactctgtttctggggtttatgaattcatagacatgatgttgtttttcgtgatctgcctaaatcactcctaagaatggtagcaaaatgtatggaagacgctaatctttgggctgagtgttttcgtagagaagacagggtagttgtgtcaatttggaaggatcttctctcttcctccgtacacgtcactcgtcatgctaaggtggttgatgatggcgctagctgcgcgtgtgtcgcagttgcgcaggcatggtgcgcatggctggtgtagaccgggagtggttacacagcatggcacatgcgctggcactggacacatggacgtggccaagagaggacgttcctggcctagggttgatcgacgggggcgtcgatctctcttaaggggggacgtggccaagagaggacgttcctggcctagggttgatcgacgggggcgtcgatctctcttaagggggtgagggtgtaacatcccggtctagggcttaataggattaatagaatactcatatcaacaagttgcaacttcttttccggaagccaatctccaaagaacttcagggttaagcgtgcttggcctggagcaatttgggatgggtgaccgactgggaaattcttcccgggtgcacacgagtgaggacaaagtgtgcagaacagacatgtgttggtttgtgagggcagtctatgacctatgaaagctatca

SEQ ID NO: 61588 - DNA, 1849 bp, Oryza sativa
  unsure (1)..(1849): unsure at all n locations
tatagggcgaattcgagctcggtaccgttgtccaactggacggcgccagcctctctggcgccgtccccttgccgacgtggcggggcgatgctgaggtggctagggggagcgccgccgtccccttgccgacgtggcggggcgatgctgaggtggctagggggagcacgccagagtggctggcgcccccccccccccccgggaaattttttatttttgttttatttgtttgatatttttttcacgcttagagacacacaagaaccaaccatagaaaaaatgaactcaaatggacgtaatatgtgacctgtagaatttttcctctcctctcctctctctctccgaactagtgcagaggagagagatgtgcaacttttttatttttattttattttttgatatttttttcacacttaggaactcacaagaactaaccatataaaaaataaactcaaacggacgaaatatgtggcctgtgaaattttccaaagctctaccgaaaaacttctctcctcgaaaacacaatcttgcaagcggaatttggaggttctaatatcgccgaacccggcaaagcagggagaattggatgtaactttttctgtagatgtccgtggatatattatttgcctgattccgagtctgtatgagaaagttacgcctattttaataaatgacatattttgtccatttcggtagagctttggaaaattttacaagtcacatattttgtccgttttaagtttattttttctatggttggttcctgtattctcctaagtgtgaaaaaaatatcaaaaaataaaataaaaataaaaaaactgcatctctctgtactatttaacttatggctatcatttcatgtggttatattttgaattagagattaagtaatttcatatagtggtagagtgtattatatttaacatgctgatcaaaggttttactaaagaagttatggtctaattctgatgaaggtgtaaaataggctaagtggtatgctattttcggatatctagctaagtggtatattccgttcaagtttaatttttttttgtggctggttgtatcgtatcctaagtgcgaaaaaacatccaaaaaaataaaacaaaaataaaaaggttgcaatatagagaaacaggaatggaggcgaggggtggtgggggaggggggcggcgccagccatgctggcgctctcctccctagggcggtgcaaccattttggcgccctcctcctgccacgtcggttcgcgtgtaccacggtggcaagaggacggcgcaagagaggctggccccgtcccgttggacgacggcaccagccactctggcggcccaaaaaggaccatttctgggataagtttttttaggggtctatttgcgaaataagttttttaaaaggaccaaaatgtgaaaaatccagtgcggagggcagccaacggccggcgatgaccctgctggcggcggcacgaggcgtgatgggggaggtcgagacggcgttgggagcgtcggaggctcgatgcgagatgggggggagcgagagtgcaacactgggatcgagataacggggggatagggatctaaggttaatttgtttgcatttatacctggtgcctagttgggctgagcctctaaatatttttgttggactgccttttgacttgacctcgtttagctagtgagctggctcgttatgacaagggataagttcacattgggtccctctatttgtcgcccagtccgattttcgtcccttggtcgcaaaaccgggtacaactggtcccccaacttacgaaaccgtttaaatgaggtggcgnnnnnnnnnnnnnnnnnnnnnnnnnnnnnnnnnnnnnnagta

SEQ ID NO: 61589 - DNA, 961 bp, Oryza sativa
gaggacaggtggtatcttgtgccgtctttcttgagttcttgcggtggttttctttttttgaagtttgttggtttcttttcttcttttttttttggggttggttcgtgatttttttgttgttgtgatggcggctgagttgtttgtttagtctgttcttgatgtttgcttagtggtggtactgatgtgtgggtagggttcgtgttcttttttttttgcgtttatcttcgctttccttttttttttcttcttccccttttgagatttcgatcgtagcattggttagcgtgttggtggatgtagttaatcaatccccttttaggtgccaaatgtcatggaaagcgagctctttgcccttgtttaaccaagcttttgatcgcagcattcaagaattggctccatctccccgcaaaaaaaaaaagaaagaaaaaggaattggctccatcgattcagtaaaaaaacccgaatgccgcggaagttagcattgctcatccgtggattcgacgctggcacactggtttcttggctagagagaaacaacgatgtgcttgctgtttcagccaccaatttcttcccggcttgtgatttttgccttttgtatctgctttctttttcctcttttgagaaagtacacgattcctttgcctaccttcattttcagtgccgattactaaatttgcagtaggtcctactctctcgccgtggtgttggactatcattgggagtagttgtcatgtggatttatgcccatttgctgcgattaaagagagaatatgtgctacgccttaacgttcatggacctgatttcttgaggtcgctgtaactgttgcctttggagaacaagaggaagagggtgtgagtgtgtggagacactaaccgtggcttttgcagattcctcttatctgttttccttgcatggcagttgtgccatacattggggatcctctagagtcgacctgcaggc

SEQ ID NO: 61590 - DNA, 1606 bp, Oryza sativa
  unsure (1)..(1606): unsure at all n locations
ctgggcaaagtaaagtcgaccaatgcaagttagaacatatccgtcaatagcacagtaacatagaacagtcaggtgatagatcacttacaatgtgccagcaacttttatgcctgcacgtgagttttcttgttatcatagagcttggcaagcccaaaatctgaaatcttagggttgagaccggcatctagcaagacattactggcctttatgtccctgtgcacgatgcggacggtagaatcctcgtgaagataagctatacctcttgctaggcctaagcatatctcaaatcttgttggccaatccaggttcaagcttccctttcctgaagataaagtttgatgttttaaaattttggcatttaagtaaaattccaagtcatgtaaaaccaaataaacttataccaaacagtgcttggtcaaggcttccattctccagatactcataaaccaacagcggcgtattgctctcaaggcagcaaccatacaatgtcacgaggttacagtgttgtactcgagatatagtttcgatttctgtagcaaattgctttttcccctgattagatgactgagagagctgcttcactgccaccgcccttccatcacttaatctaccctgcaagaaagttgcacttgtcaactatgcagggcatttcataattcagggagttaaacaagttatgccgatgaatgcacttgaaaaggcactagtttacaataaaaggcatatctcttgagttttgactttcctgtgtactaatatttaaattaccacgaacttgctttcggcaaccaaattcaaacatgggatgcaaatccagaaatttactacacaaacagaccttgtgaaccaatccatatcctccttcaccaagtaggttactagaactaaaattttccgtagctgaccttagctcattataactgaagacatttggtcttccaactatgttgtacagctctggagattaaatcacaacaaaacttgttagcataacctccacgtcaagttgaagcacacaacgtgacactggtatatgaaataccttctagctccaataatatctttctcttcttctgtctccatataaagtgtccagcaagtgcagccaatgcaaaaactgcaacaccaaccataactacaatgatcacagcaattttgctcctgctcttgttgtctgcagggctacggaccgttgggatgaagtctggagaaagctaactaagtcagagcatgaaaaggttcaaataaaacttaaaaaaaataatatgtacaactacaaaacattgatcatgtgtgttttgatatttatatgcgtttgaaacatattcattcaacttaattcatccataaatttaagagggatatttatatattggtcttatagccaaatattttgctggcacagactgctaacttcattacagaggcttttgatcattcactttagaattgcatattcagttaaatctttaaaacatgatggaagtacctctagcaccaaacatggtggatcattgcccaaagtttttttttagaaaatatcaannnnnnnnnnnnnnnnnnnnnnnnnnnnnnnnnnnnnnnnnnnnnnnnnnnnnnnnnnnnn

SEQ ID NO: 61591 - DNA, 874 bp, Oryza sativa
tggcatattcagttaaatctttaaaacatgatggaagtacctctagcaccaaacatggtggatcattgcccaaagtttttttttagaaaatatcaaagcatgcatcagcatgtcacagtgatgattttttttttcaaccagaagaggtataccgatatatcttagatgactcccaaatggcgttgtgaacagttagtataacagaaatatagaacgaaaaaaaattctagtttagatcagtacttggagtagcgctcaaagctgatattgcaggcccatagtagccttgatgaggaatgcagcaagtacccttgccagcccagaagagatgaatctcaaggaaattttttgtcacagggacaacatactgcttcttaacaacagtgaaagatttccctcctgctgcctttcttatgtcaaagttctgctccttacgctccccctatacaagatacaaaaatgaagaaaaatagttttgatcagagctaatgagctaaaagcatcaaataccagagaaattgtaagtttgcaggccacctgaatgtagatgtcaaaaatcctcctccctctgctcctccaagactgcacatcagggaaatccacctcggcaaattgaaagtggggaatgtagttcccattctcgagtccaatgccatagtatctcaaagatgatggtgacatccttgctgtttggaacagtccagaatctagtgttttatcgaactggcgtgaactgtagattatgtaacttccattgggtggatccatgaatcttccagtggtgctaacaccccacgtaggtgtgcctgccacatagtatgatgcagcaccaagattggcgttatcagccctgatacatggcattatctgagcc

SEQ ID NO: 61592 - DNA, 752 bp, Oryza sativa
gctaccacagttcacagcaaaggaggaagctgtaaacaagttagatcaattagtattagtatttgactaagtgaatccgcggttgcagatttagtatttctcaactaaatacattcatggtgttgcaaagggtgaaaggctcacactgtggagaaccaagaaagaaggatgtatttctctgaaggcatgccagccctgaaggtaagatactgcaggtgcagagcatcaacaatttgaatcaaattagaagctgagagaacctattaattatgcttgagttcttgttgagaaatcagaaatatgggcgcacctgttattggaactatcaatcacaaaattgtttgccaccaaattcctaagtagaatgaactctattagagcttgtttggtctagcttgaaaaaacttaagctataaaaaagtattcgtttttgttctatgttgtaagggaagtctcatttccatgaagactcttaatcataagtggcctatagatgatagatccaaaaatttgttaagacatataaactagatgcaccaaatacagctttcagatttaccaaatgagctagctcattacatctgtatgctatacgcataaatgctggatgacaagccttacataggttaaacacgccgttatattttagggaataaaacatggctttactttggctggagctaagtaatcaatgtttcagaacttggtacttacaattgtaaatttttatcactagcccagggtaccgagct

SEQ ID NO: 61593 - DNA, 4753 bp, Oryza sativa
  unsure (1)..(4753): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaaactaaatatagccatttttttagcaacattaccaaaatttagtaaggttaaccctggcatcaaagtgaacagaccctaagtttcactttgaactactcctaactcaaagttttcacataaaactaggtatgtttacctcttttgcactttgtaccaccctctctatctctttctgctcccgccccagccacccccatttttaccactacctgaagcttgatcgataaggcaccgctgagttccttttctcccacgctggtgagcttctcccagtccggtttctctctcgtgtccacgtgccttagccacatatgccgctggaccagaatgaagcaggggcaacaaggcagcgaacaatttcaccatcgggtcagaatttaatgaagcaggggcactccagcgattctgatgacaactgaaggtggagatggtggtgggagctagagatggataagacaaagatactcccttcgtactctaatataatagattttggttaaatatatcatatcctagtataattattcttcttaacagaaccgctataggatacggggttaaataaaaatgaccatatacagtctttgatatgcacatgctctacccttagagagtcactctagccaaaactccctaagttattagcatcctgacctttagttcttattgagctgtagaaaattattttgaggtgtagatgtcacatatgagagtgacacgtactgtatagccgtaccaaaataatcatctgataccgcggaatttaacagcaccttatccctaacgagttatgctgtaagcctgtaatcaacggagttatcaaaatcaatattcttttgtcctaaaatcatcttagcacacacaccaaggacaactaattctacttatcatccatttaaacaagtgattcattactccctccattccaaattgatctacatatttcataggtacaccaagaccaagaaaaactaataactctctcatactatatttactctagcaacaaactcgatacatgcaccatccccaacattttctagccaatagcaaatcaagatattacatatgtgctataaatacttgtgtgcatggatacatgcatcaatatccatttactccaatgcacaaataacgaatagacttaataaataaacacaaatatgtagatcatttaggaataaccccagaaaaactagatgtagatcaatttagaatggagggagtactatttacatttctcgatgctcatggagccaaacttgtgtgaaagaatgaagagtcacgcattaaattccataaagtcattaagatgatatgttgttggattgaaatatacctatcaaagatagatttttcagatttggaaatatgactatcaaaaatagatgaagagagtaagatctattccatcatagtggagcaaatttcgagattaattcataatacttcctctatttcatattataagattagacatagatccattaacatctatataaatattgataatgctaaaaagtgaaagtaggatttttctttctggagaacctgtccaccacaactccacaagttacaagctactacacaagaccatttcccattcagcaatcaagtgtcaaaagctacttacccccatccatgaccatgaacacgcacgcgcccgcgcacgagcttatcttttgccaacgcttgactctttccccagtttcccctcctcttcaacagccgcaacccgcatcctcatgtggacagagagacccctgacccatcatccccgttccaaacaaaacccaaaatacggattaatcattagtttaatattgcaacaaccgcgcacatgtttagtttagccacttctcgttggccgtgcgttgcatctgggacaagctggggcttcttgcttcttgctcgctcgctgctgttttacactattcacgtttaacatttgaccgtttatcttatttgaagattagtatttttattgctattagatgataaaatatgaatagtacttaatgtttgactaaatatttttaatttttttataaattttttaaataagacggatggtcaaacgttagacacggatatccacggctgcacttaatttgagagggagggaggcagtagaatctctcttttttttttatacagttgacagcagcgtcgccgtttgatgagcagtacaacaattttggtcaattcagaatagctgactgtgtattgtgtgctgcgtgcgtatatattgtctccagtattcgtcgcagcgcgcgtccctttctacgcccgacgatatcatccatctcacccgtcgtcaccgcctcggctcacagcttctcttctcccagaaacggagaagagggggaggaggcgagcagaaggctcaaggagggagacgatgagggtgatgagccatctcctcctccatggcggtgtgctcctgctgcttcttgcagcggcggctgttcaggctcagcgggtagcaaccaagactgatccgactgaaggtgagcacgcgtgcccgcctgcttcgattctgatttctgaatgaaacgagagttcttttttttgggtttgtttgagaagcggttcgtcctgatggagctagttatgagaatctgtgactgtaaggattccgccttcaaattcgactggaaaaatccgccttttcgggagttcttgccttgagattcttgtttttttttgggataatcacttgatgataatccatctctgctttgctccgttttggcttgtgctgaagattttccgttgttgagcttggattgaagcttgccatgagaacacctgcatcctaattttgaagcctgcaactccgcaagcatgatgatcctgttcttgagttgtccttccaaaaaatttcagttcacgacgccgtcgtcactcgtcacccaccgatcgacatgaactttttttaattattggccgttgaccttcgttttttaagtctgaaaccatggcatgtttgttcaagctcgagccatttcggcgtcttgaccgattgctggccgtccgatcgtcgcgacccaggccatcggacggtggagaagttccaaggatatgctcatagttatagcgtggttggttggtgttttgcatttgcagcggcggcgctgaacgcggtgttcgcgaagctcgggcagcaggcgtcgttgtcgacggcgacatggaacatcagcggcgacccctgcaccggcgccgccacggacggcacccctatcgacgacaaccccaacttcaacccggccatcaagtgcgactgcaccttccagaacaacaccgtctgccggatcaccaagctgtaggtgtcgccgtccctctcttggcgcgcgcgcgccaggtgttcgacgaattgcctgcctgagctccgaggcgcccgatgcgctaaatgggatttttttttttgctgtgatgcaggaaaatatatgccttagatgtgcctggcacgataccacaagagctgcggaacctcacgcgcttgacccatctgtacgaatgaactctctctctcaacttccttatgttggattgtctatggtccagaaactattgcatttgaagcacaccatacggctgattgatagatgcaatggcaaagttttccatttgccgtcccgcaatgccattcaccttccagtatttctgttgtcatcacagtacctcttttgcattcctatagaatttggtcggtcacttatcattatctaacatagtggctactatttcttataagctgcattgtagtagtaagttaaaacttaaaagggtacttctattatttacttttctgaaagaaaaaaaggctaccttctcttatttcagctatgaaatgatgaatataactggaaataaatctattttagtatttcacaatattaatgttgctgatatctggtgtggtcttatttcaggaatttagggcaaaatacattaacagggcctttgccatcattcattggggagttgactaatatgcagaacatgtgagatttagaactcacaaacatcattttagtaaatgttttgctttgcattgaatctcaccttttctctcttgaacacacaaggacatttcgcatcaattcattatctggacctattccaaaggagctcggtaaccttacgaatcttgtatcactgtaagaactatattccatgatttcgtgacccttattcttcatacaactctaccatacttatgaccgtgagaaataatagatatatttatgctttgaactcgcaccttgaattgatcatctgcataaaaatcatgagatgaagcacactttaaattgagaacatatggcaacatcctcagaattgcactattcaatgatgaaggactccaaattgtgatgaatgcacaaatagcatcttcatttgttgtggtattcttgtgtactactaagacttggatttaaactcaattgaaggcaaacttttccgttgatagtgttcgttgnnnnnnnnnnnnnnnnnnnnnnnnnnnnnnnnnnnnnnnnnnnnnnnnnnnnnnnnnnnnn

SEQ ID NO: 61594 - DNA, 4224 bp, Oryza sativa
  unsure (1)..(4224): unsure at all n locations
atacaactctaccatacttatgaccgtgagaaataatagatatatttatgctttgaactcgcaccttgaattgatcatctgcataaaaatcatgagatgaagcacactttaaattgagaacatatggcaacatcctcagaattgcactattcaatgatgaaggactccaaattgtgatgaatgcacaaatagcatcttcatttgttgtggtattcttgtgtactactaagacttggatttaaactcaattgaaggcaaacttttccgttgatagtgttcgttgcaattgacaatttttatgtgactaaaatcatcttttgggttgaattttcaggggtttaggctcaaacaggtttaatggctcccttccttcagaactggggaacctggacaagcttcaggaattgtacgtttctagttgggacttcgtttttcttttttttggtctacctaaccattctgattcttggactactcagctcaatgtttgctgctactcttatctctcaattgcaggtacattgacagtgctggcttaagtggtccactaccatcatcattttccaagcttacaagaatgcaaacattgtaggattacaaaaggatgtgtttcttgttgacattaattcttccgtgccattaaacattgtttcttatcctcctatttcttcaggtgggcatcagataatgattttactggacaaataccagattatatcgggaactggaatttgacagacctgtaagaatcctatatcctccgttcattaagccataataatttttgtaacagataattatttagacaataggaatgttgtgttttcatattgttttaaataatatggtcatatgggtacaattttcaataactttattcaagtcaggctttaaatcgaggaaaattgtaggtgtgaacatgagatgcattctaaagctacttggctcatgtgatttgtgaaagatagtttgtttttctcgtttctagagtatctttttacttgactgtgctgaatcaccctataggggtctctttatttaagtttggatgattgttgagcgttggtaaatgatgcatctttcttctgtcactattcatgatgagatggcttccaatcttgaaaagcattattcagctttgaatatattttacaatatttatgtattcaccgtgaaagaatctgtactttagcttcattagtttagtttcctttttttaatcaaagagttcttcctgctatcatttctagtttgatgtttcagtaaaaaagatgatttgaatgactagttacagctatgatctgtaggcggtttcaaggcaattcttttcaaggtccaattccttctgctctttctaatcttgtccaactatcaagcttgtaagtgcctaacactaccaataaatatggtattcttaatataaagaatgtagaagggaaaagtcgaataattgttttatatggtgcagacgaatcggtgatattgaaaacggaagctcttcttcactggcattcatcggtaacatgacatcgttgagcatcctgtatgcataacttttaatccacttaattactcatacggccgtactactgctcagaatattaatgtaattcaaaccaagttgattgatcttataatgcataacatatttctttgcaggattttgaggaactgtaagatatctgataatcttgcatcaatagacttttcgaagtttgcaagtttaaacttactgtaaggattttatttctacaataaattgtaatcaggcgccttttgtgaaatatatttctatgaaccgtacaatgtctgatgacctctttgccacccttttttttacttttacagggatttgagttttaacaatatcactggtcaagtaccaacagccctgttgggtctgaatttgctgaactccttgtatggattatcttgacttcaaaagcctatttcttggagccaaagacccatttatgtgtcttactaatgtttgcaagttttgcctgaccagatttcttgggaataatagtctttcaggaagccttccaagctcaaaaggaccttcactttcaactttgtatgttcatatgatccaagtttgtttgaataacatgatgaatatttgtttaatttatttctaacgatgatctggcatctccctgatctcagagatttttcttacaaccagctctcaggaaattttcctccatgggctagtgggaaaaatttacaattgtaagtaccaacttctgaaacatctatccattagctccaatgaaagggcacgtttcattccctgaaatataagggcatgtctgacctatgttaggccagcatttatgcgtgtagcatacacatgtgacgacctagcacatttggtaaatatgaaagctgtatttgatgcatctagtttatatgtcttaacaaatttttggatctatcatctatagggcacttataattaagattttttgtggaaatgagacttaccttacaacttagctcaaaattgaatatttttatagcttttttttcaagctagaccaaacaagctctaaatatgctatggaaatatgaagtgtggaaagccttttaattttagttctgctaattctacttaggaatttggtggcaaacaatttcgtgattgatagctccaataacaggtgcgtccacatttgtaatttctcatcaagtactcaagcataattattaggttctccaagcttctaattggatgcaaaatgttggtgttttgcatctgcagtatcttaccttcagggcttgcatgccttcaaagaaatacgccatgttttcttggttctccacagtgtgagtctttcaccctttgcaataccatgaatgtgcttagttgataaacaccaaatctgcaaccgcagatttacttagtcaatactaatactaattgatctaatttgtttgcagcttcctcctttgctgtggactgtggtagcaatagactcatatcagcctcagataatttgaggtatcaaactgatgatgccagccttggacctgcatcatattctgtcacaggagcaccaacctggggtgttagcaatgttggaaagtttgtggatgcaccaaatggaagttacataatctacagctcgcgccagtttcagaacaccctagattcagaactgttccagacttcaaggatgtcaccatcatctttaagatactatggtattggacttgagaatggaaactatacagtcactcttcaatttgctgagtttgggatcgaagacacgcagacttggaagagcctagggagaagggtttttgatatatatctccaggttggttcttgtctagcttataaacttttttttttgtttagcttacaaccaagtcaacattttcttattttatttttttgcagggtgaacgcaaggagaagaactttgacatcaggaagacagcaggcgataaatcttacactgttgttaagaagcaatacaaagttcctgtgaccaaaaacttccttgagattcatctcttctgggctggcaagggcacttgctgcattcctactcaaggatactatgggcccactatctcagctctgagtgtaatccctgcaggtaccccccttaactacaaatcatggtcccaagatggattttctaggatcaatttttgcatacctctgtaagatcccattttctcttttcaatctaacaagtggcctctgttcagatttcacccctacagtgggtaatacagcacataaaaacaagagtactagtaaaacaggtgtaattgttggagttgtagttggtgtgacggttttaggtttggtagcacttgttggaatctttatgtggagacagaaaaggagaaaattatcactggagcaacaaggtacatggcacactaggctcacaatatatccttgactaggcaaactagaagttaataaattgatgtatatttttatgtttgcagagctatacagtattgtcggaagacctaatgtattcagttatagtgaactaaggtctgcaactgaaaattttagttccagcaaccgccttggtgaaggaggatatgggacagtttataaggttagttcatctgtaagtacatatatatattcgaagtttcgaacttgttatggaattttacctacgaattaacttattaacgtctagacaagnnnnnnnnnnnnnnnnnnnnnnnnnnnnnnnnnnnnnn

SEQ ID NO: 61595 - DNA, 7045 bp, Oryza sativa
tttttctgcagcgtgaacgtcaggagaagatctttgacatcagtaaggcagcaggcgataaatcttacactgttgttaagaagtcatataaagttcctgtgaccaaaaacttccctaacattcatctcttctggcctggcaagggcacttcctgcattcctggtcaaggctactatgggcccactatctcggctttgagtgtaacccctgcaggtactcaccttaactatagataatggttccaatatgaaaatgatgtattttctagggtcagttgtaccattctgcctaagatcacattttttttctaacaagtgaacttcttgtcagatttcacccccacggtgggtatcgtggcagaacaaaacaagagtactagtaaaacaggtgttattgttggcgttgtggttggtgtggcagttttaggtttggtagcacttgttggaatttttatgtggagacagaaaaggagaaaactgacactggagcaacaaggtacatggcacactatgctcacattgtatccttgaccaggcaaacaagaagttaataaattgatgttcctttttatgttcgcagagctatacagtattgttggaagacctaatgtattcagttatagtgaactaaggtctgcaactgaaaattttagttccagcaaccgtcttggtgaaggaggatatggggcagtttataaggttagtcatctgtaaccttttcctgtgaattaacttgttaaaatctagataagtagtgattatataatttgttgttcgttatggataattaattggttacactctttgtgctttctagcttttgtacaaatgatgcatatgaataaaccagaaaaaaatatatgccaatgtatccattacagaagatgtccggcattgcaatacttgaatcttgcattttggtgaattccactttgcagggtaagttaaatgatggaagggtagtggcagtgaagcagctatctcaaacatctcatcaaggaaaaaagcaatttgcaacggaaatagaaactatatcccgagtgcaacaccgtaatcttgtgaagttatatggttgctgccttgaaggcaataatccactgctggtttatgagtacatggaaaatggaagccttgataaagcactctttggtacaagctatttcagtttgatgcaattgggattttataatttaggtttatcatagtctgtaacctaaaatctaaaccctccatttgcaggaattgagaaattgaacatagattggccagcacgttttgacatatgcttaggcattgcaagaggtctggcttatcttcatgaagagtccagcatccgtgtcgtgcacagggacatcaaggccagcaatgtcttacttgacgccaatctcaatcctaagatctcagattttgggctagccaaactttatgatgacaagaagacgcatgtcagcacgaaagttgctggtacattgtaagtacattccatctgttccacctttatgtttacaatcatatttatgttaatggtatttttgggtatcctttgtccagcggttatcttgcacctgagtatgccatgagaggtcatatgactgagaaagttgatgtctttgcatttggcgtggtcttattggagactttagctggacggccgaactacgatgatacacttgaagaagataagatttacattttcgaatgggtaagctcagtagctcagtgatgaactcttaacccaaggaaattcaaattataatttagtcgtgttattggcagaatatacccgaaagttctactttaacattgataacattaacacacatgccatcatatgatttacagttagaccctctaatttaccccttttaaatcaaaatcaaaacaagcataatttatctgattttgcccctatggtctgaatgcttccatatcaaattctcaataccttcaggcctgggagctgtacgagaacaacaaccctctgggcattgtagacccaaatctcagagaattcaacagggcggaggtgctccgggccatccacgtcgccctcctctgcacccagggctcacctcaccagcggccgcccatgtcgagggtcgtgtcaatgctcaccggcgacaccgaggtcaccgatgtgttgatgaagccgagctacatcaccgagtggcagatcaagggcggcaacaccagcttcgccaacagcgccgtccgcgggcagtcgagctcggcgccaggatcgacgtcgcagcaagcctcgtcggtgttcttgaactccatcatccaggaaggccggtgattttcacgccggtgcttgatcggatcaacttttcctcaagtggcagatgataatctcgtcttgtggagctgtgattgtgaatacacgttgcgaagggcaaatggtgtcaagactgtcagttttgcagtgcaggtcgtcgtctcgtttttcttttttttttctttacagtttgccggttgcgtttttaaaaattatgttcagtttgtttcatacctgtacagtgtaagtttgagtatatatatttttgatcgaatagcttatgtgctttgccctatttgaatgtgaataagattttgggccttttactgtggttcatttagtttggtcctgaaatcatgccgaaagagtccgtcctctcgcatccctccaattcattttttaaaattttgaaatcattcacactaaatttatatgaaggatgcttccaaaggtatatacagtggatagatatgaaatcatccctccaattcctggatgctgttttatacctacctaccttaagcccctcgactttgtgcacggttcgtgagtcaaaacgcatgtggttcagacgtgttgctcaattgactcttaactcattggtcagagctaaatctcaacacgtaagcacagtgattcaaagctgctgacgtctgtcattgaaattattcctctgttcccccccccccccacccccttttccatatatacaagtcgtccatggaaaaaaatattactgctcctaaagaaaaggatatttcaccatagagtcatgactaaatcttggaaagatttgatcaagacattgatatacattgtgaagtacttaggaggctgtttagattgtagccaaaataagccttaccaaatgttgataatgccaaaatcatcttggaaagatttgatcaagacattgatatacattgtgaagtacttaggaggctgtttagattgtagccaaaataagccttaccaaatgttgacaatgccaaaattttggtaagttgacaatattatcgagttttgtaggattccttatatatttatcaaagtttggttaaaaaaaaactaaatgtatgcacatttttagcaaatttaccaaaaaaaaatgactggtttgaaacatcaatctaaacaaccccttaattattctatccatccctaaggaatgtcttatcagcttcaagatttatcatataaaaacgatttttcagagtggagtccattaaatctgttaatactaatttatcattttcttcaattttaaaatagtacccctccttatttactcactacattaatgaaggacatattagtcttttaatcttttacttaatttgtctttgactaggcagaacaattgctttttaaggaacagaggaagtagctagtaattcattttctgttttatgtatagttcaattctcacaaaaaaaaaacacgataagcaaaccactttcacaactttggctgcacattctgaagaaaaaaaaagtctgaggctgttagttatgtgtagtgacgtttaattatttttttagggtacacgaccttatgcttgaacaagcatcttggcatatgtgaaatgtgctgaaaatgcaactgccagggacgatttttcatttcgttcatggcatttgggcaagatgttggacagatgttgcatcggcttaataaaactacctttgtttattttcttttccaactcccactaatgcgtggagaattagttattcccttgtcctaattaataatgggacaagttagggcaagccccagcatctccttgtgctagttattttgcagttaggatatcttttttgaataaaaataatatcaaaaccaaagtgtaatcctatgcatataatctcattgacgtgccaagattttactttgatatttatgtggctaatgacgtttgctttctctttctctgtcttgattcttggaggtaaatgtccgtcgcaaaaccaaattaaccaaccaaaccacccatatgacgacgttgaagtccaagttggcacactccaacagtacaaccaagaggggacaacgtcatcaaaccatacatcatgtagtactatcagttaagagacctccttaataaatatctaatccaagacactactaagtacaaatgtacacctcatgaaatgtatactagatcacatatgtagaaatctagcacaacaatttagaaattactacaagttcaaagagaaatgtgaaaaaagaaaaaaaaaagaacagtttcattaatcattgggtgtatttagatcccaaaattttttggctaaaaatgtcacatcaaatgtttggacacatgcatgtagcattaaatgtgaaaaaaaaaaccaattacacagtttgcatgtaaattgcgagacgaatcttttgagcctaattacgtcatgatttaacaatataatgctatagtaaacatttgctattgacggattaattaggcttaataaattcgtctcgtagtttacaggcgaaatttataatttattttgttattagtccacgtttaatactacaaatgtctgtccatatacttaaaaaaattttagccaaagaactaaacacggccaggccattgattagaaaatctctttcacgaaaacactggacgaagaaaagtcttctggcttcatcagagcacagtataaaatgtcattccaagctagccatctgctgaatcatatgtactatgtgatggcaacaacacgacgcatgcatgtttagctgctttaacacacactccatcggctacattagttggtcatcagaacagttgttgctagcagctttgggatgccactttgggaattttttttgaaaataatattattttaatggaaaatcgcaaaattataggtcggctagacgaaatcgcaagtttagcgccctgtcgaactgggacagttcgataggtacccctgtcgaactggggcagttcgacagggttctgtcgaacccctgtcgaactgccctagttcgacaggctagttgtagagtcgaaaaaaaataaaaaagtacttgctacagtgcccgatagggacgtatcgaacagggggagttcgatagggcgcgtggcatggacgtatcgaacagcgggagttcgataggcagtgtcgctacagtgtttttccttttttatgttattttattacctgtcgaactggggcagttcgacgggcagttcgacaggtaccctatcgaactggggaagttcgacaggtaccctttcgaactgcctccgttcgacagggtgctaaacttgcgatttcgtctaactgacctataattttgcgattttccattaaaataatattatttccaaaaaaactcccactttggtatagcataaacaaaaacagaagtggtactactagtacgtgctgcgatgcagcatcaccatgcatgattgcatctttgtttccatttgcctaggcactatttgattcagcttagtattattataatctgaattattagaagtaagctgaaacaaacaagtagattattatgctagattattataatctataagccagattattataatccaataatctcctttagaggagctttttccagattattgagtggctaaaaaacaactacccttagatgtctctaataatctagagaaacaaacaactcgtagcttattttatattagtttattataatccagtttagagtaatctgatttaataatctaaattacaataatcttaaactgaaacaaacactacgtaatactctcattactctccctcatctgattgcatccttgtgtgcattcgcctagctaattaatgctccacatcatctgtcagccactctgatccatcatcttcttcggagcaaaatccaagaagaaggggagagagagagagatggatcctaggttgagctactgttgctacctccatggctgtctctgcgagcttgtgctgctgctgtgttcttggacagcaacagatgctcaggctcagcaaccaccacctcacactgatccaaccgaaggtacacaaccacgcaatctaatggcgtttgattagcgaggagatcgaggtgaggtgaggctgatctgtcagttagtttaatttcttgtgttggttttgggtggcggcggcgtgcgtgagtgcagcggcggcgctgaacgcgatgatggcgaggctggggctgagcgcgccgccgtcgtggaacatcagcagcgacccgtgcagcggcgccgcgacggacgacacgccgctggacgacaacccggccttcaacccggccatcaagtgcgactgctccgatcacaacaacacgctctgccacatcaccagactgtatgtatgaaactgatgaaatttcttcttcttccttactctctccgtcctaaaaaagacctaacttaaataggatggtttaccatatagaacaacaaatctaatctagatgtacagatttcgttgttctaagtggtgtcccattttcatctagattagtttttcgtgggatggagagagtattgaggaattttcatatgttcatcgtgttcgtctcgttgatttgtttgatggatcaggaaaatcaacacgctggatgtggtcggcccgatcccagaagagctcaggaacctcactcacctcatcaagctgtaagccgcctgtaacctaattatttcagcttgagcaacaattgcaattttttttatttttgcgcattttctcggctcagcttgatcattgtgcataatgtggtcttg

SEQ ID NO: 61596 - DNA, 2698 bp, Oryza sativa
  unsure (1)..(2698): unsure at all n locations
ttttcttgtcttgctttcaacaccaatcctacattctttttccttgaaaatcaacagtactgtgggcatcaatgcgttgtctggacctatccccaaggagcttggcaatcttacaaatcttgtatcgctgtaagcttcaatcttgctgttctgaacttctgataagcagtaagcttttttaatagggtaacactccaacatagttggcgaatgtagcaatgaattttatttttgttaatgtgtctttccattcgtgaaaaaaattgaaatctatatcgtggaagagggagcctgacacaataatatgcctttctcatcatatattaaccaaccttttttttaaaaaaaaaaatcagcacttccttgtgaatattttcctggagctaacctatttaaaatcttatactctcagggcattgggctcaaataattttaatggatcacttcccgatgagctgggtaaattgacaaaacttcaacagctgtaagttatccgtttggtcttgttttcattttattttatatgatcatcagtttttgtttgttgtttagaggtgataatcatctgcttgaatgaagttgtatgtctgaattgtaggtacattgatagtaacgacttcagtggtcctctaccaacgactttatcacaacttacgaacctgtccaccttataatttcgcaaagcagtgtttgggattttattgtttctcatgaaatttcaacaaataattatggacaccattgtcattgtgcatccaggtgggcattggataataatttcactgggcaaatacctgattatcttgggagtttgaccaacttaacccaactgtaagatctatctttggccaattaccgatatttaaccccttttttttctaactgttctcttggcacaaatagcaaggaaatgctgtgcatgttttgctagcatgaaatgtttatgtgaaatgcatcttgtttctcaagaagagctagaatagtccgcgttgcttatttatgaccaaacatatgtctatttttaggaggctccaagggaactcttttcaaggtcctattcctagaagcttatataatcttgtcaagttgagaagcttgtaagttcctagtgtttcagtgacaatgactgtgtttttgttgcaaacataagcttatggcagtgatagaagcattgattgtcccaatttaacagaagaataggggatatagtaaatggaagctcttcactggcgttcattggaagcatgacatctttgggtgatctgtacggcactttcacaccactttacttctcgtaacagtttaagatcttaagaatttaactttttgtctttcagtgtcttgagaaacagcaggatttctgattcacttgcatcagtggacttctccaagtttggaagtttaaatctactgtaagaattttcacctatcacaaaaatctccgacaagttttccatgccgttgtctaactcattattgttggtgcagggatttgagttttaacaatatcacaggtcaaattcctccgtcaatcgtgaatcttccttctcttacttttctgtaagtgctggtgcagggattctaccttgtttttgcaacaatgtttttctttttgctgtgtgctgatgtttgcaaatatcttattccaaaacatgtttgagtcagatttcttgggaataatagcctttcaggaagtctgccagccatgaaaagtcctctgctttcaaatttgtatgttcatattttccttgtatgttcccattttgtttcaatgatcaaaatatgtatcgatctaattctaaaatatcccatgttacttttcagagatttttcatacaaccacctctcaggaaactttccttcttggactgcccagaaagatttacaactgtatgtttcatggcttgaaacttctgtatatacctctttacgattgaatatacaaattacaaagacagaaaaatctaaaagtgatatctgatgtgcattttctaaggaatttggtggcaaatgactttgtgattgatggcactgatatgaggtacttgccagttgctaccatttttttttcttattaagaccattagctcctttaggtaaaacactatattcatttcagcttgtaagttgtaaatataatttaaaatagtgatgtattctatctgtagtggtctgccatggggattgaattgtcttcagcggaataccccctgttttctcggttctccgaagtgtaagccttcatctctgtaactttgtgcatatgcctacttcagagaattcaaaactataaaatcgtagttgcagattactaagacttttgatttgatatttttcctccagctgcctctttcgcggtggactgtggtggtagtagaaccatatcaggctcagataatgccatgtatcaggctgataacgccaatcttggtgctgcatcatactatgtggcaggcacacctacgtggggtgttagcaccactggaagattcatggatccacccaatggaagttacataatctacagttcacgccagttcgataaaacactagattctggactgttccaaacagcaaggatgtcacatcatctttgagatactatggcattggactcgagaatggaaactacactgtaacannnnnnnnnnnnnnnnnnnnnnnnnnnnnnnnnnnnnnnnnnnnnnnnnnnnnnnnn

SEQ ID NO: 61597 - DNA, 1079 bp, Oryza sativa
  unsure (1)..(1079): unsure at all n locations
tttttaattttaaaaaggttctaaactatgcatgtctaacgcaaccaaaatttgataacacccaagcgtgccaacaaattgaattccaaaatgttggtaagggtgattttaacaataaaagaaataatacctttggtatatatagtgtagttcagggctgcacgacctaaaaaaaagttaaatcctgtcaaacaaaattcccaaacacgtacgggtgtattttcgtatgaatttaaaaagcttttttgtaccgttggcttgagcttatgttaaaaatgtgtcacacttgcgtgtggtttgcgtgcgcaccttttgtataatacgtaaacaaattaggaggaaacaatggaaaacttaatacatgttccacattactttccatcccaatcgaagtataacttattatatgactcgcggtgctcataaatcgcaaaataagcaacttatccaaagcaacctcttaaattgccgtcgacatctcattgacaccgactgcaatcccatttctgaagatgaaaacaacacctttaaataaggatagcacgttttacatgtgtagacataggaaagttctagaaccatgcaaacaaaaaacttagactcattcagatttgaacttttctctatctatatatatttttaaccgggtccaatctattttttttttgcgaaaaatctaagaaagtgtgaactgctctctagcctagatctaatagaatgatggaaaaccttacatttttttttttcgaaagaagtaggtgcggattgtatccaacattttgcatgagcatgacttacaaaatgaaatctagaggcacgattggaaccaaagaatttactttgttttaaccattttggagctttatccagcatagaaatgaaaacttacagcttgctgtccatttcatttctcctgattattttcttcgtttcttttctgctataggaggcataatactcgactacccatcagaactgttcttgggtatcgaaagatgtttgcagaacctgttttgtactaaaaannnnnnnnnnnnnnnnnnnnnnnnnnnnnnnnnnnnnnnnnnnnnnnnnnnnnn

SEQ ID NO: 61598 - DNA, 4691 bp, Oryza sativa
acatcaatgccacgtaggcgaaaaaccagttgaaaaaccattcgagggtgtaaagtgaatggtattgaaagttcgagggtgtattatactcggttttgtagtttgggggtgtaatttgtaccagcataagagttcgagggtgtaaaatggacttatcccaaaaaaaaaaaaaatctcttctcgtcgtcctcttctccaaccacgcgctcacgccgccagccggccaccgcttatccccttctccagccgagcgcgccgtctctctcctcgccgcgccgccgcgctctcgtcgtcgccgccggtggcttccggaccttcctgggtgggtgaggagatcccccacctcctccgccgccgctcatcctgctgcttccgccgcatccgttacgcacatcctctttcccatctctctctctctctctctctttacccacgcatttttcttctcgaatttgcgttaaccctagcttctgttctagaaatttgccttaaccttaatactaataacagtttgatggctcccaaaaaggtttgggggttcaactgagcagattctgttcttgttttggcgtgtatgcatgcatgtgcggcgtttttaccagttttcaatctctgaaatggatatgtgacctttatttcttctgaaaacagatagctaaaactgtccgtacgcattgtccgtgagggtaatagatgatttgctagtttggtgaacaggaatttgcagtgatttttttcatggagatacttcacaataacggtatgttcattattgtttcaaatagccttgctttctttgtagtttcatttgtatagctggtttcttatattcaactttggatccttaattcaggtttttgcgttagcttgatagacatcaacagaatcagaatgaacaagttagtgaaggtactgattctattctatatttaaagttaattttctttcagttacaacagggtggtactttggcttgaaaacaattatgaaatcatgtgtaggttagccatattaagttcttgagtatcctccactttgtaaaggaagttactgatcctactaattggtaaccatcagaagtgcagttataacctgtagcataacatgtaggattgtgtaatttccaaaaaatggcatattcttaaaaatcatgaaaatgttagatatctcattattgatatgtctgctgaagaatcaaggatcttgattgacctaatgaaatggtagcatcagttaacacatgctttattttaacttgaaagctctttgtcctgcatccacccaaatatgaagataaatgatgcatccttgtcattttccattgctgatgtctcaggcagttgggcctgttattattgttccccttcagcctgcacattattgttaactgttttattagcagataatctcacagaactaattgaaactatgttcaagaagctagtattctcataaacaatcctattactatggtggcactcaatactgaatatcacataatggagaaattcctagcagttgttcattattctttcttgtttgcagtaaatcactgttgcaatggaaaatgtttaagcgtattctctttgttcaaatgctgtgatcagttataaattcatcctttattttcttgtctcaggtaggatcccgtcctcgtcaaattgcttggggaatgtcaagaatatgctgtgagcagtctcctggtacttccagcaagagatatgagaggtatcaaagacaaccacagaatgttgatctcccagaattgctcccaaagaagaaaaagaagccatttcctgttccaattaagaagatgttgcaagcttctcgacaagataaaaggcttgcgcgaatgcgaatagagaagcctcttgagcccccaaagaatggtttgcttgttccagagcttattcctgtagcttatgaggtccttgataactggaaggtgctcatcagaggtctctctcaactgttgaatgttggtacagtttatggttgcaggtaactaaggaatgctagcctgttccatcagttgtttacatgtgcaatgatatttgtattttcttgtacataggcatgctttaatatccctgtatgatggtatattttgccaagtatcctgaacttatgtcatctggctggtggtttgtagaaaatgcccccaagtccatgttggtccagttggccaccagatccaagattgctatggaacaggaagccaacgtcggaatagccatcactcttgggtcagaggatccgtcaacgatgttctcatcccgattgaatcttatcatcaatttgacccatttgggtggagagtcaagcatgaaaccaggttttgactatgacaggattccagccatcgttgagctatgcattcaagctggtgttgagttgccacaatacccctcaaggcgacgaactgctcctgtccggatgataggcaagaaagtgatcgaccgtggtgggtttgttgacgggcctaagccacaccgttcagaagactgcatatctctgcttgctgaacttgacacattcagcaaccagcaaggccagtcatcgacgccatcaaatgtggaagagctcgcggagaaaacactgaaagcatacttaaatgtccagcgaggtgttgcacggttgatgaggaaatacacagtaaaaacatgcgggtattgctctgaggttcacgttggtccatggggccacaatgtgaagctctgtggggctttcaagcaccagtggagggacggcaagcatggatggcaggatgcagtggtggacgatgtcatcccgccaaattatgtgtggcatgtccgtgaccccactggccctcctctcagatcctctctaaggagtttctacggcaaagctccagccgtggttgagttgtgcgtgcaggcaggagctgaaatacctgaagagtaccggccgatgatgagagctgatgtcgtcatcccagactcagaagaagctaggttggctgcatgactacatttttctaccctctgcacctcttcagctgtccagagtccacatagaaccaaagggctgtataatataatggtatgactgaaccattatcaatcagagttgcaatagatccatatatgtggtaaaataatcacaccaaaaggtgatcctcgaatatcctgtcttttgtccgccttttcagcgatactgttcaatcatatatttcttatgagccattggttcgtcactttgcaggttaaacgcatgaaccgaggatgcgcggcgacaatgctgaaagtgagaaaggatggccaatggaacatgtatgatgtacatacccattttgtttaatggttgaagctgctttattctttgcctatgctagactgtgaggcacttccgatggctccatacttggccatacagatggcctcccctttgtctgctggtactatgcttaattgtcagctgattccttggattaaactaatcacggcgatttgttcgggtatttgtgcgcttggctgtaattaatcatggactgaaaaaagcaatgcacttgtgcccgtccccagatcaatccggagtatggctacagcctgcatgtaggagtacatcaggttatcagtttagtgtgctgctacttgctatgtgtactactatgtataaaaacaagtcaggagctacttgtactgttgtactgttgctactcagtttgaaacagatcatttaccagagagtaaatttcactttggaccatctttattgaccaaaatttcacattgggctagggctaggctcatgtttttacttaacaccatgtataattaccattgtttgcactttggacctggttttatagttaccattacacgaattgttgtctaggtgcttagcattttacaagaaacaatgatatggaaatttttgccatacaaatatgcttagcgcaagaacaatgattgtaacatgttaaaggatatgctatcagattaatgggacttcattactactacatatgaacattcacaacccttatactagagacaattggagaaatattgagtttaagaactatttttctagaaaagatattacatgttttacaatacccaactgtagtgttagtacaaattgttgaattataagttttctaacacaaaatagaaatgagatcagatctacaatcattatactatgtgtaatttgtgaaacccggtccaaagtgcaaatgatggtaactatatatggtgttaagtgaaaatataagtctaactctagtccaatgtgaaaatttggtaaataaaggttgaccaaagtgaattttactctttaccagattattgtcgttgattatctacttgattataaggattacttaaatattttgagaaatagcttagaacaaaacaatccgtggtaataatccggtgaataagctcatgttcatgctatgttgagctacatgtatcaattggatggtgaagaagcgatgcaaaagatcgatggtatccctgaataacacttttttttctctaaataagttaagtactgcttccatgttcttcctagaagtaaattgcatgaaccctaaaaccatttgcaattacagcttgtgcaaaccagtttgccaactgcccaactaggtctgcttccaacttataactagaggagcaaataggcattgtgatgaaagaacaaccttctgttgcaaacccctt

SEQ ID NO: 61599 - DNA, 3394 bp, Oryza sativa
  unsure (1)..(3394): unsure at all n locations
nnnnnnnnnnnnnnnnnnnnnnnnnnnnnnnnnnnnnnnnnnnnnnnnnnnnnnnnnnnnnttcacttctcctgtgttcttgttgttgttcgtcagagacgctgatcgaatttgtgtttcgtcagagatgcttaattttgtgttcgtgtgcatggattttgtgtttcgtcagagatgctgaattttgtgtttgtgtgcatgggatgttgcaggcgtgctgaggacagagatcaacccgtcgctcgacaaggtgaccgtcgtcggcgacgtggacagcagggtgctcgtcaagaagctctccaaggtcggcaagatcgccgaggtgatggcgccgccgccgtcgtcaacggcggcgccttcggaagaaggcaagaagagcgacggcaatggcggcgagaagccgacctcgccggcggacgagaagagcgccgcgcgcaaggacgaaggcaaggacggcaaaggcgacaagtcgtcgtcggcggcggcgtgcaagcaggaatgcagcaagtgcacggccgggaaggaagccgccgacgaggctggccgcgccggtgggaagacggcgtcgtccaaggacacggtcacagccaagaacagcgacgacgtcgacggcgacaaatccgaaccggcggcggtggcggtggagtaccagtaccaccaccactacagccggccggagccggccatggtggtgccggttcacctcccgtactacgccgcgaacgcgacgccgtactatgccggaggatactacccgatcccgccgccgatgccggcgatgctccgtcaccctcctcagctccggccgcagccgtcacgcttcgacgaggactacttcaacgaggacaacaccgtcggctgccacgtcatgtgaaaccgcaaaacacgccaagctcctcctggctcccgccatgtacaaccgatcgatcaccaagaaatcagcgaccaccattcgtttcttcaatctcaacacacacacacacactcttcagaatgcatttgccgtttaatcaaatcaaccaaacaaacaaaacagcaattaactcgaattcgatcatccgtcatcttcttcctccctctctttctactccttaaaaaaaaagaaagaagaagaaagagaggagggcgtctcgggtgtgttcgctgctgatgcatggaaatatatcatctaaccatggaaaacagagcagttcattagcgtgtgattaattaagtattagctatttttttaaaaaaaatcaatatgattttttaattaaattttgtacaatttttttttataaaaaacgtaccatttagcaatttaaaaaacgtgcacccttgagtccgaacacacccgaatcaatcaaccaaccggcaaccgaccgacgaaagaacaagccagaaagccggctgttgcacgattccgtcactgctgctggcgtcctggcctactctgtacccggattcgtgcatgcgatccaggccagcaaaggacgaacggccggcgacgagcgaacgccatatggtatatgaaaaagatcgccgaatatatgatgccgcgctcgcccgcccgcacgcacgcgccgagccttttgtttattcgggggacggcgtcgccaccggctttgcgcttgcttgcgcgcggatgagactggagagttgatacgagccaaatttcgcacctcagattatcaatagcgacaaccaaaatttcaacttaaaaacagtaaatttcataaaactgtaactatagtgataaaacttgcgacctatttcagtttactgcaacgatagcgcaaaaaaatatcataaaactgtaacttttatgtgacccaaacttaaagttgacacatacatgtcttgtagtagcactggcacaccacataaaagctacaaatttgcttatcgttgcagtaaactgaaatatgttattaatgctgcagtaaactgatagtcttatacaggtttctgcaatttactcgtttaaaaacctaattttataattgatatgattttatgattttttttagcttttaagacgaaaaaaactcgtatgtggagtatattttatctataaattaattttaattgttaataagcgttacggcttatgagtgaaattataggcgaggcgagcgataaagttgggcgagggggggatcaggggtaggtagcccgctgctgccgccgcgctgctttttgccgaattctctctgttggctcattctacgctcgtactagctcgggattcctccactgaaactggccatgagcttagctgcaaaattcgacgatctctgcactccaaattcgatgatctctcgctcgcacgaatgattgaattgacccgtcgattttgctgttgcaacgaccggaataaagcgtgtggggggcggcggcaaaaaccgggaccgcacgtacgttggtacacaacacctatagcataagtctctcccagatgtactaaattttctttgagagggactaaagtcgctccttcccaaacaccacataagtttaagtatgttttagtttccaactttttcttcaaacttttaacttttccatcacatcaaaactttcttactcacaccaacttccaatttttttattcaaatttttaattttggtgtggaactaaacacaaccttaagctaagtgggcggttttctgaatttacaatgggggtggtgctctgtggagggaatgatgatgataggtttaggtaaatttaatcgggatactagcagatttgcagggagtcaaggcgtgatcgcatcaaattcgatccaaaagctggggacttgttagtgaaaaaaagagattcaaatcagagcatggaattttcgcataagaaattgcatggtgttccaggaatttctgtagtgcgattgtttaggtgaacaaaataaacgcttaagttaagtctacgcgttttataattaaaaaaaaacagtctaaggtttttcttttccaggtttggtactccttccggatggagggaattttaacagaattgttcgctgtaatggaacagattcttgtaaatgttttttgaaatttttgtattcttaaagatcccttgtttgacatacagtaatgtttgtttaaaaagacagaaattacgtaaaccatctcaattgtcatccttattttgaaatttcacctcataatccattttattttttttaagaaaacaccctccacattgcgaagctgaaattactctccacccccagctacccctgcacatgtgtagctgttttggcctattttttctagcttggatccgtgacaggccatatctatgaggtcgggctcatcgagcatagcaacatcattctttaaatagctaatatccactggatatgtaaagctcaaatgcaagtatgatatttattatcactcctaa

SEQ ID NO: 61600 - DNA, 2452 bp, Oryza sativa
  unsure (1)..(2452): unsure at all n locations
tgtagctgttttggcctattttttctagcttggatccgtgacaggccatatctatgaggtcgggctcatctagcatagcaacatcattctttagatagctaatatccactggatatctaaagctcaaatgcaagtatgatatttattatcactcctaaaacctatatgcaaatatgtcacatcaatccattaaacacataaaaacatgcaagcatatagtaattatatctacaatttatttcattttagaactaacatatacatgataaatcatcattcttaagtcattttcataatattttaatccaaattatttcattatttctcctatatctaacatatatcctgtaacaaagcacggtgcatcatctagttctttagataagaacaagcttgacttagctgataatggcctgcgacatatccacgtcgaaagaaatgagccgaatcaactactggtgggtagggttttgcaacaaaataagagtgatggtttatgtaattatgtcttttaagaaaaattgcatggtgacccgcgcatattgcacggctagcatcgttatattttttatacatatatatttacattttattataaaaatatgttaaaacggtaacataattctaaattttgtactatcttgatcaaactgaccaatgtgtaattgtatatacgtgagagttattaattatttttaattctaaattttagttatttctaaattgtattctgatatggaatttttttacaaaatgtatggcatgagtattaaaaaagtattgtgtgataatgatcagaggaattgtgtgattggttgagaagagtatatgaaggagaatagttgtgtcccaaaatataagtgagaatgatcgaagaaagtgtgtgatcgattgagaagataaagtatctgaaggaaaatagttatgtcccaaaatgtaagattttttaggttagcacgagtattatgaaagttcgatgatgcattatacccggttttgtagttcgggggtgtattttggacaagcataagagttcgagggtgtaaaatggacttctccctttttttttccttccacggccaaaataggcctcgttttacgggtccaaattccagcccatgtatatctctttttttaaggaataagttcatctgtggtcccttaacttgttgatgaatccgattttcatccttcaaccgcaaaaccagatatagtgggtccctcaactgtcaaaaccagtgcagaagaggtccattagcggtttggacagcggttttgtctgacgtggcgcctgcatggctaatttgacttggttttcagctgatgtggcaatgacgtttcgcttatgtggcaatttgttccagaaaaataataaacctcatgggacccacaggccagtgccacacacaaattaataaaaaaaattggtggggccatgtgggccccacaagccattttccctctcttcaattctctctcccttctcatctactgcgacggtggcacgggtgaggaggggcggtggcggggcggagcaaaggggctccgggcggagccctcacgacggccacgccctctccggcggggcgtcggcggtggcggcctcctccggcgagggtaaattcccggctccgacgtctgaccccgcatccgccgatcagcgcaccaccaagctctcctcccccttcgccgaaagccacggccacctcaggcccacccctccctcctccccgccgcgtcgcatccccgtctcaccgccactcgacgatgttcgccgcagcctctacctcttccgcaacccccagccctcatccggcgcgacctccgccaccgcctcctggaaccccagcccctccttcgtcgacatcttccacgccaggccggcccctccgaccggccgcgctgcgaccaaagatctgaagacgaacaactgtaatgatacatctgattttgctgttcttgtttcttgtttagtcgacattggtgaatgcctgatgaaactaatggataacctttggttactgatgatgccgtggttgcatttggtttgctagtggctgcagcacagagtgtgtcggttttgatggcctttggctctcaggccataacgacgtacttgctgggaaaaccgcaacagcagttggtggagagggtgagctgggagtgttgtacatttgatgcattttgttgtttagatgaaatcgcagtgaacagcagattggttggctcgcggggcccttcgccgtcgccgtcgacctcctcgcgccgctattcaccgctgcggcatagacctgccaacgccgtggtgttcgacggcgtcctcccgtgggctgccaccgcggcggctgggctccgcatcccgcggtacgcgttcacggggatggggtgcttcgcgctctcggtgcagcgagcactgctgnnnnnnnnnnnnnnnnnnnnnnnnnnnnnnnnn

SEQ ID NO: 61601 - DNA, 771 bp, Oryza sativa
gaggatccccggctacatagaatctgcagcatggttgcactcttagctttgaccttaggctattacttcattagtggacaagaatgtcaaatgctgaaaaaaaaggcataaaacttctcgacaacgtcgatagtatataactcacttgggttaattgattgtttccgggaaatgcctgctgttgcatggttggaagtgaggaagcctacagtaagccacaagaagctgatgaatacgatacttcaatagaatgagatatattttttaaagtaatagatgatcacatacctgaccaaactgattcaaattgttatgaagattctctgaggtaccaagcccatagctctgaccaagtatataatgcccctgaacaaggaaatcaacacctgtaataaataactgttccacagtgatgaaaggaacatctaaaaaaaatactgtcttgaagaaaaatcaacctgcattaattgatctgggaggaactgatttggagaattccttgcttctgactgcctgttgtctggtgtcatattcagttctccatctcttgttccagtggctgcttcatcagggtgccttgtgtctagcaacaaaagaaaatttacaaatttaattttgcaattataaacagttagaacttgaaatccacaaaaaaattggagtcccaccttttcttgttttctgcattttattagttaccacagcacttttatggcgataaacttcagtcttcttctttccagtagatttctcaacttcattgctactatt

SEQ ID NO: 61602 - DNA, 2223 bp, Oryza sativa
  unsure (1)..(2223): unsure at all n locations
nnnnnnnnnnnnnnnnnnnnnnnnnnnnnnnnnnnnnnnnnnnnnnnnnnnnnnnnnnnnnnaatatttgccggttatatggcaaggcccaattttcccgatcttcatacaacttagttaaccattcctctcctttgaggctgtacttcttgattatcacattccatatctcatcaaactcctggtcatcctcgatatcaaacatgcagtggtgaaaatcatgtgtgaattcctcaagagtattaaaaacatgttctaaggacttaaaagcattctggtatatttgccacacacaagaacggtgaattgtaccaggccaggtgagactcagggcttccttcaaagcagcagatcgatctgtcaatatcgtctttggctgtttcccacacatggcactcttaaaggtctcgagaagccacttgaaagattcaacagtttcatcatacagaaaagcagagccaaatatgattgtttgcctatgatggttcatacccaaaaacaaagctaagggttttctgcagtcatttgatctgtgtgttgtgtcaaagcagatcacatcacagaaataatgatagtctactattgatcttgcatcagcccagaagacatttgttgctttatcattttcatccacctgaatggcatagtaaaaagagggattatcactcttcattcttcgaaaataatccattagagctccaaggtcctctgaattcatgtgtgttgaagacttggcccgaatgtaattcttgcatcctggaggaatgttactagcatttcggtttcctggttgaaccttggtcaacactctctctgacttcagcatatctatatcaaatggtgcagcaagctggtgattgtgatcttccacaaattctgctacccggtacttgccattggataccaattttatagctatccgtgcaggacaacctgtcctagtctctgggcgaggtcttttggcctcattctttgagcgaaatccctccctagagcatacaaagacccttgacctagcaacatttttcaccgttttatcccacaatccttttcgaacactgaatcctacatttccagcataactagcataatactcatatgctttctcttcattctcgaaaaccattccaactatgggcactcctccagcgttagcaataacttctggcggcacctctggatcttcttctggtttatctacagtctgggaggaaacgataacgtaagtgcagacaaatacacaatgtcatacatctaccacagcatcaaagtgcttcttggtcatttgtaccaagaatgtttttccctaccggtattctgtaaaaatcctaaaatcagactccatttgacatgattgtgcaccaatgctactaactccaagacatgctgaactcaatgcgcatctacattagcctacttgacacttgcaatatccaaccatgaaagccgggttttcagaagccgttggtgttggtgtagaagccgggttatataaattcccattatctaaaaaacaaccatgaaatgcgccacatggaacacacgaaatctctcaaacaattctctgagaaatcaatcagaaaccatggatccccggtctatataccttggcgccctccttgccgaggaactgccctctcgcaccccgccgcctccgctccgcgagagcctgcctcgatggggcctgcagccaacaatggcgccatcaaaaaataatactaataatgatcaaatttctatccatctttaacctaaactcaaacgcgaattcttccttcttggcgatgatatggatcgaggagctcaccttggcggtggcgcgcttgacgcccttttggccgctccgcttctgcatgtagcggaggacgatgtcgcggcgctcctcgtgcgtgtagcgggagacccggacgccgagctcgcggaggagccgcgtggtcgtgggctgcgccgccgacgatggggtcgccgccgccttcccgccgccgtccttcccgtctccggcatcgggggcgccttggccggcggcggcggcggcgggcttggggtggctcttgggagcggcgcggcgcttcttggggttggaggagaggtcgaggtaggtgcgcacgatgtgggatatgcgggacgccggctgccgtggctgcgcggatgctgaggacgacggcgtgggctcgccggcggcggcggtggggtcgccggaggtggaggcggtggccatggtgg

SEQ ID NO: 61603 - DNA, 3996 bp, Oryza sativa
gatccccatttgttgataattacttcatacttcgtattggggatttaggacttgcaaaatacttgaacaacattacgttctctcagttgacatcactttgtagttcgtcatatataggagtatgcctatgtaatgttatagtttatgtaaagtatagcaagatttgtcttggttcacacacactaaacaaacttcatgtcagcctcttgtacgactttgttctaagctatccgttaagtttatttttttaaaaaaatatttaatttattcatataataaagttgaaaatccatgtcaataatctatttcaatatgaccattcttcacaaaacaaaaatcacaactgcaatcagtgcaattctagcaattactttgttcatcagacaaggagaacaagcaatacatactatcattgcctgaactcttttaaggcaatacatgtttttttgacacggattaaggcaatacaccgtgtcaaaaaagagcagtttagtacttgttaacacagatacaaaagagcagtttttgagtattatacaactttctgcatggaggacacctcaagaaatccgcaggaacacaggaagtgctacaatggaatgtgcatgtatgcttaattacacagaccaaaatttgccataggtgtaatatttcagttcccagatccctgttttgggatgcatgactgggtccatttacatagtgatattgaggatggccagcttaaattataatgatctatttacaaatctctggcaatttgttgtttacgtctatgaaagaacaacgattatcttccaacagttacatacttcctgaaaataagtggcgtgaaatagacattgttagtccatcagaacatgaaatgccgccttaacagagaaatcagaattcgggagtaaaacaacctgcttgtttaagagacaaaaatagactgaagcctgtgacaagcattcaagaatggttgcggttaagcatattctggaaagaaatgtacaaatctttatgttctgttccaaaaatctcttctgcctttgagagagtgtcctgcgcaaattcatcaagtacaacaagaaaatcatgtttacatattttcgcagaaaataaccaactgaaaagtcaacaattataaacgggcaatatgctacctctcgtgattgtttctgagcattgaactccttgatgttagctaaaaatgccccaaattgctcatacgaaagtcgtgtcctgggatttgtgtccagaagtgttaggatggaatcgaaatattaattttcacataaggtgaacagcataataaccaaccgtgcttgccggaaaaattcctttccgtctatacggggccgccctggaaacataaaagattttgtattatcagcatatgcatgttcaacaaatctccccaaatgaaaataagattcaacaactcccaaacctgcgaacgaacgatgctgaggaggggaggtgggtgctgaatactgatggcttgacgatccatgccatgatgaaaatgttgagtggacttctgacagagattttgtaggtgatgttggaccagataagaacttaggtgttgaaccaggagttaatttaggagctgtgtatggtgtgactgagaactgatgttctgtaaatgtttcatagcaagtatatgctgatataagatgtgataagttgataatattcaggtgttcgataagagtaagttattataaccaccttgggctgattcagtcattgtggatctgctggaactatctgcagaagtgcgactacttgaaacttcatctgccaagtaaaaaatagtgaaaccaaggaagatgcatgcaattctggctattacttgaagaaaagacaatattataggatttccgatgaggttgaacaatacctttccaagagggaactcgagcagtcaaattgttgtttgcatcaaaatcacggtcatcacctatttctgacaattgctgcaagattatgcaaataaaattatttacgcacatgagcaacttcagaaaagcacagcatgaaatattcaacatatagaagcattttcataagtaatactcactaataaattgtcttcactcagtgacttcatcaactgcttcttaaatgcttccaactgcatagaaagagtgatcttcaacaagcagccaactaacatacaaattttttaatgctgataaaaaaaaacttgacaaacttcatgtcgattagcattctgacaaaatcataccaacaaatatgaccatttagggcaagaattcgagaataatttgaaagccacaaagggtgggtaaacttagcagttatagcttccacaccacagtgagtcagtgacaacaaagcattagttagtcgttgatcctgttcttgtttcttttgaagtataatatctggcaaaaaagggtgaccttctagaaacttcttttttcataattgtggactctttaacaccaagtcattctgctattccattgtaatgcacaccaaagattatacatttgaacaaaattcctgactcactattaatctacaactaacaattaaaagatattccatctgatcccataaaacttcggtacacggttgaccaacctatgcaaactgcctactactatgattctaggaacacctgcaagaaaatcacatatctagcaagctagcaaactaacactgaaagtacatgggttgagacatgattccagcaagttttgcacgaaataaacaggcgagctatcaatcagagcacggataaaaacccactagctccctagtataagcagcaattgaaacttgaaaccgaacaccatgttgagaaatcacagaattctcactaaaattgggataattgagtcaccttcgccaagttcctcgccatcttcttggccgtggaggcgagcgagtccctctccttcgccagcttcgcctgcacaccacgaatcgaacacaaaccaaactgagtacgcatcccaattctgctgccgaaagcatcccagcgacgcgaggtcccaggggctcacgttctcgtcgagggcggcgaggaggcgggcgtcggagtccgcgaggcgggcgcggaggtcggcctcggcgcggtcccggtcggcgaggtcgcggcggaggcgcgccgcgtcggcctcgaggcgggagacgcgggaggcgatggccatggaggtgatcttccgcgccacgtccagctgctcgtacgggtcggtggggatcacagccaggatctcgtcgggcaggtggaagtccaccaccccggccgccgcctcgtgcctcgccatcgccgccacgcgcgccccacgagacggagcagctcggccggtcagttcctggacggcggcggcggcggcggaggttgctgcggtggtcgccggcggcggcgcagagcaagactggaaattaaagttttttttttctgatttttaattctttttggggatttgatggggataggatggctgtatatacctgtatactgcggggtcgttgagttgggacttccaagtcattttctcacacatatatgctcttcatttcctcttattaattctccattttctaattttatttttttttgttcatcaatgtgatagttgagggttggtacttggtaggagtgacctgtataaaaaaaatatagagagagagtatatgctttgatggctcttgtctggaattgtgttaaattaaaggtgtactagtaagagatactcttataaaatagttatatctttttaaaaaatgaaatgcacatgagaataccagaatattttgtcttttcatacatgatatggtagtataccttttttttttttttggcgagaggtagatacaggcatactaacctgactgaaaagaaaaatagaaagaaagagagaagaatgggctacatcatttctcgttgcaaaccacatttctgggctagggcccagtatggttggtgggcctaacacattcggcccggtgcgtcagagtgaatgcccaggt

SEQ ID NO: 61604 - DNA, 922 bp, Oryza sativa
  unsure (1)..(922): unsure at all n locations
actagttttgttcattatgcgatagagtgagtagtacatactaggagctttatcggttttttaaaaaataagtcaaagcagaaataattttggagttgatttttaagatatttttgatgtagtttatttttttatagacttttaagttattagaaacatatattaaaattgtatacgtacattattttttggacattaataagctcttatgatttgtaattaacttttagacaactgatgagactctcctgcaaggctgcaatccaggcctgtaagaagaaatggttcaaattactacctagataggctagattgcttattgctacctgctcgaaatcgaatacagtagctcattagtactttgcttgtgttacacgtcttattttccaatttggacataacacggggatctaacagaaaaaaggccacatcccaaattctggacttcccaattattcctacccaagatgactccacgcggcaggttgccaacgtccacttgactcgtgtaaactcctcatgtcccactttgtccctcttagcgcaacaaaattgctgccggagcacacagaaacttgccatccgtcaggggcaaaatcgtattttcgcacataattctcgtgcccaagcaaaattcacctgcgcgccctcctcctataactacccctcgctgccatcttcgatcccctcctcctcctcctctgctctagcgaaagccgagagagagagagaaaaaaatccgtcacgaaatccacacgcttctgagttctgatctgtgggttcgagttcacggcggagatggccggtcgcggtggccgcgacccccggagaggctacgacggcggctacgggtacccgagannnnnnnnnnnnnnnnnnnnnnnnnnnnnnnnnnnnnnnnnnnnnnnnnnnnnnnnnnnnn

SEQ ID NO: 61605 - DNA, 1140 bp, Oryza sativa
tctgtcaagcctttaacagtgtacttctcctcagtcttcctgtgacttacagtaacacacaggcctttgagcgcattgttcaattttttcaattggtcttccaagagcgggtattccatgaacttcatagtcttaacaaggtccaacacagatccagctttccaacatggcaaaaccgaatagtccacacacaggatcagccctttctgagtgcatttaaggctctgctgggttcctttgagagctacaatattgctatcactgatggcctcactgccgctctgcgggtaaaatccctgaccaaggacaatcttgccgaagctagatgcctcacgcacaatgacatcaaggccctgcatgacatctctaggcccaggccgctgctccaagagttggcttaaaggcagcggcttcttcaacttcactgatacaatgtaggtccgtgaactgtccttcacacggaatttgctcacagggactatgcagtcttctggtagttcagcacaagtgtataaatttctctctccatcataagcaacagctgacgaaagctcctgaaggctctcgtgctcgaagagctcattcttgactgtaagaagctctgcctttgagagctttctgttgggaccgtcaccaagcttgattcgtatttcatagtgaaaaaaggttgattcctttgggtagtcgactgaaaaatggttcaccaacaatttgacctcgcctttagataatggacctccaccaccaggtggtcttgccattggcctatgtttggtaggtggttcttctcttttattcttgttactggaagcaattggggttgccggtggttcttctttttcatcctcaccgtagggaatgcgctctaaaggaaacggaagagtggttagaaacagagaatgtcaagtttacacaagcaaacccaccaactcaacgtgtagttaaacttaaaactagaacagaagggatcaccaatctgtagatcgatattccccctaaagtaatatgattcacattcaagcaaggaattactcttcctatgaattttctgaaatctaaatgcagccctgcctctagaaaaaaaaatgttgatggtacgtgacgtcaacaaaaaaaaattgatcgtatattcagattcac

SEQ ID NO: 61606 - DNA, 718 bp, Oryza sativa
gtgtcactgtaaatcataggaggacaaagcagaagttcattgataaaggtttgactgatatacctgcaagtcacataactattgtagattctgaatcaggacagaccaagaaactttttgattactattagcagcagtatggcaaggttattgagtatcaaatgcttccatgcttggatttgagcaagagcaaggacaagcaaaactatgtgccgattgaattgtgtgatcttcttgaacggcagagatacccaaaagcaagcttaaataggaattctgataaaacactgaaagaaatggctttgatccctgcctcaagtagaaaggacgagattctggagttggtgaatgctgacgatgggccttgcaggtaactgtttcaacttttgagttccaactatttccactgtttgcaaacgcctaattgatcttgaaacttaacatgttgctatgattaattagtagtagtggtggtagtacaactatagattcgtggattcaatggaaatacttctctgcgtgaacgacctagtaccacaaaacttgggttaatatatgtgtgcgaaacaacaagagacttaactacctcaaatattgtatgggtcaaatggttgactcattgttctccttgtcacatttgtctttctgatatttaactgttattactcatttttttccttgctaagggagaacataaacttaactgatctttgtcatt

SEQ ID NO: 61607 - DNA, 941 bp, Oryza sativa
gtgggcctaacacattcggcccggtgcgtcagagtgaatgcgcgaggtgttgggagcgattagtaccacctcgctggtttgagaggagttggagtcgacgggtggctataaaaggagagcctgggcgactttggggcagcacgcagctgcgcgttgagcataaagcgaactattttttcgcttttacttaggccttgtttagttggggaaatcttttgggttgggatgtacgcgccgcaaatagcagcatacgccaaattttggaggggattctcctaggagggcctctacaattctcaatccgaacatttacgtttttacgaatgattatttgaaagttatcttttttttacgaatgattatttaataaaaagcaatctagaatgttcgaaaccttaggcttaaatgaatcttcattctgttgccccataatgttttaaatttaaatttggggtttgcaagtttttcgagacgtagaatcgtttgtggctgtggccggtacgagactgggcattctgcttcattatttacttttgattacgatttacataacttatccttttagtccattatttacttatgtctttacgattcactaaactggtcctttggagcatatcaaactggctggttcataacatgaggtaattaaacgatgtcccatgacaacacaatgttgtcaatttaactgaaatgaaagatgtctaggaaatattatatagagtaaagttcatcaccggtccctaaacttataccgctgtgtcatcccggtccctaaactcgcaaatcgaccgttcaggtcctcaaacttataccgctgtgtcatcccggtccctaaactcgtaaatagaccgttcaggtccttaaacttgttcaactgtgccatcctggtccctaaacttgcagatcactcgtttagatcctccaacttgttcagttgt

SEQ ID NO: 61608 - DNA, 3541 bp, Oryza sativa
cttgcatgcctgcaggtcgactctagatttttccacataaagtttttagaccatcctgtttaggaaccggggtgacacaactgaacaagttagaggacctaaacgagtgatctacgagtttagggatcaggatgacacagttgaacaagtttgaggacttgaacggtcgatttgcgagtttagggaccgggatgacacaacggtacaaatttagggaccggtgatggactttactctattatacagtacatatggaacaagaatgtgcatggtaggcgcacaggcgacaagagagaacacttttgattctacgatggaccactgttagttaaattccaaggatttctgtacatcagttccctactgtaatccttccctcatttcctccaacctgctcagctcagacttggggatttgccagccaggtttcaaatcctgaaacctgcaagacaatcaaacattcgtgaataaataagaatgaattgcaacgcaaactttagtgttagtttgattttgtgaaaattacctgaacttctgttcacaagatgggaccagtgaattgtgtatctgtgttaccggtgatgctcctctgagttccgggctcccggctaaacatgaaccgactggtatgcacttgttcatcgcaataattcaggatgtgaatgagcaatagagcaagtgagacctcagttagtagtgatgctgtcaaaacattatccacagaccataattttattggtaaacttgtttattcacagaccgcacaccgacagttctgactttgaatttatactgaggaagctcttcttcctcttcatcctcatcttcacttgagtcatcttcaactttgtcccattttgagtaatcaagtcctgaatgtccctttggttttgcgatggtctcccacccttgtggtttttgaggcagactgggaggcacctcaacctttggaggttcagttgcatgtttcttttcaagaataagttcagttgcaggtttcttttcaagaatcagttcagttgcaggtttattttcgacaataagttctgttgtaggtttctttttgagaatcatttcagttgcaggtttatcagacttggtaatacaaatctcgatatttacatttctctctggacgcaactcttgcttatcttcttcaagatataacgattcctcttcagattctggaatgggagctagtgcctataaaggttaaaataacacagataacaggttaacaggcagtaggataataagtaaacaagctaaggtatagtttctttcattcagaaaacatttgtaaataaaggggagaagttatgtgctggtagcaactaaaaagcatatttgaattatgtaaggatatttgttgtagttatatcgaatgaaattgcaactagagtaatgccgatgcaagaagctaaagcaaagtgaatcaattagcacagcaaagagaatgaaaaacttacaagctgtgtcttcagtcgtgcatgaaggttccgatatacttcagatgacggatttatctcaatcagcctgttcacatcaaatagagctgactggtaatccttcagagtgacaagtgtctgtgcacgtaacatgagagctccagcatgctccctatccaactcaaggacagatgtgcactcttctgcagcctacagaattttgaaaagaagaaaaaacacgctggtaaaagtgatgataacatagaaaaataaacaaatgatgtcaggtgccaacttattccggagaaacacacagcctactgcagttttcatcagaccatcaaggcatcaactaccccacaagtatttcagatgaaatgaaccgtaattttgtctcattaactaatgctggtttctaaagggagcatgattttgcccctgtatatagttggtcatcaaaacagaggtttaattatcctacaaatttggatgccgcaattaaactttctccatagaaatcatgcattctatagactattgaaacctaccaggattattagaaagttcattcaaatactcaatagtagcctaatcattcgccaagtggttcactacatcgaaatcgatctgtgccagatcaatttgaactactattattgggaaggaaacacaggtttttcacgaagcaaggcattaggcccagtacatggattgcaaagtgtcactcagcacgaaatttaacaggatttgagctcaatctacagaccaccacaatatagtaaacaagccacgattgatgagagttcgtgttggctataatcgaatctctcatccaaccgaacagattcctgaatctgcttctcctcccgacctccccaaaccagagtttgcacaggtaaatcaaaaaccccgccgttgaactggaatcacaaaccacgactaggcatcgatgactaacaaattaagcctttattactctaaacaacacttggaagcggcaacgggcgctcaaatctactcaagtcaaagaagagagagagagagagagagagagagagagagaaacagaaccctcgagaagcgagaccttgtggaagtcgtggagcttgaggtagcacgcggcgcggttgctgtgcagcgcgatgcgctgcgcgggtccccgcgccgccgccagcgccgccgtgtacagctcgagcgcgtcccggtgtcgccctccccggtagagctcgtgcgcctgctccaccgccgcccccgccatcgccgccggcgaggaagcctcggtgtgctgatttcgggggaggaggaggaggattagatgagagaatcgcgaatttgggggagattacgaggattggaatggaattaattgtggaaattcggatgaggagcggtggggagatttgaatgtggacggacggatcggatggattggatactttagcggtgcgggttgtcgggttgctgcccgcgacggatgcgggttactcccctcctgtgaattgacggatttgcccctgccctcctttcatgcaggaatgacgtgtcgtgtaaccgtgtataaagcattacttcagtgggaaaagaagacaaactcgtttggctgatttgaggaaaaaacgaaaagttgtattaataaatgaaaaataaatttatgaataaagcttttataacgtgtttttaatgattaaaagtaaaggttgaaaataaactacgatgaaaaaaaaaaaaatatccaaaaataaactctgaatttaagattaaaaatttaaattttctgataattataagcgaaaagatgaggacatttgtttcgcggctatcttagaaattagaacgtgtagaatgccataaaaaagtcactatctcaccaaaccgacacctaaatagtaccggagaaacattgcaaccagcagcttagctaacagtatcatcagtcctcgtgcttctaatgatgatattaacaaaagaatatttacacaaaagcaattgctactttgttagcccttcatctgcgtggtgtgtactgtgaaaagggcacaccctcttgcgcattggaggagaaaaagggaaacaaaagaacaaggccaaaggga

SEQ ID NO: 61609 - DNA, 1952 bp, Oryza sativa
cgttgtgttgcagatatggcgaccaagttgatagcagattatgatggtggcccaccggtgaggagtatcaaagcagggtcttgcaactatatcctgtacccaggcagcgcgtgttttcaggacacgtgcaacacgttctgccaacgcatgcaggattcagccacacgacaacgtgtccgcctctggcctctgcacttcccagggatgcgagtgtgtatattgtcctaattaaccaacgttaaatattaaaaaatagagaaagtaactctttaaaaacagaacaatatgtaatgatactgatagttctaaaagaaaaatactgctacactatgagcaaatttgtagttggtgttgggcattgatgcaacaccattgatagttgatactggaaatttaggaaaatagcacaaatgttgctattatcttaaaaacaagaattaaatgagttgctgtttttgtgcctgtgaattctgtgccaaagattttagagactgatcctgaggatgttccagtcatgttgtgaatttcaattctgagctcaagaatgacacaaggccgtacctgacagatttagataattaattattatgtgctttaatcttaaggcaaacttaagaatgatcgatcttaggtttaaaatcgtcagcatgtgcttaccaagaaaagaattgtaaacaaacttatgaatgacaacggccagacttgcatacttaaactaaagctcagtttgtcaaaaagtactacccattgcagttgaaaagtcaagctcgatgatcaatggagcattcccatagccatgaaaatctcaaccggtttacccaaaatttgagcgttcactagttttttctccgtaacaatgtgggttgtaatttgtaaattgattaccataacacaaaggtgttcatcagcgcccagatcatcgacgtcatacttaaaggcatcacgtacgttttgttgggtcaatctgaatctgaatcatcaataatcttcatgttttcttcaggccggtgaattagcagcggtgatccaagccatgaatcccgatgaatacgagaccatcagaccacgatggggacgacgacgatcagagcgagcagaggaggttgcgtcagaattcagaaattggacgtcagagtgcacatggccaacctatcagttcagagaaaacatgccggcttttcgtcagaattaggttcacccatcaacaggttgagacaataatctactggtacaataatgttgcttaattaagttcagtgagaagtagctactgaaattcacaaatgattatcaagcaacagcagattgaacaataagagatggtgaattgtttcagatggccttgtagctaggcctaacgttatacttcagtgatctctcttaattgtaaatctgtcagtatcgatgagttcttgaagtacaattttattattgttgcatccgtgaaattgaagtatacattcagaacacgaggacatattcaaaacagttcgtacatgcacgacagcacgagtgtccaaattctatttcaacatggccaagtaattcatgttctactaactagctcacaaagctaactttttcattaagatggatggtcagactagctaattatcgacaccatgaacacaagaaccaagaccatgcatgcattatcgatccatgtgtattaactagtatatagataagaatcaaatacaatcttgttagttggattagtcaatggctcaatgccaatgagctacaaaaaaagggcttacatgtagttagctgctgaccggatacaaaaggctccagatctccaacattgtgttacctaacgaggatataaactccacaatcctttttttagctttgcatgtgattgtcagctagtatgaagttcaaaaaaaacaaattaatatacaattgcaaacccaaatttaattatattgggtcaactctgtaagctg

SEQ ID NO: 61610 - DNA, 2654 bp, Oryza sativa
aatctataggatttatatttttagatttatcatttttatattatattgtttacatcttgttaagctacatggatttttaaaaattaataatcaaatataaatatatttgatttaagataaacaaaaacgagaagtaatttgaacatagccttatctgtcgcatctaattaaagataattaagatcatagacaaagcggacataagaggagcatctgctctgcgcagatcttaagttctcaactagataagtccatatgattccttgccattatctgaaaaaaatatatatatgcatgattgcttgcgtctgctaactgtctacttgatccatgttggtgtttactgtgcacagcattttcagcgtatattaatcagtttattaattgacaaactcactattgagaacttaagatgacgctggagtagtttgttatagttaaagaatgttatagtcgctcttcaataatggctcttaaaaatatgtgtgaaaaggtcatatatatgcagtgtttgaaattttgggaacgaaatttctggaaatttcggaaattttgccccccaccaaaatgctaacatctcgcccaaatttcggttttttgcaatttttttatgaatttggtcaaattttatttaaatttattcaaaatccgtcaaaaaataaaaaaaattcgtacgaaatttatccgaaattccagaaatttcggttctatcactcagcagcggcagaactgctgcttccgaaatttaaaaccctgtatatatgttcaaacaaagttgaatcgactgccacactttattgatttaaccggtgtagtttaaaagcatatatttgacaaaccattactttttttactgatagaataggcatgatgcacatgagcaggttaatttatgcaattaaccgtgctatcacgaaccacctaataccatgataaattactgtctccatcgctccatggaaaataaaaagaaatgaccaaaggttgatccggagatcaatccagctttataggaaagccaaagacggttcacacaaaatttcaatctcccaaaaacggtgactgattatataattgttccaatagaacatatattctattataagacgctttaacttttttaatcaaatatttttaagtttgattaaatttataggaaaacatagtaacattctcaacgtaaaacaaatattattaatatgtattcaatattatatttaataaaattaatttggtgttgtagctagtgctaaatttttctataactttaatcaaacctataaaagtttgaaaagaaatcatgatgtcttgtaatataaaagaaacaaagaatttactagcaacattcagtagacattagaccatatgaaacatgagacacagaaaggcagtgaaaaaaggaagaagattctacctgtcgatgatcagttgccaactctgatgactgactgaccagtgaccacagccccggttagctggcgatgctgcaagactaatcaagcaaaagtcttgaataatcttttctctggtcctgcttcatgcttgtgtgcatagataaataggtaaaggctggcagaacccagacagaaagcacaagatccgaggagcagatcgaccaaaagtttctgatcccctcttcttctcgcttgcttctctcctactcgatcaatctcgctagagcttcttgcttgctttgatctctcgagcctctagcctagcttagctagctaagctagctactcatcagtgtcctaagtagagttgctagctagctaagcatggcgagcaatggcgaggcgacgacggggagcgagacggcggcgccggcgccggtgccggagccgaccccgccgccgtgccaggggaggctcatcaccgtgctgagcatcgacggcggcggcatccgcggcctcatcccggccaccatcctcgcctgcctcgaggccaagctccaggtatatacgtagcaagaacacacacacactgctgctagctcatcagctgatcagctcagctatggtgaaatcaaatgctgatctgcaaggaacggaacaatcgtgtgttcaacagcgaaaacatagtcgctacaatagagaagagtcaagggatcgatgatatcaaaggggatcgcagaccgtccatcagagatgcattgatgatagtgaatccaataagatgtcgtcccttgactgatcttgatccctattgctacacctaaactatttggaacatctaaatccctggttttaatataaatgatacaaggttttccgtattcggaaaaaaaatatgatgattaatttggtgatgattaattcaggagctggacgggccggaggcgaggatcgcggactacttcgacgtgatcgccgggacgagcaccggggcgctgatcacgtccatgctggcggcgccggacgacgaccggcggccgctcttcgccgccggcgacctcaccaacttctacctcgagaacgggcccaagatcttcccgcagcggaggtgcgtgtcgaatatcgatcgatctctgtctttttttcagagaatcgattcgcgatcgcatcacatgtcgatgatcatatcgctgcatttttgttgaatgctaatgttgattcgttcgtgacgggcatatgcacatgcaggttaattaattc

SEQ ID NO: 61611 - DNA, 2464 bp, Oryza sativa
aaataaaaaaacatatgtgtccacattcatcctacaattagatttattttgggatttgcaatgaacggagtcctcgcactcgccagcttgctccttcttccttcctgtagccttgacgatttagcacgtcagtcctcgatccgccgccggccgacctcgctgtctccgacggccggttctggctgaagtacgcggtgagactgtacattgggtatattccctccgtacttttttttaaaaaagacaaaccctaaatttccatgtcctacgtttgactgtccgtcttattttaaaaaattataaaaaaaaatttaaaagacaagtcacgcataaagtattaatcatgttttatcatctaacaacgatgaaaatactaattataaaaaaatttcatataatacggacagtcaaacgttggacacggaaacccagagtttgtcttttttttaggatagatggagtaccaccaatgggagtgaagaaaggttagggcatggggccgactaacctcctgcctagttataccgccgcagtctatagtataattaagtggtagtagtaaatatgtgtatataatactgtatgtcgttatcggctgtcgtcatatttataattgtgtattgtacaagtattaatgttgggtgtggtttctactaacggaatctcttttacgtgtatatttcgatatcattttgaccctataaagatccaatatttcttaacaatctgcttggttggcacacctatttccttaagcacgccataatttttttctttttactagcacgcctaacatttggctggtaaaaatggagccaccccctttagctaaaggaagataacattgccacattcttctgtgccattgacatatggggcctacctaatgaggaatgaatcttgctgcaaagtgtgacaacatatagcctaacctgattaaacttatctaacattttttatggcaagatgaggcaaaagtggccccgaaactaaacatagccctgaacgcctttgactctcgtaggttgtttcttgccatctcaacaaatcacatatgcaccatatatttcaactgcacattcaaatgtataattcaaacgtatagtagggtgtagaatgctatatagtctagtgcctagtacgataatactccgtattggattatatggatactgtgtcaattttttaggccgtattcttttggaggggctgggaactcctcccttcacacgcaaaatggagcgatgaattaacgcgtgattaattaagtattagcttaaaaaattttaaaatgtatttcttataaaaacaatatcatttctatttaaccataagacctgacgcacaaaaacaacttgttccccctccggtttcttttggctaaataatctaccttcgctctaagcgaaatatgaagaaaccaaaaaaattattcatgggcggcatacctacactagataaggtcgtatacgtcaattaggctaagaaacactctctttatttgtgtttgcgaaaaacactctctttatttcagaaaaaaaaaacttttgtatattaaggtagacattggtaatgcccaaattcgtattcaaatattggtttattataggatagagggagaatccacattgacacaaatccaacctaaaattatcctaatattatgtaagatgcacattttctagttattattattattttcagaacatagtataaatgcaaacactcgtatgcacacgcacactcatcctgaacgtgcccatacacatgacacatcctactcctattgacacatccaaaaaactgagccgacatacattaagactgataaagtcactacatgacccgtacaatcgaagggtataccacctttcactaaaagaataaatagttgtaaatatgagcatctgtgtaaagtcctagtacgtgaaattggatggacaggttacataacctaaccctgggttcaaaattttggttttatcgaccccccctcccccaatgacattattttggccaaaattttaaacattttatttttttttgtgaatttgacaatattttgttcaaatttgactaaattttgtttgaaaatcaaataatttcagaccggagtttctgaaatttcggtatattggcacccctaatacaaatgccaaaaacgattgattaaactctgacctgaccaactatgcccagctcgtgtttttctattattaattagaagagattcgtaggttatcccaattctttgtcatatgtatactaagggggtgtttaaatgggtcaaactttttagcccatgtcacatcggatgtttggacactaatttagagtattaaacatagactaataaaaaaactaatttcataaatgagagctaatccccaatacgaattttttaagcctaattaatccataattatcaaaaatttactgtagcatcacattgtcaaaatcatgt

SEQ ID NO: 61612 - DNA, 1071 bp, Oryza sativa
  unsure (1)..(1071): unsure at all n locations
gaggaggggcgcggctccgtcccttggcggcttgcgcgcggagtggcgggggccgggcgatgacgacggtgatgacgggagggcggcttggagcggggcgacaacaccggcgacaggcgcgcgcaaaggctgacggcgtcggcgaccgggcggtcggccactcggctcgcgcgcgcggcttgcaacaggcggcgtccgcgcgggcgcgcgcacgcgaacacggcgcgcgggaagcggctttgcgagcggggagctcgcgcgaggggagggggcgctcggcgcgggcgactcccgcgcatgcgcgagcagcgtgcgggcgaggctgagcgggggaaaggaaagagcgcgccggggggagagagagagagagagagagagagcgcccgggagagagatgggccgagctggattcggcccatcgaacccgggggaggcaaactagacttttgcggaggaaattgatttggagggatttggattcggaattgaactcgacgattgatcggggattgagatcttgagatggcacggacactagacaacaaacaaagaaacaaatttcgcaattagggtttttaagagataattttcccgctaggcgccacgacggaacgggcgctacaatatatgattataaaaaataataagctgaaaatttgtttttttagataatggaatgaaacatcccggcctttactccaaagagctacagccaattattacaaaaagtaacacacttataaaatcttaattcgagatgaaactatcaaaccaaccaaaattaaaagaaagacctaacatgacaaggaaaacattattccagcctattagaaaatctccatccatggttggcaaaaagttgcataaccgttgactcaagagtacgacatgcaacattcaggaaaactccatcttcctcacacttttgtagttgagcccacaaccgaagccaatatgttgccctgaaaattacttgcatataggaaatagatggtgatttgtcaaaaaccctatcannnnnnnnnnnnnnnnnnnnnnnnnnnnnnnnnnnnnnnnnnnnnnnnnnnnnnn

SEQ ID NO: 61613 - DNA, 1022 bp, Oryza sativa
tggtgtgtgctggaaaggtggcagtggggccaagctcgaaaaggttaggtgttaggccaacggcgaggagaagaagaggaggcgacgattagagtttgtgtgtttgcatgaagtgtttgaaacgaaaattcacaaggtattctaggtttttttttcatatgtagagtaacgctagggagtgacggcgaaggtggtggggtcaagttcaagatattgggagctgtggcggcggaggaggagcgggggactagggtttaggtgtttgcacgaattccaaagcgatccgacgtttcagaattcacaagatatttatgggctattttttttctaaatgtacaatagtcagttacttcatttattcgtctcacattcctaatttccaattaagacagggacctaacagcaaaaaggccaaaccctcccgcgacagaacgggcagtcgggcacgaccgagaccctcgcgcccacgcagcaacctccgtacacacgtcgcacttgacttgcgtggactccaacttcccattttacccctccgtgctcaaccaaattgccactaaaccgctcaccactcactaatctatcaggggcaagatcgtattttgccactaatcccactaatccccctgcgcgcttctcgtataactactccccactgctctcttcgatcccctcttctgctttttagcgaaatccgagaaaaaaattgcctgcaaaaaaaaaaatcgaaacgtcgttctgatcgatcggccgttcgagttcacggcggagatggagcacgagcgcggtggcggtggccgcggccgcgggaggggtcgcggtggcgggcgtggcggcagtggcggcgatggtcgcggaggcggttatggtggtgctggtggtggtggtgtcggcgggcgcggtgggcgtgggcctcctggtggtggtggtggacgccggtacgagcccggcggcgggcgtgggtactgtggccgcggccgccgtggtggacgtgggtatggcggcggacgcggccgtggtgggta

SEQ ID NO: 61614 - DNA, 2131 bp, Oryza sativa
ggcccgggtggacgcttgaaaagctgttggccgggtgccaatcttgtttcaaatctaaagactgatacattgcacatactgcgaccggacaagacgcactgtctcatgcgtgtcgtttgagaagcactcacttagtcgttttcgaaaaaaggagttcaaataaaatcaattgcaaaaacaccagcctctccttgaagccggcattaacacttatttcccctggcttgctgagtacccccatactcacccttgctctgtataaataatcccccccagttgctgaagaagatgaagcggatcctgctgatgaggagttcttccaggagcaagccggctacgatgagttttagggtttcggcctagttcccaagtcgcgcctgtgatgattggtccaagtcctggcttccgctttccttttgtaatgcagttgtgagctcgggatctgtccgtagcccaacatgactgtactcctactctataataaagagacctctgttgctgtgatattctgtctccctgtgataccagcactgtttcctaggactggtatcgattaacaggttaatttgaaacgtcacgggctagttccggtcgggactatttcggggcgtgacaagagatggtatcagagcacaggcttggccctagggcgaaacccgacgcttaggacgaccctaaggatactaagttcaaaactacttgcgaaaagctaaggtttcttttgttttctttattttcaatagtttgtttctaaaatggttactgatctttctccctctttcaaaattgtagatggaagtgaacgccagcttcagttcccacggttttggtgagggtcaccacgtcgcccagcttcgtgacctcgcccgtttccttggcttctcgtgtcccgagtacacggggtactccgtggaccgtgttccccctcactgtgagctctctgtgtacctttaccctcgtggaggtatacacggagctggccttcgcccccaccacttcactgtggccaggcccactctccagatcgcgtaccaggacctctcctggaatgcgcttcgtcgcctggcccacgactacagccaccgtctcggaggttccgccttccggcagcttccacgccttccttctggccactcagacgccaggtacccttgtccgtacagcgagtctcagccagtgctgactcgcatggtcgagctttcggaggctcaggccactcagcacgacctactccttgaggcttaccgctcccttgcccgccgctacgccactttggaggcccgtctggccgaggagggtgtcacctcagttgacactatctcttgggactcaggccgcctctgccacgccagccacctgtcctcccatagctcccgcggctctgctcgcactcccagtggcccgcgctcccccagctcgcgtgcgccgtactcaccagtgtactccccctacccacacccagttagcccttcctacacccccggacacactccagttgcttcctcccgccgtggcccacgctttatccgcactgcacggaagcgtgttgttggttcttccaccgtgttccgtttccgccacccagctcccccaccgccagcggcccgtgctgctgccggccctcgacaggttccgccggtcccttcgcgccagccgatcgacgtttcttcgactgaggagccgactacagggggcagccaggccgacgaggagtagaggaggcagtcttcagcagccgtccgtgtgttaggcccttttgttccgccgccaactcttttggagtcgtggcgaggtagcgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagttgtgcctagtgtgtgctatctgagttgctatttgctttgctccttgccctcctaagtgcttatctgactcttaccccgcccttttctgggagtttagatggctagccgcccccgccgtgcagctcgtgcaccagcccgctttggttttgaagatggtagagttgaagcagagcaaatcatgaatcagctaatgagca

SEQ ID NO: 61615 - DNA, 5149 bp, Oryza sativa
ctcctaggtggtgtgcgcacagtcaagctcggcgtagctctgtgacttgtccacacccgttgtatcaggtgtttttatgatttgaaaaatccagttgtgcctagtgtgtgctatctgagttgctatttgctttgctccttgccctcctaagtgcttatctgactcttaccccgcccttttctgggagtttagatggctagccgcccccgccgtgcagctcgtgcaccagcccgctttggttttgaagatggtagagttgaagcagaagcaaatcatgaatcagctaatgagcagtctcaccgcagcaaccgttcgcaccgtactgtttcccgcaacgcagaggttgagcaaccccgccgcagcagccgctcgcatcgcacagtttcccgtgatgcagagatggagcagtctcacctctctcactgcactgtcagtcacaattctggagaagaacgcctcccttccccacctcatgtggaaaacaacatgcaacacataatggcagttcagacacaaatcttgcaaggactaaccacagccatagccagttttcagcataatgtgcatggccaccctcacgtgggcaacaatagatccaagctgacagactttctgaggtcacgtccgccagagttctctcagaccgtcgagcccgtcgaggctgacgattggttgaaagatgttgatagaaaactcaacttagtgcagtgtactcctgttgagaagacgctctacgcctctcaccagctaagaggacctgccgcagattggtgggaaaattactgcaatgcacatcctgaacccaataacattgcttgggatgagtttgctacggctttccgtgcagctcatgtgcctgaaagcactattgacatgaagaaagaagaattcaacagacttaagcaaggcaacaacagtgtcaatgagtacctaagtcagttcaacaagttggctcggtacgcccctgaggaagtagacaccgataagaagaagatcaggaaattcttgaagggaatcgcagttggaatgagactccagttgcttgctcatgacttccccacttttcaacatatgatcaacaaggcacttctgcttgaggatgccagaaaagaggctaccgaagaatacaagaaacgcaagtctaaccatcagggaaattcttcccgaggcgcacctcgccctcgctacggtcaacccatgcaataccaccagtcgatcactcaaactaaccgccagccaggctacgcccctcgtcctcagataaaccgtccggcacctccgccacagcagcgtgcccctagtggcaatactgcgccaaacagtgttacctctttcaagtcaccacagggaccgtcagcagttcagtgtttccggtgcaaccagatgggtcactatgctagacagtgtcctcagaatcctgccaacaccaactcagggcatgctaatggcagcaccgccagaactcctactccagcggcagctcagtctcgtcctagctctcaggcaagtggacaaggttctcgtgcttccaaccactttggtcgaggacgtgtgaatcacattcaagctgaaaccgctcaggatgctccagacgttgtgatgggtatgttctctgtcaactccgtacccgcaatagttctatttgattcaggagcttcccattctttcatatcacaagcttttgtgaaaagaaacggttggaaaacccaaaatttgcgtgtaccaatgatagtacattcccctgggaggaatataagggcaattcaaatatgcccggaagttaaccttagaattgaggaagttgacttcctagccaaaccgatagtcctagactcgcaaagcttggacatcatcctagggatggattggttggctaagcacaaaggacagatagattgtgccgaaaagtccatcaccttgcaaggacctggaggaaagcaagtccgctttacccctaacacccctaccgcaagtcggtctatcctaacctgtttgcaagtcacctccttggagtcggtgcccatagtcagtgaatatcctgacgtatttccagaagaattaacgagtatgccaccagaccgagagattgagttcgccatagaactggtaccaggcacaactccaattgcataaataccctaccgaatggcagctaatgagttagcagaagtcaaaagacaaatcgaagagttggagagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgatttattcgatcaacttaaaggagcaagagtcttctcaaaaattgacttgaggtcaggttaccaccaattgaaaatcagatctgaagatattccgaagaccgctttctcaacgcgttatggtctatacgagttcacagtaatgtccttcggactcaccaatgctccagcgttcttcatgaacttaatgaacaaaatcttcatggaatacctggaccagtttgtcgtggtgttcatcgatgacatcctgatatactccaagaacgaggaagaacatgctgaacacctgaggctgataatggaaaagctcagagatcatcaactattcgctaaattctagaaatgcgaattctggttggaccgagtagcatttcttggacacgtgatttcctccaacggtgtcgaagtagatcccagcaaggttgaagctgtacttgcttggaacccgcccaagaacgtgtcagagatccgcagcttccttggcttagcgggatattatcgaagattcattgaaggattctctaagctagccagacctatgaccgagctgttaaagaaagaaaagaaatttcaatggtctgcagcctgtgaagacagctttcaagaaatgaagaaaaggttgaccactgcaccagttctcaccttgccagatatccgaaaagatttcgagatcttctgtgacgcatcaagacaaggcttaggatgtgtcctaatgcaagaacgaaaggttgtggcctacgcatccaggcagctcaggcctcatgaagtcaattatcccacccatgatctcgagttggcagccatggttcatgctcttaagatctggaggcattatttaatcgggaacagatgtgaagtatacaccgatcacaaaagtcttaagtatatcttcacacagaccgagttaaatatgagacagagaagatggttggaactaatcaaggattacgatctgggaattcattatcatcccggtaaagctaacgtggtcgctgatgcgctaagtcgcaaggcctattgcaatgtagcccaaacacggcctaaccaagatcacctgtgcagagaattggagaagttaaggctgaccgtggtacagtcaggtgtccctgccagcttgacagtacagcctaccctagaatcacaaatccgggaggcccagaaagatgacgaagggataaaagagttaataaaaagaatacgggagaagaaagacaccaatttctccatagacgaacaaggcacagtttggtgcggtccacgcatctgtgtaccggccaagaaggagttaagagatctcatcctaaaggaagctcatgagtccgcctactccattcatccaggaagtacgaagatgtaccaagatatcaaggcatacttctggtgggctggaatgaagcgagacgtcgcagaatacgtagccttgtgtgacatttgccaaagagtcaaggcagagcaccagaggccagctggtctgctacaacccctaccaattcccgagtggaaatgggaagagatcggaatggatttcatcaccggtttgccaagaaccccctgcgggtatgactccatttgggtaatcgtggaccgactcacgaaatcagctcatttcgtgccagtgaaaaccacctatgatggaaagaaactggcagaactctacatgactcatgtcgtatgtagatttggctgtcccaagaaaattgtgtcggaccgaggcactcagttcacctcaaggttctggaagcagttgcatgaaactctcggaactgatctaaattttagtacggcctaccatccacagaccgatggtcagacagaaagggtaaaccaaatcctagaagacatgctgcgtgcgtgtgccttggatttcgaaggcacttgggatcgttgtttgccgtatgctgagttctcatacaacaacagttaccaggctagtattcagatgtcgccaaatgaggcaatgttcggaagaaagtgccgcacccccttgtgctggaatgaggtgggcgaagccctggtattcggtcctgacatactcaagtcagcagaagaacaagttaagctgatccgagaacgcttgaagacagcgcagaaccgtcagaaaaattacgctgacaatcggagacgtgaccttgagttcaaaaaaggagatcatgtgtacctgcgggtgtcacccctccgaggtatgagaaggtttgggatgtccggcaagttagcaccccgctacatcggcccctacctcatagccgccagacgtggcgaagtggcttatcagcttgagctacctgaaggtctcgcagatgtgcacaacgtgttccacgtatcccagttaaagaaatgtcttcgagttccagaagagcaagttcccctgggtagtatcgagctggaaaagaatctgacctacaaggaaagaccgatcaaggttcttgaagaggcagaacgtcagactcgaaggaagaccatcaagttctacaaagtccaatggagcaatcattctgaagatgaggcaaccagggaacgagaagatcttctccgcgccgagtttccggagctgctcccttaggtgctgaatctcggggtcgagattcttgttaggggggttggtctgtagcgcccgttccgtcgtggcgcctagcgggaaaattatctcttaaaaaccctattagcgaaatttgtttctttgtttgttgtctagtgtccgtgccatctcaagatctcaatccccgatcaatcgtcgagttcaattccgaatccaaatcccttcaaatcaatttgctacgcgaaagtctagtttgcctcccccgggt

SEQ ID NO: 61616 - DNA, 11075 bp, Oryza sativa
cctcaccggcgtcatcctcctgccgccgctttggctgcaagcgccgagcgccagctcgcgccttgaccgttcaatgccggttcccctctcccaaaccgacattgccgtccatttaagcccaagccccccctccaaactccctcatttttcgcctccgcgccattgccgccctctgtttcgccgtcgccgatcgtcgttgcgcgtgtgggaggagccggcacgagcaaggacgcggaagaggactccggccgcaccctctccttcctcttccccggcccgaggccggagagattactcccgcgccgtcggcctctcatcacagcgcccctcctcttctcggtgatgtctctctccgttcttcctcctcgctccatctccttcccctagctttcggtagtagcttgagtagccttcccgtagttagccggcgccgccccgaccgttgccgtcgctcgccgcgtgctcgccgccgtcgccgcccgagctccgtatcacccgcttgtcgccggcctcgctcggcgtagttccgcccaatccgacgctagcatcgagttcccgaagccgcgtagatgctctcaccgccgggaatcgacctctcgtggcctcgtcgccgtttccctcttctcccgccgccggttgccaccgccgcaatccgccgccgtcgagcaacccccggcaaatccgagccgttggttcgtctcccctcgtctcgtgtaaccgcccggtgtgctcgcttttgcccgtatcaccgtggttcgctccgccgctcgccgccgccgcccgccgtccattcgcggccggatcgtcgtctacctcccgccggcccgcgtggcggccatgtaggcgccacgtcggcgccagctcagcccagaccgggtcgggccgaccccggtcggtccctccgcgtgcgcgcgttccaccgcaagccgtgaggctgcgcatgggcccgccgcacctgcgtccgccgcggaccgcgcgcgtgcaccgcgttcctccccgcccgcgcacgtgcgccgcgtgctccctccgcacggtgagccgagccgctgacaagcgggtcccacccggggccacgcgtggtgagcccggtccaccggactctctctcctccctcccgcgcgcgcgcgcgcttgggccgtcttgggccggccggcccgttaagctcggccgagccgccccaaatctcttgggccgcaccctagccgcccgagaaaagtctatattccctccctcccttcttttctttttcttttccaaaaaggatttaattaaatcctttttcctttagaccaaaaatccaataatcttagaaattcaatatcttcccaaccgtgactccgtttgactccgttcaacttccaaaattcatcaaatctcgagatctatctaatggcacgcttagaggtcattaatagggctttattttcgccgtttgttgagtcgttccgtttcgcgtgtagattcagagcccgaagacccgcagtgcgaggatttcgaggatcaagctccagatctcgagcaaggcaagccacctttgaacatcttgagcctatcattgaaatttaattatattgcttgaaaaatattatgcattgataggaccgcacttaatcttttgtcccatctgcaaggcagattggtggacctacctgacttgttgcatttgatccttccattgttaattgccataccatgtccccttgtaaccacccagttgcgcctcgatattcgtgcactctgtgcgagtatcgacggtcgccttcaaacttaaaatctgagtaacaacctaggtaaaactggagttttacaaaagacttggaaaacccgacacctgggtcggtgcttgtgaactaaatggatttccaaaaccgcggaccggggaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgccatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactaccgcttgtgaatttgctgttgagaaaatgggttcgatgtttgaaaaatcagcagctgacgggatcagctaggcccgggtggccgtttgaaaagttgttggcccgggtggccgtttgaaaagctgttggccgggtgccaatcttgtttcaaatctaaagactgatacattgcacatactccgaccggacaagacgcactgtctcatccgtgtcgtttgagaagcactcacttagtcgtttttagaaaaaaggagttcaaataaaatcaattgcaaaaacaacagcctctccttgaagcctgcattaaacacttatttcccctggcttgctgagtacccccatactcacccttgctctgtataaataatcccccccagttgctgaagaagatgaagcggatcctgctgatgaggagttcttccaggagcaagccggctacgatgagttttagggtttcggcctagttcccaagtcgcgcctgtgatgattggtccaagtcctggcttccgctttccttttgtaatgcagttgtgagctcgggatctgtccgtagcccaacatgactgtactcctactctataataaagagacctctgttgctgtgatattctgtctccctgtgataccagcactgtttcctgggactggtatcgattaacaggttaatttgaaacgtcacgggctagttccggtcgggactatttcggggcgtgacatatattccctaaataaccaataatcggataatgcggtgagaaggatgaaacgggcagagccaaatcatccctgtgctgccttgtgtaattcctataaacactcctaaattaccatctggcattctaataaataaggtcatgggccacatttacttatgtacatacaccatcaaacgtacatatgtaggtacgtacaaacacccgctcatccccctcccctttattattatttttttttttggggggggggcgccaatttagtcgttaaactttcgctttgaggtcaatatgatccttgatatttcattttgttcgaactagtcctcagagtttatctttcagtctactatggtccttggaaaaaaaaaatcacgttgccatgccatcttgtaacataatctatttggtgtttgaatctcctgaagatgaagatggagataaagattaagtgtttcacgtaaaacgatgtgataataacgtgtgattaattgagttttaattattaaaaacttggaaaatggattaatctgacattttagagcaactttcatataggaagttttcgcacgaaacgtaacgtttagtagtttgaaaagcatatcacgagtatccaaaatttcatctccatcttgttggagaaacgaacaagacctagtgtatatatcaattcctgggattagattaaattatctaattatataagattaattagttatagtatttattatcacatacaaatacaaatatacagattaaaaatttcacaatccacttttaataaaatgatgacatagcatgtctacatggcatttctggtgagcctaaggttcatattggaccatatgacaaagtttaaggatctgatcggacaaaataaaatatcgaggaccatattgaccttaaggccaaactttagggaccaaaaggatatatgcgagttgccatgaaatgttgtcatttttttaaatagaaaaaaatacatgtgcgttgcaacggtgaaggctattttaattttattattgttatacggtttagttagggtgaaattcactatgagaattcacttggataatttttttagaaaatcattagctgcagttaggagtccaactttcgtctcaagttagcatgcgagttttttttaaagaaatttcttgtacgactacttttgtatttttaaaagcgaacgaacttaaaaacgaactcaaacatggatttgtagaacttaaaaagttgactcaaacaatgatgacgtatcaaaatactagcaaaaacatttttaatttttataatagtagaagatagaagatggaagataaaaagtagagttagagatagagatgtagaaatatagcaagccactgtacattgtcaatatcaccgttagttttaggcatgccactgtacattgtcaatagctagggatgaaagtggagtggatagttttgtccgttccgaataaaaacgaatacatatatctttcgaaacggataattctcggatagttcggatactgataaaaaaacatatattttctcccatatacaatacgaataagatatcggggtttccttagatatgaataataattcggatatcaaaaaagccataagacataccgtatttctttataactatatgaccttcaatatacctttttagattttaatagtagtccatctgttaacgctagtccacactattaataatatttaaacttttaaaaagttatatattatattatattttatataaaatgagctaattatatatgatgatatttgtttttaaaagttgagttggtttttacgttccgaaaaaaaaaatattttcctatttgtgtccgatcgtatttgtttcgttgtccggaaaatggtatgcgctccgtttggtctgttaaacccgtgaggcccatgacctgacggacgcggacttcacctatcgatcggttttcagtatccggttcggtttcaacgatgaacttcgagtcggacgcgggcggagcggtccaccagtataaacctgcacgccgcaccgcctcctcccccccacaatctccaaaatcgagagggcttgcttaggttaacgagacgacgagattcccttttgtggcaatccaagcatcgaaacttccctctgcgtgccgccggcgagtcagaacaagtatatatggctgcggcggcaactggttcccacgaggaggttccggcgacggcgacggcgaagctgcggctgtcgcaggaaaacgtcgactggatcctcgcccggaaggagctgtgcggcgacgacgcgcccgacatctcgaggtacatccccttcctcctccagagcccctccggcgtccccggcgcggaggatcccctgccggagtcctactacgataaccccaaggccctgatgcggtacatcgacagtctcctcatggacgagttcgacaagttcagggacttcgagaagtgggtgcgcgccaagcacgaggagaaggggttcgtcgaggtggagtacgaccacaaccacttcgagcagaggcagcataggagggaggagcggagggcgttgtgggcggagatgctcgcggaggagatggctgatattcttcccacgatcgaggacggcgagttcggcgattacatcgaagtgtacgatgagaagaggaggaagtttgtcatgaaggaagtggaaggtaatattggggttcctgtgttcgataaggagaagaagcgttttgtcttcgtgaagaagaactgaatcaacgagtgcctaataggtttcccatttgctgaagcagacttatgtattgcgatgttggtacttgtcacttgttataagttagataatgatggtttagaagattaatgataattcaatgcattctgcaaatctctttccttatgcaagcgtatgtcattgttttcttgttattgtgggattatctttttggatcttaatcggcgatcaatcttgagtactgctggcccatctatgcaatatgagatgttttaattagctaattataagtgaactttctttagtcctttctgttttttttttctctttaaaaatcacaagtttagctatttaattgaaggaaagataggtgaaattatgtagtgcctgaacgctgtgaaattacaaagttttgcatattttttcatctcttgttaacagtgcatgcacttgttaggtttcaatgctgttcaattcgtaccatgaaaaattgcaaactttcttgtgttcatttgcctatagcagccccctataataccaatctcccaactctcaagtgctatatattgcctttgaactttgccttatgctaaagctcagacctaggtgagatggctcaatctagtggggatcattggtaaggatgaatagatacggtggaggcacagtgttgccaatggcgtatagtggcgcataccactgctgcgtccattccatattgctgtgtgctgcaatcaccaagctgcatgtatttattggtctcatttggttttatatgcattaaagtaaaaaaaaaagaaaaaaaaagaggatacgatggaatgatactgagtgacttgcctacgaccgggaatgctactgggcgagcgatcgccctcgctctctcagggcgatcagttttgcgccctcgcttgcctacgaccgggaacgctactgggcgtgatttcagattgtacagaaggtgaatgcgagctcctccgacgaatttgtgcctcgtcgaacaagatctcagcatgaacgttatagcagcgtcgagacgttaaagcacgtcgaggtcacggtttatcattttctaaattagtttttggtacgatttatctttaattaagtttcttgaaagggtcatttgtcaaaatttcggctattttcttatccagcgaccctgtgtgcggagccgtccgatcggccgaggacggttaagatgccaacgtgaggccgtcgtgcgggagtggattctaatccctcgaggggatatcccctcatatacctttttcttctaaattcgatgcaaatagttgtcaaaaattctaaaaaaaattgacaatgtagagtataattatacctactagtccaccaaaattcatgttcaaattcgatctacacatcgagaaacaaaaaagacaaatttatatataaacagtacgttactattcatacgctgaatttgtcttttttttatatctcgacgtgtgagttgagtttggacttaagattttgtggagttatatatatgtgttgtataaatgttgtcaaatttttctagaatttttcataactgtttagatggtttttgagtaaacgagggaatatcccctcgagggattagaatagttcccccgtcgtgctcgtgcagtgacacggatagggggccgcagcgataactctagttcggtttccggtaacccgaaaaccgtacggaccggcccattttattttacataagccacggctctaagagttcgttcagaaatgtatcgccgcggcgagccggggaaatcatggcggccgcggcggcggcggcggtcgagcagcatggccagcaggaggcgtgccctaactccgacggtacggcggcggcggcggtgaggaggagggtggcgacgatgcggctatcgcaggagaacgccgatcgagtgggtcctcgaccgtacagagctctgcaccgacgacgccccggacatcgagagatacatcccatattcccattcgtccccgacgccgacgccgacgaggaccacctcccggagatctactacgacgacgagccggaggcgctgctggtgcacgtcaacggcatcctcaaggccacctgggcaaatcctgggccaagttccgcgtcgagtacggcagcaacggcttcgtcgaggtggagtacgacgtcgacgagttcgaggagacgcagcggctgcaggaggagcggaggctgtggcgggcacatgtctgggagaaaatcttcgccgatgatccaccggaggaaggcgagttcgccgagtatgtcagcgtctataatcaagagacgagggcgttcgaggtgagacccaaggaattggaggaaggaaccaggacgatcgctgtgttcgacaaggtgaagatgaagcttgtgttgaagaaattggatcaatatctagtattataaaaaactttttgtcaaatagtataatgatttatcttcagttagcgcaacgatcgacgatgcatgtgatgttcatttgttaaattatcatcaagatttaaccatgcatgctgatggtctgatgctgatgcatatagttgatttgtgatgttttaatcttgctgtgatatttattgaattttttttatccttttccttatgtcatgtactgtaatgtttgtttatgacatttatgctggtcacttggagaagcattgtaacatagaggcaatatagatgataattattttgtttcagccttccctgaagatgccctaattaggatttttttttgatcaagtttataaaaaaatttggtaacattatacaccaaattagtttcattaaatgaaacattgaatatattttgataataagtttgaaaagcatgtcaaagaatctgtcaatataatagttgtattatggcacatggttgttcatttatttaccttgcaacaatattttatttgaatgatgtagatagttagatactactattgaggccctgtttagattccaacttttttcttcaaactttcaatttttccgtcacatcgaacttttctacacacacaaacttctaatttttccatcacatcgtttcaatttctttaaacttctaattttagcgtggaactaaacacggtctgaatataacatgaaacagatggggtagttgcatacataaatagccatcacatagacatgtggagtatgtagatcgatagatacggagtactgaataagctcagcataggaaagtgaggtccccatcgtttggcttatttcctaataagccaaaacggcttattaggaaataaaaatgaatttataggtgaaatttttataaatgtgttcttgtgacttaaaagccaatgttgtaaaagaaactacgttgaaaatatctcaaaatcaaactcaaaattagatttgaaaattcaaaatttggttttttctttgactgattaggccatccgatgagacagtacgtattaattgtaatgctattaagataggcaaagctctgcaattctcagttgcgtctcagatcagcttttcctcaccaccaacgacgtcagccacctgctcctcctcctcgtcttcctccccgacccagtggtagcgctcaacgaaggggtgcagggccctggtcacggccatcctgacctgcaactcgtcgtcgacaatggcgtagcccttgttctcgtggcgatgctcccggatcatggcctggcacgcggcgaacttgtcctgcaaggcctcgtgctgcacggccagctccctgagctcgtcgtcgtccgagccgatgtcgtcgtcgccgaaggagaagggcctcctcttgatggccaggatcttgtcgaccacctccctcggcagcagcagcttccccgccaggaccacgacctcctcgccgccgtcgatcgcctccaccgccgccgccttggtggagtactcgttgccggccatatatcgatcgccggtagatttcgccgcgatgacgcgagttggaagttggaaattgacctggaatcgatcgtagctttcgatggggggaaagagacggtggtttatgaaggcggaggcgaacgcggagccgtacgtatagccggggaagagttggagtcggaagggacacggctcgattgtttcgtggttctttttttcggatctgctagaaatttgacgaatctgttgtttttcacgttccttagattacttagatacgagtatacgacgttgtacgtgccgtgcatttgtttgctctctctctatatgtacagaagtttaactcctcgatcacgtttcacacggcatttttttttttttgaaatcagatcaaatatattgacccggcttttggagaaagcccaaaacacaaacggagtctttttcacacggcaatcattaagctctacctccatctgagtaatacatactacaacaggagcattgtattctctactataccacaatcgcagtgaaggtttttcgctacccaacaaaccaatacttgagcaacaccgaaagagaaaattacattatagcatcggcccgcctacctaaaaaattacagcatagttattatgttatagttacagtgtagttgcattatagttataatgtaactttgagtagatttgtttgtaatttttattttcaattttcaaatgtaaattacataagctagttcgacgtactccttccgtatttacgacagtgttaactttttaccattcgtcttattcaatttttctttctattgtgttggtattcgggatcggagtaatgattaatagggacagtcgggggcattcgtatttcatagtcagaggtgaaattcttggatttatgaaagacgaacaactacgaaagcatttgccaaggatgttttcattaatcaagaacgaaagttgggggcacgaaggcataaatttgacactgaagaaagaatcgaatacataacatttgcatctatagatgcgcattcaattgctaggggggcttttaactatttgccactcttacgagtggtgcttaacgatttgccactaggcccatatgtcatagacacataagggcccacatgtcatagacacggtgtggcaaatcgttaattgccatgtcacaagagtggcaaatagttaaatttcccattgctaggagtagatgactctgaacacatatcagattgcagtagcagcaggcaaaaaatgtataaacatcaggcacattgatggatcattagcgtgatttcgatcaaatttgattagatggatagacaaaaaaaaccatgaatcatcctgctattattttgtattccgttttcttctc

SEQ ID NO: 61617 - DNA, 5267 bp, Oryza sativa
aaaatattgttgcatgtttatagattttgaaattttaattttaaaattacattttgggacaaaaaatgacttaaaataaaaaaattcaactacaaagttgtagatcgcgtcgaggactacaagtttgatataaagtttgtctttattagagttcacatgaaaaagttatgaattatttttaaatataaagtctttaaaccgtcctattggatctagatgatattcaaatccaaatttagagaccggggtgacacaactgaacaagttggaggacctaaacgagtgatctgcaagtttagggaccgggatgacacagttgaacaagtttgaggacctgaacggtcgatttgtgagtttagggaccgggatgacactgcggtacaagtttagggaccggcgatggactttactcttgttaaaagcaactctaatgataaaataaatcataataaatgaaatgatgaatatataactttttaaataaaataaatggtcaaacatgatttaaaaattaactgcattaaaccgtcacgttgcttctcccgttaatccaccgcccactagcgaccaagcttattagttatcgggatactaggtagtatcgttttgcttaaaatagtatcgtatcgcagtatcaggatactatgagattttattttttttaagtttaattaatatttatattaattatgtatagctattctatataaaaatatagtaataatatatgttatgtaaatagagacatttataagaaaatacattatgtttgatatatttaactgatttttatataaactagtgcatatttatttaatttattttcaaaccatcttattttaaataacattttatatgatcgtagaatcgggatattacctaagatttcgtaaaatcatatggtaatcaatagtaggatcgggatattataaaaattaggatactaagtgggattgatattgtttcatcttggtaggaagatactacgatatatatggatcgcaatacttacaatcttgctagcgaccagtgttttagatcggagttgataggcatgaacagtgcgtcgtcgtcaaaggcgagcgccgtgacgaataatgcggcgacagtggcgacagagaagagacagtctgctccgatcatcacaagtcgagcatcgtttccccggccaaggcggcggcgacggtggaggtagaggagtgcaccggtcaagagggccagtgtacatggaggaggaggttatcagggagatcctgacacgggagaggaagccgctgccatggtcactcacggcagcggaggatgccaggcctggctgattggcgatcagcagcgcgcggcgcgcggtcagttctagcctcttttagtctccctcctctacagttcatacatatgtaaatagagaaaaactaaaggacggtattccgttctcccgacagtatagattacgatttctttctacagccagcgcccactccgtggtgttgtgtgggccctcctcgagtcacgcgcttgtcgcccatcttccaagcgtatcacatttctgctcctaacctgcctagcagagtgcatgtgcatgttcattcggccacgtatggccttgttcatttgaccagaccaaatatactttaagatagctttgtagtactaatgtgaaatcacagtaacaaactgaaaaattcagtatttctatacaattttaaaaaaggataccggatgtatgtgatacacatgatactttcacagtaccatcctaatacaccatatgtatcatcatatctcaagagtataggtaccagataataccctcgagacatcacccggtaccatcgaggtatcacctaggcactcggtgttgttaaggtatcatcgtatatccggtattcttaaggtatcactcggtactcttgaggtacttttaaggtatcatcgtatatctggtactctcgaggtatcatccggtaccatcgaggtatcatctaggccctcgatactgttacggtatcattatatatctgatacttttaaggtatcactctaaggtaccggatatatgatgataccttaacggtaccaggcccgatgatacttcgagggtacctgatatatgatgataacttgattgtatcgggtccgggtgatacctcattggtaccggtgataccttgagagtaccagataatatctattgaatgataccttgagagtgtcgaatgatagctagctcaagggtatcggataatatctcaacattactagatgtgtaccgtaaaaatatcacagagattttattgtcatcttatatattagcacaaccatctagcacataatcgtctaactaaagtacgtagctttagacggaaagaaatagttagcactttattagttaaacatgtgcactgcaaaattttaaaacaatagaaacaagtctacaatcgatgccaacagagacaggagcacgtgatatgtccaagggttggctgcgtgctgcactgagagcctgacagcgaggtgcttgtgagcatcgtgccaggatcagacacgcggggcttcgagtcatggggaatcgtacttgtgctcgtgggtgtatagagaggtataccgtcaaaacggtataccgtcctctagttgctctctttttgtgtatatgtataaaaaatatatacacaaataaaaaatttgtatacgatgtatacaaatacaaagtttgtatacatcatatataaagtttgtatatatatgtatacaaaatataccaactttatatacgtatatatacaaagtttatatatgtacatattagaaaacacatatacaaagtttgtatatgtgtatacaaactttgcatatgtatatattaaaaaacccaaaaaactgaaaaaatatatacggatagaaaaaaaccgtgcgaaaaaaaaccgcagaaaaaacagaacaaaccaaaaaaacgaacgtgcgagaaaaaaggaaaccgaaaaaaaaagaaaaccgcaccgccgcctgcgccccttctccgcgcgcgacacgtgtccagtcacgtgggagaggaggcgcgcgaccgatcgcctattagcgttctcagaggatgctgcccagttcaagagggagtaggactgatccatgcagtaccagaccagggtgccactagggagggtattgtgtaacccatatctatacccaattttaaccattcacatctaaaaaaatatctatacccaaattaagtggatattattcaatgggtaggggtaacctaatgggtaagagaagagacatgtgagtcccatatgtagaaatggaccaaaatttgtagaaaattgctcttttatataataaatcatctctgtaaatttcaagcaaaattgataagattttataatgtgaatgtgagtttaaaaattttatgtcagatttttacccattataaacgggtatgaacaaagttcttcaaatatgtaataacctccccatatccaaacttggaatgataacttttctacccataccaatttaaatgatagcttttttatctacgtagtatatcttacccaaataatatggacatgaatataaggatttttaatgaatactaggtgacagacctacgaagaacgaagcgcatagttgtgtccgcctcccaaatgactacggctgtgtttagtttctgaaattggagagaagtatatggaaagttggtagtttgaaaaaaaagttaggagtttacgtgtagaaaaattttggatgtgatgtgatgaaaaattgggagttggggaaagtttggtgtgaactaaacacaccccacaataaccccaagaggttgtcttgcatcacaactgtcttcagcgtggagtacgaggtccatggagtaccgcgctaacaagacacggggcattgagactgtgagaggtataggggattgtttagggcatgttcactttaatgctaaaaaaaaccttaccaaattttagaaatactaaatttttagtaacttgccaaaattttggcaggatttcttatatagttaccaaaatttggcagcaaactaaggacatgttcactttgatgccaaaaaaaccttaccaaattttgtcattgctaaaattttggcaaagttgccaaaattttagtaacttgccaaaattttggcaggatttcttatataattaccaaaatttggtagtaaactaaatgtagccactttttggtaactttaccaaaatttggtaaggttgaaaatggcattaaagtgaacaggccttaaatgtaaccatttttctttggcaactttaccaaaatttggtaaggttgaaaatgatatcaaagtgaacaagcccttaatcttttttttttgtttcgccgggtcagtgagaatgtgagagattgtgtcagttattttggccccgcttagttccccaaaatttttttccaaaaacttcacatcgaatctttaaacacatgcatggaacattaaatatagataaatgaaaaaactaattgcacagttagggaggaaatcgcgagacgaatcttttgagcataattagtccatgattagccataagtgctacagtaacccacatttactaatgacggattaattaggctcataagattcgtctcgcggtttccatgcaagttataaattatttttttcattcgtgtccgaaaaacattttcgatatccggtcaaacatctgatgtgatatctaaaaattttcttttcgcgaactaaatgggtctttgttcgctgggtcagttatttcatttgaattggctggacgaaaaactctagctcgttagctcgctcagctcgtctctagcttgactagactgggcttggcttgtaatgaattcctaacgagctgaggcaatgctttagttcatttgtcataaggaataagttcactttgggtccctctatttctcgcccagtccgattttcgtcccttggtcgcaaaactgggtaagataggtcccccaacttgcgaaaccatgcaagtgaggtcgctcggcggtattgtgcccggtttttgctgacgtggcgcctacgtggctcctttgattaggtctttgtctcacgtgtcattgaagtggcgcttacgtggcaattagatccgaaaaaaaaacatcaaaattcaaaataaaaaaattatacaaaatttgtgggacccacatgccagtaaaaaaaataaaaaagggacccacatgtcagcgggtcccactttttcaacctcatctacctctgtggctctgtatgcttcaacgac

SEQ ID NO: 61618 - DNA, 1224 bp, Oryza sativa
  unsure (1)..(1224): unsure at all n locations
acacatctccatcctagcgccgccctctatgcccgccgtgctcctcatctccatcgttgcctcctccgtgacgacatatgctgccgccaccactgtcacggaagaatccggcgagggaagacccgaaccgcggaggccgccgccgacatctccccgcccgcgaccaccatcagcgagagtggctccccgccgaggccgccgccgacatctccccttccgcggccaccgttagcgagagcggctccccgtcgaggccgccgccgatatctccccgcccacggccgacaaggaggaggagagtggctcccggcccttggcgccgccgttcttgtcgccagcttgctccggtcatcggcgtcgtccgctccggctcagccgcttgtccttcttcgctgacaaaaagagagagagagcggataaccggatagattatggatatgaagctgacatgtgggtcccactgttttaattatttttcagggatcaaattaccacgtaagcgccacgtcaataccacgtatgacgaagacctagtcaaagaagccacgtcgacgccacctcatttaaacggtttcgtaagttgggggaccagttgtacccggttttgcgaccaagggacgaaaatcggactgggcgacaaatagagggacccaatgtgaacttatcccttgtcataacgagccagctcactagctaaacgaggtcaagtcaaaaggcagtccaacaaaaatatttagaggctcagcccaactaggcaccaggtataaatgcaaacaaattaaccttagatccctatccccccgttatctcgatcccagtgttgcactctcgctcccccccatctcgcatcgagcctccgacgctcccaacgccgtctcgacctcccccatcacgcctcgtgccgccgccagcagggtcatcgccggccgttggctgccctccgcactggatttttcacattttggtccttttaaaaaacttatttcgcaaatagacccctaaaaaaacttatcccagaaatggtcctttttgggccgccagagtggctggtgccgtcgtccaacgggacggcgccagcctctctggcgccgtcctcttgccaccgtggtacacgcgaaccgacgtggcaggaggagggcgccaaaatggttggcaccgccctagggannnnnnnnnnnnnnnnnnnnnnnnnnnnnnnnnnnnnnnnnnnnnnnnnnnnnnnnn

SEQ ID NO: 61619 - DNA, 1104 bp, Oryza sativa
tatagggcgaattcgagctcggtacccctcctatgtgaacttgacctgtttttgtttctaacggttcttcattttccttcagagcgcattgcttctactgaggttgtaagagtacaaccacctgcacccccagttgctgtgtctcgtagtggcacgcgtgtgccaatgcgaagacctgatggtggaggctcagtatcgaaagccaaggtcaaattgttggtgaaccattttatagttaagtaccgacaggcatcaactgtttttcactatgacatagacatcaagcttgatataagttcccccaaggcttcagacaaggagctatccaagggagattttcttactgtcaaggacgagctcttcaaggatgagagctttcggcggctttcatcagctgttgcttatgatggaaaaagaaatttatttacttgtgctgagctaccagatggtttgtttcgtgtcaaagtccgttcacggacttacattgtatctgtggagttcaagaagaagcttcctttgagccaactctcggaactgcctgtgcccagagaggtcttgcaggggcttgatgtcattgtgcgtgaggcctctagctggcgcaagattatcattggtcagggattttactcgcagggccgcagtgtgcccattgggccggatgttgtagctctcaaaggaacccagcagaccctgaaatgcactcagaaaggactgatcctttgtgtggactattcggttatgccgtttcgcaaagctggacctgtgttggatcttgttcagaagtctgtgagataccttgactacaggacaacactaaacaaacaccaattggacactttgaagaatgaactcaaaggccagcgtgtcactgtaaatcataggaggacaaagcagaagtacattgttaaaggtttgactgataaacctgcaagtcagataacttttgtagattctgaatcaggacagaccaagaagcttcttgattactattcgcagcagtatggcaaggttattgagtatcaaatgcttgcatgcttggatttgagcaagagcaaagacaagctaaactatgtgccgattgaattgtgtgatcttcttgaaggg

SEQ ID NO: 61620 - DNA, 742 bp, Oryza sativa
gatagcatcatctacttccgcgacggcgtcagtgacggtcagttcgacatggtgctgaacgaggagctggcggacatggagaataagatcatggtgggtgactacccgaagatcaccgtgatcgttgccaagaagaggcaccacacgcggctgttccccaaggacaggaaccagcggcagaccaagaacggcaacgtgctccccggcacggtggtggacaccgacgtggtcgacccgacggcgtacgacttctacctgtgcagccacaagggggaggtcgggacgagccggccgacgcactactacagccttctggacgagcacggcttcgcctccgacgacctgcagaagctggtgtacaacctctgcttcgtcttcgcccgctgcaccaagccggtgtcgctggccactcccgtctactacgccgacctcgccgcctaccgcggcaggctctactacgagggcatgatgatgttgcagccggcggcgtcagcggcatctgcctccgaggccatgatgccggcggcacagccccaggcggctgcggctgcggctgcggcagcgtcgccgtcgtcgtcagcggcatcctcatctgagggcatgacggcgtcccagccccaggcgccggcggcggaggcggcatcctccttcgcgggagctgccgacttcagggagtttgcttcgatgcacgaggatctggtggacaacatgttcttcatctgacgacagcctttcgtcgcat

SEQ ID NO: 61621 - DNA, 805 bp, Oryza sativa
cagggcgagggcgatcagaagattcgactgtactcgaacaacggttaaacgattcaaacccgaattgattcctcttcccctcacacactatgtaagcccaccaccgaattaattcatgcactatataatcccaccaccgaattgattcacgcactatataagcccaccagcgaattgattcctctccctctcacgcactatataagcccaccatcgatagaccttgaacaacagataaacttatcgaaggaccctaattgattcctctccccctcacgaactatactatataagtccatcaccgatagacctcacaatggataaacgattcaatccgatttgattatcaaaggacccaaattgattcatctccccctcatgtattatataagcccaccaccactcatgcactatataagcctaacaccaatagatagaggaaatacaactatgatcacgtgcactattttatcatcggtggtatgtcttcttctgttcctgtgttgcacctctgcttccccagttcggagcacttttgcgtgcacaagtgtttaggagagtatctatacgggtaggcaggtgatcaaatttttggggagcgcttcctagcgcgactgctctgctgcgtcagttctgcacgacgtcgtcttcttcatctgcatcgttcactttgactacttccactacaacggcatgtctactggaggaggaaatgatagaggcgctagcagcaacggcacacctggaggcggtaacagcactcctattggtgacgagaacatcaacatcaatggaggcaacaatg

SEQ ID NO: 61622 - DNA, 3208 bp, Oryza sativa
  unsure (1)..(3208): unsure at all n locations
cagcagcgagcaagcaaagcaagaagcaacttgtccgagatacaacgtacggccaacgagcggtggcttggggagtttgatcggccaagagcaggtacagtagatgaattttaccggcgatactgtatgcatgcagcctaatattctgagttggcatcgaaatttgaggagagagagggtgagccggcgactaattagtcgccgactccacgcgtgtgccgaggcaagaaaagcaacagcatgcgttttcttactggaccatgcagttgtggggtccacgtgatttgtagtctgtagatgagaagataacacgtgtagacatgacactataaaaaaaaaagaaaagaaaggttttggtattgagtggaggcagcttgtagactattgttgtacagattagctatttggtgaaatagtattttattatacttgttaggttttggagctgacagcttactcctctattaaacttgctcttaagcgcggttgttgtagtattcatctttttttttttttgagcgggaggggtcaggggtctctgtccacgtgggttgcgaatgttgaaaaggaggggaaactggggaaagagtcaaagcgttggcaaagaattatctaaaaaaagcgttggcaaagaggtggttcatggtcatggatgggggtaagtagcttttgaatgggaaattgtctggtataactagtggagttgggggtggacgacaggttctggagcaagaaatatactaatggttttttctcgctaatatgaattaattttcaaatatgctctgctagctggttttgatttactgatttcgacaactctattgattataccataactcgttaggtgattatgtgttgttaaattttgatgcggttaaaacgattattttggtataggtctacttttggacacatagaatacattggcaatacttgtcaaccttgagggagtacttaatatgaatgtttttttatcccgcatgcgctcagttgtttgcttgaccattactatttttttaagtgcccgtatcccgccggtacatagtcccagggatttttttagttaaaggtaactctggtggggtgtgcccatatcacccaaatcataatatattctaacttttaacatttttaaaaatctcatcaaacttgaaggcatttactttctttttttttaattagtgagagcgatctccatgaaaatggcaagctggctaataagctcaaaagggaaacaagaaaaggacagcgacctgcactgcaaaactgacagtctcgcacaccatttgccctctgcaacgagtattcacaagacgagattatcatctgccacttcatgagacaagtcagacccgcgcgaaaatcaccggccttccgggatgacggagttcaagaacaatgacgagccttgctgctccgaggccgatcccggcgccgagctcgactgcccgctgactccgctgttggcgaagctggtgttgccacccttgatctgccactcggtgatgtagctcggctttgtcagcacatcgggcacctcgacatcgccggcgagcatcgacacgaccctcgacattggcggccgctggtgaggcgagccctgggtgcagaggagggcgacgcggatggcacggagcacctcctcccggttgaattccttgagctttgggtctacgaggcccagagggttgttgttctcgtacagctcccaggcctgaatgtattgagacggtaagtattcagatgatcagaacataggggcataactagatttttttttgcatgtttagataaaattggatgatggcacttgtgtttaatgttatcaatctttactagaaaatttcagagtatatgctgccaataacacaaagaccagattataatttgtccttccttgggtgagagttcataagtgagctgctgagcttacccattcgaaaatataaattttgtcttcttcaagcgtatcatcatagtttggccgtccggctaaagtctccaataagaccacgccaaatgcaaagacgtcaactttctcggtcatatggcctctcatggcgtactcaggtgcaagataaccgctggacaaaggagagccaaaaaagccaccgccaacataagtatgaaaaattgtaaacataaaggtgggaaagaaggaatgtacttacaatgtgccagcaaccttcgtgctgacatgcgtcttcttgtcatcataaagtttggctagcccaaaatcagagatcttaggattgagattggcgtcaattaagacattgctggccttgatgtccctgtgcacaacacagatgctggactcttcatgaagataagccagacctcttgcaatgcctaggcatatctcaaaacgtgctggccaatctatggtcaatttctcagttcctgcaaatgaagggttaagcttttacgttgtagactatgataaacctgaattatgaaaatatcagttgcatcaaactgaaattgctcgtaccaaacaatgctttatcaaggcttccgttttccatgtactcataaaccagcagtggattattgccttcaaggcagcaaccatacaacttcacgagattacgatgttgcactcgggatatagtttctatctccgtcgcaaattgttttttcccttgatgagatgtttgagatagctgcttcactgccactacccttccatcagttaacttgccctgcaaggtggcattcaccaaacagcaagttcaagggatcgcaatgtcaaagccgaacatatttggtaatggatacattggaatgtttttttttttctgatttattaatatgcatcatttatgtgcaaaatatagaaagcacaaagaatctaaccaattatccataaaagaaatgaattcatacaatcatatgtattttttagctgtacactacttgtctagacgttaataagttaattcgtaggtaaaattccataacaagttcgaaacttcgaatatatatatgtacttacagatgaactaaccttataaactgtcccatatcctccttcaccaaggcggttgctggaactaaaattttcagttgcagaccttagttcactataactgaatacattaggtcttccgacaatactgtatagctctgcaaacataaaaatatacatcaatttattaacttnnnnnnnnnnnnnnnnnnnnnnnnnnnnnnnnnnnnnnnn

SEQ ID NO: 61623 - DNA, 788 bp, Oryza sativa
  unsure (1)..(788): unsure at all n locations
attcttcctgaagtccctgaaatcacaataccagataccagcgacgttagttacacacatcagtcacatcttatacatcctacaagctttggttttcccaagctgttcacaaactcagctagctagtagctactgatatgcagtgttcatccccaagtagaactcgatgacgacctatcataaactgacgaaccgaacatcataactcgatgctgacctaattaactgacgaaccaaaccacccaaaaaaaaaaaactgacgaaccaaacatcaaagttcaaacagacaaaattggggagcgcgagaatgtggtggtcgcaggagcaaggccaacaatcgcaatggaggacactgcctaatctgctcctaatacgatcccaaaacggattggattgggaataagatcgaacaccatcaatccatcatcacctccgcgatctcgacgcagccgcacgtcccagcgcaccgctggctccgaggcgccatggcgctcgaactccgcaacgccagcaacggtctcctccaggcccacgagcatcggcacgcggccggcgacgacggccgccggccagccaaatctccggcgatagggcggcatttccggtgaggcggcgcgtggaaccggagcgtaggtgtgggccgaacggggtaggttgaaagatgcaaatgggcttttttatgtgggccggaaaaaaggcccagctacttccaggagatatttacgaannnnnnnnnnnnnnnnnnnnnnnnnnnnnnnnnnnnnnnnnnnnnnnnnnnnnnnnnnnnn

SEQ ID NO: 61624 - DNA, 3962 bp, Oryza sativa
gtgtgatagtgcattgtgcatataattctagtttttgccaaaatatagacgttcttgatttactattcccatcaggacttacttcgttagaggatttctacatagtccagttggtgtttacagaatcaccatcatatttcatagtggctataacttaaaaaggttcagcaacgcctttttgtgtttttctcttttttcagagtgtttctttgtgaagcgctctgctgtacatattttctcttcttcttaatgaaatgaaacgcgtggctcttgcattttcgagaaaaaaaaaacttgaaaaggtgttatggaacttacaactcaaccaatcatctatactcaaaactcatctctttcagaaattcaacaaaacatgttgtaaatatctgatttggtcaagtttcaggaatttatcacaaaatgttttggcagggcctataccgtcattcattggggagttgactaatatgcaatacatgtgagatatataactcaaaacataattacattaaatgcatttgttttgcaataagtctcacatttttctcccttcaacacactaggacttttggcatcaatgcattatctggacctattccaaaggagctcggtaaccttacaaatctcatatcactgtaagaactgtatttacattatttcgtggacgtaattcatcatacaactctactatcatgaaatgcttataatgtaaaaatcattaaagaagcagtgaagcacagcataattgtgaatatatgccaatttcctcatgtttatgctattcaattaaggattccaaaatattgagccggagagcaaatagcatattcatttttgcaacattcttttatttgggtattgcagttggactcagttggaagaatagctatgctgacagtgttatttcttcatagaatataaattccaatacaactttatgtggctgacatggaatttttttgaggtttatcttcaggggttgtggttgttcacgagcaagagcggctgccttaaagagttgggaaccctgttcaaccttgaggaattgcgcgtttaactaattattagtcgctatgtttttttttatcgaaccattttattttcttggactactgagcctaacgtgttctgctatttgcatctctcaattgcaggtatattgacagttctggcttaagtggagcactaccatcatcgtttgccaatcttacaagaatgaaaatattgtatagacctttcaaaagacatgttcttgttgacattaatgtcagattccatgatatctgtgtatcctttcacttgttcaggtgggcatcggataataattttactggacaaataccagattacattgggagctggaatttaacagaccctgtaagtttgctgttagcctctctatattgtacagtaatttatttttttaagatgaaatcaatgaacacaaaggggagttaaaaacttttcatataattctaaagaatatgggtacagtttgctacagttttacactgagctttagtttgagagagaaagactagatttaaggtaacacaaaaagtctttactggtatttcatacttgaccttgggtgtgttgaatcgcctgagatctctttatttaataaataaatcctcaataatgcatcttgctgactcaccatccatgaagagattgatgctagttttgaataaggcactagtgttagtaagcattgattctgtttatatcatttctatttacactggaaaagaagttgtgctttagctacgtaagtttgcccttttttcttagcactactagtttaatttgccactgaataaatgataatttaaattaacaaactactctttctacatctatgaatctctaggcggttgcaagggaattcttttcaaggtccacttccagccactctttctaatcttgtccaattaacaaacttgtaagtgcctactgctggcaagaatgtttatacatcgttcttaaatatcaaaggtttcatcaagggaaacattaacaacctatttctgtggtgcagacgaattggcgacatagcaagcggaatctcctcttcactggcattcatcagtagcatgacatctttgaatacactgtatgcaaaaattttgttcactttcacgattcaaactacggttcagattttaatgtagttcaaaccaaattgttaaatactataattaaatagcatcattgtttgcaggattttgaggaactgtatgatatctaatagtcttgaatctatagacttctcaaaatatgcaagtttaaccttactgtaagtattttatatttatagtaaacaataggcaagtgtattttgtccaagatattagacgaattgctgtggatcaagcactgacctctggccattctcaatattttttaatattacagggatttcagttttaacaatatcactggcccaataccgcaagccctgttgaatctgaattcactcaactatttgtacggattatctttctttccaagcttatttcttggaatagaagggttatttgtttatctagctaatgcttgcaaattttgtatgatcagatttcttgggaataatagtcttacaggaaaacttccaacatcaataggacgttcgttcagagttttgtatgttcatatgattcatttattgtaacaacaaaatgtgtttgatttatttctaatgatgatttggcattttattttctgcagagatttttcttacaaccagctttcaggatatctcccttcttgggttagtgggaaagatttacaattgtaagtaccaacttctgaaacctccattaactaactaacttcagccaaattgagggcatgtttggcctattattaggcttttgaactggcgtattaggattacttttgatgcatttgcttataggtcttcacaaagttgttggatctataatgtcatctgtgattcagattcttctgttaagggtatactttcagattataagttattttgacttcgttcaaagtcaaactactttaaatttaaccaagtttaaagacaaatagtgatatttacaacaccaaattagtttcattaaatctataattgaatacattttttataatatatttatcttggttgaaaatgttactactttttttataaacttgatcaaacatagaggagtttgactttgaccaaagtcaaaacgacttataatctaaaacaaagggagttgatactaactattactccctccattctaagatataacaacttttactcctcaggatttgtcccaaaatataactacttctccaccaacattttcttcccaacaaatcacaaccctatattattcacttttcctacctacctccactacttatccaatcacaaccctgcactattcacttctacctacttttttaataaccatatccaactctaaaacttgttatattcaagaacagagggagtaagaggtattttggggattttctcatctctgttatacagagtacaacacatatttgccttttaggtttatgtgaatgcaaaagttaaattctcaatttaactcttcttcactaaacttagattaaatttcactttgggtcatcagatgttcagatttggtctaccctttaaccaatgtttttactttggatcagataatcttacctttgctgtaatagttcaattcccaattaactcttcttcactaaatttaaagtaaatttcactttaggccaccttttattaccaagtgttttattttatactaccctttaaccaatgttttcatttttgcctagataatcttatctttgttgtactttggactactctaactctcttcatatgaacatccgttacgccggctctgatttgtcactaaactcccaccgctttatatagataatttatttgacatatcatgatgtgcataaacaaaagggtgatt

SEQ ID NO: 61625 - DNA, 2924 bp, Oryza sativa
  unsure (1)..(2924): unsure at all n locations
nnnnnnnnnnnnnnnnnnnnnnnnnnnnnnnnnnnnnnnnnnnnnnnnnnnncatcgaagtcattcctggcaatcaccatcatcttcatcaccttatcatcatcaattccgggatcatcgctaactccctgtcggagttggtatatcacgtcaccagcttcccgtcgaagttggtatcatcatcattcagtgaaggtccgaagaacagtttgtgaatggccttcatcatcatcgtcattgtctctgaatcaatgaagagccaaagaacaatttgtgagggctttttgtactgagggctgaagaatagtttgtgaaggcgcaagatccacttcacatcatcaatgcaatagtttgttaagggtatagatgttaaggggtattttggggattttccaatctcttctgtacaacatacatttgccttttgggcctaggtcaatgcaatagttcaatccccaatttatgcttgtttcttgcgaaagaattcctttttcccaaatttgggggcggtaaaaaaaaaaacgagaataaccttacaacttagcacagaaacaaatcattttgtagcttaagtttatgtttgttcaagctagactagacaatatctaaatattgctatggaaacatgaagtataagaacccttttaattttgatactgttcattctacctaggaatttggtggcaaacaattttgtggacaatgaattaaatataggtgcgtccattttctcctcaatatcgcaagtataatcaatagattctcacagcttctagtttggattcaaaatgttgatcttttgcatctgcagtatcttaccttcaatgcagtacctgaactgccttcagagaagtacaccctgttttcttggttctccaaagagtgagcctttcaaccctcaatatcaagaatatgcttacttgagaaacaccatttacttagaacattagtaaatgctaatactaattgatgtaacttgcctgcagctgcctccttcgctgtgaactgtggtggccctctcacctcaggctcagataatttgcggtatcaaagtgatgaagtcaatcttggagatgcatcatattatattacaggagaaccaacatggggtgttagcactgttggaaggttcatggatgcatcaaatggaggttacacaatccgcagctcgcgccagtttcagaacacattagattcagaaatgttccaaaatacaaggacgtcagcatcatctttaagatactacggtattggacttgagaatggaaactatacagtcactcttcaatttgcagagtttgggtttgaagacacacagtcttggaaaagcctagggaagagggtttttgatatatatctccaggttggttcttgcgtagctagctgataagctataccttttgatttaacttgtaatcaagttgagattttcttttgtcttgtttttgttggagggtgaacgtaaggagcagaattttgacatcaggaaggcagcaggtgataaatcttacactgttgttaagaggtcatataaagttcctgtgaccaaaaacttcgttgagattcatctattctgggctggcaagggtacttgctgcattcctactcaagacaattatgggccctctatctcggctctgagtttaatccctgcaggtactcctctgaacaacaattcatggttccattttgaaaacaatgtattttcagtgatcaactattgagtttcattgtaggccttcattgtaagataacattttattctaacaaatggacttcttttcagatttcaccccgacggttagtactagcatttcaccagaaggaaacaataatactagtaaagcaggtgtgagtactagtaaagcaggtgtaattgttggagttgtagttggtgtaacaattttaggtttgatagcacttgctgcaattttgatatggaggcagaacaggagaaagagaaagttatcattggagcaacaaggtacaggaccactaggttcaaccgagtaaatgggaagctcataaagtgatgtatctttttatgtttgcagagttgtacagtattgttggaagacccaatgtaatcagttatggtgagctaaggtccgcaactgaaaattttagttccagcaaccttcttggtgaaggaggatacggggcagtctataaggtaatttcatctatagcatatagattgtgagttatgacattttttcaatgaagttattaacttataaacatctagacgagtagtatattgcaaaaaagctgcatatgactgtgtcagttccttttcttttatgtattattactgattatattcgttttccattctatttattcacataaatgatgcatattcataaaatgggaatgcatataccaccgtatccattacaaaagatgttcttttagaaacattacaaaagacgtttgacattgcagtacctgaaacttgcatttttggtgaatgccaccttgcagggtaagttaactgatggaagggtagtggcagtgaagcagctatctcaaacatctcatcaagggaaagtgcaatttgcagctgaaatacaaactatatcccgagtgcaacaccgtaatcttgtgaagttgtatggttgttgccttgaaagcaataacccacttttggtttatgagtacatggataatggaagccttgataaagcactgtttggtacaagttatttcaatttgatgcaactggtattctgagaacttggatttatcgtagtctatagagacctaaaagttcaatcctacatttgcaggaactgggaagttgaacatagattggccagcacgctttgggatatgcttaggcattgcaagaggtctggcctatcttcatgaagagtccagtatccgtgttgtgcacagggacatcaaggccagtaatgtct

SEQ ID NO: 61626 - DNA, 1364 bp, Oryza sativa
cttttcttttatctagtggttatcttgcacctgagtatgctatgagaggtcgtttgaccgagaaagttgatgtctttgcatttggcgtggtcttattgaagactttagctggccgaccaaactatgatgatgctcttgaagaagacaagatttatattttcgaatgggtaagctcagtacagtagctcatgattaaatcttaaccaatgtaaagaagatataataatggtctctctgcttttttcaattgatatttgtgctattgacagaatatacttcgatattttctactaaagattggcaatactcccaccgtctcaaaatatagcaatttatagcatctaaatttatcctaaaatataatcaattctccacctacattcttttcccaaccaaaaacaacatttcactatttagtttccctacttacattgttactctcaaccaatcatatttttttcctatttaatttcaccaacttccttaatacatgcgtccaattctaaattttcttatattttaggactgaggtagcaagcattgaacacacttctcatcatatggttttatcgaaacaagcaacatttatctgattttgtccccacgatctgaatactgaccgtctcaatactttcaggcttgggagctgtacgagaacaactaccctctgggcgtcgtagacccaaggctcacagaatacgacggtgaggaggcgctccgggccatccgcgtcgccctcctctgcacccagggctcacctcaccagcggccgtccatgtcgagggtcgtaacgatgctcgccggcgacgtcgaggtgcccgaggtggtgacgaagccgagctacatcacggagtggcagatcaagggcggcaacaccagcttcatgggcagcgacgtcagctggcggtcgagctcggcgccgagggagatcatctcgccgcaggattcgtcgccgttcttgagctccgtggagtagggagaggtatggtgatttcgcgctgcgctcaggtgcttcattcatcggatttaacttgtcctgagagtggcacacgatcttattgtgtgtgcatgttcttccaaactgtgtcgcgtaaggtgcatattcgaagtactccctttattctcttttgatcatcatatttggtccatgcagcaagaccaaagagagagaaacacatatttaacttgcatgcgagaaacacatcaccatatttaactattgtatgaataagcgattagattgtctatagatgatttggagctagtagttggcagcttgcatcggcatcgaggaaagggagagagatgaggaagggagaaaagatgagagggggacaatgtgggtcccattgtaatattttttt

SEQ ID NO: 61627 - DNA, 979 bp, Oryza sativa
ttcaagaagccgtcgccgcggctctgcgagtcctgcggcggcggcggcggctgctgctgctgatacccgccgtagtcggcggcgactggcggcggcgcgccgtacgccggcggtgggtaccccgtccccggtggcgggtacgctgcaacagtagataatcacacatgcatcagctgatgaatttgtccatcaaaacgaactcagaaaaaaaaaataaaaaatgtcgggatgcatgtattttctcctaatcttaataaaatttgtcgcgtttcttcccgaccaggcaaaaaaaaaaagaaacaaagaaaaaaaaaggagacctgacacacaactctcacaattattttctctgtgctaaatcacaaaccagggagttctccaatcagatcaagaaaccaagagatttcaatacctgcagtgccgggaggaggaccttggtagctcatgatcactactactcaatagtagtaaatcctccaaagagcaagaagagatgcaaaccaagaacaagaatgcaagataatggagatgagaaatccaagctctcctcagtttatttaacgctggactctctatctcctagctatatatactcctacatatatagtgctactaaactttatttatttccttagccgcgttaataattaattaatgacaagaagaaaaagaacgccgaatggctgctgcttatcccactcttctgaaaaacgcgttgttttacgtcgtttacgctacatttatttagacgtacgggatcgggttctccatctcttctacatgcctttttcatttttcaaattgaaaaatattgaaaaggcgtcgtttttagattgtttgaacatgcactatgtgtctatatgtactgccttttcagttttcaaatgttgatcagagatggcggggaactgaagaaggctcgtttgtcaatttgacagaatcttcttctaagcaatgcagggataagctagctaactta

SEQ ID NO: 61628 - DNA, 2034 bp, Oryza sativa
  unsure (1)..(2034): unsure at all n locations
tgcaggtttccttcagctttgtcctttttctttcctggtcaaagttggttgcctgtgaaccgtgtcgttggtgttcataatcttcagtagtgcttcaccaaccatagtccaataggcaattttgggcgatattttggtaagctgaaagatattttaaattgagctagaacgattttgggcgcattgagaaaacaaaaggatttttttttcaaactggttgatatatttgtgcaactactatatttatttcaaaatatagtaacctagagccagataaaattcatctattactacgaatctggacactgaaaaatcattttggcatgtggccattagccaataattctggctggtttccttcagtgtgtccggggtccctcttctttcctggtcaaagttgatagcttgtgcatgtcaatatcgttttggtattcgtaagctttagtgctacttcaccaacaaataaccctaggccagctgatatcagattaaaagacatatagtacaccttttagttgagcttgaaagataattttggtgcgtagctagagaaaataagggcgctttgatttgtaggaaaaatataagaattttggaggatttcaatcctatgaaaaaaaatccattgaaggcctttgaaacaaaggattgaatcctatccaatcctttaaaattcctatggaatgggtaatcctatgcacattttggaggaaaattagtaagaggtctaacctcttggaacatttcctctaagtctatctctctcatctgattcctgcgttttttcctgtggtccaatcaaacggtcattcctgtgtttttcttgtgtttttcaatcctttgttttacaattatattcctgtcagaatgtgtttttcctattcctctgttttttcattcctacgatttaaaggagccctaaaagggagaagaaattttacctgaaaaaaaaaacactcgtggcttcagtttgcaggcatccagctatcgatccagattgtctcatctttcttttcttttcatttttatataaaatcctttttgagaagaagatcgcccttctttgatcttgaattcctgactgctaatgcacaatatacatgagtgtgtagtagtggcggtgtactacgtatgttttttaatagatgatctagtgatcttttaagaaaacgttagatcatttatctcattaaaaaataatataaatatactaaaatataagtcatatttcaagtttctttaataataaaataaataacatttatgacaaacgatcaaacgccgtgcaagtcaacaacgtcatctattaatataagtctggatgggcccaaatcgtttttaatgggtgagcccaaaagtttgaggatgaatgtcataccatcaagctaaatgggccagaatttactttaaaaaaaggaataagtttatctaaggtcccttaacttgtcgacgaatccgattttcgtcattcaactgcaaaaccagatacagcgggtccatcaactgtcaaaaccagtgcagtagaggtcccttagcgatttagacagtgattttggctgacgtggcgcctacttggctaatttgatttggtcttcatctgacgtgacaatgacgtgtcgcttacgtggcaatttgatccagaaaaataataaacctcgtgggacccacatgtcagtgccacatacaaattaataaaaaatttagtggggcccacatgttattctcagcccccttcttcctcctctctccccatctccctcactttcaactctctctcccctctcctctctcgcgacggagagacagcggctcgcggcggcggaggcaaggctctggcggctgtgggcggaagagccgcaccacgtcggggagtccaggcacgaggaacggctcgtcgtccgacgcgacgcagtcctgtggggcgtggagcagcagtgctcgctgcaccgagagcgcgaagcaccccatccccgtgaacgcgtaccgcgggatgnnnnnnnnnnnnnnnnnnnnnnnnnnnnnnnnnnnnnnnnn

SEQ ID NO: 61629 - DNA, 737 bp, Oryza sativa
gtcgcccgtgcgcgacgaccaagacgctccgaggagcatcaccaacctgaacaacccctccgaggaagaactcgccatgtcgctccatctgggtgaccgagagcccaagcggctccgttcggactccggatcaagccttgacctggagaaatgaagtgcaaaaagtgctggttctgaatttctgattctggttcttcagagtttattgtcattgtggacagccaaaagtagtagtagatcaaaagacctcatatgcagttcagaaaaattgaacctgcagtaagcttcggtgagcttgaatggctttggcaagcatatcatgtaacatgatgtattattattactacaattgattcagccccttgtaggatgttaggtgctagtcctgcagttttgctgtgctcatgatcgtgagacctgatatacaccattgccggatcccttcctctttgtagaagaagaagaacaatgtgcagggaattatgataatgatgatctttgatctatttccccctattattatttaccaattatcaggtttcaattatcaatcagtctgaaatcttgcatttgcatttgcattttgtcaaccagtctttatcttattaactcgggatgatctgttgcactgtcactgacatgtggggcccctaccccgcgccgcgtcgcgacatacctaaccgtattaaactagatcacctccgagtcttttgttacaaaaggaccagctaccctca

SEQ ID NO: 61630 - DNA, 1159 bp, Oryza sativa
  unsure (1)..(1159): unsure at all n locations
nnnnnnnnnnnnnnnnnnnnnnnnnnnnnnnnnnnntatactttgataaattgcagggtctttcagtaagacgcagaagctgaaaatatatgataattagaggacaaacatctagagatttatatcttgtttgcgtagacaattagggaactccatatggttttgttgcctttaatttagttcttaaacaactgctagatggtcttcacggatggcctgctgattttccaccttcattcctttgtactgattcagtatagtattctctttctgtgtcatttgattccaaattattctcatggagcagggaaaactgtctctgtcgatgagaaaacaaatattgttgtccctgaggatagatatggactatacgctattgacactctggaccccgacatggtaaaacattatttcatatatttggttaaagctctaccttttactgttattaatttccaaaggttcctttaaccatcgattatattcaattctgtttaacttctgtctattaccttccactccgcgactgccatatcagtattgtttctatttagtgattccttgccggaaacattcacagaccatcctattcttgttaaaatagccactagtgatgattttgtgtattgtctttctgatggctgaacaataacttgcaagtgcttacactctttaaagccaatttattgtgaacctgtaccttcacagctcaacaaacgcaaatcatatactgcagttgcatacctgatctgcaccacttatattacaatttgaattagcagatcattggcgatgatagtgtttgctactatcacgacatgatagtgcaaatgatcaaatggggataccaagaggggaaaacattatttggatttggttatgatttccgccagagtaacaggtgaattgtgcacttctattcctgttttgcacatacagttctgtttatactttacaattctttagtgtttgctcaactgtgggggatcataatnnnnnnnnnnnnnnnnnnnnnnnnnnnnnnnnnnnnnnnnnnnnnttcaagtgagttaacaggtctcttataaaaacacaattggctcaggctttcagaaacacttnnnnnnnnnnnnnnnnnnnnnnnnnnnnnnnnnnnnnnnnnnnnnnnnnnnnnnngctt

SEQ ID NO: 61631 - DNA, 3122 bp, Oryza sativa
gtcagcaagcaaatagcttgcttgacttgatgactataagagctttccatagcaagatattgcggcgttttagcctcgggacagcagtgggattccgcatcaggaaaggggatctaacagatatccctgcaatccttgtctttgttgctcgcaaggttcataagaagtggcttaatccagcacaatgtcttcctgctattcttgaggtgcggaaacttaatctccattgttgtttgaatttggtttgggacggtctaagtttttctgctaaatctttcacttagttggatcattaacagggtccaggaggtgtttggtgtgtaggaataagtcttggctggttggtcttggtcttgtggtgcctttttcctgcttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggacatggcttttgtgtttagtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcaccagcagcaccggttgcccctccttcccctttcccttccccctctccacacagcagccccccggaggtgcgccatgtccgacgctcggtctcggcgttcggtcgcctcgagcactcggcgtcagcaggacgccgagctcgccgcagcagaagagcgcaggcgagcatcggctcagaccgctgcagcagcagcgagggcggccagactggcggcagcggagttggcagcagccagggcggagccgtaggcggaggcggcggaacatgcggcacgtgcggcggaggtagaggttgagaccttgcgcagcagcatcaacggctccatcgccggcgacatcaccgctgacagggagcttgaggagctggcaagaggaagggcacgggagcgagcagagcggtgggcagcagcccacctccacggcggcggcggcggcccaagggaccgtgcgcccgccgacgggaacccagacgggcgcgggcgtgccggcggcagcccggagcccgcacgcggccctcgcaggcggcacggctccctctcccctgaccggcgccatggtcaccacggcgtccagacggtggtcagggattttggtcccggcggtgggtggcctaccctcaccaaaaccaactacatcgagtgggccgcggtgatgagggtgaggctccaggtgcggcacatgtgggaggcagtccggtacggtgacgtcgactacgacgaggatcggcgggcactggatgccctcatcgctgcagttccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacctacgacgaggagagagctgtcgagaagctcttccgctgcgtccctgagaagtacaggcagatcgctcgctcgattgaatctctgctggacctctccacgatgtcgatcgaggaggcgttaggtcgcctcaaggtcgtcgatggtgatgagccacggcctctctcggggcccatcaccatcggcgggaagctccatctcactcgggagcagtgggaggcctctcagggtgacgggaggaagggggagtcatcttccccgacaggcggccataagccgcgcaaggcgcggggaggtgtccagctacggtgggcgcgaagacgtgccgagggtggcgcccgcagaggcgcccagggcgttgccaccggcaaccacaagccggcacgagacgacacctgccgcaactgtggcaagcttggccattgggccaaagactgtcgacagccacgacgcggccaggcccacgtcgcacaggtggaggaggaagagccggctctgctcctagctcacgcaagcatcgagctacctccagcggcaccggccgcagcggctttcctccaccttgatgagccgaaggtactcgtctccctctgtgacggctccagcaacgacaaggctgatgggtggtacctcgacaccggcgccacccatcacatgaccggccgacgggagttcttcaccgagttcgactccagcgtccgaggcaccgtcaagttcggggacgcctccggcgtggagatcaagggtgttggctccgtcaccttcaccgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggcactaatcgactttacatcctcagcgcgcaggtcgcacatccagtttgcctcgccgctcgtcgggacgacgaggcgtggcagtggcacgagcgcttcgggcacctccacttcgaggccctgaagcagctcagtgccaaggagatggtgcgaggcatgccgtgccttgaccacgtggagcagctctgcgacgtctgcgtggtgacaaagcagcggcggctcccctttccccagcagacgagcttccgagccaaggagcggctcgggctcgtgcacggggacttgtgtggcccagtgacaccggccacaccaggaggacgacgttatttcctgctgctcgtcgacgacctctcccgctacatgtgggtgatggtcctcggcagcaagggagaggctgcggacgccatcaggcatgcgcaggctgctgcagaggcgg

SEQ ID NO: 61632 - DNA, 994 bp, Oryza sativa
cagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactccttcttgcgctggctgctcaggaaggctggggcgtccatcacatggacgtcaagtcggcgtttctaaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttagtgatcaccggcaccaaggatgcagaggtcgcggcgttcaaggaggagatgaaggccaccttccagatgagtgatctggggcctctctccttctacctggggatcgaagtgcaccaggacaactccgggatcacgcttcgacagaccgcctacgccaagcgcgtcgttgagctggctgggctcaccgattgcaacccagctctcactccgatggaggagagactgaagctgagccgcgacagcacagcggaggaggtggatgctacacagtaccgacgtcttgtggggagccttcgctacctcacccacacacgggcggacttggccttctccgtcggctacgtcagtcggttcatgcagcgaccgacgacggagcaccagcaggttgtgaagaggatcatccgctacgttgc

SEQ ID NO: 61633 - DNA, 2083 bp, Oryza sativa
ctaaacatctcttgttccacccctttccaatgtcttcctgctattcttgaggtgcggaaacttaatctccattggtgtttgaatttggtttgggacggtctaagtttttctgctaaatctttcacttagttggatcattaacagggtccaggaggtgtttggtgtgatgttgatgttgttgaattttcgtactacggtgcaccggctcaaacacctaaagagcaaatgttcagtgagcttgttgataagttatgtggcagtgacgaatgtattggttcaggctctcaggtactcgtgttctttccctctctgtgtgtgtgtgtatgtgtgtgtgtttgcaaaaataccatgtgcattaagcacagcatgccatcatctgcacaataattgtacaggacaataccatgtactagcaattgtacccttcatgttgtaaggggaccgttcaaatttgtcaagattcatcgcaagatttgctagtacaaagtggataaattttcatggcactctgaagattatgccaaaaactgaccgttggtttgttggttagtcctaacatctaagtttgaccagttgagcggtggccacagctagtttgaatgctaccaatgttcattacatcaaagcagatgatctgatcggagattggaaggagtttctccttctaaatcatatcatatcatttgagatactgcatactatatgttggttcttgtgcagattaaagcttctggattttacacaatcctcctaccgtttaccagtcaaacctttaacatgttgctgtgctctttttgtgaaatttcaacttagtaataatattttgtgacatgcactcaaactacatactccctccatcccaaaaaaatccaacctaggataggacaccaattctggacaaacactttgtccagttttgctgtgacctatcctaggttgttcttttttgggacggatggagtacttctgaagcgttcgtccttatagttctgtttcattgtttcaggttgcaagccatgaaacttttggtactttgggtgcaattgtgaaacggcgcactggcaacaagcagggtggtttcctcactaaccatcatgtcgcggttgacttggactaccctaatcagaagatgtttcatccattaccacccaatcttgggcctggcgtttatcttggagctgttgaaagagcaacttctttcatcacagatgacgtttggtatggaatctatgctggaacaaacccaggtagagcagttacaaattagctggtcagggctttatctacaattgtttgtctatttaaaaacaatgtcttaagtaacattaaaagacacttcaactcactgtataaatataaaaaataagtttcctgcttcctagttcccatcattcatattaatgccggattgcattttttactagttagaaacaaatcaacatttagttttgattgtaaaaaaaacatactatgtttgtgcttttctggtcatttaacacatttaccattttattgattattccaaatgatgtatataccagtctaattcccaaacatatatgccgccccattatggatttgcagagacatttgtacgagctgacggtgcatttatcccatttgctgatgactttgacatttccaccgtcacgactgtagttaggggagtcggtgacattggggatgtcaaggttatagatctgcagtgtccgctcaatagcctcatagggaggcaagtatgcaaagttggcagaagctctggtcacacaactgggactgtgatggcctatgcccttgagtacaatgacgagaaaggaatatgcttcttcacagacatccttgttgttggtgagaaccgccaaacatttgatttggaaggtgatagcggaagccttattatcctgactagccaagatggtgagaagccgcgtccaattggaattatatggggtggcacagcaaatcgtgggaggttgaagcttacaagtgatcatggccctgaaaactggactagtggggttgatcttggccgtctactcgaccgtctggaacttgatattatcattaccaatgaatcactcca

SEQ ID NO: 61634 - DNA, 768 bp, Oryza sativa
caaactaggggattttgaacctccttagcagtagcctgcaatgaaatggttgccacacccagggttactatttttttcccctgaagctgatgttctgatagaaataagaattacctgaatctggttttctgacggaatgtttttcatgcaatggacaatggctccatactctcccttatgagcaccactgctcttacaagatgagaaaagttttgtcactgccatctctggaccagctataccctgtaaccaagaattcgaaagaaattcaatattcctttcaaaagaatataaataaattaaataaaagatagctagcagttatatgacaaacgctgattgaaaaataaagtgatctcaaggaagaatagatcttttcatttcacaggtccagtttaacatgcatacattaattcagtgttgctggttacatgcttaaaatcctgtatggacaggccattttccatgtgagaaattaatgacaaggggatgcttttaactgtggtaatgaattatctaaatattgtagagcagtacaaaaagcaaatacctcctgcgatggatcagacccaaaaggtgaacggagcttccatagtgtcggcacaatattttaagcagtgaaataagcaacttctgatcatctcctccatggaactccctgatagaggaatcatagcctccaataatctcatcaagccacttgttcacatcctttgctgcagcacttccaccaacatgggggccaggaataggttgacaacacaacac

SEQ ID NO: 61635 - DNA, 1002 bp, Oryza sativa
ataatgtcagtagagtaatgaatttgttgacaaatagagcgaagaaaacaatattagatacagtatacacataagcacccccccccccccccaaaaaaaaaaacaaaaaacaaaactaataaacatatatatcaaaatattcaaggaaaattttccaggagcccaacttcgtcctccaaccccatgcggtggttggagactctccagctcatgttataatttacaaaactagacaattagacaatgcgatagtgttatataaatttcggggttttatttgattcataccaatttatttctgcaaattcatgtcctattgaacctctagtagcctaccagtatgatcgatggtcctggctttatgagtaggggtggatctatctagtagacgtgcatctggatgggatggccttggcagacggcgagatctgtgtcgcctctctttgatctgattcagtctcagtaatcatcatgtttatttttacttacaccccgtggtccattgccagcgcattatctatcttcaattcaattcttccatcatccgtgctgcaatttctgcacaatgttatcgatcctactagtagctactagatcaatgtagaacacaacccagtcccacctcacctcaccttcccaggcaacttactctgcatctcctatgcttttactgtaaccacatagtgaaccatatttatttcacttcatccgtattatgagtacggttctaagaaacacatgatccaaatttattacacaaatgatatatggtccagattagtttcacctgtttgcacaaaactgtacatcccgcaaactcgcacagtgaatgttttgaatgtgatacttgagcacaatacagacagacgattagcagcatggtggccatactaattaaggtcttgggtctcaccagataatagtagaatacagctagcctctcagaattctctcctggggaagaagcccttatcatgcccagcaacaggttcagagatgagg

SEQ ID NO: 61636 - DNA, 1413 bp, Oryza sativa
gtaacaaaactgaaaagaaatttggaaggacgggaaagggccacattttcaacttgcacatcttcaagcggcgccgtgcactgttagtagtagggcctaacaggccgatccttttcaggcccatcaaatttattgggccaaaaaaatcctagctctgagggcccaaaagaatttgtccgcgagaggaaaatgtcttgtttggaccatcaatcaatcaaaagaagaaacaaacatgaggcatgtggctcttgcactgatcccccgagacagttttgagatgggatagtataatctttctgaattttgttttgttgcctctctctttggatggatgtacttctcattcaatcatagctgaagacatgatgacatctttacatctaaagtactatcatatcatatcatatcatatagtttgcccatcatgcgtatacttgtctgccgtcaggtatacagtaatataacttgaaatcgacccatcaatctacaacaaaccaaaaaaaacaaaattcgccctttcatgtgcaaataaagctatcttcctgactgtacgtagcctacaacaccagatactgcccgatcgacaatcaaaatcaatggatgcatttaccaggcacagtccacctggcattgggctttgcccagggtggcaacctggtgtagttcttccagtcagcaagaacacccttgagatcactgatcttggattggaggccgatgcagcagttggcgtgcatggtgcagatcttgctcagatccttgccgtagctgcagaatccgccgatgtaggccgtgtccaggtactgaaccttgagcttcagcttcttcaccagcttcttcttgatgtggttgaacaccggctgctcgttgagccccgggtgcgagctcctcgcctcgtgccactccttggtcatggcgatcgtcctcgcgctcggcttcacgtagaagaagcccgtgtttgggaagttgtcgatgttgtccgggtcaccgaagaacacgtcgctcgagatcgccatgtccgcgtacaccgccacgtgcttgaacggattcctcagccacacaatgtcaacgtcctgatcttgcaattggttaattaatcagttcatcttgatttgcagtcaatggcggtgttaatttcaatttacagttactgaattaccgtgaagaggaagttgtagccgagctggagaattcggcgctggagcttgagcttgctccagacgagctcgaggtagtccttggaggcgaagaacttctcggaggtgaagtcgacgtcgaggccgggcatggtgtagaggtagcagtgggggtggacggcgcggcaccgggtgagcgcggtgggatccatggcgacgactaggacgtggcggaagagcttctgcgtgccgtcgccgacgcggaagccctggagga

SEQ ID NO: 61637 - DNA, 3270 bp, Oryza sativa
aatagtagatcaagtctcatggaatgatttctgaattcgtggttatatgtagcatatatcttacaaaatcattttcttggtgcatttggcagacacccaaaaagggttagttgtgtcctactgaaattgaagaaccccctgtttttattatgatgagttgtactgttgagttaattttgaacatgtgaggaaactgtgggcaacagagtgaattcaagacggcacaaatttagcagattactgataccagatgacgcataagaaattaaagaagtgaaaattaattaagccgggagattaatgagaactaacctcttcttcaagatctgtactggttgctggaatatgatgagttggtgaagatgcagtagaggtcgcaggaggcttggttggcggctgctcctcggcgacagcagtagcagtcgtcggaggcttgccggtgatgttagcctcctcgccgccacgtgcgatcaccggcggcggcggcgccgttccattgccgccgcagtgcagcagcagctggtctctggaggtggagaactgcaccggcgacctggcggcgcggccgtagtccggcggcgcctggtactggaagagcagcatgacggtgagcgtggccacgcagccgagcacgaacgacgccgcctgccgccccgtcgcctccgtgaccgccaccttgggcgccatggacgatgagatgaattgatcgatcgagctaagtctctgcagcgggcagagtgctaaactaatatagatcgagacgtgtacgcactgtaccaagacgacgactgctgctgctactactgctaacttcgttccaaaataaatacagtcgtgagtttctgtgtccaatttattttatttaaacatttttaaaaaataaaaaacataagtcatatataaagtactattcatatgtatgaatgtgaacaatactaaaaaattttataatataaaacggagaaagtattatactaatcataaaaatttcaaataagatgagttggacacggaaacttatggctgcacttattttgggctggagggagtaggagctatcagcagcggccgtgtatgtatgtatcatgtatgtatgcagtatttatttgtgtatttgtatacgtaggtgtagatgtggcaatcgatgggttgcagttaacgaggcgtacgaagatagctgccttgccgtttccttccctgaaatagctgctactccactacaagtcgacgaattcgatcgagcactagctgctgttactacgtactccctgctgtaactgacgcgagaaatactccattctcgaccgattcatccaaattggtgccatcactaccctcgatcactaaagaattagactagtccatgctttggaagcttcgctgcaagtagcaaaggagatacctgtgtatgtatggatcgaaaattcgaatttaagaataataaataggtgtagtaaccgtatagtatgcatgagtgtgtactactatatgatattcagctggtaaactgtctagctagctactagctagtgtttaattttgatatgtgcgaactgatgatcgagctgagcaatgcatgggtgtggtagtactaaagtataattaagctactgatcaaattcgatcggcttgagagttagtgccgggaggatgggcgcacatggcgacgaacatgagttggcgtgggtgacggatctctcgctttgactactcgatcgccaccgaaatgtatgtactccatgagtatgtatatatgttcttggcaatacatggagaattcatcaactaactagtgctccatggttacatattgaggtgagcgttgctgcttaatttcccggacggaccgggcatgctgccatgtacacatgcacctcataatctgtagtatcaatcatcagaaatgtttagaaacgtattatctattatattcagatatgccaactgctgctggatccatggcactgctcatactacagtgagtgagtacagcagcttaccgaataaagtgcaataccatttacgtctcaaactcctcctccttgaaaatgctctaattatcctccacttcaacagatgctaattcatggatttcctaactgcactaaactactgcaaggcattgagctgcttaattcaggtatctctctgttcaacgtgatctgcgggcaattaaattaaacagcagactgaccaggcacatactggaagtctggaagtagcaaaccagtcgctggccttttctgcaacagtatttgtatttcagctaacctgtcaattagtgatcgatgcgttgtatgacgtgacagcaactgctacgtggcgttgctgcatcatatatatgaacagttcctcagtttacttgcagagaaggttcgcacttagattagcatagcaataactaaatgctgcacagtgctgctacttaatttggttactagtactgtagtactatgtgtactggtggtagtagcttagctaggatccattgattccgccggttttagagaatcttgtagtgatgtagtcgctgctgcgaagtgccacgaatcattggtcattcatatgttcatctaccatttgctcaacttgttaggtttcatctgcgatgctacttgtttgttcggtccatctgctacctacttaaactactcgatctatcgatgagacgatgacttttgccttagttaattggacctgcgattaattaaccaacatgatggcacaaatttattttgctgtcattagctaattaagttcaactgctgtgtccactacgctgactgcacgtacacacgtctgcatattttattttttttaaagaaaaactagcaatacatgcagtctttgctggtatccacagattgataccgctggatctgtatatcactggtggagaaatgctttttagtcccgtttcgtaacccccctgtagtcccggttggggactacgaatccgggactaaagatcgctatctttagtcccggttcaaataaccgggactaaaaatcaatctttaccaaccgggactaaagatgggagcatctttagtcccggttgataacaccaaccgggactaaagatattttttctttttttttctgcttttaatattgaatattgatttcacaccatcccctcccatatccaaatcatcacatattacagaacatctccaaatcctcaaacaaatcatctccaaatacattaccaactcttaaaaaaattacatcacagggttctaaaaaattcatcacagattcacatct

SEQ ID NO: 61638 - DNA, 10270 bp, Oryza sativa
tgtacttctacttcgactcttcttttttttctttttcttcgattaacgtagctgaaattcagaattaaaaataaagaatattaaaagaagagtccatataagaacccagtacgagattaattaaaattcggaataaaaataaaaacaaacccgaaattagcaaaagaaaataaataaagagttcaagtaggaatacaatttaaaattagctgaaattcgaaattaaaaataagcaatattgaaagaagaatccatataagaatccaatacgagattagttaaaatttcaaataaaaaataaaataacatcgaaaattacaaaaattaaaagagtgttcgagtaggaatacaattttgaaataactgaaattgtttcagctaattttaaattgtatttatacttggactcttctttattttcttttgctaatttcggatttatttatttattctgaattttaattaatctcgtattgggttcttatatgcactcttcttttaatatttcttatttttaattccgaatttcagctatttttaaattgtattcctacttggactcttcttttcttttctaattttggattttattttattttatttcgaattttgattaatctcgtattcggttcttatatggaaacttcattcaatattgcttatttttaattctgaatttaagctatttttaaattgtatttctacttggactctcattttcttttctaattttgaattttattttatttttatttcgaattttgattaatctcgtattgggttcttatatggaaacttctcctttccttttctaattttggattttattttattttatttcgaattttgattaacctcttattgggtttattgggttcttatatgaaaacttctttcaatattgtttatttttaatttcaaattttaactatttttaaattgtacttttacttggactctccttttcttctttttctttttattcaattaacgtgagaatttctagtctcaacagcgaacgtggtgcctcctttcaaagctgtctttatataatataatataatagatataatagataggtagataatagcctggacacatgcttgatgattgatgcaaagctgatgcattcttttatctttacagaggagctccgggatacaagcatgctagaattaatctgtatacatacgtacgtacgtacgtacgtataaatatatgatgtaataacttaatatatagattttcctaacttgacaaaaagaatcggcgcaactaataattgaggagaaagaatttggcagctcgagaaattaaccggcctgcagtcgagcgatcgcctagctaaattaaccaagcagccaaggcaatccagcaatgctgaacgctgcgtgtatatgcatatgaacatatgatcgatcgatcgatcagtggatgcagatgccggggagcttccactggaacttgcccgagcgccgctcgtcgggcggcgccgccgtgtagttcctccagacgtcgaggacgcctcggaggtcgtgcatcttggcgccgaggccaacacagcagttggcatggagcgtgcagatcttgttcagatccttgctgagctgacagaagccactgatgtaggtggtgtcgaggaactggatggcgatgcccagcttcgcctgctgctcgtgcttgatcaggttgaacacgtcctgctcgtgcttcccgaagaatcgccacctcccttgctgccaactccggtagaaatcgagggtcttgtcgttggatcgcacgaacaggaagccgccattggggaagttgccgaggctgtaggggtcgccgatgaacacgtcgctggagatggcgatgtctgctcccattgatatgtgcctgaacgggtccctgaaccacatcacgtccacatcctgcaaatgcattcatatggattaattaattactgtcagtgcaatcctttttcagtttactgttcattcagccattgattggattaattgtactcctggattagtatgcaattcgcaagtcattctctgaattttgcaatcaatcagtgagagcgccatcaggccaggaaaaaagggcatgagcgtgtctgcttcctcttgctcaacggaatctttcagtttcacaggttcagttttttcggtcgcctgtacgcgaaagacaagccacaagttccaatccaaatggacggccgggccgacaacaacacgagtagagtagagtatagacgaacgtgtcaaagtccaaaccaaacggtttagtccaacttctctcgaatcggctgcgtctctgcttagccgaggacatttctgcccagcaactatgatgaaactgtagtgcacgagagctaagctaagctagctagccaagcagagcactagcagccaatgtatcgcccaatccggccaactcaaccaccacttcgatggaacacatagtatattgcatcgaaaacgacatgaaaatgaatttatatattgcaattgaagcgtgaaaagaagaaaataatttagtactgaccgtgaagaggaagttgtagccgagctcaaggatggtctgctgaaacttgttgcgaccccacatcatctcgaggtagtccttgctcatgaacatcttctcggagcggtagtcgacgccggtggtgcggaggaagtagcaatggcggtgcaccgcctggcacccctcgtacgccgcggggtccatggtgacgatcaccaggtggtccagcagccgcgacacgccgccctccccgagcctgaagctctcgaagaagaggtccagcagcgaccccggcttcgtccacgccaggttgatctgcgtcatgatcaccgtcctgtccttggtcgccgctcgccggagcacctcctccaggtcgccgtaaggggacgccggcgccggagcctgcacattgtatatgcacacatgattcatgattggtttctgttcacatttcatgatcagtgcagatatgagatgactacagagttggatttttttgcttcatgatcactacaaactgaactccaagaattggatttttgctgcatgcatgtgacgagttggttgcgtctctatggttcagcattggctgacaagtggggccatttttttttggaagaattgagctatgggcagcaactaaagctgagtatagcagcaatctaggagaagacacgcccatgaatgccatgctgcaactagcaaatgagctcaaaccattccttcattttatctctttttatgcaagattttattttcaacaattgaaacggccaatgcattttcttctgaacaacgacatgtgctacctcacatggttgaaccaagaatagattttgcctgtcagtaagacatactactctgtcccatagaaaatctaattctagttacaaacttttacacacatatgtctagattcgtagctagaattggttgcgaacccgtcttctctctttagccttagagcaggtttaataaagcaggcgactgccggcggtaaaaaacaccacatcagcgatagagataactatgagataactagaagatgggtgtatgtacagctgctggctatacgcacaagcaccaatgaattgattatcatttttttacgcccaatccgtctgtacccgcgcattgcctcgcgtagacccacacgcagccatgggataagctttttctacagtttctttcttcttgaagttcgtgtgtagtcggcgacaatttaggtggtgtttggatccagtgatttaactttagtccctgtatttagacactaatttaaagtattaaatatagactacttacaaaactaattacataaatggaagctaatttgcgagacaaaatttttaagcctaactaatcaataattagagaatgtctactgtagcatcacataggctaattatggattaattagactcaatagattcgtctcgcaaattagtccaagattatggatgggttttattaatagtctacgtttaatatttataattattgtccaaacatctgatgtgatagggacttaaaagttttagccccatttaaacagggccttagtcgtccgctaacaccctctctcctggttttttccatccagctcatcactttggccaggttggatgcgctatcgccggcttaaaccgtatattgtacctgctcttacgcgaaaaccgccagacagaggcgtcatgggccggctgaacatccatcgccgatcagtcacacatggaccgtccgatcgggagccggactactagccgtttccggtgccacgtgtacccatcccactgcgatggccggtgacacgtgtgagaacatggcagcagtggcagtaaacctgtgggacccatgccgacagcagctacaggtaaaaaggagctagtagaacgcgatgagtcaccaggtctagactagttacatcatgtggagaagaagggaattagctgctggtgttaacaagtgtgattagtagtaatagtgtttacatggggagaggggaaagacaaaagtggttgggagaaaggggagaagatgggagcaagaaagcaggtgtcaatggcgagcattagcatagaggcaggaccgtgtctttgtgttgtaatctagactgactaggtaaataaactattactggtatggtaatctaatcagtaatcacgcgggtttggttaaccggtcgccgtcaggctacgtaacttgttcaaagaggattcctcctcctcctcctgttaatgtgttttgttaattattgctgatcgcggcagcatatgtaaatggcatctctggtttttatttgagcttattaaatatcacaatttgatgccatctccaccaccacgcactacttaattagtattactgtttgattattttttattcttgttactgttctttcagaaaaaaaacggatttgttaactccagggaggtagaaacatctgagggaaaataacctcctttgttttttttttcattttgaaatcttcagaaatgatattggtgccaatcaattcgttttgttcatagcatattgaagcaataaaaaaaatggcaaatatgtgcatacctggacgggggcgggagccggagcagcaacgacggtgacgttggcggcggcggcggcggccagcgagtcgttggagtcgacggcggcgtcctgcaacgggagcggcagcggcggcgcgtcgtcggcgttgctccaggcggagatgtcagcgaggcggcgtcccgggctggcggacatgacgaagaggatgcagacggtggccatggcggcgcccagcacgaacgacaccagcgggctaatgctgctgctgccgctgccgccgccgccgcccatcgtctccccacccttcatcttgccgccgcccagcatcgatcgatcaaccaatcaatcaaactatagctgcttcctccgttgatgtgacgaatggtttcttgctcaaattaagagaggttcttgcttcttgtggcaggatggtggaagaggaaggaaaggcaaagcctttgtctgaagaaaggaacaagaaggaggtatagtagtagcagagaggagagggaatgggggtatttgatggaggagcagcagcaacaggtaggcgaagaccagcctgaaagggaattaacgggcgtgatggaggcctaagagacagatcatcatcatcttaatcctctcccactgattgatttactcgtagttttggctttgctggtgtgatgacaacttgtagtgtgatgcgtgcctcttgcttcagcgtgacaggtttcaaagtcgcaacacacggttgctttgctttgatttgctagctgctggagctggaggtcgaggtttggctgtcaggaactcaggatgggttgggttgttggtgccgaccctgtctgcctgtaggttcgcgtttgtttaggcgtagactggacctgatgcgttgaactgttgagatggacgtaataaacccgatccggggtattattctgatttctgaattctctccctgcatccctgcaataactgaatttttctatgctacttacctgtacatgacattgtgtacgcgtctttggaggtgatttttttagtgttgcagacggctggttggttttattctgtttgctcacatgggggagaaacaatatttctgaatttccctcgtactgtgtaggaaaataaggttcgacatgaagaaaagaactgcacaatcaaacgttggatactgttgctaatttgagtacaaaacggtttcatgctttgaatattgttgcttatttatgtcaaaaaaagtattgttgcgtacaaacggcttcatgctgtatggtaaacaccgccaatcattcgcgtgctgagtcttacaaaacgaacaaacattcactatcggtctatcgccgcatgtagaagaaaatgatggtaatttcgacctgcaactgttagagttgattaattattaatttggtgaagattttttctctaccggaaggaaatgactaaggtgctattagcgacttctagctagctaggtcagacgccatctgatggccaccacaccctatatgctactagtatgatgctgcacttgccgtgttaggtttgctcatgtgtaagtcgcagcaaagctcatgccgctgttgccatcgatgagcaaaccttacctactagctctgctatctcatcgtcaactccatctttcgctacttgcatcttcagaaaaagttcagaaaaactcagcctgcctcttttcttgacaaaataggttccttgttcagagttaaattgaactgtctgcagcgtattcttttgtagtttttcgtgtatctagcttgtcattttgaggtaagcaagtaagcaccaacttctgtcattctcggtatataaacaaattggagaagtaggcatctaaataaagggtagcgtgagcctgtcattctgccgccaatttcgggattgcatgcaagactaagctttgaactataactgaacaagtaatctgatggcgatttgtcggtgcagcgatttggtactagcactgctaatctgaagcacaacagaaggattgttttttttttttacctagctttcactctgcttttgcaatcttgcatgctcttgggtgcaaactaccatccatcaatagctttggccgatacagtgctatatacttttgtgtgtttctgtcagatcagtctatgtgcaacagtgcaagtgttcttctcaactgctgaaaaagccaatgccggaggaactatttttaggtggaaacatatactatgcagtattgcagtaaattaactctccacacgggcgggtgaataaacttgtttacactgcctattattaattatctaaaaacattattcatccattttcctatagacagacgtctctattgaaggcctaaatacatctttgactaactatcttattctaatcattttgggtcagggaaaacaacatgtacaaaaacgtgcatatttccatggaagttagcagcatatgcaacacatattctgttaactaatcaggtcgggttcctgtcccgatcatgattcatgagccgaaatgtctaatagaatggcctagctgactgattgttttgcctaaccatataaagactggccgggttgattattatttatccggtattttgtcttaataatcaccagatacaagctgcttgccaaaccttaggcgcagccatgtacacatttttgcctttcctgttgttggttgaatcataacattagcaccaaactgtctgtttaccagtcttgaggaagaacaacaccgtaaatcacgctggaaatgctgcattttgctagccattcttatgtagttgatgatattatatatgctcctaggtttatggcaagttggcagagttaatttgattagaacgacagatgttaggacgattactgtgttggaagtttcttggattgacctcaaacgtgcaagcagatataaggctggcaacttgactatagttattagttggattctgtagtctggtctgcacatataatattatacaggtaatcagacagcattatatattgatatatactactgaataaaggaactaagaggttcagttttaacgaatccatgattgcgacatgaacaagaattaatctattcatatctagctacttgctacgatacgagctaacatgcacccaaatgaaaaaaaggaagagaaaaaaaagaagatatgatgtgcacaacagtacagatggtatatgtagccgtttgcacatggcttctcaagaacaaaatgcagtggcttgccaaaacttaggacagttggaggctctgcatttgtgtagcgagtataatattgggaaatcttgctgtttaagagtaaaccagctctgcatagctatatgaaaaggagtatcaggtaaccggctttgcaggggacctcacacggagagacgacgacagtggagaggttgctgtttaggtgcatgatgccattgctattgctgtattaggccaaactcaactcgctaggatgacaattattgcaggtgaagcgtgcataattaaagcatgtatagcaccaaacatgcatgaacctatcagttatatatatgggttttcagactaggcaggagaactatttttcagagaatgccctgtggatgtttaaaccaaatgaacggatcaaatcagcagcaggagcaggtaatgtgcctgtgtttgaggttgtaacacgtctcaatagtattttgcagtaatgaggtcacaagatcacataatcatatggattaatgggagatggcgaagaatcatgtttccttgtgtcgcagggcagcacatgcattgcgtcgccgccgttgctgtcctccgatttaacaagtcaaaaggcagaaaaaagaggaggagaaacagtagtttaaacaagaagaaaagtgcacaacgaaacgcggcgttctcgaggcgctttggctacctgatgatatatactaataatccaaattaaggaggtaattagaataatatactaatatagaagaatgggcagctagttagctggtgatatgaaaagaaaaaatgaaatggttggtggttgtaccggaagaaaggaaggttctgcctgcctggatggattacaagaaatcgtcgtcgtctttctgtgctaggctgcaactattgcaaagccaaacacgtacacgggtctctgcttttgcttccgttgccgttgaggttgttgctttggtcgccgccggcacaacgtgctttacctccaccgacacctcatcattttctctgaaaaatttgcaccgactcgttcgtcatattctcgtgtgaaaaaaccaactcccaggtgaaaatcatgtgctgtattttctctcctcttcttctgaagaaaaaaagggaatgcagagaccagtaaaagttctgtggagatcatgtatttatattcttgcgtgctgtctttcgaccgacaagacaataattgggttgaaagaatagctagtcaacgtccaacaatccagtgaggcagtgaccagtctagttttccatacatatatacagtagtacccccatttcgttcttcagaatttcagaaacagcaggacgaggtctcccatacttccaccgttcaatgaaactgccctctcaagaaacgcgtgcatttgtccaagtcggtgccaccatatttctgaattcccctcgtactgtgtattaaagctataaaaactaggatgaagacccacacagattatgcggttagcatgattatattttttttctcacataatagcataaatacttatgcattttactattagaatatattgaaatggcagcataattttaaattatgtactaacttgaccaaattaactaacatgtaatattcatatgtatatacgtgatagttgttaattattttctaattctaaattttagttatttgtaaatagtatttctatatggactctatactcctattcaaatatctcttaatttttaatcctgaagttcctttattcataaatttaatttctataggaattctaaactcttctttcaatatttcttatttttaaattttgaatttttcaatatttcttatttttaaattttgaattttagtcatttctacattgtattcatgtatggattctatactgctttaggaatagctcagtgccaccgagtaatgtataaaaatatatgtatatgttaatattttgttttgtgcaactacattacactctgacaatgagagcagaaaaatagaggaccgcat

SEQ ID NO: 61639 - DNA, 929 bp, Oryza sativa
atcaactgattgagcaacaattctaagagtcaatccaactgtaaccaggattcttgtaattcttctctcatacatcatactccttatttctgctgatttagtccaatcccctagagaagcaagcccactggacagttgcacatacaagctgggatgtgacgattccatctccatcagcttcttcgccaccttccgcatcatggcctcattgccctgagctttgcatccaccaataacagttgtccagctaaccgcatcagcttcaaagggcatattttcaatgaattcaactgattcctctagccgacctgcgcggactaagagatcagtcacacatgcgtaatgctcagctgatggactcacactgaagtccgcttgcatccggtgaaaccatgtcagtccctctttcacgagtccagagtggcagcatgcagaaaggacagcaataaatgttcgttcacttggttttatgcccttagttttcatcaactccaagagttccaatgcttcatgtccatacccattggaagcatgaccaatcagcattgagttccataagacctcgtctggcttatcgatttcttcaaagatcctgcacccatttgctaggcttccacatttgcaatacagatcaatgagtgaagacgcaacaacatgatcagattgcaaaccaagaacagtggctagagaaaagatctgctctccaaaactgatagagcaaatgctgctcgatgcactcagagcactggctatagcaaccttgtcaagccgcaaaccaagccgatgcatctcacagaataacccaagtgcatccctagcatgcccattctggctcaacccaaccaccatagaattccatgagatcacactcttaccagtgatcatatcaaaaattcttctcgcctcttctatctgcccacagtttgagt

SEQ ID NO: 61640 - DNA, 1665 bp, Oryza sativa
tgagtgttatatttcgagatcaacatggatcgaatcaattgttaactgcaatgcaagtatcgtctacagagttatgctgattcaagcatgtttatgaagaaaagcataaatatggccagctgagatatttcttcagttcagaactgctggagttgtcagccggttattgtgcttgcccagctccattgctgacagctgaagaaacaacaaacgtttacctcttgatttgagtggtgctcgaattcaacacaaacagaatcagttgttgattgaaccggaagtgctgtttatggaggattggaggctcttttctcaagaacaacatatatttggccaggatccttttttcccagttcagaactatcagggtcgtctgttagttttcaactgaaacatactgccatctaaatgtatgcatttcttcatttcaagtgcattgcaagcttaacattttcaggctttgagcaaagcatagagaagtaaagcagcagctctcaatgatgaagggagaacaatggtactagtcagttggcagtacttgaacagaagacttacccggaccaattggtgaatggcacctaaacttgtaccatatgcagcagcaccaggatacaatcctctctcagcaccaataatctgagttaagaatacaacagaccctccacaactggattctgagtcccggagtcgctttgcaattgcctttactagaaaccaaggtgtcattacattcgctttcattgtcttcttgaactcatcttcgcttatattgaggcagtcttgtacttcacctgcccatttgggaaaaacaaacatttgtaaatgaaaacaaagcgccattttgctgaagtagggggttccagatgtgtcatatcgtggttaagtttgatcaccaggcatacagggtacaagcactaaccaattgatcctttcagttgtatcctattactgacaacaatatctatctgatactggttttgtgaactaaggcacttattaagaaagctacggagaatgcgacatgaagtacatataaaaatacaattcactttattgttgcagaaatttacagtgaaatttcaacagttcatagttgacagacagactgatccacccattgcccaaggcacattttctcgggtagtaatctatgaaagatcagatagggaattttctctaaaattaaaattaggtgagcactgggcagactgtttggattgagcttagagcatggcgaaatgttgtggttctcagctacgagtacacgaattgaagtcgaccggaggaattttcttttgaaatgcagaggaacaactaagaattagctctgcaggaacagcatacagaaattcagaagtagtgtacggaccctcgtaggagtagcagttcaccatggcgtctaggccgtctaagcagcgccacgccgtgcccaccgccgtcgtcgacggccgcctcgtcgcagccgtggagatccagccccaccacagcgaccgcatctcctccgtccccaccgcgccgcgcctcctccgcggtcccagccagggcgccctcgtcgccgaccaaaaccaatctacggcgggagaggacgaattagagagggagagtggagagcacggcgaggcaagaggtccgtacgtacgtaccggcagccatgggtggcgaggg

SEQ ID NO: 61641 - DNA, 16436 bp, Oryza sativa
aagaatgttccacgactattactacagatgaagattttgaaacctgagaggctgagaatatagtgacaagtccagtggatagatttgctgtactgccaggagaagacagagaaactgactaatacaaacatcattgatcactgacccaaaaaaaaaaaaaactttattctttttcttcatcaagtccatgtctactattagaatgttgaattatgaattttaccctcgagctaacatatgtagccctatcacccaatatttacacattacaaattataatgctaaacaacgcaaagagactattgataactaggtttgctttaacatcccactactttgttagaaattatttttaaaacccatggaatgaaagatgtgtgttttcttaaaaaggaagaaatgtgtactccttccgtactcgtaaaggaagtcgtttaggacaatgtttaagtcaaaccttgggaatataaatcatgaataactctcaagttattgagtttcaaaatgtaaaaattatatgaatagattggtcttgaaaaatactttcataaaagtatacatatatcacttttcaataaatatttttatagaaataagaagtcaaagttgtgttttggagaccgtgtcgctgtcctaaacaacttactttacgagtacggagggagtacagttttagcacatacctgtggtgaattatcaacaatgaccacacgagccaagtcacgtccaagaactgatagatcctttaagtagtttccctccacaaagagacaggactcgcggtaaactcgatggcggaacaacctccttttaggatcaagaatattaagtagctgttctgcataaataccttgtgactagcctgtgcaaaatgcatgcatgctcataacatgtcttgactacctggtcctccaagcaactctttcagcatatggcacggtcaacgtcacatagcattgtgtgtctctctgagattaaaatgaactggtgaatgctgaagctcagcaatcttcacagggtctcaagtagtagagtgcaccagtgtctctgcatgacagcataacaataatggtacattaacattgactgctcaatataaagtacagaggttacatgtaatggctaacaccaaacaacaggacagactgtatatgatcaagtaaatgaacaaccggagatattgaaggctaaacagaacaggaatgtgcacacatctcatagggtggatgttctctactccctccgtcccataaaaaacgaatctaggaccggatgtgacacatcctagtactacgaatctagacagaggtcacatccggtactaggttgtttttttatgggatggagggagtactcactaaaagctaagcaacatgctttacaattatatcataagtggaataataagcaagttacacgatcctaataacaatatgcaatccattttgacataaacttataactgtgcaaaatccaggtctcatgagctttaacatttccaagctaatcacagattattgactttggaagaaacataatcattaatgattccattaaaggagtttaccaagagtctatccaagttaaagtgtgcacaacattcacatcttaccatccagatcaaggacaagggtagttctaggacagctccgagtttgctttggaagaagaacaggttgaaacttgggaaccaccaaagataaatcaggcaaatcttttatgaaggcatacggatcaaaataatcaagctctacagtttcatcaggatcagcacacccatctgttgaggtagaatcttggctttgttcatcaatacactctagctttgagtgctgcattgcaagatatatagcagacacttcaggagaaaggctgcccaattcactgaattcatcaccttcgagcgtgcttccacatgccgattgcatatgaatatcataagagtgtttgctcaaaccatcaaaagtattgcatgatatgctattggtaacatattcagcattctgaacaggctcatgtatgacttcttcatgtactaagcctgcataatgacaatggcgtattggaaaatacaaactggagaagcaatgcagcaggtatcagtatgcacagagtgcatctaaatatgcaatgtacactatcatgaagtcatctaaaaaatgttgtttttcttattctctagataaatgcatgtgaaaaattcaaacacagatctgacacttggagtgcagaaaataaatgctaaggtggagttatattcaaaaggtaccttcgctcaagcagtcagtaacatcttccttctgattgtgaaaactgggagaaaatatggaatcacatgaacgatcttcatcattttcatgagattgctagcaatagaaaaagatcaaccagacaaataagtaaaggataaagcaacagtcaatttgaggttatttcagaaacaatattgctttcctcttttttcttttttcgcttttatcgaaacacaccgtatgttaaaatgtatgattacacaaatagacaacacctgaccagctaaaaaattcactttgagcagaaagaactttaccttgtgattgaagaaactgctacttggcacgcccgcgacatcatttccagtaccagcagaatcataaatagaattcaattttttcccacccctaagagctcgatttttcttcagaaggcctccacctgcagaggtagcaattcatatttggaacaaaatcaagaaaaatctatgtggagccacaaccaatttcaagaaaactaaagataaaggaaaattgaagaataatttcccaaataataccaagcataattgtagtagtggacaaaaaaaaggcacttaaacatcaggaataagcttggatataatgagcactgcagaacacaacaagtaggatgaaaagctctggaagttttcagtttactctcccatactcatagtttcatacattcctataaataggctatagctttgtactgtacataatagtaggggaaactttaccgatctgctttttggaggaagaagtgatcagatcattgactttatgttcagcagctgcagcctgagttgatctgcttgattttcggctatttgggggattgatatgctcagtggtggcatttcttgcaaggcctttttttcttgttggcattttcaatcaagaagtgtcctaaatagcagccgatttatataccagaacaagaatagcacatcagacaagcagacagcccgtttccttggtgaagactgctcagggttattgtgcaactttcagggtgctgacctagaggaagatgagaaaggaatcagctataagcagtacaagtcaacaaactgcatttcaattttcatacacgattgtttaaaatgatgatacacaaaagttggtataaaactacagaatacttcaggacgtcaaagattggaaaattaacttcatggaatgacatacaaactcactacatacactgaacttagctcttaggtacttcaatcaatatatgtcaaactctccccacagtcatcaaaaaacaggacgctactacggcatacacacttcagtcactcggtaggccactccgtacggcactcaccgtatcggcgttcgctactactacaggagtgacccctcagctcgcggcagcgacgaaatcgcgcatacggaagtcggaggaggcggtcgctggtcatcagcgccggcggaacccagcagcattaccggaaaatccaagcatgaaggtgtcgggagtcaaagaggcataccggaacaaggagagcagaggcggcggcgggcgggacgggaccagccggaggaggcggcggaaaccaaaccctagcggcggcggccggagaggaagcggacaggagaagagggatttttgaatcgtcgaagaggggagggagctccaaaagggcgagaaagtaagcgtgtcaggtgggccccacgtcagaatccagtaggtgtaggcgggccgcctggagcttggcccattaaggcccaatcaaataatacaggcccagtaagctgaaagaaccatgggctataaatagctagctggttttcggggaataaaactccgaaccccctcgacaggttcgggaagaacacgcgttcgtatctgcaacgcgaaataactcaacggctgcatatgcagagttgaatttgaacttatatatattacatgttaatacaacttcttatattttttaaaaaaaatcatatctatatttaagtaacatacggacacaagtaaatattccctccaggactcaaaatccacttcctatatataccaccagaagctagcaggaacgggaaggcaggtcggtcatacacgtaagataggacgagtatgagagagcgagagcaatagcaaagcccagtgatggcgacgctgctctccaagctcctagctctgcctcaacaatggcagctcctcctactcctcctcctcctcccaatcgcctccctcctgttggtaattggcaggaacaccggcggccgtcgtcgccggcggcatcttagactgcctccgggcccagcgcggctgccggtcctgggcaacctgctccagctgggcgcgctgccgcaccggagcctgcgggatctggcgcggcggcacgggccggtgatgatgctgcggctgggcgcggtgccggcggtggtggtgtcctcgccggaggcggcgcaggaggtgctgaggacgcacgacgccgactgctgcagccggccgtcctcgccggggccgatgcggctgtcgtacgggtacaaggacgtggcgttcgcgccgtacgacgcctacggccgcgcggcgcgccggctgttcgtcgccgagctcttcagcgcgccgcgcgtccaggccgcatggcgcgcgcgccaggaccaggtacagtacagtacaacgatagcctgcatcttgtttgtctccctactgtgtggtacacacaatttccatctaccaagtgggcaaaatttccacacatgtatgataggcctgcttggatggtgaggtgaaggagacattttcattgtacatgcccttgatgatgacatgttgataattggttggtggtaggctggtagctagctattacctccataccgaaataattatagttttaagtattaaggttcaagaagaaagatgtccttcattaaatggtgaatatgtgagattgtgagggtggttgagggtaaaattgagagcaatttaaatgagatatcattgatggaacaattagtactctagagtgacaactgttttgggataaattttaaatcctaaaaatgcaattattttgggatagatatagtactagctactccctatgtcccttagaaaaccaatttaaaatggcatgatatattttcttgtacataaatgtaaataagtttttatcttagatttattatataaaaaacttggatttttgtgggacgggggtacggaagaagataacgagtagcagattcgcgattttgtcttcgtctgtatgtttccacctattattggatatatggaaatctcgctagctgttggggggaagttgcatgcatttgacaaaatggaaagcatcggtgcaagtggatttgacaagtgaattactttatctatacattaaaattaataatctagaaggtgcttggttctcatctccagctttaataaacataaatatgattaaaatagtttagttgagatgttataagttaatgagagagaggagacaacaaatttgcaccttaatcagatcatgtaatgtacttacatgcttcctccattttttaatatacgaagttgtttacttttaacattatatttatcatccgtcttattaaaaaaaatatagatataatttattttcttatgattttttacatcaactaaattaaaatctcaactttatacttttacatatttatactaatttttaaattaatataaatgatcaaacgttatagtatctaattcgtattggttgatatatggaggattttgcaatctaatcaagtgcatatacattcatttactcatcacgtttcaaacatcaatcaaatagttatacagttcttaaataattgacaacatttaaatcaaaataaaagattcgatcataaatattactactccgtactaccataatttttattatagtgaaatctgtagggttttaccttagatgtgttgatgattgaaatatggcagtgatacaacgtatggcttggcacttggcaggtggagaagctgatcgggaagctgacacggccggagccggagccggtggagctgaacgatcacatcttcgccctgaccgacggcatcatcggcgcggtggcgttcggcagcatctacggcacggagcggttcgccggcggcggcaggaagcgcttccaccacctgctcgacgacgtcatggacatgctcgccagcttctccgccgaggacttcttccccaacgccgccgccgcccgcctcttcgaccacctcaccggcctcgtcgcccaccgcgagcgcgtcttccaacagctcgacgccttcttcgagatggtcatcgagcagcatcttgactctgacagcagcaacgccggcggcggcggcggcaacctcgtcggcgccctgatcggcctgtggaagcaggggaagcagtacggcgatcgccggttcaccagggagaacgtcaaggccatcatcttcgtaagcagcagcagcacacgtcgtcgtcgtcagctagtcaaatacacaaacacctgccacgcatggcgatcgtgacggcgatctttgcttgtaattgcaggacgcgttcatcggtgggatcgggacgagctcggtgacgatcctgtgggcgatggcggagctgatgcggtcgccgcgggtgatgcggaaggtgcaagccgagatcagggccaccgtcggcgaccgagatggcggcggcatggtgcagccggacgacctgccgaggctcgcctacctcaagatggtggtgaaggagacgctgcggctgcacccgccggcgacgctgctgatgccgcgggagacgatgcgcgacgtgaggatcggcgggtacgaggtggcggcgaggacgcgggtgatggtgaacgcgtgggcgatcgggagggacgcggcgaggtgggaggaggcggaggtgttcgacccggacaggttcgaggcgaagcgggtggagttcaacggcgggcacttcgagctcctgccgttcgggtcggggcggcggatctgccccggcatcgccatgggcgccgccaacgtggagttcacgctggccaacctgctgcactgcttcgactgggcgctgccggtggggatggcgccggaggagctgagcatggaggagtccggcggcctcgtgctccacaggaaggcgcccctcgtgctcgtgcccactagatacatacaactataggagtacaaatgaaatggaatttagctagtagcaaagccgcgacttcggccttgattagttcctaaattattttttttccaaaaacgtcacctccaatctttggatatatatatataaaatattaaatataaataaaataaaaaattaattgcacagtttgtatgaaaatcacgagacgaatcttttgaacctaactagtccatgattagccataagtgttacagtaacccatatgtactaatgatggattaattatgcttaataatttcatctcgtggttttcaggcgagttatgaaattagtttttcattcgtatccgaaaactccttccaatattcagtcaaacgtttattgttacaccctaaaattttctttttcgaactaaacaagcctttcatttcatgcctctctcccctacgttttgctgctttgctgttcaacatctacatacttattgctccttcacagatgtactcctacttcataaattaagattgggtgattagaatggattggtaatttgttgagatatgatgaactaatatctgcgtgtaataacaaagtttatgctccgtcatgtcctaattacttgaagaattagctgaggttgcgtgaatccccagcaagacgagaaggtgattccacaggaggcagattagactagagtggcctgtaaatgtgttttgccacagatggaggatggaacaagaatagtaggagactgacagagtgaatcatataattgagccctcatcaatccttagataggcagacctgtcgaaagtctactcgcctagtaggctcttcaaaagccggccataacgcatgccaggctcagctagtctgatgatctgctctttttatccgatactttttgccattcttcggaacatgtacagtcacgacggacctgaccagggtgatggcttgatctgatccttattgtaggtgatctgatacttatctcattcctccataccatgctatgctcttctttcacatgtaccatattcgatatgcccggtcacacgagagcaaattcattcatgtggctggggaatggaacccaagtggctgaggggtgtccatccatgggtcaacccaaataagcaagcaaatgtgacaaactcgttgagaaatttgcagagaagaatataaaatccaaatccccggatgccctccaaaaagctaaggtgcacagatacacatctcacattctcacatccagcaggccaatgatccgttgatcgccaccttttgcttgtcaagggccaaatattcttgttgtgccaaacacgctgcctccagccaaagtcagaagctccttccttataaatatatgcccaggcatgcaaccatcagtacacagccacaaatgcaagtgcagatgactgactagaagagaggtcttgcatggaagtaagaggccatcttcgatagccaaggatgatttgcctgtagccccattgtcatcagctctctccgtcgagagcgacaaccgggctctactggcaagtctcctcggctacccgagtacctcttatgctatcccatgtcagacctgctcttctttaccatcagtgatcatcaaaattcacaacaccaacaatgaggtaagcaatctaagtaacaaaacgtcccagtgattaccttggtggcgcttgtatgtaccaaaggcatcctctatggctacactgtattattctgcagttctgtcattgccaatctgccattgtggtactatcagccaccaccatgccacaaaaggttacacttcggctgaaaacacacgtcttgtttagatatttagtatttctggagttcctcccaaaaatatatgatctaagctttgaaaaaatatcaaggatgatttttatttagctttgcacactcaactcgtagcctttcctttttttcctttcaaaaacacaggcacacaatctgcccatataaaacagagcagcaccggagtacactgaaaattcttcaagtgcaagactataatattagggaaccacggtatttcttgggggtgacattcaaaaaactatggtttttggataaagggtcccactcactatcatttgaaatgtatcaatgtctctcaccctatcgttccaaccttcatgtcaggccgccatccagaatgtcttaaaccaggaggtattaaggataacctgtgaggaaggaagaattggctgagtacttcaaaagaaacctctactacctgaatctggtgccttaccaatgcgattcaacttttcaaccaaaaaataatctggcagtactaaaaaataactggtctacttatttctgtcaattacaagcccataaagtcttcttttacttcaaatatacatgccatccgtacttgctcagccccccatttccaccttttagccagttgacctcatcgttaacacaagttggagaaacattgcatggtagtactagattgtacatgatgtaaggaatatgtgcaagtctaaaacatgttctagcattgaaatataagcgatcagttaagggtacaaattaaatcattatgtgtatttgcaaaaaggttattacaaataaaaccagaatttccgcatgtttctgagaagatagtcaagttatatataagcacaaccaagatataaacaaattcaacacattgaaaattgtatttgcacgataattaacatgttgaaatcattgataaaaatgaaagttaataagccatgatgaactccctacatcagttgtctgcatgacatagaaatgataataggcaaacaaaagttgaagcatgtcgaaatgtcaatgacaagtacagtggaagagcggacaggcaaacaaggcaacaatgaactgacaaatataagcaacaattttaaagatgaatattaaataggacagaaggaacacgtagctattttttgctgattagatggatggaacccataaggaacatagcctggtactgtttcaattagttcaattatgatgatatcaatcacctgccttacttttcatatgaacaccttacgggcataaaacagcatttatgaaaatagttttcaatggctttcatgccataaagttctgtttaagcattctatatcagaccaacaacggatggagataaatgttgattgacttgaggacaaagttagataccagtttctatggacctgatgttgattttttttttgttgttgttggaaatcatttcaacaaagaatagtcttccccacttgatatggaataattcctcatggggatcatgtgttgacctttcatagccttttgcaaggttgaattttatgcattatttaacaatgaccttaaacagagctcaagaggtgaacaatgtatacatgtttcgaaacatatcatatttctcatgatttctggtaaaacgtatggtcaaaatagagaaactggtcctgagcaattttgagaatatatacctaccatggtcaggaaaagattcaaaggaaaaagtgcgctgatgtgccataaaggaaactatgaatagcatattgatttttatgaaatctgtgtggctgtcttgctgcatgtgcatacctactcctttgccgagtatgatttgcgcccttcctactcgaagctgtaatcctaccttacctttacaagaaaaaaattcatgtgtcctaataagaagctgtttgaatgttctcagcagctcttgcccctcactaagcctgtatgatgtacctcttactacactaccaaaaaactgtggtgccagccagaagtcatcgagaagaagcttgctaaggtagtcaatctgacaacacaaaaccagtctaaacaacatgaagtaggttagctctgacaaccgaatttaaagttgcccaatagataagcaaatagccacatactaatgagtaatgaggctactaagtagtttccattttggattggtttcattctgtttactagttgaccacataatttacattttatcactacactgcaattattggctgctttctcaaaatagaggttcgcaacgatatcaaccagagtacttagcaactggcaattagcaacctccaatttcacaacacacaatgcataacacttctagatttcgtgtgcaacaaaggtgaccctatatgttctatttatccaaacattaaatttgtaggttgactaaccaaacaatatagattaaggccttcagttgtgaccaaataaagaaaggcctcagtaggcatgtaggagtcatgaggcctctggttttacagaggcatagtctgctatatttagccttttatgtcgtgcactaatcaaaatcattatcatttcatgattatttctactgggtttgagagtacaatttgacaatccgtaagaacaccttttaaatcttgaaagcacagcacaaggatcagcataggaagtagtatatcaaaaccaagtaaacaatgatcacatttattacgagcaaatacagttgattcaccttattccattcattattcaaatttcgttcaaacaattcctttcgaactagcggagtagatggtcatcaaacctatatacacacttgggttgacaaatgccataaactagcagctttctatggaaatgaaacaaaaattgggggcaatagaagctaagagctcaccaactcaggaaacgctgtcgctcctctggagcttctggatggcggcatacaacttcctcctcgacccaacggcgccgatgcccatgtccttgagatcttccaacgttagcagcgggagcacctcgtcgtctacctcgtggatctcgaacactggcgcgtaccgagagagcccaagtccatccagccacgccttcacgccaccataccccatggacccagggagccggccgttcgggagaccccaatccgccacgccgtccgactcgtcgccgctggcgtcgcggctccccgaaaccctagccctggcagcggcggcggcggccgagtcggactggtcggcatcatcatagtaatgctccgcttcttcctcgtatccgtcggtgccgggagcagccgggatccaggcggtgcgcggccggcgctgagcgggcttctggccgcggcggtgggcggcggcggaggagtggttgagggggtcaagggcgtcctccgggtgggcgcggcggggcgggcgggggtgggaggaggaggaggttttgtggtggcggcgctgcgggagcgggacgtcggcggcggcggcggagtggacgccgatgtcgccgaggcggacgctggggcggcggcggcgcttggagtacggcggcccggcggcggcctgcgctccggaggcttccgcggcggggtccccgagcggcgcggcggcagcggcagcggcggcggcggcggcggcgctgccgccgttggtgtcaggctccggcgggtggagatcggccatgagggcgaggcgagatgcgtaatccgtgagggcgaagacgagtcgtgggagagaagagtggatgattcccttcaccaactgtggcgcccgcggcttcgggagactcgcgctcctctctctcctcgattgccgctgtggggaggcacgatgccgacacgtgtcggatcggacggtgaggatccccggttgggcgctcgatgaagtcgccgagcgttgactcggtagagtcggacgcaacactctctgaactccagcttagatgggcccaggcttcagtaacacgggttacggcccatgggctttttccttttacccctccatccatttcgtgctgtactcctgctcctcgagtctcaacaagcagttgcgaacttgcaattgcagctttgagctttggtaaatagtagtaataaagtttacagagttggtgaataatcatctatgcgtacttatgttattgatgatgaactacttgttgtctcctccaggaatgtgatgagcatgattgcatggagagtgtcaaactgctgagcaggctgcagcagcagcaccaataatccataggagtagccattagtgattagtgtttagtcgttgttgcaggtaggtaaattcgtccttggacctcaggtgtctccttcaaggctcgaccagttcacgtggtcctggccggcctgaaaaaaacaaacctgttgattttgattggattttgatatgatcagacgtcctgtacccggaactgggactcggaaaatctgggcgtcgttggtcattgccttgctgtttgggcgcaagagaatggatggatatttctgaaacaaacaacgggtgtgtgcaagagaatatctgaagatcactcgccttcctgtggccactagtaattcggtgctacagtttctcttcccatcgatcatatgcacagtgcatggaaatgacctcaatgcatgaatgatgccattggcacagaacactgtcgaaccaaaaacagtcgatccatccactgattgatctgggccaatgtacctttcaaccaaatctatcactctctaatagcctgtccttttctctcaaggctaaataaattataccgttgttttctcttttactagttggcatcagcatgaatcagtttatacattatattatatagaatacatgagtatctttcggcaccaggaatcgcagatgagcttcttacataaagcataagaccagtattgggtctttttgcccgtcagacaagtccactcttgcttcttgtatgcatgaagaatggaaaatactgcagctcagctggcatgttccaagcaggtcaggcctaacagtttgcacacgaattttgaccagaaataatccacaagtccagctccaaccagcatccagattcagatgacgcagttgcagaaaaaagatcgaattcaatatggaaggattcttttcagagtccacaatatgtacaagtgttctgtgttcacttgttcagtctcaaccattcataaagagatactaacagagttcaagttcttgttgcatacatcttccaagtgccaatagtttatttattcacgattcacggttgtctgttcactgttttgtcccttgattcttcttttatttgacgagtgcgccatggtgtaagcatgaatgcgttgcgtattcagagaaagtgaatctgaattttctgttgatcaagtaacaaagaggaagacaccatcacaccacgctctacttgctgggttcagagaaccatgaaactttcagagtgggagtagactcagaaatcaattcctttatatatttcgggcttgttcacattgatgccaaaaaaaaccttatcaaattttggtaaattttggcaatttgccaaaattttggcaggatttcttatatagttaccaaaatttggcaggaaactaaatatagccacttttttggcaactttaccaaaatttggtaaggttgaaaataacatcaaagtgaacaggcccttcagctaataaaactcctacgctgtatatattttttccaatgctatgaaactctgaagcttgagatgaatgttcagagaaaaagaaaatggcaagacggttataaagtgtgccttttgaaaagtttatctataaatccatttttgggtgaggggcagttgctaaagacggatctttgttggattctttttttaaccagctgacttgatttccactgagcattttgtcctcctatgagcacctcatgcatcaatattgcatgtttgcaccgttgcgattttttatttctctttattttgtttgcttaagccgatgcatgaaggatgcaatttgtcagtgaaaatcaggtaagaagaatttgacaatcgtatggccagaatttttcaaaagaagaagaagaagaagaagaagaagaagatttttatttcattatatccacagtgtatctattgttgttttgttgtcttcttccaattcaatcagtatcacataaaaccaaaaaaaaaagactgaaagtggcaggtttttagattttcgtttggtgcattcgtcgatagtatatatgggtatcatttcttcataaaaagatggaaacagtttattgtctgcaagtgatatgtgcttgtcagctttcctgctgattataacaaataacagttacattgttgggtgactgatcagcctgatctaccctgcaattcagcaatccacacaactctaaacatgaagaaaaacattggcactagtaacaagatcaccatagcataaggcccagtttagttcacaaatttttttctcaaaaacatcacatcaaatctttggacacatacatggagcatcaaatatagataaaaataaaaactaattagacagttagggaagaaatagcgagacgaatcttttgagtctaattagtctatgattagccataagtactatagtaacctgcatgtgttaatgatggattaattaggctcaaaatattagtctcacggtttccagacgagttatgaaattagttttttcattcatgtccaaaaacctcttccgacatccggttaaacatccgatacgacaccccaaaattttttcttttccccaattaaacatgccctaaattaactagaaaacatactcctgagatcgagcaagtatttactgaagccatgccaatgcttaaaaaaagatgtagccatgaatcatgccaaagaaaatgtagtactactaataagcttagatcaaaatcaactttagtttagtttctagagagaaaaataaaaaatggttaaccaatcatattcatggtggcaatgttggagtgggacgtaggaatcgcaagcagtgttcccatcgacatacagagacagccggtggattccaaaacaaaaccggcgcgaggtgaagaccccaccacacacgtcgcttccaggtgggccctcccatccgcccacccccactcgcgtcgcggcgtccccccgcccacctttcgctcgcccatttttctgcgtcccggcggcggtggggccccgcgtctcgatcgccgtcggagtttgatccacgccgtccactggccgcgtaaacccaacggcccgcctctcc

SEQ ID NO: 61642 - DNA, 3598 bp, Oryza sativa
  unsure (1)..(3598): unsure at all n locations
tggccgcgtaacccaacggcccgcctctccccgccgtccgtttcccctccgcctatataaccccctcctccccactccaacctccaaccacccccttcgcctcgccgccacctccgcttcgatccttggaagaggtgaggagaggagagatctagaagcttcggtcggtgctgacatggcggtggcgctccggttcgcggccgtcgcgcgggactcgccggcggccgccgctccccccagggtggggagggagcagcagtatctcgcgtgcgcggcggcggcgaggccgggagggaggtgttcgaggaggaggggattggtggtgcggtgccagagcggggcggcggcggttgtcctcaacaaggacgacgcggcgtcggtggccgccgccgccgcctcctccgcgacggggttcaccgtcgccatgaagttcggcgggtcgtcggtggcgtcggcggagcggatgcgggaggtggccgatctcatactcagcttccccgaggagactcccgttgttgttctctccgccatggggaagaccaccaataacctcctcctggtaaccatttctagctctcgctgtgattgtgaaactgaaatgtatggatttttctaccgccattctgtgcttaactgtgagtggttgattggttgttcaggccggagagaaggctgtcagctgcggcgccccgaaggcgtctgaaattcccgagctcgcagttatcaaggagctccatgttaggtgcgtttcgtttttcatttttcgtcatttcaggttagtttcggagcattcactcctgattattcaatttttcttgctttgctcaggactattgatgagcttggattggatagatcgattgtttcaggtattgtccagtgcttctttcacaaaatcccccccccctccccccaaccaaccaacacacacacaaaaatcactggaagcttagtctgtctgaagcttcccaattttccttatggttggcannaaaaacctagcacgtgcaaannnatgtaatatttnccaattctatgttnngatgcattaatttccatcttttggcacatgtatagtcgtcaaaatattgcgatttcacagtcctggttggtgtaaggtttagaagaccttattattttaaaggccataagatggtctatcaaaactacaggtaattcagattagggcattgtcatccactaaaccacatatctgtttttattcagtataaactaaagaccaccctctgatgggattttttttttagctacacaaacagtcctcattactatacgaagaaatttgatttcagaagttagacaatatttgtggttgaggattgtcaataaacacaagaacaccaattttcctttaatgttgtatggtggtgacaagacttgaggtcgttatcatgcattttatgtcattttcagcagagtacctttctattctgtatgcaacaaggtgatcttgtgtatcctatagcttagtgcctccaccctagttggtttaactaaagtagcggtttctaaagtaatgttcatacttattctaacaatgctttgaattcatacaatggacacataatcatcgagcagtcttaaagtagatgaggcagcaattgacatggcaagtgcaggtgatatacatcacaaggaagaaaacacattgtaatgtttgttttgttccagtttctacatacaacaaccaaataatttaaatgcagcaagtatggaaaataaactccaattaccctatttagaatccccaatctaatgacaatgaaatggaacatgtggcttctctcatgatctaaacctgtcaggtttctctacttgttttatagcccaccatgttttaaacatgaaagattttagacagctgaaacatggtatgctgcatccttagttataaatcataataccattttaaactttcaccaatcattcttcagcatattatccattggtcatcaatttatttttggtcaatgtagcatttctcgtcccttttgtctttaatggaagtactttctttagcactgtaccatctataaaagcactgtatttatcactgttaatatcaacaggtttattggaagaattggaacaacttcttaagggtgttgctatgatgaaagaactaactcctaggacacgggattaccttgtttccttcggtgaatgcatgtctacaagaatatttgctgcatatttgaataaacttgggaaaaaggctcggcaggtacatgcttctagtaaatgtgttggtgcagtagtttaattgaaggcttgttgagtgctttgtttcaatttagcttctagatccttttcatgataatataattcaaatattctatctaaaaaagcaacatctggacctgtgaaaaaaatgagagaatattactaccgtagcaaattgactaggttataggaataaggtaatttgggggacttcattacatttatcccttgctcatttgatttatagagattgtacatggttattgctagtgcaatagcacaaactaagaaatttctttccttatcaatagagctgatcactttcctttaaactgccaactgaaacctgctaagaaaaaatggcgtgcgatcagtttatttataaaatatacatgagtaatccactaaaacatagttcttttcattttttcttgtttcatagttcttttcattttttcttgtttccttttaatttctcatattcatttcaccataggaacaatgctggtgttccatagtaagttgatcttattgtgcttctatatgtgtgtagtcttttttaatggattgttattataatgagtatattttaattgttatttggtacctttttgttccatcaacacctaaaagttcctaagcatgcagcgtttacatgaagtttcagtgcgagcagttattggtatatgatggtggtccaggttttagcttgacgctgtctcaactaaattttgcttgattgcagtatgatgcatttgatattggctttataactactgatgatttcacaaatgcggacattcttgaagcgacatatcctgctgttgcaaagaggttacagggtgattggattgacgaccctgctattcctatagttactggtttccttggaaaagtatgcattttcccattactcatgtttaaggccatcgcgcctattcttttgcatttatgatgctgcacttgaattagatttgttatatttgtgtttatgataatgcacatcaaattgcagggatggaaatcatgtgctgtcaccactttaggcagaggtggcagcgacttgactgctaccaccattggcaaagcgttgggattaagagagatccaggtttgtgttcctaagtttgtgataattacctgttgaaaatccacttgctcccagaactcattcaacacctttaagcttctatgtgtaaacacattttcttagatcattccttcagttttgtgttcgttctggttctgcaattgaggaagttggttagatgtttaaccatatcagctgaaaactacagatatgctttgtggtgtctctgaggttttaccggctgttataactctttttcttttt

SEQ ID NO: 61643 - DNA, 2291 bp, Oryza sativa
gcaggttttctcaatatttgaagatttaggtatctctgttgattgtgtggctaccagtgaagtcagtatatcattgacactagatccatcaaaactatggtgtcgtgaattgatccagcaggtgagtttgagacagatcacgtttcgatatacatgtgtgatgtgtcaaacattgggtttgggggtatgaataaaatattgtacaaaagcctgaagtttgaattgcttgcgaatagctgaatgtgtttcatttttagttttctttggctttgatgaatatagatacttggaacagtagatagcccacatctagaaacctgttagggcaatttaaacttaaaaagaacagataatggattcaagttgttctgcaggattagcactttgctgatacatcctgaaaatacgtactgcaccagctgttctcttaattcaatattcatttgttttcttgggatgatgtggcaggaacttgatcatgtagttgaagaacttgaaaaaattgcagttgttcatctactgcagcacaggtctatcatctcactgatagggaatgtacagagatcgtcattgattcttgagaaggttattatctcttagccccgaaaactctggttggacatattgttgatgaacacgattacttgcaatcctgtatgctagggtgtacttttatttttgcagggcattgactggtttgttttttgcatctaatcatttacatttgttgctgtacgccaggctttcaatgttctacggagaaatggcgttaacgtccagatgatctcacaaggggcatccaaggtatccatctctcctccccagatgaacgaaattcttttgtgcaaatgaccaaagggtgtatgacaatactcactgtgcgtgatcaggtgaacatttcattggtggtccatgatagcgaggcgaaacagtgtatacaggcccttcattcagcattctttgagaacggtttcttgtcagaagttgaggaagaggatcttcaacacaatggctctcctgtgagcccaaatggtgtcatttacggaaactagtcgacttagcatttcctgctattgttgtatctttggaatttggataggtttaaaggtgattcaggcatatagtcatttaggccacctaggtgaaatggtgaattccctggtgttgtaagagccctacaaggagcaccctgtgttaatgataatcacgcatagcaggctcacttataatgttaagtttgctgcaataccagcggtgcgatcgtaaataacattgtttgttatcttttggaataaagaatgatccggtgttgaaacaattccctgaaaaaaacattgatatcaagtttaaaaaccctatcacagttgcggaagcaccagtgatgtgatagttgtatttgtatggtttcacttactaaggtttaaacgctagtgatcataaatatcacgcatataatcataaatattccacgcagacaaatatagtctcaatataggattttagtgagtctaggttgtgcattctaccgttagtgggccaaattataaaagttcaccggaggtcccatcaacttaacagcgagcagtaaattttgaattttcaattttcaatttagagttgattttggatttttttattgaagtttatttttttagcatttgtttttagatcactatgaagacgtgtataaaaattttatttataaatcatatttcgtttgtaaatacgatcgaggccgtatctttgagagtttgagttattttagagactgattgtgcgtctatgtgttaaaagcgaggctgagatgccacgtgtgagtactaaaacgcgagagttctactagtcgagtcgagtcgagcggcagcgcagcgcctccgcctcggcaagtcggcgacggttgcctggctgttccgcctccaccgcgagaggctacgtcggcgtcgctccgcgccaccaccaactcgcgaggccgcgacgccgtcgtcccgctcccgagctcgctccgcaagtacggcgacgacgcccgtggcgcgccgacttccatctccggccgccaactcgcgaggccgcgacgccgtcgtcccgctcccgagctcgctccgcaagtacggcgacgacgcccgtggcgcgccgacttccatctccggccaccaccaactcgcgaggccgcgacgccgtcgtcccgctcccgagctcgctccgcaagtacggcgacgacgcccgtggcgcgccgacttccatctccggccaccaccaactcgcgaggccgcgacgccgtcgtcccgctcccg

SEQ ID NO: 61644 - DNA, 1208 bp, Oryza sativa
gtgtgtgtgtgtttcttcgtggttttccccttcgttgatgctagggtcgttcgtggtactcatctccgtcgattttgcgtttttttggtgctccgatgaggcgatgatgctagctagatattgtcgtgtgacgactgcgagtgcgagctgtcagtttttcgatcgcggtgttcttcttcttttcgcaaatggacttggtgcttttactgagctatcttgctcgaacatatttaatttcggaagtctttggatcgtttcgtggcaagattttggatgattgctgatcttgttgttagttttacgttcctgtctccaccacctctccaaggcgcttcatgcgcgtacatcgtcttctggcttctcttccgttcgtgctccgcctccgcccaaaaaccgccgtggccttggttcacagtttgcaagccgcggcgagtgccgacgctgacgcatcttctgcactgcgaccagctacccatttgattttgttgtttggttggttttttcgatgagttctcttcggttttgcgctatgcacgctcgcgatagaattccgccgaaaagacaccattcttggctacttgtggttttctgcgtctctcccgtgctccatcgaactcttgggttgtttttctttttttaacctattcgtattaaaggagagggaaacactatacaacagccgtgaggctaggagcttataaaattgaaaaaaagagagaaacagtacgtggttggggagggggcgaccactagaggagtagagggtgcgaaaagataaatttcttgattacggattattgattgtgctaccacgggtatctggcagtagggactggattaccttcgctccacttgcgcgccatagccatgtttcgtcaattgcccggttaatgattccttgcggtggctcttgggttggttttttgagctctcgtgacccaattccgtcgagaagacgctcaagatgccatgctcggcaactagtgattttctgagttgtattgcgctcgatcgagatgccatcctcggcaacttttctgtcgctcttgcgcttgatcaaactccgcaagacaacgccggagacgccatcatcggcaatagttaagctagcctattgtttgttgggctttgggttttttttagtgaaatatatggccggcccctaaacttgtgtgttagtgtcacttaaatccgtgaacttgaaattg

SEQ ID NO: 61645 - DNA, 1810 bp, Oryza sativa
atgatttcttttacgcttttatgagatttcgttgcatttgtgtttctttttcagtttttctaatacattttcaaatatttgatccgtaggctaaagcataatgtcgtcgactcttaacaccctaataagaactttcctacgagggttctttagggaagtaaaagaggaagtcaaaaacaaccctgatattgttcgagaggtgtttgagaagaaatttctgatgagggaaagttgccactgccaagcgctgatgaggctcttcagctgcctgaggaggttattcagctgcctcccgaggtgcttgagcgaatttctaatgttcttaaggaaaccatccagactactccgatgtcagagaacattgagcttattactccttcagagatcaccactcttttagagagtaccctgctcaccactcctttacaaagaacttcatcaacaccaaatgactgcaacactatcatgcctatatctctatctgtgtactcaagtcagcacattcttggcttggtcaaagagattatgtccgatgtaaaattgagaccctatatcgttggagcagtctgcgttgtgggagtcatagtagcctatattctttacaagaaaagaacagctgctctcaacaatagaaatcccaatggaggggacgacattgctgatgatttttggggcaattggcatgatgggaacctggagatgtttgatgatagcaatgaccatggttcttcagacgatgaaggagccattcacgatattgttgccattcctggagaaggttttcaattcaatattattgctattactggaggagggttccaattccttgttgaggtatttggcagtgattcttcaaacgatgaaattcagaatgttgctattcctggaagagggttccaattccttgttcaggtatttatccctgaattattttcataatgagttttcagatcatgtactgaattaatcatttggagttagtgctatttctggcttcgtgaaagtatagccctctgtccatgcttattactatcttaattaatatctttaaaattacattgcttttactctcaggttgccatacagtcattaatatctttaaattgcattgcttttactctcaggttgccataccagtcgcccccacattcaaggtgttcatggcattgacaaagtttgaagggttcactgcacccccttacagccctaacaatagcaagaaccttcccctaacagcagccctcctcaagtttattgatgcggtgaatcaaggctccttagtgccatcagtagtcttcctcaagtttattgatgcggtgaatcaaggctccttaaagccatcagtagtcttccccagttctcaaatttctggattcaatagatcaaggctccttaccaccagtaccagtcatcctgcagtgcatgaatccaatggatcaaggctcctttcactcagtgcttagaccccagaagctgcggcatgcaggatatatatagctaggacccgacctatttgtcattcaaaggagaggaaatgtagcatagatagatagcattgttggttcgagagttcatacatatttgccgatacttgctgatttgagtgaaaggacgagtgagagatttgaagatgggcttcaggtaactgccgagaaacaatctggcttgtctagtttcgatttgatgaaaacttctgttcctagcattccttcgtttaacccaaatcatgtcaatatcacttgcatgttattgcattaacctgctggtagtttttgaccgaggtgactgttgataatgctggtgctgtggt

SEQ ID NO: 61646 - DNA, 3795 bp, Oryza sativa
  unsure (1)..(3795): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaaaatataatttagaaataactaaaatacgaaattaaaaattcgacgaacgctagccacgcgaggcaccatgctagttactccctttatctgcttttgatagtcatatttttatcttgacacacagatcaaggataaataattctacttatcatccatttaaacatgctactagtcattcctcgtaaacaagcgatttattaatatttacatttctcaatgcccatcttgtgtggaagaatagagagtcatgcattaaatccgagaaagtcattaagatgataggttgttggattgaaatatacctatcaaaaataaatttgtcagatttggaaatattactataaaaatatatggagggagtaatatattattatgtcaaattgcaggatctgaattagccggattccaataccgagatgacgactagccatgcaccagcattatcgacaagactgccggcggcggggatgaagaggtttgaagcgtaccggacctggagggagccgtgccgcccttgccgcatttgcgatttgctgcccgaaccgcgccttccctccgccgccggaccgccggaaatgcgctgagccgcccaaaccgcatccctcgctaacccatactctccctcggggctgagcttctcgatgtactctcgtaatctcaaataaaaatttctgtcagtcctctgtcaagtagtgtcctgctctgctgtcatgaactctagaatctgaattagaaatttgtcttctgttgatccagatcggttgatggaattatctatgtgcatcttatcgaattcacttgagaagaagcgagcctatatgaacacgcagccactcaaaaagacggtggtaactgcaagggcctaataagaaaaataaaggaatagatgttctcttcagatatgcgtgaacaagaaaaaggttagataccaagacactaaaacaatctttcaacagaatcggtgtgtttccaacaacatgaggtttgatacacttctcaaattttggatgtacccttgacccttgtataatccggaggagaccgtccaaaatgaaacaatcaaaatccagagctctatgtataaaaatcattccaacatccatcctaaacgaacaacacgagacgtatctacggatattgagggacctaaggcaattttcttctatgtactcaaattgatctttacatcaaaactggatgttatcctgtttgtctctaggagcaacacactgccataaagctctgaatgtttcgatttcccttgcatctattcctattgcacgaagattccgtgcatattcctgcataataagaaaaaccaaaaaaaaaaaaagaaatgtcagatgtggtgcagtgcatccatcataaacaggtatcatgtttgatcatataactaatacccattggtccttgcaaaaaaaaaatgtattggatggccaacatagaaacattcagattacatgctaaagttgttttccacagaaaatggtaaggttgaataagccaaccataagcactagttgggtctttgatgaaaccaaaaggcaatgaccctcttaaaaaaaatcatttgatgcaaaatttacaccctaaaataaatcttatatccgttatatataatatgtcccttatcagcataaaattaaaggacagatatcaaacctgaatgtcaagaaatagctgcatgcagatcttgtcagtatcagaaatgatgttatccgaggtatcggtattagctcctactcgtctttgtgcaccttgacgtagtctttgcaatgatgattcagttttccttgcctttatattcaataaaaatggtttaattcaccaataagcagatatgagctctcataagcagttaagcattccttacttaccacagtgactacttcagacaccatgtcataataaattgaagtgatcttatctgtcgatccacggcgcagctttgctttatcatcttctgataaatagtgaatacggtcaccttcaagaaaaacctacaagaacagaggaacatcacatatgaaatatggaggcaaaaagagcataaacacatgtttctaaatatcggggcctgcaaaatggcaaaacataagttattcttgagggtgataacgatcagactaatgggtactagatactgaccatggcacttaaaaatcgccaagaacacatactgaatgcagccattaggacatagacgctaccagttaagtagttaacttttgatgcttcacttttgagaaacataaatcataaagcagagaagtaaaacaggatgtccattcaccttaagtggatgcaaaatcccagatacatatggagaatgccttactggaagcttattggtcattctatatgttgctgttattccctttaggtgcttcaagtcctacaatcaaccagaaatatagttggtaagaacagaaggaccatgactcaaaattgtcttattgtaccatacgagtgatgaaccacagatacagtaagaaatgatgacattgcttctcttctgctgacttaggtgtactcacctcattagaccttttaactatcaccataatcatgacattcattatagcaggcaacaactcctttaaaggctcaacagcttgcagtatactgtgtttcacgagagcaagtacttcggttgggcatgatgctagcaattggtttacatgttccacaaattggcctgattccaaaagctcgcttattacagcatttacatcatgcattacctgtgcatcaaatacagaatttaaatgcaattcacaaaatatgcctgatggccataatcttctatgtttcaaattttataagaaatatgagaatcagggcccaaaataatgggtaagattacgtaataatcaatattgactagcttccaatctagagcacatcatgaagaacaagccgaacaactatttccagtttacacatgaaaaaaaagggacaagtcatacctgatatgctacaccgctaccaactgtagactttctaactaaccagtaaccacagtatatgtgttcctggaatgtttgttgggctagaagtgcaaggtgtcatctttgggatgccctcctaagcacttatagtcttaaaccttagtgtgagtctcaaattattgctaatctatgcaaccatctcaatgtcactggctaagatgacaatactatttcagtcttaagccaaaaagttcatgatgaaggatgaaaagcagtaggttcagatgactgaaataacacacttggaattcaaggagtattgtagacatgacatacataaatgaaatcctccacaggtacagatagtgcccattcagcatccgcaggagaacttgagcccccatcagaagctttccgtgcagccaaaccagaagaaagccatgttgtataccttattgtaaaatgtagaatacaaaaagggtcaatcaccataggttaaatcataaaagataaggcaaagaatcctctgcagtagctataccttgaaataagctgcaaagacaagcggaggaacttatcagagtgggagaaaacaagaacatcgtcactccagcaggcctgcaaactttctaagagcttaacgctttgtttcaacaa

SEQ ID NO: 61647 - DNA, 10537 bp, Oryza sativa
ttacgctcaattttaactttcaatgggacaatttattttcatgaattttgtaacatttgtcgactcgttttttcgtgtattcatttcagattgtctttgctcactccttgatttttgtgtattcatttaatatggtctttgttcactccttgatttttgtcaactactccattattattagcttagtagtaactactaatatactccccacgttatatataagtatttgacattcaaacaatattcggtcgaactttttgaaactttgactcttaagttaatttatgtgagaataaatttatgaaatctaatatgcaaccgtagcatatttacaacacaaaccaaattatatatttccttgaaaaaacatttaatagttagtattgaagatcattttttaaagaaaaagactgaatactattttaaatattaaatatttatggccgaactgagtatcttattatatgatcaaactaccgacacttttcatcatcatcatcatcattatgagatataaaactcaactcaatcggcatatcatatttactgttatatataagactttaaaaatatatccgtgtgttgcaacgggtaaatattattttaattttattattattattatacggtttagttagggtaaaattcattatacgaattcgcttggataatttttttaagaaaatcatgagctgtgattgagtacgtatttcatctctcaagttagcatacgagtttttttaaaagtgatttttatacgacttttttttatttccaaaagcaaacgggattaaaatcgaactcaaacacagatctatatttccgaaaacgaacgaacttaaaatcgactcggacacggatgatgtaacaaatagtatagatgagactcaaaccaaatgatgtaccaaatagtatagatgagactcaaaccaaatcgacaggcggtatgtaaatatagtaccatttactcctattagagcaagtttaatagtatagccaactactagctccaatttatttatagccaatctaatagctcatttatacaatagttgcatactacactattaatatctggtcccacatgtcatacacacactgtatcttggagtccgtgctacagctggctacaaatctgtagtccgctgaccttctctctcctcatttatctgcttaaaatatgtttgcagctggcttatagcctgctattgtagctactcttatatgaatggtctcttttgataataatgataaattaattaacctagtggctagtgctacctccgtgtattgatccaggggcgtgcatcgggtgagtcgatgacgtccagaatccagtagccgaggttacctcccagcccaacgcatccagcgtagaacaagacgccaaactttaacatctcagagcggctaagcgggaatctctcatacgcatgctccatgatatcccgtttaacgtagcatgttgtgatgatcacaccaatccatcccaactcaaacgtcactctagcaaacggatccgaatctcgatccccagctcgaggcataattaattaattaattaatatcctccgaaatcttaatcttaatcttaatttcctcgctctagatcttctcttgttgaagaggccgatcaatcgattcgagaacacctcacctggctgcatataaatatccatatatcgatttgcctatgttaggtgcatatctattataaagaataacactgaagggaatgtaaaagctgcatgtatgcgttctaattaatggcaaaatctcgtttaatttatctgccaatcatattttggggaaaaaagagcaaagaaacaaacatagatataatgtaaaaccaatcgatgacttgctgtacctacggcgagcgagcgagcgatcgatcgaacaaaccaataaaattattgggagctgggagaagaaattgcggcgcgtcgaggcgaggcgagatggactccgtgcgccgcccgcgcaagcgatagatgcagcttctattctagctagggtgtcaaaacgcaagcgtatactttgagatttatatttatacagggcgaatcgacttttgctgggccgtatcgggccggaatttcgctggagctgaccggttttcgcgagtttatctgtaaactcaggacatttatatttaaattttggtttatgaaatttattcggaatctatcaaattcgaattcaaacatctactagtcggaatatattctgaatacaaataaatttgtatttgaatctcagtcagaatatatctgtatttgtatatttgtatacaaatatattccaaatttgtatttaaatctaccagtcggaatatatttgtattcaaatttggtagatttcgaaaaaatttcataaactaatatttgaatataaatatcatgagtttaattaccaataatcaagcttgtgaaaaccggtcggtttttgcgaaattctgatcagatacgacccagcaaaagtcgattctctgtataaataaatctcaaagtatacgcttgcgttttgacaccctagctagaatagaagctgcatctatcgcttgcgcgggcggcggacggagtccatctcatctcgcctcgccgcgccgcaatttcctctcccagctcccaataatttattggtttgttcgatcgatcgatcgctcgctcgccgtaggtacagcaaatcatcgattggttttacatcacatctatgtttgtttctttgctctttttttcccccaaatatgattggcagattaattaaacgagattttgccattagaacgcatacatacatgcatgcagcttttatattcccttcagtgttattctttatactaatatatatgcacctaacataggcaaatcgatctatgtgtatatatatgcagccaggtgaggtgttctcgaatcgattgatcggcctcttcaacaagagaagatctagagcgaggaaattaagattaagattaagatttcggaggatattaattaattaattaattatgcctcgagctggggatcgagattcggatccgtttgctagagtgatttttgagttgggttggattggtgtcatgatcgcaacaggctacgttcaacgggatatcatggagaatgactatgagagagtatcgcttagccgctctgagttgttcaagcttggcaccttgtactacgctggatgcgctgggctgggaggtaacctcttctactggtttatggatgtcatcgactcacccggtgcccgcccctggatcaatacacggaggtagcactaggttgtatatatatattcaattaattatgcatcaaaagagaccattcatagcaattactaatgcatgagtagtattcacgtaccggcaccccctctcgattggtttcagggcctgtttggatcagggactaaattttacttcctccgtttacagtgtaagtcaatctagtatttttcatatttatattgatgctaatgaatctagacatatatacctatttagattcattagcatcaatatgaatgtgggaaatgctagaatgacttacattgtgaaacggagggagtagttcttatcacatcagaggtatacacacacaaaggaataaccaaattcacgtatatacaccgtaaggcacagagaagataatcacatgagaacagacagttgtacagggtaagacccctctctgatcagatacccagaggagatccatcaacatgtatatatatttatatctgatttgcaactacacatcgcaattactctagctagtacattctcattcctatgtataaactgagttactactcttactgacatgtgccggtatctgtgaaactaccatacatgtacatcaattgcatatacttccttggacgtacacgtactaaagctgctgtgctggtttcagccatcggtctcagtttgcatctcgagcttctgtatcaaggccttcttttcttcttcagggagggcgttgaacataaaaactgatttgtcaccaatgtcatcctgattcatgaggatgacattgatcatcaatattgtaatgttgtaagtgaggaacgaacatatgtactcggtagtaatgaagctagatgcggagcattttaatttggaggaatctgtaccttgatgggctgctggaattttcttgctgcgaatacagtgaagagaaccatccaaactcctaaaaggccggcttttgttccgttgtccattagaccagactgcacgaggtggtgacaagacaaatgtaagaaatgatgaatgagtgctctaaatctaatgcaccctggtgctgtaacttctctaggagtgaacaaggtgaaactaattataacatattgaatttgtaacaaaaataacagaggcttaatttaccaggtgtccaagaagaaggccagggataacaaaagttaaaataccagcttccagttttccatagcagagacctgtagaagcattctttgtcagagaatgaataattcgattcagttcaatgttcaagcaattcattcatgcaatccgcatccaacgaaaaatgaaaaaggccactaaattggtgctcattcttgttggaataaatgggctaggcccaatttaattcaattaaaatctcaagagcccacaagtaatgttagagagaataatactgccttgaaaatttaggtggaagaacctcaacttaaatagggtgatattagagattccctgttgaccggttgaagtgatggttggactgccacacgcatgcgcgcatgccgagtcggcctcggccgtgggcgtagcgaggcgaggcggccgaccgagccgagcctgcctgctgctcttacgttttgtaacagacgagaataaaatcaccattaacaaatgaaattcattgtgttgtaacctccacaacaaatgagagattcattgtgttgtaacatccacaacaaatgagagatttatttgttgtaaccttcacaacaaatgaaagattcattatgtggtaaccttcacaacaaatgagatttattttgtggtaaccttcacaacaaatgagatttatttgtgtggtaatggagatctctctctacatataacgcaaggcagaggctctcaaagtgtgtgtcttcctcctactattgttccttggcgatactctccttctgttcctgcgctgtctctctgtttctccggttctgttcatcccgcgcacacgggtgatcggaacgagcaagtgcctccgaaactccgtccgcttgagaacctgcacgggtaggcaggcgatcaagtttttgggtagcgcttcaagcgcgactgctttgcatcatcttcaccaacatgtcgacaaccgatgacaacaacaacaccggagacaaggagaaggagcctctcgtcaacaccaacgaaggcaatactgcctcaaactccagcggagggtcattttcggggtataacgtttcactattaccgttcgttcttcgtttcctacaactgtctgtcgcaatattattgcgatctcttatctatgttgatgcttattctatattaagcatgctcatgttatacacatctagcactgccactagatctactcaaattacaaatgtcatgtttattgtcttaaaattttagattaaaatatgccgaattatgaccaaatttccaacaattctaacactgaacacacacaagcactcagctagggaacaaatcagcagcgacaatgaactgaaattctccgattaaatctgttcagtataaacactagaactccttaattgtcgtaccaatttggtagtaataagcaatgtgtaattgcacggtaccttccttgaagacgaggcctgtgagcgccgcaaacgtagggccgacgaaccacagcgcagccgggtggtcgagaacgtagccgacgaggctctcgtcgagcggctgcgcgccggcgacgtacgtcccgatggacccgacgactccgaccacccacagcgcctggaggaaccgcttgatcggagtgacgtagatgtgaatcagcacgagcgaaagccccagccccgccgctccggtggcgtagaggaggtcggcgccttgcctgatggcgtcgccggcggcgttcccctcggggaggaacgcggccgaggcggcggccacgaaggacgcggcggcggtgaccagcccggaccgatacagcaagacctcgcgcacgtcggagtcctcgacggtccatgggccgtagacgccgttgtagacgttccggtcggcgacggcggcgagctgcctcgcggcggcggcgcggcggccgaggtaggcgaggggaagaggccgtccgactgcggtgggggtcagccccagcctggggtgcggccgtagaggcgcgacggcgaggcgcggcgagaggaggaggacggtagcggccatggcgtcgcggcgggatgataattttttgggggagattttttggtgggtggtggtttccggcgaggtgtcgagagctccggcctgtgacgaccgcaggctcgacggacggtgcagattcagtttcggcgtcgatccaacggcctctgatccggtagagtgccgccacgtggccgtcccggcccaactcattgggccgcacggagattgcaacccctttccggcccaataagtacaggccggcaggcctgccgtcagtcaaatccatggcgctcccatgttaatttccttctttcacgtaaaaaactaatctagtatcggagattcatagtgttataatatgttgtatcgggttttagattcgtcttttataggacggagagagtacaaaggagtaatgacaacttggaacgcatgaaacacttgcgacggttcgccgccggcagcaggtcaaccacggcaagtccggcgagcggggcatttaactatttgccacttttagatttgacgattaactatttgctacatctatctcaataacatgtggatctacatgtgtctataatatatgagtctaatggcaaatagttaattgccacgtctaaaagtggtatatagttcaatatctcccggcgagcaactagatcgaccactctcttcagtgtcagtttcatcacagtgattccggtcgaaaaatattaacggctgctggtggtaatgtttgcccaattccgtgggctgcctgtgtttccctgcatctgcatctgccgccgcgagcagtaactaattaaaagttactgtctgttctgatgccaggaccaccgtacctcgtctatgagacgtactatgactgtaattcatactgtttcaacatttggatgcattgcatgcatgcttaatttcaacatactattatataattaagtactccctccgtttaatataaggggattttaaatttttcttacaacgtttgaccattcatcttattcaaaatttttttgcaaatataaaaaacgaaaagttatatttaaagtgccgtagataataaagtaagtcacaaataaaataaataataatttcaaaaaaaaattgaataaaacgagtggttaaacgttgcaagtaaaaacttaaaatctcttatattatgggacggagggagtatatgttttgattgccaacaagatgcatgctttgatgcagacgaacttgcatttctcatcaacagtgatcattcatgatcagtactgttcagagccgtaattcaatgtatatagcacgcacgtacgtcctcgaattcgtagtgtcctcctgtcccgtatacatactagtaacatacattcacgtacaccgtacacgtgctacatacataccattaaattggatctcgagatgggtgtacatacatcatatcgatcttcatgcacgcgacgcgagagctatctaccggcggcgattggattcggtggcgccattaataaggggcgagacgagcttgagcttgccgccgtagtcctcggcgaggttggagtcgtcgatggcgtcgcggagcgtggcgtggaggtccttgtcggcgacgaagacgaacttcttcttggtgttgtcgtcgatgaaggggtagatgatcttccaggccgccatgaacacgtaggggacatggatcaagaacaccctccccagcctctccgggtagtagttctgcatgatctccagcgccgccacgtacgcgcggatgtcgcagttgccgtagtacccccacccctgcaggtcggccacggcggcgaacttctcctgcccgccattgccgccgaggcgggcgcaggtgcggtcgaggacgtagacgacgtagcgcttgaactcgtcgaggtcgcggcgcgccgggaagtggcgggcgccgaagccgtacaccagggggcgcccctgccggtcgtagccctgcatgtagagcttctcctgcgccagctcgccgcgcacctcctcgtcggcgatggcgcggccgccgggcttcacctcgcgcttccactgcaggtacttcaccagcatcgccgacgccttgccgatgttgtggtctctcgcgcgcaggaaccggcgcagctggtagtcgtcctcctcctacgtatacatatgcatcatcattgattcattgtcttgctactctctctgtgttttactatattattataagttattttattctttttataattaaattttttaagttttgatctataaaaaagttatagtatatttttaatataaattgaatatattatcaaaatatatttaatggtagtttcaatgaaactaattttaaatgttgcttaatcttttttatagatttggtcgaatttttttgaaaaatgatatataatataaaacggatggagtactaattaccaacaattaagttattaattactgtagctaggtaatgctgcctgctttgctgatggtcagctcgtgttagctactctaggctggtccagttcgatgtgtactggcgggagtagtattgaccaacatttatgaagggctttttgcacggcacgggtgacgcatcgcctcatgcttcacatcgccaaattaaataatggttgtgtgtagacgtccatgctactgttcatctttttaattatactacagtatttaatactgcctcactccactccacatatttacgcatgcagctggttagttgtgtccacgaccatctgggtagccctccaactaagaggatccgcaatggtaaagtaccgcaatggtaaagtaaggtgctatctataaaacatgtatatctcagcaatagactagattaatagtaaaccactttaatggtatgtctacatgagtatctatagctctctaatccattgtctcgtttttatgtatagaccatcttcaggttagtagatagctttgctctctcttcatttaatctcttacaagtaggaaaatatgctggtatgaatctcttgtagagagactatagataaccattgtgggtgtcctaagatggtgtctatagcattaactacattgtcacgtagaactttaaacttatgtggcactatattaattaaaagagagagcgaagagatgaagaaactgggtctcatgcaagacacggcttcaacatgagaacttatgtactagacactatcaagttttgcatagggagagaatagtgtctttataatagatgaagaataaatatgattggtactccctccggttttattttaattgacgttttggacaatgacacggtctacaagatatatctttgaccttatttttctactataatatatataataaataaatgcatgtttaattttattatagtgctttaaaagacaagtctatatatgttgttctagtttctttaaactaaatatttttaaatttattgatgatcaaagttataaaagtttgacctcaactttatccaaaacgtcaattaatatggaaccggagggagtagataagagagatggtgtatttattaatggcctactttaagaaaccatgagttgtagagtgtagtttttattgtgatgtcttattgacatggcaccatagacactgcttatggacaccatgggttgggagtacctcagtgtgccgttttctactgtatatattggacgtcctaataattaatattcccctaaatgacatttgtattggtaatcaataatcagcgtgtgatggtggtatagtaaactcagttgtcctaattggatggatcgatgtagcagatggttgattaggtggagtgtcgctgatgaatgaattcctccactactggattgtcatgacgagttgagagtgagatcaatgtgatggccatcgagatgtttctgctcaaccgctaactactttggcttagaccttcaactacctggagctggagatggatgggcaagccaccagtctcaaaccaccaaaactgcccagtcccctagtcctttcccatgtacgtacggtacaatacaattcacgctgcgccgaccagccaaattgcattatactgtaggagttatatatatatctgcgaccaaattatgttgtgtgtaaccacctgcagtacggcaaacaaacccagggtgtgtgtgttcttctgtt

SEQ ID NO: 61648 - DNA, 2547 bp, Oryza sativa
cgccgccggtcctctcagatccgggcgccgccgagtgcctccgcccctagacggcactaacggtgagtacaaatccgtccatcccatcccacctcaatcccttctaccaaacaaaaaactataaccatcccataccataaaccaaacagacaactggaaccatcccatcccacaaaactaggataggtctgacctatcccacttcgtccccaaaccaaacactacttaagttaattactactctgtgatccggggtcgtcgctacatagttggaaattaaataaagagggaaaattacaaggaattaactgattgagcttcaagaaattaactactgctactcctaattgccttcgcgtttgtgttcttagttgattgcttcatagctagctcgtacctctagttgtccttccatccacaagaacataagaggaaaaaaacaacgaaggtgtgaactatctatctatcataccattggttcacatcatcatcacaaggccatggatggagggaaagctcctaagctaggtgagtcatacatgcgaagaagatgaactaattggggagaaggagaaggagataccttgcatgcagggtcctgggcttcgacgacggctctcagctcggccaccttcttccactccgtcacatcgccatcgtcgcggtgcccgtctcgctcctgctgcttgcagtaatccatggctgccttagctagctctcctctcctctcctcttgaattgctcttcaggcgatgataattcagaaatggaaatcgagagctgaagccctttttataggcagaggagaaacagcagcagctccaaaaggaagctaagctgacgatgcagagtcgctgacccccactatttatggttgcggtctaaccgtgtaccaaagctgctgtctcgcaaacacttgcatgacatataatcatatactattaccccctccgtccaaaaaagaacctaattggacggagtagtaccttctttgcacagaaataaagaacttttttttctgtataggtataacattggcatgttgctgctgctgcctaactaactaaatatgacaactcaagagattactgactgacgttaatgacgatgatggcgaagtctaacagagtgacagaggcaattttcttgcagaacataagtaggaggttggacggtccactcctccgttgtcgaaacaacgaaattaggacttgtttgagcagcagaagcaatcacctgaaagaaggtgttaagctctgttatttactctgttcgatgataaaaatggacatcttaacaacgttggcggcttatctccttcgttatctcctctctctctctctcccataaacggtaagactcattaatactgaccactggctgcagatacaatcatacaaatactagaactcttgttaatttcgtagttctgtttttgctagaagagagagagacagacagagagtttagggggaaaaaaaatcttaagctctactagtacagtagttgtacctatcagaacttgtggtagtaagcagtagcagagaagtagtgatgcgtacaggaaacggcgagcgtcaactacaaacagcaacagggacgttagccaactactcttggttttcagccatcagaaatactaccaaaatcatgatctggcagtcaagtcacgttattagactagtagcagtatccgtttacaacaaaatagtggtacgactaattattattttaaagattgactatgtatctattggcttcgttaatattaaaatatatcggcatagggcctatttagtttgaaaccaattcttaccctaccaaaatttggcactaccaaattggatagtattgaatttaaactattgttgataaaatttggtaacaaaccaaacatgcacttgctattattgaagttaccaaaattttggtagggcaataagttggtatcaaaccaaacaagcccatagtcttctgtagatgcttatatcagtaagatgtgtgttcatatggatgcatgtggagcattctaaacgtctgctttgctttgtcctgtctgtcttattggttgctcgtattctctaataaactatttattagaaaataaaaataatttatagataaaatttttatatatgtgttcaatgcagaaaaactatgtaaaaatatctttaatcaagttaaattttaagcctaaaaattaaaactttaactttattagggacgatggggctatgtgtatgtaaagaaaaaaaaaggaaatggcgagatgcatgggacgcaagaaggaattttcctcgtgccattttgatgcagagtagccaaatgctaaccaccacgtacccccgaattgaattgaattgtatctttcattgatttggccatgaatgctagcagctgccgagctttgtgccttaccgacgctgccccgggaaagtagtggctcgcacacacgcgcccatggcccattgggcccatgcctcgtacacgcccgtacgcgcctcctgtgtggctcacctcctgccacgacgccatccaaagcggcat

SEQ ID NO: 61649 - DNA, 3126 bp, Oryza sativa
gtgatacacaattatacacataattataagcgtttggttctcatgactcatgacgaattcaggacaaacagacatctctgtggtaccaaatgcagtggaactgggagtgtggaaatactaacttatagtcacctaagagtatcttgctgtcttctttacctgttgggcagctcatcagcatgacaaacttaacggagactacaagttgtatcactttggcaaacctaaacaatgagtactattaactattaactgaagtgtacatgccggcaatacagaaggcatactctactttcaagggaagatgacacaggactggtgactaacgagaaattctttaattcttgaccagcaagaggcagcaatacctgcagacatggctcaaattggaacatttcccaggcatatatttgggtctgcatatttctatggctaggctcaaagttgcagagccgagatcgaacattggggaaataaaacttaatggccagatggccacagtttcatcacagagaagacatcacaacacttaaagataatattcccaaaagctacattgcacaatcatctataagaatttaacatgcgatgaaattgctgagaaagttttttggaaagtaaaattgggcagcatttcagaacataacgactagcgatcagtggaaaatggaagtaaagttcaaggggcatgggccctttcatcaaccattagtttgtgagtctgaaaccacaagcatactaagtagctagcctataggcactaaacaagtgatagatagtagaagttaagaactagaatgtttttgttcgaaatgcttccaatgaaggattgcactactgggtgaagcagatcccctatgatttcatcatacagctgtagtctccttgatggatacagttcatagtgttattgcctcttcccagcaaaaagaaaaaaaaaaacagttcataatgttaattgattacatactgtatatgcttcaagtgagctgtttatagcgctattcatcggtcctggttgaattgtatccatcaaaagtgtagcatcattttcaatttttcattcaaaaaaaatgcatcctcaacatactgaaacaatgtactaactactagcaacagatcaatatgcagcaattccctggatatatgaccaaagcataagaagggacatggactctgaatatttgcatcctcttgtgggctctaaccttaattctgaactatacaggtggtgcacatggatgagaagggatggaacaggaaattgccgcggaatagggttcaaaattaccggtgtagaagacccatttgacggggcgtttggtgagggtgtcctcgtagtaggtgatgaagtcggccttggcccagacgtggcagtcgaagccgtcggcggggtggcggccgaggtagacggagccagggacgagccagtttgggggcaggatgccgacgccgacggcggcggagcggcaggcgcggcgggccggggtgtagaagaaggaggtgccgttgttccactcgttgtcgtagaagggctcgtcggcggcgagctggtagcggatgacgtggaggttgcggccccccggccagtcgtaccacaggtccgccagcgacaggttgccgtggaactccatcaggagcttcgcgtggaactgggccggccatggcgtcggcgtcggcgtcggctccgatccgtcgccggcgacgacgaggaacaaggccgccgcgaggaggagaggggccgccgtcttctccatcttgtgcaagtggctgcgctgctgcgtgggagtgagatggcgtagtacggtttcgagggcttgagtgaaattgtgtgattttccaagggtgattatgcaaaaattcgtccatttttagtacggtttgggcccattaacaaatggactttgctttgtccaattgctacaaattgagcctactttcttttcgtttttgctgctttaacaagtagaaataggcccaagtggcagagttacctacctttgctaattttggactccaagcacacaattagtactcatccgcattgtgctaattcaggttattgagaggggaagaaagtggttatacgagatcgatggaggacgcagcagctaacggtcgctatacgatggaaatgagattgtaccggacatattgtgcatatatacaaaaagtataggagtatgttccagacgatggcaacttgacctctttaattcaaagctagcctcaaacgtacttaactattcatgctttgacgtcaaggcaagggtcgagtagtaagtaacacaggctcaaaaggcaggctatcttaagctacctatacgttttgagtgtagtatacgagccgatcgatcgatcgatcgaccactgtaccgcactgcacgcgccaaattgaaaatcggattagtggctcaaatcaaaaactaaagttagtctgaactttgtctagtgtgcaaaatcttttgacattaattaatcaattggtaggttttgtgcgttgtgtcttgtgtgatttccacacttggttgacgccgacgtcgttgtaaagtttgcacgcggcaactgggcgtggtctctgaacgaaccgtcaattcattcatggaatgaatttgatggaaacatatcccgactttgtgcagtctgtaattgtgctatgttagtgccacaaagtcgatatagcacaactacaaattgcacaaaatcgacatgggacgactgcagattgcacaaagttagaggagtttctttcgaatttgatatatggtccgtccaaaaaaaatcatgggattggcgcctgcctgaatccatggtgggtcgttggccaactcctccatttctcacggcgccggtcgccgccccggccctacttcccttcacgcctccactgacctcgccggccggccaccaccaccgcccgcgcgccacacctataaaacctcacctcctccacctccatggctcaccaccacgtacagcaaacaccaactcagctagctatactctactcatcttctctgccagctgctactacaccaaccagagctaatcaagtaacaatggcgggaagaggcagtgccatggcggcggttggtgtgctggtgctcctctgcgtgctcctccacg

SEQ ID NO: 61650 - DNA, 8833 bp, Oryza sativa
tacttcatctgcaacttccccggccactgccaggccggcatgaagatcgccgtcaccgccgcctagttcttcttcttcctcgtcgtcgtcgtctccgtcgccggcatggcgccatgccgtccatctcaaccagctgcttattatatctatatacaaatgtttgtcgatcgtgtgtgttctaaccaccatcagctgatttataattctacgaatgaagaatacgatccaatgcatctatgcatgcatacacacatggatcaatatataatagttgtacacttctttgagtgacggatgttgtatccggtgaaatttatatacatataaatatgaataaaagccacattatgcaggttcttgaatcacaaatagtacgtttgagtttcaggtctgtttggcatagctacacctccacctctcctgaaactggagctcagccaaactgttttacctccatctaaaatggtagtggagctaggtgaagctctctcacaaagtaaacttgagaggtgaaactgggtttagtcagctccacaactccactccaaactcaactcatgaagttaaatttagaagttagagatctaccaaacgggctattcaggcatagaaattcggaataagttcatctgaggtcccttaactttacaccgaatccgattttcgtccttgagttcaccaccgagggatctcgtttgcaccaattttgacagttaaggactggctgatctggttttggggttaaaggacgaaaatcggattcggtataaagttaagagacatcagatgaacttattcctagaaattcccactcaaaacttccacacgaatacgaccgggccagttattgtagtacagtagtagacgagatggttgtgggccgggcccaaacctttgggccggcctgaccgttccatatatggaaaggcccaggaattcgtccacaaaaccctataatcctcgcaccccccaacacctctcttctcctgcgccgccgccgcctcctcctcctcccgcatctccctcctcgcctctcgctgccggccgcgcttcgccaaggtgagactccccgcctctcctccgactcattccacaacgcgtattcggcggccagcgaattggcttctttttttttatttcctttcccgacgcccgatgatggtttatcctagtgtggctgtgcgcttcgattcggatccatctgatctcttccggccgcattctggttgcccagatccatgccactttcctcgttcatgttaacgaggagattttcggttcgttttgcagatgaacaaggagaggcttatgaagatggccggcgccgtccgcaccggcgggaaaggcaccgtgcgcaggtgggtaaatcgcctttgtcgcgaaatgaaatgaatgtcttgttctttgcttctcgccgtgtcgcgaaatgaaacaaatgtgcttcattttgtttgttaggaagaagaaggccgtccacaagacggggaccactgacgacaagaggctgcagagcacgctcaagagagtaggtgtcaacaccatccccgcgatcgaggaggtcaacatcttcaaggatgatctcgtcatccagttcgtcaatcccaaaggtataagcatccctcctgttttgcctaccgtaccatggaaatgccaactgcttcttggtgttagattacttatccatgttcgatccgacctgtgcagtgcaagcttccatcgccgcaaacacatgggtggtcagtggctccccacagaccaagagtatgtgacttctccttgttacatttgatcagttcgttgtgcgagttcaattcttttaagattagcggctgttctgtttctcttatacactgctgagttgcagcaaccatcccatgtagagctctgtatgacatctgaataatcccatgttcgtctttagttttatctctgcacactctctaggagattttatgcattcagctgcaacattgtagggtttactatatatgttgattgtggggtggagtgaatattacgatgaacaaaactagcttttagcaagactcaaattgccttttgattactttatttcagtgattgtctgttattagggtgttatttttatcttcctgacttgtgatcactgtttgacttgtcagagcttcaagatgttcttcctgggatcattaaccaattgggtatgtcctcttcttggtttgctgttataaaaactacttttgacttatgcttctgcacttaatattcaattgatagttgtcttaattggtctgaattggcttgttttttctgttataagaactatgttatcagtctcatttcatagctgcatgactccaatttctctttcctgtcatgtatatattccagaaccatgttcacaaaatgtatattccaaacatgagctctttcgtatggagtatctcctagcctacccatcatgtaaatcagcgatgaagctatgcaaacattagtgtttatctatttttgatctccataaaatgtaactcttattttttttctggttttcttgctttgtttccattgccaattatctgttggttgccatcagcctttattcctgctcatcactggacttgtctgattattgtcaaactcattcagtttatctgcagtttgtccagttactgacagtcaaatctttcttgtaggtcctgacaacatggagcacctaaagaggattgctgaagagatgcagaagcaggtagctgctgcaggtgccactgcccaggcaaaggaagagaacgatgatgatgttccagagcttgttccgggagagaatttcgaagaggtagctcaggagacaaaagcctgatcatagataccacaagtagtgaaatgttacttgaccgctgttctgaggtcatggttttctatgacggccctgttttgcttctcctcgtaggccaatctttgtatttgcaattggaaacttttagtttctccgagtttttacctaagttatgaatgctgagatgccatggagtcctttttacctggttttgatgttcacatttctggttggttcagaatatactagcatcagggtttgcagatgtccttcacgtctcaactatctactagtatcatttatgtttggagatatcctgcaatggtacagtgttgatttttccccaaatgaaaaataatgatgtgttttacctgctcagatttcagttctgaacttatgttatactagcatatgaaccatatgaacatgctacgtgctctctcttgaatactaaaccccccagcaatgctctcttgaatactctaaacctctcaatgagaggcagacgcccagttcgtgtttgtactatagtgaactatgattagcaaagggtgttaattgtttctgtctgtaaagagagagctactattgattgaaatttgaagtacagtttaaaacagcggaaatattggtataagaagaagtcccactgaaaatagtgcaaactgggaagcatatggttgaaagcgatgttcaacacgccagcatatgactggtttgaataatcttgttctcgagacaagtttgtattcaaatgatatatctactccaaagctcatgatgatgccatttaaaatagacttttgcgtctattgcacctattaatagttcactaatataagaatgtacagccaaggtgatggaaatcaaaactgaagctcttgcgcgtgcgcatatcagctagatgatcaccacataaaaggcttaaaaactcaatctttgtacactgttctgcgccaatttcagagtttgagtttgggcacagaaaataatcaccgcaagatggaagacgaacaaaaaatactctgcctagcaaaaagctctctctgctcaaccatggatgaacagcaattggcgcaatgtatgtgcctcttgttgctgcttgccatgtcaccagatgctacgctcgccggcggcggctcggtgaggcgccgggcggacgtggccgacgggtacgcggaccaccctgccggcgaacatggcgtggaggtcggcggcgtacttgacggtgtaatggtaagcgtcggaggaagacaccaccctcgccggcagccagatcacgaggcagcacctggcggtgatcttcacgtacctcgtgcgcacgtacacggcggtgccgcacgtcagccgccgcgccgggtggacgctacgggtcacggcggcgaccggcggctccgagaactcggacgccggacgcgccggcttcctggcgaccaccgtcttggggttggacgacggcggccacggcctggcggcggagggcgcgtccggcttcttggagattgagggcggcggcggcggcggccgcggcttggcgacggcgaggtttgacgatgacgtcgcgcgagcgatcttcttggcctgcgcggcggcggcggcggcgggagagatgaccctgggggcggcgagcgccgggaggttgggcgccgacgtcgtgcgggacatgatcttgttggccggcgagtgcgaggagatggaagatggcttgttggcggcggcggtggacttgacgcgggagttggggaactgcggcggcattgcttctcctctcgacggctacgccgccgccgcagccgccgtcgattccgcttcttgatttctagggcttccaaggatcgatgagatgatgtgaacgctaccctccgttgattcgttgcgttgatcctaacttgggaagagatgtgtgtcgtaaaaacaacttaacaagtgacagcgaaattaacccggacgaattgacatcacagcctaactttgcgagatagtcgccgtgttcatctcacccggacgaattcgcattgttcattgttagatacgatttaaataataagtttcagatttcagacgatttattttatcgtctcgactgaaatcctattagttatttttcgtcttatagcattgatgattatttgattgaacttctacaacttgagattgttgctctgcttataccattgactgaaattcttctacagatatagattgtttttccgccattgatgaactcaaatcggcaaagatgtttttcggccattgatgaatgaattcaaagtggcaaagatcatgcaagatgcggcacatatcggctgcagtcttccatagactgaaagcaatggctagcacattttatgacgactgatcacttgatcagataagtcagccatgtatccggtgtgaaacttgaaacttcaagtacacatcgataaagtaaaacagaaaatcatgcgagagaaacatcaaccattaagatgcttatgatgaatctttcttatttagtcaccaagctatgggcaaaaaaacgtgttaagatgactaaacgcgttgttatacagcaacaaccagacatggaaaaagaaaagcaataactagttcggaatggtggccgagccaacgatccctgcatctcatgaattcagagaagatgctctgcgagtccctcgctcttttgctctcatattgccggtcggatagatctgattccctatgaacattcatttgttactaaattcgctacgcagaaaaaactggaaacagatcagctgtaaactttggaaacaactccggcaccaactgtcctccctccttccctcagcgcaaatctctggcctgaatagcataaaatgaaacaaatgtgttcacttcaattgcagaaaaccataccaaaaggtcgaaatgtcaaaaatggtggagcatacctggctcaaggggaacaggtgatatcaactcaaatcctgcagttacattatcaccaggcataaccatttccacgccatcaggtaacacaacttttccagtgacatcggcagtcctaaagtagaactgtggactgtaatttgacaagaaggctgtgtggcgaccaccttcatcctttgtaaggacgtaaatttccgcctcaaacttttggtacgtcttaacggtaccaggtttgcacaccacctgaaagcagtacaaaaaatgacaaacataggagcatcaataaaagggtcaaagaattgttattgcaccaagagtagtaatatatcaatccaccagttcgctcaaagaccacaaatgatacgaatagaataaaagatgacttggatcagacttatatgggtcccgctcagagttaggtatgctaacctggccacgctgtacatcaccacgcttaagaccacgaagaagaagaccaacattgtcaccagcctgcaaacaagttgtagctataagattccacattaatagaaaacaaccagtaaatggtttactttcagaacagacctctccatgatccagtatctttttgaacatctcaacaccagtaactgtagtcttcaagggaccactctgtgaccaagaagtgctcatcaaaattcacaatgcatcaaaatagcaacataacatacaacatggaatcaacgtatgacagttccaaagaacctagaaatgtcaagaggctttatgtagcaggcttacatttttctttcaataaccatagttggtaaaaaaatatattagcttaacccattatgacatatacatattccattccgatatttgcgtgaagtcaaatgtgcatatggtgtaaaaaaatcgtgggtaagatataactacaaagattgtggattctcgaatcttcagaaccaagcaggtcatactctcaagaataaatttgtacgtctaggaggcggtataaaccacattactggacttaagtaataaaagacaaatcagatattttactcactggagtcaaacctaggatctcaacatcttcaccagttttgattgtcccctgctcaacacgccctgtcacaacagttccacggccctgcagattgaaatcaattggtctgtgtcatccttatacttgccaaaaacagtaaacagtgttctggcacactaaaactcatagttacaagaacaaaattaacataatataaacaatttaatcatatgacttctcttccagagacttaagggtacaatggttaaaatcttttcaggagttaaatagaatgcctattgacagaacaaagtataaagtgtcatatattcttgctgtatagtttctaggttcccagcagcattcatccatcaacttcaatggctaattttgtataaacagatgctaacaagtacataattcaaaccttgagccggtttcagaattagaacactaattatatccatagatcaagataggttcgctcattgtacttggcacagaggaagtaaattcaatttttaattgcaatcagttcaaaactacagtgaatatgaaaaaaaaatagctgtataccatagcataaagttaatcacctggatagagaaaacatcttctatcggcatcaagaaagacttatcaagctgcctcacaggatcagggatatactcgtcaactgcatccattagtttcaaaatggcattctttccaatctcatcattagtcccctgtaaggctgacaaggcggatccacggatgattggaatctcatcaccagggaacttgtagaaactgaggagctctgcaggaaaaaaagggaaatataccttagaacaagaacaaaacaattcatacaacaatgtaaagagatgcagaatgctagcataccacgaagctccatctctacaagctctagtagctcggggtcatcaacagcatcaactttgtttaagaaacatacaagtgatggcacaccaacctaaaatgccgagaggaatgcttgagtaatcagtaaccagaaatgaaatgatatactaaaattcgcactgaatgtgaaaaagataaagaattgtcagtgattcaaaacctgtcgggccagaagaatatgctctttcgtttgtggcatggggccatcaggagctgatacgacaagaataccaccatccatttgagcagctccagtgatcatattctgaaaatgtgcacattgaaacagagatgtcattggtcattgctcaatattaaggattctagcagttccgggacagtaactcagtaagcctgagtatcagaagagcctactggatttaataattaatattgacagcgcatactacaaatgtgctcagcaatttcataatatccaatgaattagtattacataatatccatggttattgttcgtgaagattgtcaatatataatcttgataacttccactttagtaaaatagaactacttaccttgacataatcagcatgccctgggcagtccacatgagcataatgccttttagcagtctcgtactccacatgagcctacacaaccacaaccacataactcagacttgatctacacatgatgacatacaaggacaccatctggtccaaatgaagaaaaaactagtgctaaggctcaccgttgcaatggtgattcctcttgctttctcctccggggccttgtcgatctcgtcaaaagcaacagctttagccttccctgcctcagctaacacctgcaaagagcataaaaaaggcatttcacgcgttgaaattgtttggactccaaagaaaacaactgaacttgcactatatgtgacaaatcagaccttggtaatcgcagcagtgagtgtggttttgccatgatcgacgtgcccaatggtgccaacattcacatgaggcttcctgagacagattcatacaacaaattcaaaacacaagtcacacacggatcgatcgctagatgctaaccacaggaagagagaaaaccaggcgcggagagcaacggatctgatccaagaaggactcacgtgcgggtgaaggtggccatggacctcgcccacagggttccagccagaggcggtggctgctggggcgccg

SEQ ID NO: 61651 - DNA, 6457 bp, Oryza sativa
ggcgcctcagcgtcggctcagcgcgcgcccggtcgacacggtgccttgcggcggcggggggtggcgggctggcgccggagatgagggcgacgctggacaaggtggtggggtcgcacaaggtggtgctgttcatgaaggggaccaaggacttcccgcagtgcggattctcccacacggtggtgcagatactccggtcgctggacgtgcccttcgagacgctcgacgtgctcgccaacgaggcgctccgccaggggctcaaggagtactccagctggcccaccttcccgcagctctacatcgacggcgagttcttcggaggatgcgacatcaccgttggtacgcaccccgcctccccgatttgacctgacatcacgcaagctcactgttaaggaattgaatctttttaagcagcattgatttgttatgagaagtttgacatgccaattcacctcttcgatccaacacattgtgattatcccactacgattagtctaatgctgaagacatgctgcggcccgcttatcgtgtctagtccattagaatcctgttagaaacttttcaaggggaccagacgtccctgttgtttactgtggttctgaattttgatgattccctatcctcataggcatagttcagagtatataaatttgagagaatttatcagagtatataaattttgagagagaattttcatggcatgagatactcgcagtatctgaagatctgatcatctgaacgctggttttgcgttaaatcaagatatgctacttgtactggccataaaagagcagcttgtgaaccctgattcatatatataacccgagacgtggctttcacccctctcatcattaccagttaatcatcaccaatagtgatgtatcctaagtatccatgcctagtggcgaaccgagaacaaaaattaacagggtccaacatactaattacctaattgttaactgatatattgatcagcatgatataatttagtttaaattaccagaagctgcatgtaggagcgccactgtctgtgccaccattggttataatctggtttagtgttcttcactgaacaactagcttgtataggtctgctccatgcagttttctgagtgttgccacctatatactcaagaacctactataatgtaagaaataactgttaaaaaatatgtatacatcttgcccagtagtagaaattaagggagtattcactttaatgcaattttcaaccttaccaaattttggcaggatttcttgtatagttaccaaaatttggcagcaaactaaatgtagccacttttttagcaactttaccaaaatttggtaaggttgaaaatggcatcaaagtgaacaggccctaaggtggatggtgcacttggcgaccagctgaccagtgagaacacaaatccatgatgtagcaaatcatcacttaaaatgttcatcatggtagtatatttagatacttgacttgagtaaacccaaatgaataattgacacacaagatgtgaggatgattaatgtgtgtgttccctactgaatgtttgatatgatcagtgtttcagcaattcagctggatttaatgtttgcactgttttatattttgcagatgcatacaaaagtggagagctgcaggaaacactagagaaagcaatgttatcttagtataaacgtcgaaacacaccatagagtacatataaatggtatatggtcctttacgatgtactcttcagccatgacaaagaactggtgatgctaagattgtcaacagttcaattcatcaagcagtgaggtccaactcgaacgtgcaattgtactcatgactaataaattttaatattgatgacaaatacttcctgttgcaacactcggatgtcacagctctaaatgtctggatctctaaatgtctggatggtattctcttatagagctgaggcgatgatcttgtacctaaaaagatccaaaacttggagcgaaatcttttgcccaagtagtccaatctatttgtttttcatcgctcttaaatgtactactccttaactgatactccctccagtttgatattaagtgacgttttggacaggattgcatataccaatgacttattaattagtcaccatattcccttgttatacccttattaaatactctcggatacacatcaaatcaggaataacttctcctcacttggttaaagccaccatcccaaagcatatggttccgtgttcgagcgcttgtagcgctcgttttcatccgattttgcatggtattgtagccgtgcatgcaggattttttttatgtcattttcgctcgcgcgcgcgctgaagttttgtaagctgattttttcgctcgttcgtgcttggtatagaaaattttttggtgcatcttgcagctggttttgagcgttttggcgcctgctgcctcttgcgcatattctctgtgaacaagaccacaacgagagcatggcctcctacgcgcgcatcggatcttgtcaagaccattctcgtggactcggccgcagtgaacgcacacttgcgcgagctgctccacctccatggcgtcggcgctgttgtcctcctgcgcgaggtggtccacgatgccgcccgtcatcatgtcgtccaccggcgcaacctcagcatccatggcgccgatggtcacttcgtcttcatgcgcgacggcggcgtcctgcagcttgacatccatgatgctggtgcgcgacgagcggcgttgtcaagaggcgaagcgacgcaatggccagaggcgagcaactagcagcacacggtggctatcatggagtctttccgcttccgtggccagagtattagtactccaggcattagttaatttttgccttgggacttttccgctggatggagacgaagcaacagcatttactgtttgcatgcatgaatgagggtattctggacaaatacaagggagagagttgtggagagcgctaaaacatcaatttttgccagccaaagaggattaacccatagcgtcagttaatatggaactagagggagtaactgataacaaggttatgtacctccatgcagatatttgtaccattagttaagagcacccgcaatggtaaagtaaggtgctatctataaaacatgtacacctcaacaatagactagattaatagtaaaccacttcaatggtatgtctacatgggtatctatagctctctaatccattgcctcgtttttctctatagactatctccatgttagtagatagctttgctctctctcttcatttaatctcttccaagtagaaaaatatgctgacatggatctcttgtagagagcttatagataaccattgtgggtgccctaagtagcttggataactctgctctaaacagaagatagccctgcccccaaattcaattacttaggcacgagttcaccgtgcttcatgcaaacgacaagatctccagttttatcttctccacatatgatgcatctccagaaacttaaaatcacaacgaacgcgttacagatcagatcatattgagaaccagcgcatctgcagaacctaaaacaagccaggcatctgattgaataatctagaattcaaataatattcgggaagatacacatgttaagcaaattggaggacagcgattgaaccccaacaacaaataatatgtcatcattctgtggtcacagtatttaagatcattcacgcacgagttcccaaagcaaacaggtgatgcttgagctgagaaaagcttgacgtcctgtgattgtaaaatttgaccatagaaggccaggcagagaacctaagcaagccagccaatgcaaaatggtttacagattaagctttcaacaccgccttatggatcatcgtctccttgtgtatttggtgacagctcttctcaacaagatcgaggagtttctcgaggttcgccgcccaggaattgagtataccattactgtcttgtgctgtgcggaagcatacaacacccattggcctgtcaatcttcgcaatcagcgactttgagtttaccatgtccgaaaggtgtttctctgcctcctgaatgagaaaaatgtggggcatgttagatcttggtaggctacaaagtaacaagaggaatacaagtgatgctaggaaggctgggaacacaaacctgcaagctcaagcaaagaagatctgcgagcctcttcagggtaatccttgaatagtacttcgaaacaaccaagatattctgaacaaaagcaaagaactggaaatcaactgacaaatacaaagcaaggaaccaaaagagaaatacgataaagtcaagtaagcaatacatgttcaatgatcctcaatttcagatcctctgcagctttgtcacccaaagctcctccgagaaaattcttctcattcgcatattcatctttaaagaattcccacaagcttgtccactgaatcacctccatggttacaagttgcttcagcagtaacctattcccatccaaacagcaaaagtaggaattagaaagaacattaaaaaccatgataatttgtaatcctgaaagcaacataacgtaccggaaatttggtatctcggagagatttttgtcttcgagtgtggcattgagaaggcttgattgcatcggatcatgaggcgccaacaccaaataccaacagatctttctaagaacctaaagcgaattcaggcagtcagataaccattatagcgtgagtgagtatgcgcacacaccacaccaagtaagacttgcgaatgagagagctttaccggtatccactttgatggatcctcttttattgatggaatttcataaatcgacttgtagcaacggcagatttccaggtaatcattgttgtgcgagtaatagctgaatagagacaaacagaaatcatgtttcaccacatatatagaaaaaaatatatactcttagcaggttataaaatcagttagcgagaattcaaacagcacaaatacagtattcataattgtagcataaaaaaaggttgatggatacaaataaggcattcaagcagtaaccataacatgatgatggtaaacaatcgcaaacatatttgacaggtaaccgcagaagaggaattgatatttcctgagtaaataaaatacaagctacataaacaattgtctaatagcagtaagggatatgacaccacattagttcttttgtttaatcaaccaagcattagattgacttagcagaaaactctaaatagttaactatcactatgtattagatcatgaatcaaacagtcgaaagcaattctttgctgaacaaaatagaactccctccatcccaaaatatagctacctttatctgtgaatctgaacttgtccatattcatagctaaaggtagctatattttgcgacctgagggggtagcattaacttcaaccaacattactagaagcgacatgaactcatgatgaattagtctcactgagcaggaagacataccgaatcatcagttcatagtagatgcgcttcagttccaggagggaaggtatctctgctggggcttcctgaacaatattatcaccttctttcggtttctttttttcctttgacgggtctgcatcaaataccctaggactgattttcctggataaaatctgtgcgcgtacataatcttgacgatccaagcacagccggacctgtgatcatgattacagtaagattccagaacccaggcttttgtaacaatttcaagctttattactgtatttcttcatacctgctctagaatgaatgcaatcttttctgtctttgccatggagccaaatgtttcaacctgaggatgaacttgttagacattatgtagatgcgaagacaacactatggtggttatagtagatgtaactgtgtgccatgattatagtgcagcttgaacttacagcaacttcttgcattaaatcagcagcctcatcaatctgtccctgctcctctttgatttttgcaagtcttttgatcaatcttgctctctctatctccacatatatctacagttgatgcatatcagtgagattacacacatgaaagggcattaaatcttataggtaagcaatatttgagtagccatgattctcacttttccagcagatacactgctcaacgtcttgattagctcaatacgtgtgtccatgtctggcgttaagtcaatgtactccattgctttctgaaccatggcagtgatagcctgtaaaaataaagaattagaagagttgagacatgccacatgtgcataaccaagttataatgcagcagcaatagtattgcatacataaacaggcatgatttatgaaatattgttcaacttgtaaataataactggatatttcaggaagacctaagtatgggatatggagagacaatgctgaaattttggggggagaaaaatgcatgcaaatattgtttcgaagtgaaatatacaatgcactcgattagcactcaacaaa

SEQ ID NO: 61652 - DNA, 10845 bp, Oryza sativa
  unsure (1)..(10845): unsure at all n locations
tagagtataactttgaagatatcagttagatagctaaatacagctagtaattcaactagaactactaaacgaagtccaaagataggagaggacgagagcttgacctgcttaagctggcccctcctcttggagaggaccacgatctgatcgttgagcgtcttccaggcgccggccttgtagcagagctcgacgatgtcgatggcggccttcctcgtgccggcgacatcgccggccagcctcatctgcttctccacgttgaggagcgactctatcgccgcatcgaggttggtactgttaccctcctgcatcggtccacaagaaacagggtcagattgcaaggcatcagatcaacccgcaagagatcgaaaccctagatgagaagtgcgggccgcggcggggcgggcgggaaggccaaaaccccggagaggcgggcggagggtcggggtgggggaggggaggagggaggtgagctcaccatggcgagggagggaccgtggggaggcgccggcggcggcggcggagtcgaggagatctaaggcaaaggcggcgtgcgctttgcttgcgggagaggaagaagaggagagaaggggagtagggctctcgggctctctgtggtgtggtggtggccgttttgcggggaaaccctcgcggcttctctcaattacgcggcttatagcagccggccgccctacctacaccgtaccggcctccttgcaagttgcaacgcacgagttctattaggatttgcattttcacatgattatgttattatccatcgtttcaagatctcataaaattctttatcccattggttagcactcgtctaactttatccaaaataacaataataataatctgatgcagtatttctaatagtgtcttatatactaaaacaaagttttaagatcactgctggttacatatatacacatcgtaaaagctagtttatgacctgatatcattgttgttaaatgtcaaggtaagtcgctttgtattttgttgtgaaatatgtggatgcatatatgttaaatattgtggaaatgatagatggtatatgttaaaatattatggtaaagatatggaaatgattatttgtgtgcttacatattgagttctaaaatataataaattgcagatgacgtggcatgcttgtatgagatttaagatatatgattagctattgaatgatggagtgacatgtttgcatgatgcgctttaaaatataatgtgttacaactatgtagaagatagatactctatttccacaaaaattatcatctgaaaagaaaaagactaaaataggcctgattcttatgacatgacatgctttgtattgtgtcgataacatgtacttttcctctccatctcctatttcatttcatctatcatattgcatgcgttgtatttgtatttgtcgactacaattgtgaaaaaaatggtggcatgattaattattaactcgagagtggtagcatgatgatattacgatggataatatgacacagttatattatataagaagttagcattcaaattagttgtctataagttatttttctatgttgtgtatatatgatttcatacatggcgttttcgtttgttacatacttcaaacctatcgaagcaatcgacctcactattgcatatacatttatatcaaatgaattttgctatcgaccacgtgggctatggtaaggaatatgggtgttaagacccatattacattattttatttcatcctaatgtttcgcgtatgggctattgcagcatgggccgcccgaaggcttggcccatgttgggtctacacctttgcctcttgtactaccacatttaggcctcatggttttctatgactttagttgtacttgtgttgtgttgatcatgtcgcatgcattttttcttagaagcaactactctattgtaaagttagaggggcgtgagtccctaacatgtggtggcccatcgtcatgggcccacatgtcaaaggtacacatcggtccaacgtatgttatgggagactcgtcgcttcttctctctttcatctctctagtttttttttgtatattttgtgccatgcagttgttgattaaacttgtgaagaagaaggggtagcgtgattgattgttgatctgaaagtggcagcaaaataatattatgatggataatatgacacaatctataagaagttaacacttaaaccaatcatttatggagtcatagaagatgtttttctaaggagatgacaaaagcgcacgtatacatgagcacaatgctgatgtacgatttgatttcataccttatcttacatatcctagatccatcgaattttatcgttatgcatacatttacctcgagagtcatggataggagtgtgtgtgttaaagcccatatcactttatatttaattttggaaatacttaatataatttcgttatagtgtttcatccatgggccgcacaaaggcttggcctatattgggtctactccttacctgctacagttagtttgtctttgtactatctcatggtttatgtatttgctcatcggtgggacatcacctaataatcatatatccactaacgattaatatctaggttttattttagagtgtgacttacttcttccgtccgaaaaagatagtaggtttaaaagcgtctataccatatctgataatgtcgatagcatcaactcatgtacaaccaaaataatttatcatgagatacctctattttcagtaacaaccaaataatatactcaccgtggagaacatagaaatcgggtgctcacacaacctccatatttgactagatatagaaggtggagcaaatccatgaattttgtaatagagtaggactagttcataatgtcgggacactaatgttgtattcggttaggtttttttttaagtcctatccccaacctatataagatgggtacacatagcaataataagcataacaccaaggtgaccaatgatatgctcaaaatcttaatggatgttctaaattagactaatttaagtatcttgacaaattttatcgtgtagagatagaggagctagtaattattactagcaacctgaaaaacttaatttggctcctccgtaaaaagaaggaaacggcgaaaaagcggctgcctctgccgccgtcacgctgaacgcgcctcaccggctcaccgccgcggctgacccaacccaacccaacccaacccgggctcgatttcacttgaaatttggaccccacccaaacctgtcgtcgcgactcatctactatccattctattcatccccatggcgccgccgccgccgccgccgcctgccgccgccgcctcccccaccccaatgctgctcgccctcacgggcctctccaccttcagcgacaggctcgtcgagttcttcaatcactggaactccttcatccgctatgccaccgccatctccgacgacttaccaccccttcccgccgccgaccaaccgcccaacctcgccgatgtcgccgagccagaatccactaccccgcacagccccgtcgccgtcgatgagccagaatcctctaccgcgcccaaccccgtcgccgtcgccgtcgccgagcccaagcctgcacccgtgccccagcccgaggagcccaggccgaaccgcggcggcgacccatcggcggagcatatgggccgcatctgcgagcgcatgggctcgggggagctcctccgcttcgtcatctcccgcatgggggacctctcctggctgctccgcgctgtcccgcccgcgctccgccgcgcccccaaccccgcggagctcgtgctccgggctatcggccgctactacatccgacccgggggcaggcacaccgaggccgcgtgcgagctcctcctgctgtcctacgtgcgcgccggctgccccctccgcccgggccaggaggccggggacgaccacctgcgggcggaagcccgcgaggcggcgctctcgtggcgcagccggcttgtgcggtccaaaggacggggttgccgctgccgccgccaacgatgcccgcggccttcttctcctcatggctgccttcggcgtgcccgtggagttcccgtcgcaggagatcttcgagctgttgcatgctgctggcggcctggcctgcgccgaggtgctcaaatgctccaagcatttcttagataagctgcgtggtgagggccacttaccactgaatcactgataaacccttgtgacatttcacctatgcctaattattccagttccttgactaactggctgcagctgttttgtcttgcagatgttgttgctcatatgctgaatagaggaatttatcatcaaaccgttgctacaataattgcatttgaacttcaggatgcattcccgctttctgcgatagcgacttgtgtcattgagagagttgggcgtacaaaggatcaagacagtcaagaacagcaccatctgccaggatcggtacctttgtcgtttatcacactatcagcttattatcatatattccttctgttaatgcatatatttaattactgttatatgatgtgttattttcaatactcaactcctgctatatgtactttgcactaccagtaacctattacaagtggtttacatgatttaatgtttgacatgatatattctttccgttagtgcatatatttgattaccgttatatgatgtgttatattcagtactcaactcctgctatatagtgtagattacactttgcaccacctttttgtgtttttgtgtcaccttgcgccaccattaaggatttgtatcaccctgcaccacattttactatcaatttttcaacctgtgccacatttaaccaataggcgttaacttccaccgattaatgcatccatccaattgatgtgcgcaccaataccttcaacaggtcctttttagcgccaacaccagacaaattgcacaattagatttatatgactgctgaaatgtaacaaacttcatgtcaccatacctataagcaataaactaaaatgactgtagaggttcatattgtagcaaagactaaataaacaccatgccaccaaattcctccagtattatgtgagccaatcccttttgcatctgttggctgttgctgaaacactggtacttcatcaatgttaaacacatccaagtcagcattgacatcaaacaggtcttccgcatcagtgtcagtgtgtcacttatggtccttgtctatcctactgctcatctaagcaatctgctttaagttctttattctcctcttccaagattgataagtcttcatagttatcatcaaaagattgatgatcagctagcgaaaccataggttgcaactaaactaaattctccaacccattccaaccaacaaaaacagaaaagtaaattggatgccaaccatgtttatgaactaatctcttcccatcagagaacatcttcttgagagtcgctgtgtgatggtggtaggatctgaagtggggtgcggaatgctgactgctcgcgccgttgcttggcagcggcactgggaccagggtcagggcatgggtgcggtacccatcatgtgttgtggggcacatcggtgggttgtgctgattcagcactgatcgaacaataggaagaaaaaagtggtgcagagtgatgcaattccttaaaggtggtgcaatgtgagtatgtgacagtgtaaattaatctctatgtttctatatagtttgtgtgtctctgtgtgtgtgtgtgtgtgtgtgtgtgtgtttccagcctcatccctaatgttgtataaccatttctgtgcagaaagagaatgatgaagagaagctagctctactgagattactatccaaatacgtggaggatccaaaacaatgttccacagagaatttcagcattgctgataggattgcgatgctggaacaaagcctcgcaaagccacatcaagcatttacaggaacaaagcgcaagaggacagcacaggaggacagtgtagaatgcactcgagggcctaaatgttcatacactccagctgcttctagtgcctcacgtaacaaaaatcttgaaggatagaagcagcatatctgttcaattaactcagagttcgccaaactttgttggggatccagttgaaccctgtggacaatagaattgctctacctagcaaggtgtgaaaagtataaccatgttttcgtttaattttcttgtggcaagcttagccagacttgcctagtaagcacattatctttctacatgtttgttaagggatgcattttggggttgggggtctgaacctaggaaatgtgcatcatccttagcatcatttcaatagtggcctcattaagaaagctccgtttacttattcctatattagtgagtcgtacaacgttgttgtttatgtttctaactataatacttatgatatatcatggacttacgtatttaaaatcattttcatcaacatccactagtatttggccagacttgttaggccttattagttgagtaagggtcttttaaaatatcttttccatttggagaagatatggatgagttctggaatataatcgaaactttgtatgaagtgcattttcatttcaattggcacaattttctgtcaatttttaatctgcaccacattgaaccaaaaaacactactgtttatttgatataccatagtggattccattactggttcatggtaaaaaaagaaaataaacacgatgccaccaaatcgtccaatctttgagccaacccttttttccatctgttgctcaaaattcaagtcagcaatggcatcgaacaagtcttcaccattggtgtcaccctcacaatgaaagtccttacctaccctacttttcatctcagcaatctggttcaagttctttttttccctcctcgaaagcatattctgcatcatcctcatcagaagattgataatcacctagctgcaaggtatgattctcctaatccatgtcattgtcatcatcatcttactaagggaagcatgctcttgttcatctatagtaacaatggtcgatgatattgtagaatcaacaatatttttccagtggagataaaatcctattgtcatctatcaccatgtaaaacaagactgaaacattacaattcaactacatatctaaaaaggaaaattgtactccaagctgaaaccccaggttgcagctattcttttttttttatctccaatccattccaatcaaccaaaaaaaagtaaatgggatgccgacctctaggttttgaaccaatctcttctcaccagagatatcctccttaagcgttgtctggcaacgtcagtatctgaactagggtgccaaaagctggctgattgtgctgtcgcttcgcagctctcctgggaggctgggaccaggggtcgggacatggggtgtgtgcatcatgggtccttcatattcagtgtaaattgaacaatgggaaacaaaaaatggtctagaatgacacaatcccttaaaggtggtgcaatgtgaacacaaaggcacacataggtggttcacaatgtaatttgctctatatttttttgtagttgtgtgtgtgcgctcacgcgcatctgtttgttttgctgtaatgtgcgtatgtgttttgtcggccacatccctaatgtctatgtgcaataatttgtgtgcagaaagagaatgactaagagaagtcggctctattgagataactaatatgtggaggatcagaaacaatgttccctagaggtttcttgtttcagtattcctgatagggttgcgctgctagaacaatgcctcggaaagccacagcaagcctttatatgggaacaaagtgtaagaggacagcacaggagggcagtttagggtgcactcgagggcctaaatgtccattcactccagctgcttgcaatgcatcacctaacagtaatcttgaaggagcaaattgctcaacctagcaaggtgtgaaaaatactaccacattttcatttaatttcttgtggcaagctcggtgagacttgcctagtaagctcaccatatttctacatgtttgctaagtgatgcattttgggttgggctgttgggttctgaaagactgaaactaggaaatgcacatcatcgttcctttttttttttttgaaaaaagaaaattagcatcagtttgagtattggtctcattaagaaggtcagtttacttggcatatcaatgagttgtacagctttgttgtatcaatttctaactatagtacttatgataaaccattggtttacatgttcaaaaatcattttcatcaacatctactagcgtttgactagacttgttaggccttattagtggagttatgtttacggtcttttaaagcacctttccatttggagaatctatggatgaggatgagtcataatccaaaattacaaactctgtgaattgtgaagagcatttttcatttggagaatcatgcatgagttctgggatataattgaaacttaatgcaaagtgcatttttaatttggagaacctatgcaatgcataagttctgaaatataacccaaagtttatgcaaggtacattttccatttggagaagctatgcctgagttcctggatgttatccaaactctatacaaagtgtttttttttttttcattttggagagggtattcatgagttctggaatgaaattcagactctatgtcaagtgcattttttgtttggagaagctatctgtttgttctggaatataatccaaactaaatagatgcacatttttcatttagagaatctatgcatgagttctggaatataacccaaactcaaagcaaagtgcattttccatttggagaagctcgctccgtttgctgctccgtttgtcaaaacttgcttatctttcgatttcagaatttacattgattttgtttgaagagtgcaattctctacaaaacacatgatctttgaatgttttttaagaattcatgttcatgcattttaattctttttcaagcaccccctatctgcacactggtctggaaatctggttcacagttcacacgttttttgcatgagggcacagggagagagtggtagttgcaggctgcttccaaacttccacctacctccacagtgttagagatcccttcccatttgctgagtaggaagctttcactctctagtagtaggtgtgtcctttacatttgctagtctccactttccgagctcgatcgatcgagcatggaagccacaacctccagcttgctcgtgcgccccgtcgacacgcggctctccgccgcctccctccccatcgtcgtccgcgcccgccggcgcgtggccgtcgtcacggcggcggcgccggagcggaagccggccgcggcggcgagcagcagcaactacgtggtggtgccgctggacgcggcgccgtcggggatcacgcggccgctggtggaaatcctgcgcgacctcaacaagcgcgtccccgacaccgtcgtccgttcctcccgccgccgcgcgtcgccctccgatccggtcatcccctggtacggaacaacctatacatccttggcctttgcttgtgctactggtaaagcactgcagatcttgctgccatacacatttgcttgcaacaaggagcactcgcgatattcaggctcatgtacagcatcgaccaatgacgctcagatcctcacatttctagtggcacactctcaagagtcaagacacaaaaagaagtttgttccttgctgatgtttcacggtttcttgtaggtatcatgccaacaggatgctaagcttttatgctccaggtaagcatatctcgtgtactctatacctgaatctaataccgagctaacggtgctgaacattaatttgtaatcacaaaatcgatgccagtcactggttcaccccttctgtgcttgctcttttgaaagcaacatgagcaaataaagttacataagtagtatgtgttgtatacataacctacatatgtactagcttccaggatgctgaataagtaccgtgtgttgtacacataaactgcatatgccgttttcaggatgctaaataagtagtgtgtgttggtacacataacctgcatatgtagctttcaggatgctgaatatgtagtgtgtactgtacacataacctttataggcagcttaaaggatgctgtcatgatgaataagtgtattttgtacgcataacttgcaaatgctgcttccaggtgctgaataagtagtgtgttttgtacacataacctgcatatgcagcttccgggatgctgaattctctctcatttcaacttataattgtttccttctgatgattgtcaacatttacttgctctacctgtcctatgtctgttgaaatactccaacgactaccaaatttaacacctttaatcatttccagtggatgatagtcacatttccttgcttgatctatcctttatctacttgaaatgcactggtcatgccaactcttcagtcttttacaccgttcttggatttccactcatattatcactgttttttttggaaacatcaggctggtgtggagaggtccgtgatgttatttacactgacaatgggaaagtgacagtgatatatcgtgtcacagtacgaggaacagatggagaggtaagtttaaaggtgttgcctcttcttgaagtcttgtgattttttctctggaagcttcactttctctattgccattctcacttacatatacatgggatgggccctcttcaatagatgggctaggcacacaagacnnacacacacnataactagtctatttacagcccaacactccccctcaagatgggtgatagatatctatcatacccatcttgtcacatgaacattacactctttaacacctaagccctttgtta

SEQ ID NO: 61653 - DNA, 993 bp, Oryza sativa
atgatgtgtcaatctaagtccttatgcagcatttagtattcaacttaaaaaatactaagcaatgatgcagctttttaatgaaattcgtctatcataattacccaacgaggatatctccaaaataaatttgcaatctttttctacgcattgcattatctgctcataatcatcttctaggtcatcagaagataccccagcaaccacttttgcatagttttgaggaacaatcttctggatcaacggcgacaccactgttgtacggaatatctcttcagctgaagatgtgttgtcaatagcagcataagcacgcaaacagttgtatattactttgtcatcacgatgttctagaccatccacaaagcaacgctccaagctaccatcaagtagttttgtagcaccttgggccctcttctccatgttttcaataaaagggaggttctgtactgccataatgtaacaggataagaatcataaatataagtggcactgagatgcaaaaggtagcatcaggtagcaataaaacaaaagctaccaatatgaaaccatgttgacacttcagcagtttgcgacaaccaaatctatgacatgtgggtagacatttttcttatagttattaatcaagatgttatatcacatcgttgtattgctgtgtatactacactttcaatggtcaattgtgacacagaaataaacctttccggagaaacaactaatgtcatttttgtgttacaatttttccctaatggtttttctcagcaacggaacagaaaaagagaaggtatgtgagtgagaggtgcaaatggaccagtatttattggtgagttagtgtcacaaacctgtgcatgactgatgtagaatctgagccggttcatctcactggcgattctttctaagagaatgctttgtgtctccctaacatctgccccatcatccatgtccggtggtgtggcaacgttgcctgagtagcccttatcaccataaacagcctcaaca

SEQ ID NO: 61654 - DNA, 803 bp, Oryza sativa
gcagccagacgcacttggcagcgacgaagaagcactgcagcagctgctccggccatggccgggaccaattcttcagggtggacacaatgcagctcatcttctggtcgcagaaccggctgaagtcctcgctgtagtacttggtgcccttcctgagcacctcgttccagctcaggttgcgcagtgcgacgaaggaggcgaagctctcctgggatccttgcttgggatcgaggcaccgtggcgagccgttcttctggaacgtgcagttctcgaagtcctggtacattgcctggttcatcagagcttccagatggtacagcaccagcttggagcaatgcttgttgtcagtgatcatgagctggtaaggttggagaagaatgtttagtttttctatcaaaccattgtcaggttcttcgacctgctggatcaatgccttgcagaattgcttcaccgaaagccgcgcctcggaggcgatctgcaagaagccttccaccatggcttcatggctgaccggccccgggagctcctggcttgctccgatcgatcgcgttgatctcctcgacatggaggatgatgatggttgagcgttgctggttgagctcgtcgctagtcgcagtgccttcttgagctccgagcagtaggcctcgaggccggcgagcttggtggtgagctctcccagggacgacctcatctcggcggcttcctgcagcgcggcgtcgcggtgcgcgttcgcgtcggcgagctctcgccggagcgagtcgagcgacagcaacccccactccttgagcagctgcgacatgttctcc

SEQ ID NO: 61655 - DNA, 15977 bp, Oryza sativa
  unsure (1)..(15977): unsure at all n locations
tcctcatagtaagcctgcccaatttaacaagatattcaagccaaaaattagccaaaaaaatcttgcaaaagaacagaacaaattcagggacagtgagattgaaaaaaaaaagtgaagaaatccaaacagaatggcacattgcaacccacatttctgcaatatgcatggagttgatactgaaagtttccaatttttaccatttaccaaggcaaagtacaggttgctgctataggttaaagcacagcaagagattactccacagatgtgtcatcaagcttctttcagaaaaaggtgagaatgtgacatcaaaagaatctgagataacgcaacttttactgttgcttaactgcattacatgtcctattaattgcagagtaatagtaggagcatctgggattagctgtcaagaagaggaagaacatgctagcagcaagaagagcatgcaagttaaggagaactaatgaatggctcaagttcatcaccaacgaatgacccttgaaaacgagaagagatgaaccaagaaggcacatcgccatggcagcatcaaagatagcagtgacagggtgactgtacgcaagaaaagctcgctcaccggagtaaacaccgggtagtcctcgtcgacggtggccaccgccgccgccgccgcccccgccctggagagcgcgggggacgcggccggcgggaggcggatgatggccgggctgcggctggcgctggcgccgccgcctacgccgccgccgccgcgctgcagcagcgcggcgtggagcgcccgcagctcgaccgccttggcgatggcggcctgcacgtcctgccgcgtcgcctgcaccggcggcgtcgacgtcgccgccgccgtgccgaacgcctcggctgcggcggccgccatggccatgtcaggcgagtcaaaggctgcttcgccttcgcttgccccaaggattcttggaacgcagagcgaggcaagcgagcacgggtgaggagaagcaatggagggggaaatgaacagtagattcttgagagagagagagtggttgttgcagaggagagtgacagattgagagagagattgaggaggtggagggaactgcacatttgaagagatttgccagtgcttgctgcaagcaaggccctcttttcttttgagcttttttttggctttcttttcttttcttttctttttgcttttagctgcattatgtagattcgctgctgctttgtgtatactttgcttgattggtaggagtaccacctcaaattcgggcctcctttgccaaaaatcttgtaaaggtgtattacatgctaccgaccaatgttaaagaaacagccgacaagttggtgattaaggttacgtttttttctgtttattcatcggcttcttgggacaaagattatcagaatctcgatccatatgctagtaccttacaatactactacgattctaccaaatcaaagcggtaccgatccacctagtatttgcattatgctttaaaaaaaatgttttctcgaaaactttcttctactgcagtgctgagtagtgaaatacacttgaaatagagttttatatttgcacaaatttccctccgaaatttttctacacatacaaacttctaacttttccatcacatcgttttaatttcaaccaaacttttaattttgaccgtgaactaaacacacctctatatctgcacaaatttcgagccattgtcactatttttcacctgtttatggctggtagttggaggtaggtcaaaaatctcaatgccaacactacctctatctgcaacaacccggccattaatggacatctctgttgcgatgccctgcaggctttcttgcttgcttgcttgccccgcggtggcggatttgctgtccaaccgaggcggcgacggcgcattaaattcccggccgtcgctctcctctccggcggcggcggccaccgcgatcgccgccggtgacacacgctgccgtgtcaggctaagctcgtgacaacattctggttggagctcggactgaacattttcttttctttttttatggttagctcagacacgagacagacattctgcttagctcagctagctatcacgcgcgacgcggacggaatactgataagcttttttttatcttttgaaagataaactattaaaaggttggacctttcgtcaggaatgcaacctggctttaactaccatttctaaaaagaatgaagcgtataagatgcagttgttgttgttattggtatttttttgggtagatgcagttgttgctgatgatccatttcctcaaaacttaaaatgtactctgaaatctctccatgtcagtataccataaagaattttacaaacattaaggtactatttttcttagtgtaaaatttagtatctttacataccttcttaagcgaatatacaacaaccagacaaatttgctaacatgatatagatgagagtagagagaaatgttgttataagattaatatgggcttaacaatgatttttattgtttataaaagaaaattgtgctgtgtaagagtagggaagaggaaagaatgtaataaaaaaatccgtatactaatagttagagcatttgttatctcaatcgttatatgatgataatctctaactgagttgtgctttaagagccacatcaggttctacatttgatcatgccctaatgggctgtgtacatccttttttgggtgtagaggccggtttaatccattatctaaaaaatttgatcatgccctaatggctttaaaaatcatagtatcctctggaacttatgaactgctgaagcagagacagagatttagatgttcctttttccttgattgtttttttaaggggaggatctcaaggagtctgtcattcttcgcattgttttgagcttagtgcaggattggtcaaaagttagctgtaaaaaggtttacaagatccaagttatacacctatcttgaatcttaaattaaaccctcagggaagtgtcaagcagagagcatactagatgtaaagctcaaggtcctagctgtacatatgtccaatccaaaaggcccaagaatcttatgccaggactcaagatatgttaagggggtaggttgatcattcttaactttatccatggaaatttctcaacaagtgatctgtgaaaggttttttgcaagagacaacacaaccaacaaaaaggtgatctatccattccttttctcctctttacacctttactgaattttcctttgtatcggagtgcttttccaatggcatctagctagatggatctttgcacattgagctcaccatggccatgcatacatgcatggaaggaacaagattggacgtctcattgtcaagttaaccacaggggctgcgtgctactaaagcctaaaaaggcactaaaccaaacactttgagcgtatcttatcttaaccttttacaaccccattgattgagtaagagctgattataaacttatcaacataataaaattatttgtgagtaaaccttctctatatatgtgttcttagcaattttaaagccaatgctggaaaaataaactacaatgaaaaaaaaaacttaaaatcaacttcaaaattattttcttttggcagtggcatatataaccttttatgtgaacccttctattgtcttgcatgcatatgatctgcaaatttttaaaagcagttttcagagcaagaaaagaaaccaggcaggcaatacccccaaacaggcctttgtcttggcacaaagcaaggaacaaaatactccagctagggggcagtatgcgaagccaagggtagctgcagattgttgcagattgtatacctggaagggatggatgtctgtgtccatgatggtgtttgtttaatccaaaatggcatccagtgatgcccatccattatactagggatgtgtgagtccattttgtttgagggttattaatttattaatccattgtgattgattttacaaatcacaacaaaatagccttagaatccatttttgtccgggctgttgttcaggacaaggtggtgttaaggtcatttggaattcaccccttagtttaagtatgacaggtgcatgtgagctcctagtcctttctggctttctgtccactcttggttaggttaggttaattatctcttccctcttatccttcaatcatcggtcgttttgctaaaataaaagaaaaacatagtaacctttcctaatagcttatatgagcctgaatgcaataagaaaaatacaagtgcagaaactgatttagggcatatttggtttgctactatcttcaaccttaccaaattttaatactcctattgccaaattttttaccctgtttgaaacatattattcactggataattgccatgggttatctacatgtagagataaattaaacatttttataaacaaacttaacaaatagtttagaacaagtagtgtaagcaatgaaataaaatttatgagaaaacatactttagagatgcataattttcccttaacttattcacataactctgcacaaaaatctgataatgtatcaaaccaaactaacagagttattaagggggtgtnngggactnttanaaacatangtncntnncaaacnacccctaattttggcatcaaactgaacacgcctttaatcgaacagaaaagcagtgtatctttcaggccagaagagtacagggaagcacaacttgtgagtgtttgctgctgcaaaagattgcagcgtgcacagtactaggggtgaaaacggagcggatattatccgatccgatccgctccgaatccgtccgaagtgaggatatggtaagggtctgtagatatccgtccggatgcggatgcggatgcggatagatgcatgcggatgcggatgcggatatggtatcggtaatatccggcggatacggattatccgctattttaaacggattatccgataaacgttttggcggataatccgaatttcacagcccatataaccactcaatttggcccatttgacatgagcattttcatcgtgtaaagattcagcccatccatgtccaccttatccatcaatctatccaggagttcagtccgtgactcaaacgacgtcgcgtcaaccaatttttttatcgagacttctcttctttcagtcctcccacgccgccacctgacgccctgacttacgtgtggaacttctatgtcttatgtgatactgttttttctaacaattgtgaaacttttatgtcttgcgtgttatgtgaatgcgatatatcgtgatgtcaatactgtatgtgtcgattacatgcttttggacagaagacaaatcaatgttaacaacttgacattatattatgatgtgattggtgctttcatgagtcatgtgaattgtgatattggtacctcattgttgctcattgcacagatgataagatgttatatcgattgtatatacatatcacatccgattattttcatccgtttccgagccgagtccgcaccgagtccgcatcatttccgacacccgaaataatccgttccgcatccgcatccgcacattatccgtaccgcctccgaatccgattaaaaaatatggtataggatatggtatgactactatccatccgaatccgatccgttttcacctctacacagtacaatggttgcatatataggactgacaaaagctacagccgcgagtgcgaagccaaagcaggtccaggagacagatataactgcattctgtgagaggcggacaagatcagcggcggtggcaccactgcacgacccggtcggtggccatgcaattgcagatgcaggtcaggtgcatttgcaattgcaacgcaaagaggtgtgtttggttggtgcagcttcttttccgcggcgcctttcgccgcctggtccagagagagagagactcccattgtttcccccattcagcatttgttgttaaattttgaatttagaagttaaaatttaaagttgatttttgattttttttttcatcaaattttattttttatcattagtatttaagtcgttaagaacacatatatgacagttttatctataaattattattattttgttaatacgtcgtatggtgtattatccgtattcggccaaacaatggtggcctaggaggatctgcacgagagcttctaacggttgttgtttcttttaaattaaaagctcacttaaatggtttaatttgtcactctagattttaacaagttgtagttatgggataaaaaataaactaaaaacaagaagttagttttttttcccttgcttctcctgattctccttctcgaaacctaaaattcctcacagacattatagatcatgtttaagtagctgaagattttgataagcaactagtaagaataccaaaataattttttttagcctcttccttttagtttataacctttagtatctgaatcaaaaccagactcttcgaaagagtagagagatttaggaagagttgtagctgtcaaaaactcttctaaacagggccacatgtgtgcagtggttcagggacagagatatcaggatgctgccgaaagacaaggtgccaaaagaattaatgctaatggctgtcttgacagtcctactgtccactgtggttaagctattacgcatggcagggcaggctttgaggctactgttactaatgggccctattatattgtttttttcttgttcatcttttcttcctctttctttgcaactgtagtaggagtacagtactccatttgtgcgtctcaagagaatggatgcccagtcagtgtcgttcttgggagttggaaacagtaagataagtgtactaggggctggtttggttttgctaccatgccaaaatattggcaatgccaaatcataggcaaaatttgatagtgccaaatgttttggcaacttatgtaccttataggcacattttgttagcaaaccaaacactagccaaactactatttaaaatgccaacaatttgatagggcacattttggcatcaaaccaaaatggccctagattagtaggagtataccagaacgtctttgcaatccttccaagggaatgaattggaatagtaagataatatgtgttgtgtaattagccggtaggttaggtccgagcttccaggatggtggtgtggtgtgagcacatcgtgctagcatgctaacagctaatgccactcattatgcaaggcccacaagtttaacctgagtaatactccctccgtcccaaaatataacaacttttaacccctagaatttatcttaaaatataatacttcatccctttcacaatgtaagttattctagcatttcccatattcatattgatgttaatgaatttagatagatatatatgtctagattcattaacatcaatatgaatgtggaaaatgatagaatgacttacattgtgaaaaggagagagtaacttctccaccaacattctcttcccaaccaatcgcaactctccaccattcatttttcccatctaccttcactactcatctaatcacaaccctttacaatttacatctacctactttcttaataaccgtgtccaactctaaaacttattatattctgatacgggggagtagatcattatgctcgagggtttttttcccctctgaatagatatgtcaatatctaataagtttcagacttcagacgacttattcattattggaagtaaaatctttgctgctgctcaacacagtagtctactgcttatgtagctcactactgtttgcagttgaacaatctgatacatgaaaataatgtcaaatctgacaggcagccataggggtgggcagaaaaaaaccgaaccgaaaagactgagaccgagaccgagaaattcggtcctaggtagtgaaagaccggattttgttcggtcaattcggttagtcccctcgggtaaccgaatagaccgaaaagaccgaattaccaaaaaaaatatctaaatgcaacatacaatccactatatttaataggattaatctctaattttcacatcctacttcttctaggcatgcaacctattaagagtctttactcataagtgcttacgaatttttttttgatttttgtgttgaaaatttctattgtttctttgcatatatgaaaatattgttgaatttcggtcaggactgagaccgagaccgagaccgaatttgtcggtcctgacattttttactgaaattcggtcttcacttttcaaagaccgaaaagaccgaagaccgagaccgaaattttcggttagaccgaatacccacccctagacagccataccccaagaccacaaaaaaggggggaaatgtactcactggcagacatacattgtacgctcaatttatgcataatagcatcgatggcattgccggtgtgtatacatgatgcagaggacagggatgtgacccccttctgtctaaaacagcattgatcacctcatgtagagaaacactgaaaataaccttactgataattgttgggaaaatgggaccccatctgcaaatgggttgtaataagcccacaggaattgaacatgaatcttgcaggagcaataaatccaaccctccaagctcaatgctcaagcatcagaggttaccagaaggtacatcgtcattgttacatttggtatagtagcaactacatgtttagtcataacaggggaagtaacaatgtacatctgcaatagtatggccacatccatgcaatagtggatgctaaatcaaaaggttctgtcaggttttccaaggtcccgtggtccggttctgctgtacaaagaccagaatgtgacgctatgaaccctttgaaggtacaacagttgaacgccaccaaaagctaacagagaaactaatagaaagagatctgacgtaatgccaccattttggtggaatgtaaagcaagtcaccctcctccaatatacagtccaagaaatcaagattttctacccgtgggaactccttcagatcaacgttgtcaagatctacctgcacaaacatttgagctgtgttgataaatgggcagttaggagaaactataggcagtgctaaaattatcatggggctagaacactctgtatcctcacatcgcacacaacagaattggacataatgcttttaaccaaataatctgagaaatggttatgactagcaggtaactgaaaaggttgacctagaaaatggaagtcaagcatatttattgtttcctaatttagctctttaaaatgctctgataagtagatccagcttgcaatttcatgcttaagagtaatcaagaagaggatactaacgctgagttcttttcagcaactcattggcaacttactcattttccgttagcacgcatccaaactgctaaacggtgtgtttcgtgcaaaagttttttatataaaagtttctttagaaaaatcaaacaaatccattttttaagtttgtaataattaatactcagtcaatcatgcgctaatcgcttgtctcatttcgggtcacatccaaaatttccgccaaactgcccaattgaatggcccaagaatgcaaatctttggctcacgatccatatatattaaatggtgatgacctgcaaatatatattttttccaaatatgtaaccaatcgaacggagttatgtacctgactggtgttacttagcatagtttctgtgtgtgggtacaagtcctcagatatggaagcaggatatagtctaatatacttccttcccaatacctatcaaggagaaagcaaagatattattaaccaataactgttgataaaagttaccaaaagaaactgctgagtactgatagttatgaactatgatagtactatgcaaacatctcaaatgggtcagccgtccaccatcaatggattaatgatgtgcagaaaggcatttgaatttgtcagctaaactcttaaatatgtatcagatcgctatttttttttggaaaaggagtatcagatggatttgaatgtttggacactcgaatcctttgcaccgcaaagtttcatttacaaagattgattcgctaatattagctttttcttgactgctccaatcaattaaacttatcagatgatcattgttgccaattttgaagaaccgtttcaattatttcaatcaattaaacttatcagattatcattgttgccaagtttgaagaactgtttcaattatatctacctggtagctgactacggaattctgagtagatttatgcatttagacattacatagatgacatgtcaatcagcacctaatcataacgtgatgagtaacatgatagcataaacagtgtgaacagttgaacttgctcatagaaaaaagagtatttactctagaaaaaattattgacaacagatccaaacggggaaaaaatatgaaaaggagtactcacactatacctgagctaaaatgttgtgatgtggatcatggtgcaatggtgtcactgtcccgtgtggaccaaaccatgcattaagtgactgaagctcccctccaccagcataacagtagtcaggaaccattatatcttcatggagctcttttatctgcaaatggcacaaaaaaaaaactgacaattgggcttatacttactagagaatccacaatgatagcatggttacctgttcaaacaagggatgctgagccagatatgtcaagtttgaaggacagccagctgaccacatcctctcaaggaactgagagaaagtgattagctcctgcttccactcactgcacacataattttttccaacctgacagatattcaattacattagtgctatataagtattcagaggtaggtcaatacaggaggaactttcatcataaaatgtcttcgagcaagcataattactcgatgcatgaaaaaggtaactacgggagaataaatgctgcatactaattggattagccatgtaattcagttgaataaatagcatttttgagacactaaattaatgggtaaatatgttacgacacaactattctactgtgatcaaatttcaggaaaatgttccatcacatagaagtcttgtgaataataataataatctatgtatgaaaagattgttcatgcaagagcgccgtagagttaatctagctgtacatgttaaacaatcacacaatcatataaaccaaatctttcggcaaaataagttcatacagaaagagcattgaacataatatgagtaagttaaaatactgaaccaaataccatggcaatatggcatcaaactgaaaccaacaaatatgaacggaacagcttaaaataggttcaatctacctactgttctgatcaccaaggcaaaagattagtgttccaacttgcaaccggaagaatacattgtaacacatttctcaaaattgcacctttgtacaagcaagttgagtcagagacaaatacaagatacaaaaataatctactgtaacttaatgttacttgcagacagctggccaagttcactaaatatcatattttgatgtatataggttgtttgttacaaataagtaataaaacttagcaccaaatttagatgcacttgtttattttacttcaattgaaaagggcataatattggcgctcgaatttgttactatgatcattaatgcactataaaaactataagcatcgaatagtttaaacaaagttaactaaacagaaatggcttgtttccatataatagtcttccagatctagtgtaaagagcaaaaggcatttacttcaacaggaacagttcgatctccagcaatcttcttcaggtattggatgtctttccactttgtccttgcaggccaatgatcgatgcttccactgattataacaggggactcgcgtaaaaagtaatcacatataaattcctccaaagaaatgcatgatcgcctctcaaccttcttacaagataaagactttgccggaagaatattaagtgcctggaaaaagtactgtcagtagtaatacaagatgagcagaaggtaatgattatgaatgcccttatccatacaacaaattcagaaaatgagtaagcgaagtggtaactagaatgaacggtacaaaccataaggagtaatctacaaatcttcactgatcattccagaaaaaaagatattcctacaatttatgagttgatatacggcagttcacccctaacagtttttcgccaccagtttgttccttagccggatctaactatatatgaaattatatagttgcagccatagttaattacgcatactgcaatgagctcctaaaaaattaagctaagttggaacccgcattgccgcagaaaagcgcgcaaaacaaacacggaatcctacaaaggcaacagcgatctcacatcggcgacgtctcgattcctctcgagcccttccctccacctccgggtctcctcgtcgacggcctccgcgtcgccgccgccgccggggtcggcgacgatgcgcgctatggcggcctcgaggtcggcgcggaggaggttcccccccatgatgaggcccatgtcgagcgccctgagcgcggcgcggcggtcggcggcggccgcccccagccgccggagccgcgcgacgtggaggcaggcgagcgcgtaggcgtccctccacgcggcgcccacctcgctccacggccccgagtggagctgctcccacgccatctcccgcgccgcctccgcggcgcggaggtcgccgcacgccgccttctccgccgacgccacgaacgcgaacccgccctcctcggttatctcccgcagcagcgccgccctccgcccctcctccgcctccgtcgccggcgccggcggctcgccgccggccatcggggtggaaagagaaaaaaaaaagcgcaaaaagcggaggagatatttttctggtcgtcgttgcttttgctccggatgcttcctcaacggggatatttgcttactccgtttggtatgctaatatcacgaaatgactttctaatttgggacagataatggttgggttcggcccatatgctttgggcccactagtagacaacatagcaatatatttgggccctgctgataggcctatgtttttggccccaatatatggtagggccatgtcagctggtaccaacagatcgttaatgggctaaaaaattgggccagtaatatatcgatcataatcggcccagaaaatttagattaaggcccaatttcaaacgcacacttgaatttcacattatttttcttatgagcttcacataattcagaacaaaaaaaaaatcaatgtttcttgcattcttttcagcttatggcccatgagttatatgcggataatttgtgtcgtgtttcaaaaaaaatacaatttattcaagaaccttttacattagcattaacaacatcattgtttcatttattcatttgcttatttgaatcacttattagcaaataaaagatccatttgtcagtaaaagttttatatacatatccttatcgactcaaaagcaaatacactaaagtaaactagggtgaaaaaacaaaaaaaaattcaaaattaaattctaaaatgcaaattttagcttataagcaagcaccaagcaatgagatcctaattgtttagataacttattctaaccaaaatatgttatatacttttataatcggttcaaatcatccatttcaaaatgcccccgactgctggatattcgtcggatcgaaggtttcaaaaacgaaaattaatcttgaaaaacctcacgttgcaaacgcggtttgatcgagggagcatgcacactcctacagattaaacgaattaacaacgactgcaggttgcgttttcatcaggaaaaagtttgattgagctgcatcaacacttgatgaaccagctgctgaggtaagatccgctaattcaagatcctatcgacagagatctcgatcgatcgaccaagcagtcaaacacgcctactttgtttacatcaaagggttaatgcccaaacacagtacacatcggttcatccatccatccatccatccattccatggggggtttcacagtcgtcgtcctctctcgatcgatcgcttaatttctgatctctcgatatctctaagctgctagctaagagctacggtgtttgcatgcgttgccggcggcggtgatctcaggtgtggggggcggcggagtgcggcggcggctggtggtcgtgaggcgggtgcctggggcgggtgacccagagggagctgagggtgcggaggcggtggaagtagtcggagacggcgagcagcgaccgcgccatctgcctcgtcgtcagcacctgctgcagccggtgcagcgtctgctgcctcaggttctcagcctgcatatatccagttaattaattacattagaattaaatctactaatcatgcacgagctatttagagtaagtataatagagcgctataagaagactgaatgctgagatagatgagagaggaaaggagagagagagatgagaaacgggactgtaagcttacagccgacttaggcaaaaaaaactaaaaaaatctatgagacagacaggtggactatatatctatagtgaagagctaaccactttataagtaagctgagatatagaccataaagatctatacagtaaacaactaaataactggttgtcttattagccttgctcttagcttgtcggaatgtctgatgctttgccaccgtcatgccaaaatcagcagctaatcatccagaagcacagttagttgaagactttggagtggagttggagttatatatggtaaaactattatatattcgtgcaatccacgatataaaagtaaaaataaatattggacgtttgtaaatttgtcactggttttttctaattttaaaaggatgccactcgaatgatagttttgcaaattcaactctaagattatattttagacgcggatgataagaaaacaaatagacgataagagactataggctggaactaaatcatttctattttcaaaaacaaaacatatattaattcatacttgcatctcaaatggatataagaagttatcctcctatatattttaattgtaaaaaaaaagcaacaactagttacacgcattgtaggaatattactttacacatacgtggacatcattaattagttggctgattaattatactaagcacaaacagtaaccaattaagcaagttgcaaagtgtgatatgaaatgaaatgtgtggtcgatctgtttgtggcatccatgagcaggtgaagggcggcctataaaaaccgagcagccaggcacatctacccaacatggaaagaccgatgaacaaactaacaattagtcaagcaataaaccctcataaattatacatgtttgtggtgtttgttacacagccttttcagggtttttatatcaaatccaacctctgctctctcccgtttctgggatggagacagtcgggtgcttttcaaaagctgaaaaacctaatccacatatgcttctctgtcgatcgatcgacacaacacctagctaggcgacagcaattatctaatttaatcatgaacatattcagtattgcagtgtcgatttcaattaggtgaactatccattgaaccttctcaactactaacaaatatatgtgatcttctcccattggctccagctctaactaatccatcgaagtgacaggagattaactaacaaataaactataataaagtcataaacatgtagtacaacccagttttattgttccgaataattaaatgaacagatggtatattatctgactattcttgagatactcgacgtacaaacgaatgaattaactattataaagttaaaatgtggcttttattaaaaaaaaattctaggcaatctatatataatttcttgaaaaaaaaatcgtattgttcagcagcttggaaagtgtagtgcgataatcaatactccctccgtcccacaatataagggattttgagtttttgtttgcaacgtttgaccactcgtcttattcaaattttttttgcaaatataaaaaa

SEQ ID NO: 61656 - DNA, 14835 bp, Oryza sativa
agaatcacgcaaggtagggtacctggcggacgaagccctcgagggtggagagcttgttgatggcgacggccatctggcccatgtagttggcgacgttggaagggcagctgagggcgtcggagacgacggtgtcggagagcgactggtagagcgcgtcgaggccctgcgtcagcgcctcctccgtctccagcgccgactgctgcagcccgtacacccccacgatctgctgctccgtcagcggctccacgtgcgccaccagcatctgcatcccctccaatccacattgatcacaattactacttattaatcaatccaatcacattaatcacatcacgaattcagtcatgcaatcgagcaaaaaagaagagaacaaatgcacacaaactgttgctctgtcagctagtgatcagatattcagatattcattcaggagttatagtatatgtcaatgcaggtactgtgatagcagctgatataacagttcagtatacgcgatcgatggagcagtttaattacactgaaaaacccagcacaattaatcgtaacagattcgaaacgaatgtaggtaaatcctgaatccgtaatggtttttgttggtttatcagtactgctacgtacgtacgtacagttctacaacatttggttggattcagttgtggcccggcttgaaaagctgaaatcccagtttcctgatctgattatgatcagatcgatcattcaatgcgtcgatatatcgatcgattcgatcgacgcatgcgcccacgcggtcgcgaagatggcggggaatgctcgcacgcgcgcgagcgcgacagatcgatgaagctagctatccatccactactcgttgtcgtcgtccagctctctccatggagggagagggtatgatgagcttgccgagcaagtgcacaacttctcctacccattgctggaaacgacaataacaaggtgtgtgttttggcttttgtcacatgaatattattcactgcctccgcgacccatataattaaggtgccaatgctgctaatactctctccgtttcgtattataaacaagtactaaactaaaatagggtttactatcgacattgtttttttttttaaaaaaaaagacattttcctttacagacggctaggatgcatttgcaaaagacggaatcgcccccctaacagaaggccaatgaaaattttcacatgtagaaaattatcacattccacaagcagttggcttaactcaaccacgtgtgcggccaccttaagtcagccatatatgaaactacgttttcgtatgcgatcaatgacacgacccttatggattgtcaatgcagtcggagggggcatcaatagaaatcattttttatatagtgaggctaagtattatatattttcaattttcttatcgaaattgttttcgataagttacttttttcatgttgatcaaaattagaaatgcgcaaacttttttcatgcgacatttttcttcatcactctgaagacccgagctagttaaggttgtttatgtaaattcttttattttcttttgagggactaatacgcaatataaaaatattcgaggggtttcaaagcataatccaaattattttttccccactttgttccgtttgtcttctacctcccgacgaagccattgtcaatcgctacgagcatctagggttagggttaatccaatccaagccaatccatggcggggggagtgcatagtagcgtaccttgatgacctcggaggggcggaagccgccgagccagaggaagcagcgctcggctgggctcatccagacgccggagatgaggtggaagacgtcgcccctgatggcgccgtccttgatggcggcgacctcgtcgtggtgcgccaggcagctctccacgtacacctgcagctccccctccggcagctgctgctgcagcgccgcccgcagctcgtacatcagccggtggtgctcctcctgccacctcccgtactccacgtcgaacatcgccgcctccgagctcagccccccgccgccgccgccgccgacgccatcgatcccgcccagcaggacccccttcccgctgcctccctcgccgatcagcccgccgctgccggggaagaacaccccctgcaccatgtatagatccgtacacattttcatccataatacataatccgaattggttgtgtttgatttgatttgggtgcagtttgaattttgctcgaatttgaaattatgaaattcgcctacctgggctctcgcggtgtgcagttcctgttcgagctgagcaagcctgatcctgctggactccagctgctggatgtaagcctgtcgtttcagtcaaaatttcagtaaagtaattaatccacagtggctgaattgaagaagagtggtagtaattaactagcaaaattaatttggtttaatttgatcaaatttgggtgattgcttttgttctgaatatattgaatatatatagcctgtcattttcttctttttctttctgtgtttaattactgtttaattttgcttcactcaccttcttccttagcctgcttttccttgctgcctccctgttctgggctagcctcctcagcgtctgcatatatttacattaatcacaaaatgatacgcaaaaaagtaagcatgatcagaccaaatcatttttagtattgtccttaactcaactgatatgcacaaaaagagaacaacaactaatctctaattatttcttgagaatatcactagtatagtacctttgggtcgcgttcaccagtagatacacccctcctgtgatccttctgcaataataaaaaaaaacataaacaatatgcacattaatgtaagctaaaacataaaaacaatcaaggacagtgttctgaatagattaatcagggtgttttctttagctagcagggttagatattagttggttaattaagtggttaagtgatgatgctgaccttggctgtcaccggcttcacatccctgttgatccctgcaggctcagcagcgaaaggttggtgctgcaggtggtggtgatcctgtctcctgctccctgtcgccaactcctccatggctgctgctgcttgctgctgatggtggtggtgatgatcaggtgacctcgccatcttggttcccacagctgctggggacagcactaaactaatctctccctgccaaatcaatcaatcaatcatcacatccacaaacattaaaccaatctttgatttcatatatactacacacgagtgctacattgaaaagacaaatgacataaccaatgtgagattcagatgaaagtaagtaaaattaattaaataccttgggtgatggctccacatgcatgggctgggaagggaagatgttgagggtctctgcatcatccatgagcacaacacaaatcaagagatcgatcgagcaaaagcagaagaccagctaaccctggagactcacacaccacaactcacaaactgatcgaattgctactgaaaactctactgaagaagagagctaggctgtatatatgcaggcatgcagctggaacaagacactactgtgctactgctgctgctgctcaaattcatcatgctttgcatggcagagagtagtgtgtactatatatgcatgctaggtacgtccaaagctagctatagctgcagtactgcaggcacacaggcaacacgagaaagctgggggctacgagagatacgggagccaaggacagatatcacacagctgcacagctagctgctgctacactgcaacactgatcactgtaacctgaagctggaaacaacagaagtggatagcatcgatcgggtcaaactcgaacaaatgtgcacatcttgctactactcctagctagtagcagcaacaagaacgatcagtagcatggggattgatcgatcatctcttcggcgtgtgtgtgtacgtccctctttctctgcaccaggccacatgcagatgcagctcgatctcggcgaaatcattgagcagtttgttacatgtcacagtccaaaccagccggccagatcttagcagtcagagatagagagagagagagagagggaagagagaggtatagctagagagattgttggtttcatatgcatggactttgggttgctgattccctggtcctgagatgtgtgatctccacaggagtgcagtggtagtagtagcagtagtagtactgcagagatttgttgcagctagcagatatcctggtcaaaatggagtacctgagaatctgctgcatgcaggccggccggccgtataccatgatcgtttctgatgaccccagaaaaaggatgcaactttctgcaaccataggaatatatccctcctcctcctatactacagcctactgctactccctgtgtatgcttggcacatttgtttctgtgcctaagctatatatactgctgttattatgctattattactactaatgctaaatgccaaaagaagaacaactgaaaactgttactactgatctcatcacctgcattaatactctttgaaaaaaaaaatctgaactttttgcaaggaaatatatatggtgaatgcatgtttgagaaaatttgtggtgatttttcggttggcgaattaaaatttacgggtttttttcgtatacgtacgcctttgttcttggtgcgacgccgcatggctgccatgatccaggtacatgaacaaggcctggtccagctcccccagatgatcataagctcctgcagatgcctccttgctgctcctggtggtgcaacacaagaagcaaaattaggagcagcacaagaagcaaaattgttggtgatgaggtatagctatatgtatgtgtgagatagatgcaggtagtatagtagcatgcatgcacaaggttgaggaagtagtgaaggcatcacacatcatcatgaaatcatgcttctataagccaattatgtatgatgctatattaattatttgtctggtccaacctctgcaagactgcaagagtaggagcagaagaataatatgaatctactctacctttgtagcatttattttggcacagcccagaaaataagcatggccatgtactctccaaatttcatgtgtgcaagtcatgctcactgtaaattaaatgtaaaaacttgggcagatatgtatgatcagttggtcataaatatgtcttaggtaatgctcttgtacttatgcggaaatgaatcgctgacctcccaaaatttgaaagaaagactagcgagttgttgcaacaattcaactatatctggctccagatattaaatcacaagtactgaatttttaaatctgaacttgtttgatcatcgtctaactttttttttcttggggggagaggaagaaggaagagaaaaggaccgatctgtttgcatccgctcaaacaatcactgaattcccaaccaggaagcaaaaaggcaaaatcgtctgcatgtaaaatgcaaaattctagcaaaaaaagaagcaaaatcttcaacatgtagaacagtagaatgcaaaattcagtccacaagaagattattggtaacctagtttctccatggctagtgttttgttaaaagaggaggaggaggagaagaggaaattaaagcagtttccataaaaagaagaaggagaagaagaagaggaaaccatggcaaaaaagagatcagaagaaccagcagaaacaaagagagcaagcaagaaaaaagaaccaaaccaaaacaaaccatgcatgatcatgactaacaaatcagagatcaaaatcaaactccaagacacggcccaaatcaagaacaagaaagagacacacatatatatgcatcaaacaaatcagagagagagagagagagggagagagattcagtaaacaaagccgtacatgaagcttgcggcagcggcatgcatggaggaagaggaagacgatgacggaggcggatgatgatggtgctgctgctgatgctgtccgtagtgatggtggccatggttcatcatcatcccaaaggagatgttcatctcctgctgctgacgatgctccctctcctgctggctctcgctcccgctcatcatcgatcgatcaaatcaaagctaacctcttcagaatcgagaggaggaagaagagaagaagaagaacacacgccgaaacatacacagagaaggcaaggtagcaagctatatacgtatgcgtatgtgcctctatctatctatagccatagctgcaaggtcctaaatactctttgactctatgaggctagcagccaaggcgccacctctctctctctcactcactttctctcttcctcttccacaccagcaactaccccatgcatgacctctagctctatctaggactctagttcgtgatggcgccttggacactagcaccacttgcaaactaccctctcttactgctttgatgatgctgttcctgggctgctactgctttgatttcctcttaattcactaatatggttgctgatgatgatgatcttggctatgtgtttctagagagagaggtgagtgggagagccattaatggcgaaacagactttctgtttggctccatgctccctctgcatctaatggtatactgctacaaacagccgacttcttctcttctctcctctcctctcaattttctctctctagattgagagagaagtagagagagagatggaggggcaggtgaagcagaagacgtcgccacctttaatttttctgccacttttgcaccgaagcactcgtggtttctcttattctcgtttcaattcaaaccccggccggtgacaaattgcattagccattaatttagccactgtattttgttaactaaaaactgaactgttattacgatttgagatgccggtagagttgtgcagttgtgcatgcatgcaccaattaacgatttgagatgtgatcctttcaacttgtctttgtctctgttttgactttcggtagaaaccgatattgatgtgttcactcccaacagcaaagtcagtagtacgtactaccatgaaaaaagttggtcagagccacccaaagattgcgagagagaatttttctatgagagtgagctagaaaaagtaagcaatgccttgtgccaaaaagcccaggcctcttctaaaagtaaagtgagttcaaactgcccgtttgtctcacggcctcgatcgtgtcgatatgatgttgtagagattaattgatactatctttgatttttaaatataagtcgttttagccttatgataagaattgagaaaacaatacaaacgactttattgtgcttcatttatactgcggggaaaaaatagcgtgtttatttgtgagcgaggtaggtagcatttatttagcaatgacgggtagggaagaaagaccgaaaaagtgtcttgaagttccaaaaggacttgtatttaataatacattgagaagtttaaaatgatttagaatcagagagagtattaacttgaaaatttgcaaaatgtcatgtgaatcagtttaattcccatagaactccatgaaactttgtacccatgatttcaaagaggagaagaactagataggtgtggtgtaaaaaggtaacgtaggtagcatgatcgaacagaagcatgcgacgaacaaagaaccacccgccttcctagccatggtccccaaaaaaatatacatatagtttaattctaaacggaagaaagatctaagaaaacaacacaaatgattttatcgtgcttcatttatacatggaaaatgattcatttacttacgagtgaggtagcatttatttagcaatgacaaccagggaagaaataccaaaatagtgactataaattccaaaataactcatatttaagaaaacattgagaagtctagaatgatttagaatatgagggaatattgacgtaaaaattttacaaaactaagtgtgtgaatcagttcaattctcgttgaattccactacccataattccaaagaggagaagatcagctagacagctagacaggtgtggtgtaaaaaggtaatgtaggtagcacgatcaaactagagtaggagaggacaaataaccgtccacatgcctagctatggaaaaaaatatttctagtttaattctgaacggaagaagtgaatcgttttagccttgtgcggaacaagtaaaaaaacaacatgaatgacattattgcacttcatttatactacatggaggaaataactcaattatttacaagttaggtagtaagcgtttgtttagcaatatcaaacaggaaaaaagaagaccgcaaaaatgactagaggttttaggacgacttagatttaggaaaatattaaaaatgctataaaataacttgaaaatctgacaaaagcctataacattaaagaaagtacaaaatgtcacgtggatcagctcaactcccgtaaaacttcctacatatgacaaattgggaaggaaaacgttgagcaagcatgctataacttgaaatcagagggagtataacataaaaactttacaggatatctaggttttaattctcctgaaaattctgcaaaattatactttccgcctatgattagtgtggtgtaaaaaggtaagagtttggtttggtagtataggtaggttggtcgagcgaagtggaggatcgcgcgggcgacgacaaaagaaccgcccgctcgctcgcgctggctgtgggcatggtccaagattgagagccgcgcctgggatcagacgcacaagagacgcagaagaattattcgccgagtatgtgaatgctcctgttgctgccctcgaggcacgtataccgtccccaactcccaaaatcatcagtctgttgaatgaatgaaaatgaatgaatggccatcgccttacgtggccgctatctccccatcctccgatccaatgcatctttgcttaatttgcgttgcattatcccccgaattctcggcaaatttctcttcatcatctccagtttctgtttgttttattatctcgatcatcataatacaggtagtagtagtttgttatagtacatctatcatcttgaaatcacaacacttgtagtcctactagcaattatttttacgtgaaaaacataattaaaaaaaaccacctgcgccgataaacaatgatcattgagttgtctggcttaacaaaaatatataaagagacaagatagaatcctaaagtcctactagcaaactaacctgaatatattgcatgttaaaattcaaatcacatttatatttaacagtacgtttgttgaaattggttcaattctcgttgaattcctttgttgcaacggacccaattgaattggtgcacacgttacaaaaaaactggcctgaattcttggaggaacaggggagaaaagtttcgactgaccgacttaaattgttcgttcactggacgcattaactttgaagtgaatgtgctagcgagtgactggcaggaggatcgtcgatcggaccaggaggaccggaccgagggagttctgacatcttggaaattgcagtctcgagatggtaactcgatcagttcagcagcctcatggcttgtaaaaattcttcgtcttctcgtgtactagaaaaaaaagattgttccttttgagactttgaaaatacagttgctgctgctcatgtcatctggagacttgcagcctgtggtaggacgctcctggaaattgcagcatgagttgtgacccagtttagcgaagccgtcaacctttgcctgatgacgacgaaacaggaactccgtcagctcctagctaaagaaaacacagggtcagattatctcacgagattattaatttattatcattcgtttatgacaattcatattctaggaaaaaactcagcatatattattatgtacaaacggccggaagcagattcttttctattatataacgctcgtttcagctacaaaatatggtcaagacgacagtgaaaataaatgaaaatgcaaacgtccatgagttatttctttacctaatgtgctagaagagaaaaggtagagcaattgctaaaagactcaccttgacagcataggtgaagaggagtaagagcaggtacgatagcaggctataagccagctataaatatattttaaagagataaaggaagagagagaaaagcggcgggctacagatctgtagccagctgcagcacgaattctaagatgtaatgtgtgtatgatagatgggactaggtattaatagtatagtaagcaactattgtatgaattgactattacattagttatagataatttggagctagtagtgggctatactattaaacttgccctaataaaagattagtactctaggggtagtagaaaggacttacggagtacacttctctccatgcgtaaagagtacttgcatccaaaaggagaatctccggtagaagtcaaaactgttactgcctgacatcccgtttcgcaagtcgatattctactcaacagagcttttcactgatccagtcgttctgaattctgaacatatgctccagcgggtagcaggtctgccatgtgatgggaggcatggagctgcagctgctgctgcaaaaggattaggatcagaggacccacaatagttggcccctgctattttgtgcacaagaacagcaatcaaataagggaacaagaagtcaagaacaacattgtctctccaagccaagaggtatgaatcttgtgtctttaacgcaaaaggaatcaaacaaaatcatcctaaaaacacacgaacagaaaagaacaacaaacgagaggcagcaacaacattccagcatggactgaacagcaatggcaaagctcaaacaaccaaccaaacaatgcaaatcactgcgatgtcaaaacaaaaatgcagatgacagataacagcaatgggaaatgattatgcaaaaacagaacccgctccatgatgagatgaatgtgttacatgaagctctgcacaattagaagtcatatggcaaactttgtaaaagtactgctgacattgacagtaacaaaaattagtatttcacgaacataactgccccaatgcgatcaaagaaaaatcccttcactttgacctttccctaattcatgcattacaaacatgtcgcaagtcaatgacaatctcaatccattatcaattcgaattttttgaaaataaaaatagcagcagccattcattgcttggattgatctctacttttatcattgaaaagaaaatagtatgtcaacttttaacatttgaaactatgttggctgttatgcatacaaagcttttcttcgtgaaatatttatcaagaccatttcaagttcacatgctactcccaactcacatgcttctcaaggatacataagctacagctcgcagatcttggatgcatgcatagtcacatagatgcactgtggtgagaaaacttacggatagcctctagataagaataatcaagcatagaagatacatggtgcaagggatccaagatgcatggtttaggaaaagaaaattgtactggaagcaatttctactttccaagaaattgtgctgggtcataagtaagcagctcccaaaattaaagcatctcataaaaataagcaatcatgatgatatagttactatcaatgctgcaagaacctagtaacattctacatgctcatggcatttgggcagaacaggttctttcatataatagtcaaaactcaaagattatactttcataataagagcatcagttcaggaccaactctagccatagattgatgggtttcttcgcccaattaaacatcatgtaaccacatgcagcactgtgcttagctgaagttattagtattaataaaattaagataaaacttatgcttcccagtgtttagccataagcaccagaacatttccttaacattagttgtttttagttttttaggtaagagaactacagaagacactccatggctcttattcagcgtataaacgctttcttggacttctttttttttttaaaaaaaaagcaagcaggattgcaaacagattctacaaattggaaaatgtaccagtcatacaaaatgtccagcaggacaagctatcatagtatcatacagatttaagggttattttcttttagggaatgcacaaagacttgtctatcatcacatcaagcctgggtactgatgttcaattacatcgatctaacttcacagctgcatgagaccaccaaaagtaactatgccatattgccatgtatgatgtatcgttgcatcaagggttcttttctctcagctatctccaaaaataactatgccaattgccaagtagcacaaggggacagaggaggatagtgttggtgtgatttagtagcagcccccattgccacctggtagatagtgccattacattagagtatcctaaaattttatatgcacttatagaattgcttcacttttgtaactattagaaaatggcactggcaaagagcttttgatctgctacaacagttctctacttcattgtaattgaacatatggacagatcggatacaggaggttcctatcaactgatgatttttcatttattagtcgcatataaaatgttgaggtgaattctcaatgtttctgtagaatgcataaggggagagagtgagagaaagcaggagaccaaaactttcatttctcgcaggctaaaaaaattacaaaaactatgttcattcttcactagatatctttcttcagaaaaggccatatttcaaacttaaatcatatacacctttcccatttacaattcggtcatcatttgatatatcatttccaaagaatgcaagtcaggtataatttgccatgctagaaacggtatcaactaacaagattgatatttgatggcaaaataagaagtatagccttccatactcaagttacgatggtaatcctactgacaaaatgggcgacagaaacaaatgcaaggaggcattggagcctaacctgaaaaggagaaatgaaaaaaatggtcaaagaggaagcaacatcgaataaatggatatgtttaatgaatttacctatgttatgttcccaagtattccattagatcatcatcatgcagcagcaaatcatcaatatctgggattgggctactgatactgatatagtctaaaggtaatcccgcaaaggaactgccagcaaacttatcttgttcgccatagaaagggtaatcaatgagctgcatatctccaggaacagaagtagaattcccactaccaattatttgatcactataaggactgttgtcagctggtgttctgatacccaagggaaccacatgatgctccatgatagatagtggaagtggttgcttaggaggtatggtctggtaactactaggcatattgttaaagcctgaatcagaatcctgtgggaagatatttccagtttttggcctggaattgtcactgctttcataaggtacagcctggcctctcatgcatatgcttacaggagtagcaattgttgcctgcgcattgccatagtgattaaaatcggcaggaagatgggccagttcttgagtatttcctctgtgttgcaaagcttcactcgtattagcttcctcattgaagcttgtaatctggttagccatgccttggatttctacctggtccagtcggttcatatctggaatcatattccttgaatgttctgatgcgtcatcagctctttgtacctcctgctcaattacggtgacactgtggcgtggtctttttctctttggtggttcttttgttcctgccttcttaggaacaacctgattagggcgtttgactttagctctttctctccttgttggggcatgctcctcgctcaactgtgcagccggagaaagatcttgttcatcatctccagatgatgttgaaaggggagcctcctcaaaaccatcaacatcatactcattactgctgctgtgtgtgtccccatttctgtactccagagcaccgtggtgagtaacctctgacatgccattgtcaatgctgagaacaagcctttcctctctctgtagaacacccaaccaaatcaggctctcttttgcagtcatcttatcctgcaagcattttgatttcctaacatggtttctgatcttatcgaagtttggggacatgtgcttgatcacacctgtaagcaccccaaccttccagaccttcttaagatcatgtggctttttatacggaggaatttgccccctcggaaggcccaacgcaatccaccaatcctcgttccctgaaggccaccacgggggtggagtgcccctctccaatgggtacttgcgctgcggtggatcacagtgctgcatcaatgacgaaagcagtgaaccgagagtggcgtcttggagatccatcaagctgtgctggctcttgatcccgctgctcggagcatcagccgacgccaagttctccgactcatactttgcgattgccgccggcccgttcttatcaaacttcaccttctccttccaccaagctctaatattgtcggaagcgccgctcacgggcttccctttatcagggatgatcccgtaaacgaacccgcgcgcgttgcacacctccatcagcttgagcatgtacttgaggatcccgtcctgcgccctcgacatcttcttgcgcatggcctgatcggatatcggcttccccttggacttgtccagctcagcctgctgcagcgcaagggcgagcctgtcctgcctctccttgatcctcctcagcttgatcctgtctttccacatccgccgggccagatcctcggcctcaatctcctcgtcgctgacatcattctccgtcagattctggatgccctccacctcgaagtccgacgaatcccccaactccgtcgcaatgatagccagatgatccatcacaa

SEQ ID NO: 61657 - DNA, 4971 bp, Oryza sativa
cgccaccaaaaaaccaaaaccccatccatccaccccgactcatccaggaacaccgaaacaacgaacagaaatcggaggaatcagcagggcgggcgcgtacttgggcagcagcggatgggattgtgcgcggcgcggcgcgaggcgaatgcgacggcgaaagagagagaagaaatcgctgtgctcccctcctccctcgaatcgaagcgaatcaatctgttcgggggaatggggaattttatttatttttttaattttttttgcccagtggaggtggaaaagattcgcttctcttccgtgtttccctttttttagaaaaaataaaaggggaaagggaaaggaaacacgagggaggctagcgctgaggaggaagggagcaggggtagggaaggaaagaaagaaaggctcgcagatcccatttgctccggtccactctgtgcacagccctgtgttgtctaggactacctccgtctcaaaataagtgcggtcatggaaatctgttttcaacatttgaccgttcgtcttatttgaaaaatttatgaaatttttttaaaaaaatagtcacacataaagtattattcatgttttattatctaatagcaataaaaatagtaatcataaaaaaaattcaaataagacaaacgatcaaacgttggagatgaatagtgtaaaactgcacttattttaggacggagggagtaagttggagttgggaactctcctccaaacatgtaaaacggagctatccattagtaagaattaattatttttttaaaaaaataaatcaatatgatttttaaagaaacttttgtatatttttttatgcaaaatcatgctatttagcaatttggtaagcatgtgtacggaaaacgaggaaagtgagttgggaaagctaattctatataccactttaaatgatgttacacgtaaatgatccagaattactaattttagaaattgtaaagggttacgtacaaaaccttcaaattcaccttctaccaacaaatgaattataagagtctccaatcttgtatgatccgaccgtatgactcgtgaacatagtcggagaggataaaacgaggtgatctagaagcattttttcagtgtggctgcccttggagatgacattatatgcttaatcatctaaccatgctataaacttgttttttttttgcttttgcttttatttctcaaaatatactccctccattccaaattaatctgcatatatatttttttaagttattcctaaatgatctacatatttgcgttcattcattaggactattcgttatttgtacattggagtaaatagatattgatgcatgcatccatgcacacaagcatttataacccacatgcaatatcttgatttgctattggctagaaaatagtggggatggtgtatgcattgagtttgttgctagagtaaatatagtatgagagagttattagcttttcttggtcttggtatacctatgaaatatgcagatagggagtatgttgcaacacacaggttttagctagttttttgaaaaaaaaaatgttggagtgtgtgtcatttcacataaatttcatttatcaagttaatttataatagatgatagctgggttagaatatgtattttttaccaactacttgtcgtaagttacagttaaaatagttaagctgtttagaaagatgcgaagatttgttcgtgattttcaaatatagtggttttctcattgttgttagaatataatatactccctctgtgtcaagataaatcaacttttgtcctaaatctagacattaacgtagagagttaatttatttttttatgggagtatcattttttattacacaaaagacgcacactactcccacatccacgagtgtgtctcctaaaacacgctcaaatttagccgcggccgtagcaccactataacccatttgttgcttcattttgcgtgtaaagggagggttcccaacccttccaaaacaacacagcccgtataactcagccaacccaacagtcacagaaatgtgaaacctcttcctctccacaaaggatcccgatctcaaggggtcagccatgatgcatcaatgttcactggacacccccaagcttgtgtttgtgtacgttccttccttgagtgacttttcctgcttccgtagagccgttttccagcgtcaacccatgctcggaatctcggattctcgctcggctacgaccactccccatcccggagaccgcccgtctcaaccaccccaccctctcatcgattccatcctttctacggcggtggcggcggcggcggcgcgcggcgctgcgaacggtgagcgtcaggcattcgtcgtcttgaccatgaaacttgaaagacctcgtggttgtactctggcagaggcgtcgtcagacgtgtcatcgtcaagtggctataaaaactaacactacttaagtttgaggtcaaatagattcagagccacacgtttcttaaggatcaaggagtttgatttagcaaaacaaaaaataagattaagcaaagttatacaagtaacacaaacttgcagggtatggataagatagtagccctactggtagtattctaggagtactgctggtagcagcttgtttgttcgtgcatggcacctttggtggtttttttttggccatttgctaaggttcactgaaagggcagattcattgaacgtggaccccctcgttaggtgccgaggaagccgtccagattcactgtacccagcagcgggcctctcatgggccttgtccatcaatctgggccgagagccaattcaggccggaacacaacaagagcagtagtagaaaagtaataagttcaggttaggtcccttgaattatcaccgagttcgactttggtcctcgaaccacaataccacgtacaacaacgagggggcagtccctcaacttgcaaaacctgtacccgagattctaaacagtatagtgtccagttttaactaacatgactaggtgggtctcacatgtcaggcatatttctcgtcctctccaacctcctgccattgctaactaaaattataaatctctcctttttagttttagtagagttgttggtattttttggatgtatccatcctaatcaacaagcaggaggtctcttctctgatttaatttgctagcccatcagatatggggtgcttcgcgttcaagagcggcaacaggagcaaaggccaagaacgcgcggacgccggtggcggcggccgcgtcgtcctcgcgcgccgtcaagcgccttaaccagcgcagcctgcaggtcagtatggttttgcatttactcctctcaaaaaattgccatggtgcttttgatttgagctagatttgtcaaaaccataccgaatttgttcatcagaatgatcgaattacaggcgatacttcggcaaaaaatgaacttgcagattttgtcttttgagcctgtgcactgaccacatgtctgcatattttcagagtaccaaaaagaaataggcctaatatgtggggctcactcgtcacataagctaaaaccaagcattatactgtttgggatctcggctacaacagttttataagttgagagacacgttatatctggcattgtgtttgggggatgaaattcgaactcaacaactagataaaggacgtaaagtgaacttattccagtggaaaacgagatgaaacaaagagacgagaatttgttttattttcctccagatcgacgaacaaacaaccgaaacgaattccaattggtaaatcaaatagctcaagcaacaatgagctttatcccctccccctcactcaacaatggcaacggtggtcaagcatgtacagtacatcaattcaccaatcactctgaaactgaaaatcgcacagagagctagcttagcttagctagaaccattagctcactcagtacttcttccgcttgaggaagttggcgatccagtagctggactgcttgtggtagcgcttgagattgttgaggcggtcgatgtagatgaggccgaatcggtcgaggtatccgtcgccccactcgaagcagtccatgaacgtccaggtgaagtagcccttcacgttcaccccgttcttgatggcgtggttgacgaactgcaggtgtttcgagtggaactcgatcctatgcccgtccttgagcgcctccgtgattggcaagctcttgttgttcccctcggcgattcctgcaatcacacatgaaagtcatcttgcaggatgtcgatcccctcgttttttttttcatttccatgttatccaaatagttgtgaaaaagttttggagaaaaaaaatgagaatgtagttcaaatgtatcagcccacaaaacatgcaacttcaagttcaaattaatctatataaagagtgtactacttatctatactcctttaaaagaccctaatgataatggtgagtggtgaatctgccaccacccaccaccactaccatatgggtcccctaaatactgagataggtggacttttatcccttccttggccagaagccatcaaacaaggaaaacttattttaaagtgagatacaaaattatgaaaaacataatgtggaatgatttataatggggataattttattttaatatttgtggttttaaagccgtatattaattcctgttgcaatgcacaagcattcagctagtatatcaaaaagaagttaaagccattacaatgagaaagttatttaattgggaagtgcggcggtataaatcctaatgctcatgaatattatgcatacatgagtacattttcaataggaatttagtggagcttaggataagctattagtccctgtctatttgagcgtatgctagaagtgtgcgtactcgtgggtgagtgtagtgcacgtatttatctcgtgtgtaatgaaaacaaagatggttatttaattaccattttctgtgacgtagatgatcgggttgttgtacctcctcttggtgtagaggagt

SEQ ID NO: 61658 - DNA, 5584 bp, Oryza sativa
ccccgagccaccccctcatcgtgcctgggtagtcgccgtgcacgatggggtccaggaaccatccgtacatgaagtcgaggctgcgttgcacaacgcggcggtcagcggccgtgtcattatacggcacgaaccagtgcgacaccgccgtgatgccgatctgcccgtgctgcgtgggttggtacttggtgcggtagaggtggacggcggtggcatgggcgaggatgacgtggtgcgctgctaggtaaggctcgcggctggagtcgccgccggcacaggaggtggagacgtagggggagcaccggcccaaggcgtggatgccggtgccgtagccctgggagcagtaggtccatggctcgttgaaggtggcccagaacttgacacggtcgccgaactcccggaagcacacttcggcgaagtccacataatccttgctgaaaatattgacaatccaaatctctaatatgagtatttttttaagataatggtaatggtttacatctccggtgtctttcgacaggcacacagccaaatttgcataatcgacaaattttaatgtgagtcattgatgaattctagccaaatttgcagaaccgacaagcaatttattttgattcagatgaccaaattacctaccctgttctatctaactggtttttcttttgaaacttaggtgaatggcctaactttaatcaacctcatcatcagcttaacaagttgagtgattttaacaggtttatggattttctttgtctctatctaaaaaacttacatgatattctcactcaggaatcctccgtatttgctctcaagggcctgtggtgtgtcccagtggaagattgtgacaaatggcttcatccctgttatgaaaattttgtaattaattcaaagtttactacttaaaaataccaaaaaaatatttataattttgtagtaacagtaacacatgattgtaaataggacataactgaaaaaatttactcacctttggctatgatttcattgatcaggttgttatagaaagctactccttccttgttcacccctccactcaatgttccatctgcattcaacaggcatttacaaaggaaaatttcacggtcaaaaaactgaaatgcaactgaatgcgctgatacgatctaggaaatataatgcccattctcaaatacttcctctgatcataattatttgacgttctggacagccatatactaagttcaagtcatcttaactgtctaaaacgtcaactaattcagtccggagatggtagaattaacttcactcacttggcaggatccggctccaagaaatggaaaaccggaaggcgtccatgttcatgtctttgagaaggtttacatcctcctgcattttcaaggttcaacaaaagaaatgaatgatcagttcaagaagattcctgtccaagataaactttttattcggtccatcaagtcatgaaaacatttattttttgacatacaacaagtcaaagattaaaaccttgagttaatatctttttaaataattagactgacacatggaaatcatatgggtaaaatctcatagtaaaatcaggtttttataatgtgctcacttcggtcaaatttatttgacgttgggagaactgagtttagttcttccaatgtcaaatattttttttactagaggctggagtatactataacaaaaattagtcattaaaattgcattccaaagactgcgattttttggggaaattactgtagaaaaggcttctacagtgtgtaaatatatattccaaagactgcgttaataccgaacaatgtgtttccttgaatgcatttcaagagcaagaactcctgctttacttaaaagaaaaactagaatctaccttgtagcgatgatagaagtcatctgccacatcgccggtgtcaccatttaagatttttcctgcaggcatgaaaatagtttcccttaatcacctattttaaattttacatgccagctatatatataatagtgggaggttaacacttaataataataataacctgggatgtgcgagaaagtgtcccacacgctaggacgctaggacccctacctccttccttagcagctccctcatactgcaagtaattaagcaatgcaaggatacatctctgaatttgttcaggaactaaccaagaaccatgtgcattgcacttgattcaaaccattcttgcagatgtaagagttttggacaaatttatctctgtatggatcacctgatacgctgcagagccggtgccgaagatgaaatccttggggaagctgtacctgttgaacgatgcatcaacaccgctgcagagtacagcaacgaaaacaagaacaggaacaatctgccttcccattccgattccgagccaggccatctcgaaactggaactgatcaagccaagcagcttagctgggcagtggctctgcaggaagcataattcagaagggtatttatagagaagagttggcgatgcagataaacggatcagatcataggccagcagatgtgttggcgttgcttccctgattggcaattctcactattccgagatcgagttcctcaagactttcgagaagagatatcgtattatatttgattttaaccggttgaatttgtcatctacagtagcaagaagacgttgaaattgatttgtttagttcagcatgaggggcacgagagggcaactgctcaaggcttgagacatgtaagtacagtttttttttatatatatagaatgtatatatgatagcggctgatttcgttctcattcttctgaagaggacgcaccacctataatttttattaaaagtttttgtgattggtccaattggtgtttaaatatataatgtccgttgcattaaaagctttagtggttttaccaacttacccacaacaatcgcttattggttttacctggaaatgttttttcaacaccgcaattaattctcttcacatgtaatggcgtgccgttggttacaactgacctctgtacttgtaaacctcttcaaatggcaatggaaatttagttgggaaacctctcccctctggtctctggtgattattaaaaaaaaatagttgtattgattataatataagtacaccctatacttatattataatcaatacaactattcctttttttatatctcacttggatactaataatatacctcctatgtggattaagggagagacatttgatccttacacgtaaggtaatgatataaaaccgacatcacagtcgtcatctatatacaaacatggaaaacactataagatcaagattcattctagataagtcatttaaaggcacgatatttttgataaattttcatgaggtggatttattgcgcgcatgttcgcgctcgaaatcgctaatagacgatcagtcgcgcggggcgtgcgactggacacgtgtcatgcgtggagaggggggcgtgggcggcgtgcagtttctttccttttttttttgtttttttcgcacggtttctaggcggcacgcggtttcttttttttttctctttttatacgcgcggtttctttttttttttttcttttcttctttcagtatcgttactttttttttggcgcatggctttttttctgtttttttttctttccgtatttttttgtttttcggtttttttaatacaaacatatacaaattttgtatatgcgtatataaattttgtatacgtatacaaaatttgtatacgtgtatataaacttcgtatatgtgtacttttttatatatagatgtacaaactttgtatatatatacgtatataaagttggtatattttgtatgcatacatatataaactttatatacatcgtatacaaactttgtatatgccatatacatacattatacatgtgtatatacatattagaatatctacttatatatactacttaaaaagtttaagatgtttccttcctctgttaataaattttttttaaaaaagtccgattgtaattaaaaaaagcccggggcgaaaaaaaaagtgcggcaaaaaaaaactgaccgattcctatccttacttaaaaaagcggaacaaaaaggtgcggcaaaaaacgattgtaaaaaggaagcccggcacggccaaaaaaaaaatttgtccgtttcctttttttttccttttccaattttattttattttcaccgcttttttctttcaccgtttttccgggctttttcgtccgttttctttttttttcgttttattttctttgcgccgttttttctttcaccgtttttctggtttcgctattttttttctgtttttccattgggccgaatcctagcgccgccaccatatcgatttgcatttttatgtgtttcctcatccaattgattgcaaaaaccgattctccactactctcttatcattttccccttgaatttctcttccagttcgtcattttttttccaagttttacggattgctttgattttggtaaaaaacgaaaaagggaatcgagtggatcaaaatctctcaacaattttggagatcgagaaagattcgaccgcatttgacggagaggatcgactccaccatcgtacagacacggtactatgcgagctcgaccagattaccggatttgatgggtggatcggctccgtcatggtacgggcacgagttgacggagaggatctaatccaccatcgtacggacacggtactatgcgaactcgaccatattactggatttgatgggtggattggctccgtcatggcaccgggcatgagactgttcgagctaggcctactattgcacttgtgggctaagccgaatagaggtaggccaggcacaggactgttcgagctagggctacagctccacttgtgggctgatcccaaaagagataggccgaccatatcgcacatctgtgctactgttggactaacatcttgagatgaaggaaggaatgaatgtccggtccaaaaacaaagaagcatccggtccaaacccaagggagtataatgtatcggcttgtttggtaactcaagggaaggggattgggagtttacacgagggaattgatgatgagattaagatgggaatttgatttttaatctcaatatcttgtttggtagaggtgatggaaattgatagggagtttagttggagattagttcattaataaaaacggatggctgagattcgcttagacaaactaaaggaggaattcccttccaattaccttcccctacccaggtattgaaaaggagggagttccttactcaattccccatcccaccaaaattctcatatctcccaaccaaataaaacacttaatagcctcatccctctaaactctcaatccctcataaaaactccttccaactaaacgagccatataggataaaaaaatgtttttacccgtagcaacgcacggatattttttcgtgtgtgtgtctatatatatatatatatatacacacacacatatgtataaactttatatataaagtttaggaataaagtacgatttaccccccaaacttttgcgacagtacgaattatccccccgaaccacaaaaccggttatattacacctcaaaactat

SEQ ID NO: 61659 - DNA, 1395 bp, Oryza sativa
attggatttccatgtcgacgccacgtgtatgtcacgtaggagcaaaaccgctcattattgagtcggggggggggggtaattcaaccgatatcaatagattgaggtgtaatataaccggttttgtggttcgggggtaattcgtactgtcgcaatagttcgggaggttcctaaagtttatgcatacgtatgtatatacatgtagtatatgaaagagactataggatcagaaactgaccgcgcggctgatctcacattagggcgcccgttcgcgctcctctagtcagcgtgcaacatgacaaaaattaacctacgtgcggccgaagacacgtgttcagcccatgaagcattatagcccacgtactatcctttcctcgttcagcccacaaccgcatgtgcccaaatatatgcttgcatttggactgttgagtctactagttttcaagctcagtaagcaatgtgttgaaaaaatatataaaaactttatatatgtactccctctatttcataatgtaagtcattctaacatttcctacattaacatcaatatatctagattcattaatattaatataaatatgagaaatgttagaatgatttacattatgaagcagaggaactaaaacttatatgtgaaaatttataaatatatattttgtggggacaaactttatacacaaaaaaagtttaaacatatagaaagggtctacacataaactttacatatatatataaaacatattcaaatttgttttcgcaaataaataaataaaataaaacaaacatgtgggccatctgtcttcatcgtattcccacaccacattagatttggcatgctctcgcaaaggaaagaaattaagatgagctaagcacgaaaagaaaatgcatgcagggaaaaaaaaggtggatgagcgatgccagtcctttagccttgtcgagttccacggtacgacaagaatgtctctctctaaatctaacttagttatagtgtattatagtatcatcgaccttaagttggttatacttaccagccgcttacaccgatcgcttgttctacctgttccgctatacggtacttcctccgtttcacaatataagattttatattattgtctatatttattagatgttaatgaatctagacatatgtatgtgtttagattcattaacatatatatatatatatatagagtactataaagttttacattgtgaaacagagagtacatcctaagtatatctcagtcctagtaatcaactccattcatgtctatatctatctatgtatcatatatacttgaaccaaaatctcaacatacgtttaccacaacaccaaaaaaatcttgatcattggatcatcttggtaaagggctaggagaagatctcagctgatatgaa

SEQ ID NO: 61660 - DNA, 4280 bp, Oryza sativa
ttatccaaatcataattcgattgcaccattaaattcattgcaattaaatcttcaaaacaagaccacacatggataaattccgacgaaaaaatagcttattattgaattatttttaaatgttgcatgatgttccaccaggtatatcggaattgtttcactaactagatcgaaatgtttcactcgtttaaattgagtgttgtttcaccttatataaaaataatgtttcaacaaatagcgaaagaatatttcagttcactgcaacattaaatctatacatagtgaaacattgtgagtacattaggtgaaatattttttggtggaacaaaaaataaaccaaattcccttaatagggggtttccaaaatatgtgggttttttgttgcaatggaatgtctcgttcactgcaacattagatctatacatagtgaaacattgtgagtacactaggtgaaacatctttcggtggaacaacaaataaaccaaattcccttgatagagggtttacaaaatatgtggattttttgttacaatagattatttcagttcactgcaacattagatctatacatagtgaaacattataagtacacttggtgaaacatcttttgtgtaacaaagggagggataagtgggtgggtccagatggggacaagggagcgcgcgcatgggggagggggagcgaccgatttttcccacctcccccggtcgcccgattttaatcaatttccctttttctttagcttgcatatcttttcaaattcacttatgtgcccgctgcaactcacgtggtatcacctactatccaaagcaaactctaaccgaatgaggaatcgaatcaatcctaacctagtcacgacaggaaccaaccaacgtacgtaggctggagtttctcagatctatcaagaacactgtacgttgcgtggcattggtacgataaagcagcgattctaacaacaattgactgttctgcaataatcgattcatgattatactagatcgcaatatcttcctcctgttttgttttcaattatccggcccccagcttgtaagatatcagcagacagcaagttcagcacactgcacaccgacgccgacaccacattagggaatgcaggaacacatgggtttactggcgtgcagcaaactgaaacgcggctcatcgctcaccccttccatcgatctgtcggcgcaaacccacattaaacttacccagttacattgctggggaagagagctttactcccggttagtaatctttcagggaaccggaacatctaatcatggactaaagatgcatagcaagtcagaaaaatctgtgggtgtgggatttaaactcaagatttctcacctcattccttacgcacgttaccatcccacctactacacatatttgactttgatagagatgatttttttaaactaaccttggaaacgtttttagtctagattggtgacaccaattgggactaaaaatatatttagtccgactaaatattaatttttaaactaaccctggagacatcttcagtctgggttggtaacaccaattgggactaaaaatatctttagtttgacaccaaccagaactaaagatcaatatttagtccgtgttaatgcatctttagtccggaatagtaacaccaaccgggattaaagatcattaggggcctgacaaggcctaacagctattgatctgtggctaaaagtgatttttagtcccaattggtaatgccattgggcttttgaattggggctaaagatattctttagtacggatccaattagaaccgggacaaatgtggtttttgccatccgagtaaagatcagtttttcattaatgttagttcttccctccatttcatattataagttattttaacttttttaaagctaaattttaggtttatcaaacttataggaaaatctgacatctacaatataatatgaaattagttttattaaaaataattaaatatattttaataatatgtttgtttagtgttagaaatgttgctatatttttctatatatttaattaatttcttttaaaaaaataataattttttcctgaatttttcattgataggtgaaaatatgggagttacagagcctgaggaacggtagcatcgtgcctttacattgatttagagttagtagggctagagaaagcttgtttgcaagcagagatcacaaagcgttccgagttcttaattctttccgcctagatggttgcttcatccatgcagcggcgaagcagtcggtgaaggcacgggggttcattcctgaagacaatatcgtgtcggtgatcagaacaaattcaaagaaacttataatacaaaatagatagtaacacgttatgtactttccccatcccataaaaataaacatgattcatagtacaaactacaaagagtactccactccctccatactcgtaaaggaagtcgtttaggacaatgtttaagtcaaatcttgaaaatataaatcatgaataactctctagttgttgggtttaaaaatatttgttgggtttaaaaatataaaaattatatgaatagatttgtcttgaaaaatactttcataaaacaagaagtcaaaattgtattttgaagactgtgtcgccgtgctaaacgacttcctttatgagtacggagggagtatatcgttatctcgttctcgatttaagcctgtttagttggcaaaagaatttatccctacatgtcacatcagatatacggacacacatttaaagtattaaacgtagtctaataacaaaataaaattacagattccgacaggaaaccgcgagacgaatttattaagcctaattaatctaccattagcaaatgtttactgtagcaccataatatcaaatcatggtgtaattaggcttaaaaaatttgtctcgtaatttcctggcgaattgtgtaattaatctttttttctccatttaatactttatttatgtgtccaaacattcaatgtgacggcgtaaaataatttggtttaagaactaaacagacccttattttttaggcaaaatttgctataggacatccaaaaaaacgtgtaattagccagtggacaccgtaagatcacgaatttactgtagggcaccaccaaaaagtgataattagctagtagacactcaagacattattttattatttttaaaggaaaagaggtgagagaatttttgaattgccgagaatgccctggtggcgcatcacgttatcccgactaggtccggtcgagccgacccggctgcaatacagctgcgcccacgccctccttgccgccggcgcgtcgtgaacaccatcacccgctcctcgtctcagcgcgcggaggtcgtcgctgccggcgtgggagagatcgatgtcgtagcccaagaaccgcgccgacgcccacctcggcatcccggtgctcccgtccatatggccggcctcggaacaggctaccatgctccagttgcacgggccgccgtcactgacgccgaaaccagcgttccagtcagcgaggacgttggccgtgtcatgcggtgctgccttgacggccagcaacgcctccgctgcaaggcgcacgcgaatgcagcaagaaaaaccgggtgagtgcagcaagaagtgaaaattttcatttgcaaatttgaaatatatcaagaaaagattgatatatttggaagaacttttatcatcatgattcaagcaagaaagaatggtatgagctaagaaaccaatcaaagatgaaacaagatgagaagacacggcttgcgatcaaagaatttttttattttctttttttcgtgttcagcaccttcgccggcggcggctggggaagaaagaacctccggcggcgtgggcgccacaccggcagaggacaagtcggacaccacgaggctcaaaaccagcacggcgagcaagtaagcagcagaagcagcaactctctgctcgtccatggcgtcagcgtcggcgtcatgcgtgctctcgttcgtcggtgactcggtgtcgtcgcgtccacgccgagagagcgctatagcccaaagcgaaccgctcgtgcgatgcgaggagaaaaaggagacgagacgctcgcgatcgaacactacccgctactggacgcgacatgaagcggaagcgagagctacaaccgcagtgacgatggcgagacgcggttgacgccatcgcgggctggccacttgtcgcgccgccgctctggccacgccgctcggggcgaccgactgggtctggctcgaccggaccgatcgggataacgtggtgcgccaccggg

SEQ ID NO: 61661 - DNA, 8154 bp, Oryza sativa
cgcgcgcgcgagagcgaacaacttgttggcgcgcagagccaaaaccgccggaccggagaacgtctgcaactttccgttggcacacatggcatgcagcaaaggcaagcagcgcggcactcatcggtcatcgctcgtcagtggcttttttttccctcgattgagatatagattttacatcggtttttggtttaacacgtttttttaaatggttaaacggtgtgtttcgtgcaaaaactttttatataaaaattacttagaatatcaaataaatttattttttaagtttataataattaaaaaccaaaattggataagacacatttaaatccaacgaatctagatagacatacttatgatcagattctttgaaataggatgtatgtcctgtgcagtgctagattgctatattttaaaatggatggagtaattaactatggatgtgtttggagtatggatgtgtttggaggagatagttgtggctgcacagcgcaacagctacaaattgtgcagtaaattttatgctacttgtattgttaatacagctggctcagcccaacatctgtaatatacagcacaaacgaacacacctatatgttaaatggttttttctattttacttgctctaaccttattatcttttatcttcgttaggaaaaaaaaaaacatcaccgtagttgtgtgagatatcgagtattctgtttagctagcagagtatatagcatcaattattcaaagatgattggaggagggttcagttgatctcatcaatgacgatattaattaagcctgaaccagcccaacactgctcgacagggagcattattgtttcttcttattattgtccggctcaatgggatcagccagcaatgatgcacaggtactgaggtacacattcaatagtaatgcagcataattcatcacgccatcatatcggtcatcaccactgatgcacaaatcacaaattaaccagctgaaagctagactgacgaaacacaaatctggtggccagccgatcgatctcgtgatcaatccgaaattttgtggggctggatcagtgcctcttgaggaagtcttcgatccagtagctggactccttgcggtagcgcttgagcgtcttgcggtcgacgtagatgaggccgaacctgtcaaggtagccgtcaccccactcaaagcagtccatgaatgtccacgtgaagtagcccttcacgttcaccccattcttgatggcgtggttgacgaactgcaggtgctttgagtggaactcgatcctgtgtccatccttgagcgcctctggcagtgtgctgttgttaccctcatcgatgcctgtacacattgcacacaaattttacgcctttcgatgttcgcgaacgatttagtatatatacatgttaattgagttaattgaggatatggttcttttcgatcaacctatatttaagtttaattttggatgaattttgtaggaccagtgttgaaagattatatgttcttaccgttttctgtaacatagatggtcgggttgttgtatctcctcttggtgtagaggaggagctcacggagacctggagggtagttgaagaagatcggtgtaaattcctagacatgacaaggattcgcgtacgttgaattcctcagtaaaatggatggatcgatgtgggtatatgtgtacacgtagtcacgtacgcacctgtggaccgatgggtttgccattacggaagccggtggtgttggcgcggttgtcgaggtcgtaggatagctcgttggagttaggcggcggtatactcttagcgtagtaggtggtgtagtaattaactccgatgaagtcgtaggagcccttcaccatcgccgactgttcaggcgtgaactctggcagccgattgccgagccaacctctcatggtgcctgggtagtcaccatgcacgatagggtccatgaaccacccatagatgaagtctaggctccgttgcacagcgccacggtcagcgtcggagttgtcgtacggcacgaaccagtgggtgaccaccaccatgccgatctgtcccttctgtgttggctggtacttggtgcggtaaagctggacagcggcagcgtgggagaggtggatgtggtgtgccacgaggtagggctcgcgactggagtcaccgacgccgcatgacttggaaacatatgaagagcatcgtcccggcgcaaacacgcccttgccgtagccgtaggcgctatatgtgaatggctcattaaatgtggtccagtacttgacacggtcgccgaactcgcgaaagcacacctccgcgaagtccacgtattctttcctgcacatgttgagcaagggtgttttaaagtggtattttctaatattaaaatcaattgaaagatagtttatatttttctaatataatgggtcatatctatttataatattatctctaatgatggtataataataatattacctatttataatatcatctcaactattgatatataataataatattttctattagtattagaactaaatgaaaatcaacggttgagatcacttgtattggtggtgataatactgatagtaagaatagtaaaatactatcagtagatactatcatccttgagaatgtatcgtgaggtgctatattttctagcgtaaaatttggtatctcaaggtattttcttaaggaccataaaatttctctaaatagtattgtaaaatcactcgggaattaaaggttttttctcgagagattgcaagaatgtttgtgaaagtacagtaagcaagaaagaacttacactatgtcttcactgaggaatcctccgtatttgctttccatgcccaagggggtgtcccagtggaagatagtgacaaatgggatcatccctatgtgatacagaaatgttgtcaaaattagttcatatttttttgcgtttttggaataaaagttagtgatcaccttttgctatgacatcattgatcaagctgttgtagaaagcaaccccttctttgtttattcctccactcaaggatccatctgcagtaattacaatttgcacgcagtggctatgtgattaacatcaagctttggaactcacatgtctgcgtttatattgtgtttcgcaaaacaaaaaaaaaaaggggagaaaattttgagactcacttggcaggatcctggtccacgcaatggagaaccggaaagcatccatgttcatgtccttcaggaggctcacatcctcctgaaatttgatcggatttgtcaaaacatgacccgtttcagagaattcagacactcgatgttaatcatcgtcagtcagtcaaaatggaaggtcaccttgtatcggtgatagaagtcatttgccacatcgccgttatcattgtttaaaattttacctgcagtcatatggattgttaatttctgtctgtcagataaaccggaagaattaattacaagctttgtgatgcacttcctcacgaattaacctggaatgtgagtgaagttgtcccagacgctaggacctttgcccccttctttgtaggcgccctcatactgcaagtaatcaaaaccaatcccaggataaactgatgagtatccagctacaaattacatcactatataacataaacatggctagttgagcagtgacacaactgatattgagcttcagaattccaacatgtcatatgtacctgataagctgctgaacctgtgccgaagatgaagtccttggggaagctgtaccgggtaaacttggcgtaaacgccattgcagaacagagctcccaagaacaaggtgaagaggagtcgccttcccattctgatccccattccagcgagagatggggttcagaatgagctagctgaattgcctccagtagctgcagctctaacgggtatttatagagtgatgaacgggaggggtagtagtggagtactcccgatgtttaggacagcgacacggtcttcaaaacacaactttaactctttatttctataaaaatatttattgaaaagtgatatatgtatacttttatgaaagtatttttcaagacaaatacattcatataatttttacattttcaaactcaagaaattaagagctatttatgatttatattttcaaggtttgacttaaacattatactaaacgactcctttagtatggagggagtactaaggaccatactgcgtgctggcaggagacactccatcaattcagtgtagtgttttctctgcagacatggtaagctggcgtaattaggatctcacttcatcacaatagcgatcgatgaggaagaagatggaacaggcgctgccgaaatccacacgaggaattgtttattaaacacatgaggcgcgtgctaacatgtctctatctaatataaattctactgaataatgcaataagggcatgaacttacaaaatgctccctttttttctcaaaacacaattcaaacatagaagcatatacatcagaccgacatgtattgagattgacgaaatcaccatggtcatatcattatcgatgtgtgtgtcgcctaccactatgacttgaacccgagttgactggttccaaaaaaaaaagtctaataagttaaactacacttaatttgtggtgcgtgtaaaccaagaccatacaacacatctaggatgggaatggggcttgtttcccgattctccacgggaaattctccattagagatgaggatgaaagaatggagatggttacgagtaatcaaatggaggaaaacacgtccgtgttgggtctggcggtggcgggacggggatgatcctccatccccccgttcctgtggagatacaattaacaggcataggagtctaaatccaatgcaaatcctatatatctataaagttcatcccactaaatatagttaatgatatttctcttttctctcgttaagtcacatggtctcaattatttctaattcttaaatgattgatctacggtttaaattatctctatttttttaaaaaacaaaaacaatgaaattgttgacggcaatgctctagagttagtacataggtgatgtataggtgatgtattgtacatgctaagtaggtggataaattaaatggtagaatattgtaattgtttaatatgacgagataagttgagcagctatattttaaggcaaagttaaatactagaagtagttatattttcaaacacggaaagagtagtactatatatatttcctacttactcggttttaaatataactagaattcaaaaattattttacaatataatgatttattcatctattctcacattttagttgatcagaaccatattttatttaatttcttcttatactttgtttgaattttttcccatttaattctacatattctcttaatatctatgactaatttcgaaggttgttatattttaaaacagaataagtaggattgtagtataatttgattcagtattactttgttacaattctcaatacctttgcaccagaaaaacactttaatttattttatcgattactgaaaatacctcaaatcaaacgatacatttttttctttcaattaaacggtagcatagccgtgcacaatcacgtggaaattagcacttaagaggagccaacgtttgctctcaaggactaaaaactaccacgtgaattgggaaagaaaaaaaaagatagaaaatttctgcactgttatctgaaatttaagcttagcacctagcagaagacatgatattcgtatttatctattacatcactaaaacaaaggctaaaatgagccccatgtttatactcaggaagctgtcaattacgaccttatttaaatggttcctatatatttgcgctgctgactttatccagttagtttgtaattttgaccactatttgctttactaggatataatgataatatcttaaaaagtaatatacctaaacgatttttatgctttcaaactaaatatattattagaaagcttcaaagttttaagagtttaaccgaataaaaataaattatatatttaacaacggagggagtgctgtagtcaccaaaaatctaaactgttaattgtgtatagcagtataagttgtattagagtattgttataaccgtattataaacccaaatgtgttttaataaataaaaaatataggacttgtctatcaaacataattgtattgatctctattgctcgataaacatcgtggtcgaaaatttattatctattgccagataaacatcaagtcggatttgtattgatctcttaattgtcctcctgaagaatgccctctacctaatccggttgtccatcagaaactgatactctgaactcatatttgtcgaaaccatcgatcgttagcgtattttcggcaataattaattggctagctcattgcaacgtggaaactgtaaagtaccaatgcagtaactgttgcactgaaatataagggatatttgatttggatatcatagaggtggaggttcagatgtgcacttcagagaccgactgatgtatatatgcaactacggaattacttttttttttaagagaagggttttttttttacccggtctttatatccaaccggatatatgcagtatttttttagcatttttttaaaatatgaacttagcctatagaacagggaactagccctcaaataacccaatctaaaattcgctcctatggagatttgaactcaggaccttagggtgctactcaggtcactgcaaccactaggctacatgcactttcacactacgaaattacttaagggttaaggcaccactaggctacatgcactttcacactacgaaattacttaagggttaaggctgtgtttgttccaagtacaagcatgagaaaaacccgtcgtttttaacacgtgtgttgagttgtgatttgaattcatttacacataataaaagacagcttctgccggagcaaagcggaggcccgtagatgcccgatgtgttctttacaaaaaaaatcctatataaaaattgttttaaaaatcatattgattatttttaaatttaaaataattcatactaagttattaatcatatgttaattatccacctcattttacctatcttaatcttcttctttcccctccgttcaaactaatctatctaaaatatatcgaatgttgtataactacacactacatgcaaaggaccacaaattgcatttctgttcaacatactacgtttttttccctaaaaaagagaaggggaccaaattgttttgcttttagagcctgctggttttgtaagttgcattaatcctgatttttggagttcattttataattgttgcatgtttttttagtcgttttcatcgctcggtcttgacttttggatcactattaacgaccaaatttggcaatatcagcatcggaaaaggagattagatcaaggtggagtcgaaggcgaagattgatccgagaatagagcaagaatcggctgaagtccagatcggctacgattaagatcggctgggtctaagtcggactaagtgagccgatgtagccgattctaacagtataatttggtgtttgacattgggttgaattgaggtgcttcaagatgattgccgcacatggatagagtcttgagaaggcaattgtatctattaattaggatgttttatgtaacttccttagagatatgtttgggcaaaagtctgccgcaaagacttatggtatcttagagtttgttagagatagtggtcgtgtccggtatggacatatcttataattctcgggtataaatagaccccgagccctatgtaattttgaacacacacgttcaatacaatctcggcgcatcgccacctttttgctttagttttgtttcgacgagttcttgctttcgggttgagctgcatcggtttcgatcttcaacaagaggtaaaacttgttatgacgacttgtgttctcgtgattagcgcttccatctttatgacactctaatcttgtctatataattcgtcaagttatcatatatcttacataatccttggcaatatcgtcatctaatctataatcggctaacatctgttaatagaaggcagccgattaggttaaatagcgacgttgtcctagatcatataagatatctaccactttatgaaacgcccaacggcttgattgtctaaatattg

SEQ ID NO: 61662 - DNA, 2595 bp, Oryza sativa
atctcccaggcctcatgttttctgtcaacaatcacctataatataagtgtactagtactaacccaaaattaatttttattgcatcgatcatgtatcttccgtgtataagcaatggtcatgaggaattcctatcaaatgggcctaatttctcccttccaaaagtcaactcaagtacagaatattttttgaatagctaagtactactacatcacttatatttaatgaatcacttatattaatttgatggtctctaccatgattatattcctttgatcattctttaaccttgctctgattgctttgatgccttgacttcagattctaagaacctaaccaaatccagccattgactaatttaggagcaaaacagcataaactctagtgatcaaagatgactagatgaggacctcaaatgacgtataaactctagtgcctggatggttgattttcggcccgaaaccaatgtaatcttccgggtttattgagcccaactacgaaaattctactgccttctttttaaagtatatatgacgctatttttcgtataacatttaaccatttattttatgtaaaaatttaatataaatatataaaagaataagttaaaattatattttatttaaagataaaacaaatcacaacaaaataaatgatgcttattttcttgtaagatgcatgataaaacgttatgtcaaaaaatcaacgataccgcacatttaaaatggaaggagtaatacagtattttctccgcacgagtactatctcgatcctgcctcccagtccctagcattgatccgctcaaccagtctctgttcatcgtcaatgtccttggctagtgctctttcggcgtcgatccgcgcggccagtcaatggcgagcaagagccagcaaacaattcatcttcctcaaggaggtcaagaattccctctttcccctccgattatctccctctgttaccgttcaaacaaccttgcaagcagataggaaaacatgtgtaatggttttacaggggaaaagaaatacaaatttcccaagcaaggctcttagtattaagcagtaaccatgcgctgtcacaccatcctattacctccatcccataattaaaaggattttgtgtgtgtatctcacacatggaccctatgatttttattatttttcagattgaattgccacataagcatcacattaatgacacgtgggataaagactttcaaaggagccacttcaaccaaaaccagagaaaatattataaatctcgtttgcactgattttataagtttgaggatacgttgtatctggttatgtggtctcgggatgcatttcggactcaacaaaaaatgggggacctagtgaacttgttcttattgagtaggaataagttcatctgaggtcccttaattttacgcaaatccgattttcatccttaaaccctaaaaccagatataaccggtccctaaactatcaaaaccggtgtaaatgagatccctcggcggttttgaaggcggttttggctgacgtggcgtctacgtggctggtggctggtttgactaggtctccgtcccacatgatattgacgtggcgcttacgtggcaattatatctaaaaaaataataaaaaccatgggcccacctgtcagctaaaaataataattttaaaatagcgtggcccacgtgggccccacatgtcattccctctcccctctcagctctccctcttcctcatcaagccatctcctcgcgccgcggcaccgcctcacagccggcaggagcatgccgacgaagcggagaagcggcggcggcggcggcggcaggccgcggggtcggtgcctactcccgcgccgccacatcatgttagatgctgcacagcggtgaggaggagaggcggagttcgagctcagtacagcgaggattagtgtacagatcgagctaaacagccaacaggattagtggcaggcaccaacaagcagttgctgctgctgctgctcgagacatgcatgagctcgtgttcactacagtgaggccggccatctgcaagactgcaaccatgtcagatttggcacggagacgaaaaacacacatgttagtgacccaagttgttgtcgtcgtccatgctcgccaaggccgccgccattgccgccggtgtcaatgactgcccgactgaccgtctgtcttcaactcgttcttctcgttggcagagagagaagctgggagagagggggacagaggaggaggtacagccgcatcacctcgctgatggtcgcgtgcagccgtgcaggtagtgcatccgcttcagctcgtcgtatccgtcgcagtcgccgtcttctccggcgtcggcgcggcgagcgtccgcgtgccgcgacacctcctcgtgcacgcgacgctcgcagcgcgggttcgcggcgaggagccacaagagccacgtcagcgcgggtgctcgtgctcgtcctccccgcgacggaggcgctcctccgacgccacgtcggcgggagaggagggagcggcgcgcggagatgtcggcggtagaggagggagcggcccctcctcacctgcttcctctccaacctcctcatcatccccggccgccgcctcctcccttc

SEQ ID NO: 61663 - DNA, 12116 bp, Oryza sativa
gacctcgcttcatggtgccgatacacgcctccgcccgcgcgagccaacccgacgctgctactcctcgatgggacatggaagcatgccaaggagatgcaggccgccagcctcccgtttttgtcctccttcgtctcgtccccgtgtcattgatcgtctactgcgatgtcggcgccggcggggtcgaggtggtggaggatgacgacggtggtggaggcgggttgcggcggagggcgtgcgctgcgccctctctgttgcgcctgagagaggagatggggagagaggaggaagaaggggaggggagtgagattgacatgtggggcccacgtaggccccaccattttttattaattcatgtgtgaaactgacatgtgggtctcacgggtttattatttttcttagatcgaattgccacataagcgccacgtcaaatgaagaacgagtcaaattagccacgtaggcgccatgtcagtcaaaaccaccatccaaaccgctaagggacctcatacgtgctggttttgacagctgagggagtcgttgtatctggtttttcggttggaggatgaaaatcggattcgttgacaagttaagggacctatgataaacttattcctattgagtatgacaagcttaccaccaatcgcattgtcgattccctacagcccactaacctggcccaaggtgatggaggaattgaggcctaactttgccggcccacccaacacatgcctctagttgaacacggcctacaaataatctagcccaaccaaaacgtagatccaagcccagatccacctgcagtacaatgcctgccacaatgtacaaactattgtacaaagcaaacagtcagctacttgtattcctagttggcacattgccgtaggtttttcacctcaactaaaccatcttaaaacaagcaatgcaattcacagtaacaaaataattacacttcaacgcaacatgtcgatagatcaatgaacaatggtcagctcacgctgtgcacgtaaaactccaccgcaaaaccatcaacgagacttctctgacgcagatcgctgaaatgtattccctccgttctattaaaaactactaactactccagtaacatacatctgtacagattcatattactataatgtgttacattttattctagattcgttttttatgaaacggagggattatgtccgtcagtagtatggtttatacgtcagtaagtcagagaatcgctgctacatgttgtagccttggtgacacggttgccacccttgctgccgcctcgtcgccgcggggggagccatcaccagcgccgccgccgccgccaaatccacgcgctcgccgcagcagccgcagcgaacgcactgttcgcccgagacgttggtggattccaccacgggcacgacgcagaagttggacccgcaccgcgcgcacgcgccgcgcacctgcgcggccagcgccgactgcacccggcggcaccgcgcgtcgtcgtggtggcaacccccgcgcgcgcgcagctccacgtactccgcggcgcggcgcaggtgctccgccgcgcgtcggcggcgcgccatggcggccgacacgggcgccagccccagcgcctcgcggatctcatccacggtggcgtcgatgccgtgccggagcggcgtcgcgtccaccccggtccacggcgcccacgacgagccctcgccgcccgcgtcttcgttgccaccgcgccggggcggcgtcgcgtccaccccggacaacggcgttcacgtcgagccctcgccggccgtgtcgccgttgccaccgcgccggggcggagtcgcgtccgccccggaccacggcgtccacgtcgagccctcgctgcccctgtcgccgttgccaccgcgccggggcggcgccgcgtccactccggaccacggcgtccacgtcgagccctcgccgcccgtgtcgccgttgccaccgccaccgccaccgccaccgccggaatccatcgtcgtgtgatggcgagttgcgtctcacacggagtaaacggagactcacgatggtacatatcgcgccgcgccacgaggtgttcgacacgggaccgaggcgtgtgtccgtgtcggagaaggattctcaaccagaggaaggagaccaagagtcccaagacaggccccgattacctttctcgtaatgttttccagtacgtaccgatttcaaaaaccaatttaagatgaatccgagattaaaataggtcaagtaaaacacatcaattctcccagtttatggagttctacaggtagtggatctcttcgggtgttttgaattcatggacacatcaggctcaacgagaggaaattactggcctaatcagttacgaattccctctccatcctgaaaacctaaatggcaatgttaaggagcacaaaactaggctgcccaatgttccatgtctcttggcatgaaggcgcagtgacggtggggaagaagatgatcaatggtctctacagagaccagttcatggcattggtggagtggctgaaggcgccgctgccggagccatgctcggcttccggccggttggacggggcacctccctgcagtgcgagctcgagctcgccggagaaatggccgtggtggacagagcccggagggacctcgttcagcacaaccccgtgcggtggcggcaggtgcacgttcctggcgccgtcatggccccggctggagctgttccagccggggctcgccgccatgtagttgcttgccatgaccgagggcgacaccgggttgttgccgcctccgaaggcgctggccgttgacgacattggcggggaccggttgtggctgctggtgctttgggtagtatcccatggctgagttgacagaagagagagagcacagctggagtcggtggcgactcccgcgagacatccacctgaggtgagctcaaaggctgggtggtggagcattggtgccccagccgctgagccaccatggctgctgaacgcatggtgatcactgtatcccgcaactgcgctgcggtgaggatggagttcatggcccccttgccactggattgaaccggacatgcgatcgctgggctgaatagcaggccacgcatccctcacactgcttggaacccttgggtatgagaaatctaccacaaagcttctggacctgcctggctcttctgaaacaaaagttgcaggggcaacaagtcaatacactcatctgaagttcagagtaacaggacaaacatgagccacattttaccatgaaaggatgcagcaagccggccatagcgagaagaaagaggtccaggtgtcggcttcctccggcgttcattgtgacctgcaaggcgtctgcggcagctttttttttcttgatcaaattcaggtaattggtggaacctgtgatttgaagtggccaaaatattagtgaattaccacaagcgtagtgacactgcaggatataattgaatacaaggagttttcctaatgaagaatgtcatgctataaaaaatactctacactgacaatgaaaagcaataatcaatttaactcaataaaaaaaaagcacgctgaagagcatttttggtggggctattgcttattgtagtgaccttactttagaaaattgcaagcacatgaaaagtaggagtgccaactctgtaatcaagaatcagctacccctgctgcttatcttaatacggagcgtgcatcagataaataaatcaaaccacatgccatgtgaaaagctgcgtcgatgcaagcataacaacttttttttaatcctagactaatgtgtatttgttctaagtagcaacactaaccaaagacacgcctttcatgattagatacacatacaccacgaccgggaaaataaaaaggttacctaaccatgtggacagagcacctgcaatcattcccatagtactttagcacaaacaaaggctttagttagtacatcaaatagtcaagagatgttttatctacggcagagcagatttataaataacacaacagtcagaaccttctattttccggtaatgcatatgtccacaactccacaagccaccaactatgaaatagtatgcattttttccaaacaaattgttggatgcaatatagcagatgatgttatttcattttgatattttagattatgtagcataagcataagtgtttgtgttctagtatctactatacaaaatgaaaacatataggacaaaattagagtaagtatatgggatttctgatgaaccaaatgagaattattggttagcatgattgaccaacttcgttattgctgggcatgttcaaaggtagaacccatatagtcttttaaataatacatgtttattcagagactatgtccttacaactgttgagatcgacaacaaagactttatttaaacaatgcattcataaaaacaaaattattactattatttccttgttaaaaccctcatgcagaaaagtttccattctatagaggttaagagtcgttgctaagcggttgtttaatcgaagctaccatgtttgcatctccttgcttctctctcatccatgtcagcaaacattcctaattagcaaggttttgtagttactatttcatccgatttgttttccacctcaatttctctgctgccctacttccattttagggcattaaatagtgcatagtagtacagtgtagtaccttactactaccccatatatacttcatatcctaccacattccacatactactagaatagaaaaaaaggagatctagacttactatatgtgtgctcctcagacaagatattctggatggacacttttatgtcccttactattctagtcaggttccacatgtcctaaatttcacattgatcgctactactatcaaacccagcagcagtacactacacacagggcatgaaaatctctcaatctggccagggacaaaacggcaaaatttaatttgcctgaaatccaacgttgctgctacgtttttgcaagttgcagaggttgtttcttttttcttgtcctaaaatcagagcttgctgaggtagccaaatctagtggggagtttttttgaattttggcaggaaccgtttgaaagttgggcgaatcacacggtggattggtgagtgtctgtcacactcacgcgctcacaggtggaacagtagagcagcagaggaagcaggggcaatggctggacgacggcgacgaggaggaggaagaagaagaagattttggttttggtttttggttttttacctgctgcactgttggcagaagcgctgctcgaggccggcgacgacgacgatgggctccttggcgtgcatgtagcacaccttgtggcggcagtagtacggcttgacgccgctcagatccacgccgcaaccctccacctggcacctcggcggcagcggcggcgggggagccgccgccgccgccacgcccttccccttcttgccgcctccgcccgacgacgtcgacgacgactccaccgccgccgccgacgccgacgccgccgcgtcctgctcgaagtagatcttcttgccgaacttgagcccgtggacatcgtcaccaccacctccacctccgccgccgccgccgctgccgccggtcgccattgcggcaggcggtggtcggtcccttcctcctcctgctagctgcctagcctctctctctctctctctctctcttctttttattgccgctccctcactctctctctctctagctagcgagcgtgcgcgtgtgagtgaaaaggaaggcgagctgagctgagctgaggaggcgacaacagtggtggcacacccctcttttaaaaggagtagtaaaataaaagctcagctgctgctgctgctgcttgtgtgtgtgtgtgagtgtgacgcactagtgcactactactactaccgcttcacactcccagatgctactgctagtactactactccgagtagctaccaccttcaaagctcaaagctgcctactagtggtagtaggaggaggaggaggagtagcggtttaactcgtgtgttgcggggtttctgggggtgaaagtgaaacttgggttggcggctccaccccatatataggcgccacaggccggtgtggaacagcggcgcgcgcatgctctcgtggaaattttgtgccgtgtcgggggctcggccgcggcggtgtcgccgatgggggaatctcgcgtatcgactatactcttacttctaagagcaaggacaatagcagtctataagccagctgtaaacatattttaagaagataaatgaagagagagaaaagcagcgggctacagatttctagtcagctataacacagaatttaagacgcagtgtgtatgacagatgagaccaggtattaattttgtagtatgtaactattgtatgaggcttccatccaatggtccaataaaccaaaaaataagccaaattttgaattttcaaacttaattttgaaatattttcaacgtaattttttttcaacattggcttttaagttacaaagaacacatatataaaagttttacctacaaatttatttttattccctaataagccgttttggcttattagaaaaaaaaagtcaaccgatggaggcatgaatgagctattagattgactatagataaattggagctagtagttggctatactattaaacttgctctaattagtactccctccgtcccgtaatataagagattttaatattttatttacactgtttgatcactcgtcttattaaaaaatttatgcagatataaaaaaagttatacataaaatactttagataataaagtaaattataaaaaataaataataattttaaaatttttaaataaaatagatggttaaaaatattaaaatctgggagggagtactgcggtagaggagacggcagagaacaggagcacggccacggccacggccacgggcgagagcgagtgacaagagcagcagcaagcacagaggccagcagtacgctgtgcatcccgctgccgcgctggacggacgctgggccacagtagctgacgactcacatcgatgtgacgatggagccaacccgctcctgcctccgctcccgctacgtccacaccagcagctgcagctgcagctacattgggcgcgggacgacgaaggtgggggcgcgcgtcgatggcgattggtggtggaacgggcggttccgggctattggggagacgtgcttcatcacaggttggaaggggggaagaaccgaacaagggttgggcgtgtaaaaaaggtggctcttttccggaggtttccactcaggttggttttgattcagtggctgctttttagcgtcctttctttctttttagcacaggtacgaaccataggttattcgaggaagatatgagttgttctatgtactactacatatcagagaaagatctaaacggtatcataattaggtggatttatatcgtttgttgtatatgtttgtcgctattaacgtccggagaaaaatcataattttatatcaactttcaaaaataattattcttagaaaattatcaagaaagtatagaattatgtcaccataaaacaacgtgataatccaaacaatgctagcatataacccattaatcgagagtacttgataaatgtagtgctaggtatacgtggtttgcttcaaagcactagagatgtgttagtggatttgtagaagcatgtttttcctagtgcctacaattacgcacatgtaagtataatttttatggatttacttctgagtcattagcctgtattaagagtgcacacccatgtgtttgtgagtgtggtgtgcatatgtagtgatgtcgctacaccaagatataggtacataaatactttgatctgttggaataagtagcttttagtggcaaactatctgttgggaaagataaagtggcatagtataatttttttctaccgacagacaattgtcttctttttagtgttgtagtgtagtgtgtgtgcgcgcgcataaaacatacacatatagttctagctcatgcatatgtatcttttgtttgatgcatatgttgggttcaattccattatctaagtaaaaaggcttgtatattttgagaaattatttgtaattttaagttgtatgtttgactaaatttcgcataagtgcatatgatatgatcaaattataacaaaattacgcatctaatattgtgggtatatatatttgaggtgatgtggtttacgagagatgaaaaacaacttggatcacagattaattatcaaatgtaaaaaaaagaaattgaggtgacgtggttctataaaataagagagaaaataatttagacaacagattaatcaatagtaaaaataattgagattgtatgaattaacaagcgtgaaataaggtaacagtatttcgtatattggtatctgccatattcttttctttccatatccaaggtactccctccgtctcataatataagggattttgagtttttacttatactgtttgaccactcgtcttattaaaaaaatttaaaattattatttattttttgacttactttattattcaaagtactttaagcataattttttgttttttatatttgcacaattttttttaaataaaatgagtggttaaacaatgcaaataaaaactcaaaatccgggacagagagagtagtactacacagattaaaaaaatggtgttatacaatgtgttactagcaagcatgcatgccttatatatatttttatactagtgtactgtacttaccagtacaaggataagagctgacattttaggatttttgattccttaatcactttaattagcctcagtggtctactggtactaggagtgcctcccttccctcaagctaaaatcatgtggacaaataggggctgcagtgttgttgggagaaatggttgaaattaacgaagcgtagggtttcatgcgtggaggcatggagcatgcacgtgcttgcctgcttaattggtctctagccttccacttttgagttggacaagacggctattgggttttcttttaaccgttggtcctttgcctggggccgagttacgcctttggcgtgttaccattgctgaagaatctttcgtcttgagcccgagtttccactggtggtgaagttttggaattgcctcggaattcattagggatgttaattttcacacatgatactcacgcacacgctctcatctgtcgtctctataaatttagaccgtgttttgtcttggtgggactaaaacttttaagtcactatcacatcagatgtttggaaattaattataaatattaaacatagactattaataaaacccatttataatcttggactaattcgtgagacgaatctattgagcttaattaatctatgattagcttatgtgatgctatagtaaacattctctaattatggattaattaggcttaaaaaatttgtctcgcaaattagcttttatttatgtaattagttttgtaagtagtctatatttaatactctaaattaatatctaaatacagagactaaagttaagtccctagatccaaacaccaccttataaacaccccttttgcccctatcatatgcagtatgaataaatctaaaaattgagtcagcttatcttaaaattcacaaattctccatagacttctaccactgagaaattataataattagttataaacatgagtgttttaaaactgagtgttttatcattaccagcataaacttaatatgttttttaatcctaaaactaggcttctatgtaaaagaaaacctctaaaagttttcctacgtagatgccaatgaattaaaatccccaaatatgtatttctcgctctctacatcggctggagggcacttgctcttagtcctgattgtgcgaagagagggatgcgctctcgtgggaagaggggaacaacgaatttaggccatattttcataccggtgttttgctttgtatcacactttaaccaatgtttttattttagaataggtaatctttttttttgcagtttgaactaccctaactcatttctcaagtatataaacgaattcgagtatgctagctccgattcgtcaatgaactcccaccattttatatagaaaatttatttgatatatgatatagtttgatgtagatagataaaagagttgagagtgatccaaggtggtacaaagataagatttctagttcaaaattaaaaaaatggttaaagatgacccaaagtaaaacttattctttttaatttagggagctgagtgtatgctctctctcggtgagatgtataacttttaatctttaaattctcattatagatttccaagaaaaatttaggggttataattttgggcaaccttcattgatgatgctcttaggtgttgtttaatttggctgtcgcgactcaaagtgcctaagtttggctcaaaactgagtgtatgatagtatatcatatactaggacaatataaattagtaaagtattgattgttatagttgtaataaccaacacatggtaataatatatgacatgtatagtatttctcgtggcgacttatagcaggaaactaaatatgctctttaaaattcaaacacttcattaataaactacacctataaaattttggtgatatttagagtattagttttcataatcatgattttatattagcacaaaagaaaacatgtacttcctccgtattttaatgtatgacgccgttgactttttgataaatatttgacctttcgtcttattcaaaaaatttatataattatcatttattttattgtgacttgatttatcatcaaatgttctttaagcatgacataagtatttttatatttgcataaaaaatttgaataagacgaatggtcaaaagttggttaaaaaatcaacggcgtcatatattaaaatacggagagagtatactagaatctgcgttaattaaataagttattggtattaccaatattttagtaactccaggcttgttaccgaagtttttagtatgaaacgaaccaaactattctactccctccatttcaaattgatctacatatttcgtaggtacaccaagatcaagaaaaattaataactctctcatactatatttactctagcaataaactcaatgcatgcaccatccccactattttctactccctctgtcctaaaataagtgcagttttagcactattcatgtccaacgtttgactgttcgtcttatttgaaaaaagattatgattagtatttttattgttattagatgataaaacatgaatagtactttatgtgtgactaatttttttaaatatttttcataaaattttcaaataagacggatggtcaaagcgctaattatggatatttatggctgtacttattttaggacggatgtagtagccaatagcaaatcaagatattgcatgtgggttataaatgcttgtgagcatggatgcatgtatcaatgtctatttactccaatgcacaaataacgaatagacttaataaataaatataaatatgtagatcaatttagaattaagagagtataattaagtaacgtagagaaacaaggccctagagagtttctggcagctttactctgagaataattaacactctcaaacggcctatatttttagtttagagtttgaaacggctagataaatgtacgtagtaacacttggttctcatatcttccccctattattgcaacctcagaatctccagacagggaccaagttttagttctgagatctgctcccctgttgcaacttcagaaccaagttgtactactggcaaccttgctcccgtcgctactcccgtcatgtccaaacgaaggctgatgatggcacgcatcacagtttgatacccttactgaggggtgtttagatggggctaaaaactttttagcccatattatatcggatgtttggacgctaatttagagtattaaacataaactaataaaaaaaactaatttcataaatgagagctaatccgcgagatgaattttttaagcctaattaatccataattatcaaaagtttactgtagcatcacattgtcaaaattatggcgtaattagactcaaaagattcatctcgcgaattagcccacttttatgaaatgggt

SEQ ID NO: 61664 - DNA, 4235 bp, Oryza sativa
cctatgtgatactacagtaaacattctctaattatggattaattaggcttaaaaaatttgtctcgtaaattagttttcatttatataattagttttgtaagtagtatatatttaatactctaaattagtgtctaaataaagagactaaagttaagtccctggatccaaacaccaccacagtcgtacgctccgaaggcaaggggacgtataaacaacaaagacatgtgtaaaatgctctaaaacacaatgcaaggacaccactaataacaaaagttggcagttttaatttagttttgtgatgatgtgtatattattaaagttccgatgcaaaccctcttgtcgctacccagatgttccgtttcaggacaacacattctagtaagggtcaaaggttgtacgcattttgatgatggctagttgctttagggctcgttattttaatgtaaaataaatcttaccaacttttatcaacaccaaaatttagttaatttgctacttttgtcaaatattattgtattatgtgaagaagtttctagtaatcactaaatatttgtacagtaggtatggtacagtatttggaatttagttggattgctgccttattaaaatttacaaatgctaaaatttgacatagttgaaaatggtagcaaacggataaacgcccttacctcccacttgattgaaaatggtcgatcccgtcgaccgccagcacagacgacatcacccataaacccacttgactgtgtgttcggcgaccccattcttgttccactggggaatggatttgtgtcgggtcggtttggaagttggaaaacagatgaaaaattgtgtgtggtaaactccgggtacatggacgaagggacgatgatgacagaaaccgaaaagcttttgcatccccacggccgccgcaaggtcgttggctgggccggcaggagcagatcggttagttgacgagggagagcggtagcgaatgcagccgctgcacaggtccgcccgcaattggcctcgcgatggcgcatagctgattgcgcaagatctccccactgcgaacaatctgaaaacgaaacagattctagtgcacaaattatttggcccgaacgacagacagaacgacgcgcgtgcttcggactcgtagggggtgtttagatcaggtgtaaagttttgacgtgttacattgagtattatataaggtgtcgtctgaggtgttcgacactaataaaaaaaattaattacagaatccatcagtaaaccgcgagacgaatttattaagcttaattaatccgttattactaaatgtttactatggcaccacattatcaaatcatgaagcaattaagccgaaaagtttcatctcgcaaattagtcgcaatctatgcgattagttattttttagcctaaatttaatagttcatgtatgtgttcaaacgtttgatgtgacatggtaaacaaggccgaagatgacggacgagggtgagtacgtatacgacagaccaaatatttttggatgacgaaagtaagagtatcaatgtttcaattaggtagagatagaagagttgcggcaggtgggaaaataaggttgagtccatgatataggccattcacttgtgagaatactgtattagtcatagtctgtagtacatattaatggaaacatcatatccagtttcctcacaacaaatatagtgtttgggtttacgtgtgtgtgagtgagacatcctggtggtgggcaaaattaaaatcaatgtaaaaattatctactctctctaaaaaaaactcaaatctctaggatttatttatttttttgatacagaaagattgtggccgtgttaagattcaaaattttttcttcaaacttttaattttttcgtcacatcaaatatttggacacatgcatggaacattaaatgtggacgaaaaaaaaatcaattacatagtttgcatgtaaatcacgagacaaatctttttgagcctaattaattagacttaataaattcatctcgcagtttacaagcggaatctgtaatttgttttattattaatctacgtttaatactttgaatgtgtgttcatataattaaaaaaattgacatacgaaataaacacaacctgtgagagtgagtaaagagcagccaaaagaggaagtatgtgcgagtgagtaaggagcagccagcagtaagctactgaccaaggtttgaagccaggtgctcaccgtctcaaaaataagctcttcctcggaattcttatacatattttaagtttacttgctgctcgtatatagtgtcggggtgtgcattttaatctagtgctcgattttttacacactcattttttttagttattcaatattccgtactaagtttttccgttggtcgttagagttctttctagaacggtgcatagcttagccgatagagagctactagcgtagtcacttacatgggttagaattcatatgagctcaccacctactaaaattaaattctagacaggattagtgttgcttattttttgataaaacaatgcttagggtctgtttgaagtagtttctagttgatacaactcctccaaacaatccctccaaacaatcctttttttttacagattctgagaaactatagttgtagaatccagacaataaactactccctccatccaaaagaaacttaatctagaaagggatgtgacccctcctaagattatgaatctggactaccctttgtccagattcgttgttctaggaggggtcacgtcccctcttagattgaggttttttgtagaaggagggagtagaagtcagaagcaggaaaacttaattttttttccagattctcagaagttgttaccaaccagctgtttctcagaaatttaaactcccctaaataagccctaagcttcttagctggtagggagccgctgggaggaaggcaccgatctcggttcaaacctagccaataactttttttttacttagttctggatgtaacacaacaacattttaggacagatgtgtgcacagtacgcccttccgagaacatcacccacgcccttctaaaaaacgcatatgctcctgttacaacagaaaactagcagaactatcgccccgacgtactacacagctacccgactcacgacgactcccaaacagaagccccccactgatcgacttgacggactgactgagggtctgtttagttactaaaaagtttttcctaaaaatatcacattaaatctttgaagatatgtatgaagcattaaatgtagataaaaaaactaattgcataattatgatggaaatcgcgagacgaatcttttgagtctaattagtctataattagccacaagtgctacagtaacttatatatgctaatggcggattaattaggctcaaaagtttcgtctcgcggttttcaggcaagttatgaaattaattttttgattcgtgtccgaaaaacctttccgacatccgatcaaacgtctgatatgacaactaaaaatttttatttcaccaaactaaactggcccagactaatcctatttgcagggacgatcgacatgtcgtgaactcgtgatcctccggtttcccggccgtatacatgctaccgctagcaagcatcaaaactttctctccacagtggtgccatggcaggtgtacgtgcgatccctactttgattggctactcaccgtgacgtcgtctacaccgacgtaatacggcgcgggggagtgcagtgccggggacagcaccatgcacacgaatcttggccgggtcgccggccgtcggcatcggccggatcgcgaagtcgcggctacaggagaacgtgacggatcgccgagagagcgagagcgagtactccactactactcgagacaggccgacgagacgagaggaggaggccgtgggctctcgttggacgctggtgctcccccgaactgttgctgatgctaccggtgacacgtactgtgtgtgagcagctgctgctgctgctgcgtgtgtagctgtgtatgctggcgacggacggggtgagtggctgtgagactggagtatgcctgtgagcagtgtctcccactgtgtgcctgtgactgtgcttgctttgcttcttgcttgttgggccgagaagctgtgacatggctcctgcagtgactgtatccctcacgagtactgtagctctgtgacttcgggttggtttggattttgataggccgagagttttccactgataaatgcaagagttttttt

SEQ ID NO: 61665 - DNA, 1979 bp, Oryza sativa
  unsure (1)..(1979): unsure at all n locations
ccccccccccccccccccccccccccccgcgctagctgtcccggctggctggctggttggttgggcttcccatttgcagtgatgctactgcgtgcgtgcgtgcgtgcggccggcccagcggagggcggctggccggggtccccatccactactgcggagtactacggggattggatggcacacggaagtgaaggggttaccggttcggtcgcatttacagttgggctagggggtacgtgcacgtactacgtgtgttgttgtttgtgtacgttttctgggctgcgtgttttcttttcggtctgttactcctgttgggcctgtaccttgtgggaggacggggaacagtaatagtagcagtgacgggagcgagaaggactccgtcgtccatccatcatcatgctcggcctctcctgaacttatgagtttcactgttttttttaatggaaaatcgtttaaagttggttttgtgatgttgagtttggtgccaaaattttgtcaacagggagagaatgtataaggcgataccattattccgatagggcgccatgttttcaaaggacggataccgaacctttgctggatcaccgttggatcacagattaccatggatgagtcgaagcaatcattgaataactgaatctctgggcaaggcggaacggcacaagactagttctcacaatcaacgagatgctttgctatggagatcgatgcctgttgcgtcagggtcggcatacatacaaattaagcactgttcataggatcaaagactttccggctatgccaatctgagagaaagcctacttgactagcgcctcacgctgcaggttcacttgggctagttgcacgccgatgatctgtgacaaacgataggatgagaaggagaggattacctaatctcagtaattgcatactctatgatcaacaaaagaaaaccatccgccacattcttatagcatgctcgaaatccctctaactttggtggatcatactaggatctatttggggagtgtttaggaactacaacaacttctaccagaatctccacgtacttcaaacagttcatattctcgcccatattatgagaatatatagttataaaattttaatctaaaaaatctaacttatttagattttcaccaataagctagcttcctttggtgcgacaaaatgaaaagaaaatattgccaaacatatatggcatcggctcccgacatagtggccatcctcgcaacttggtcgatttctctctgtgtttttttagcgtgaatatggtgctctttactggtagtagaaagtaatctgaaccgttgatcttatttaatcaaagatttggatctacttttactaccaccccagttagcggtagtagaaatatgaaggggcattattgttttaaaaaatatgtgtgaaaagggtataatcgttattttgcattgactaaaccttattcttcttatttttagctttttcgatggtaaattagcgatgccagcggaatggatgaccacgatagacagaagaaaaacgtaaatgacaaagctactccaaatcactgttaaaagttattttaataatgaaccggttcggatcattaacagagagcactacagcaccggagcatatcgatctcaaaggaaaaagggacaacagattgttcaatcggcaacaacgatcctggcgcgaagaagcgagcacggctgctgaagcgcgtggaggccaccatcacggtgctatagtacattgttggtttgctgccctaatgtatgtagtagcttggtcgtgcggtaattagccatatgttgtaatctttgtgtgtcctttttttctttctttgatctgtcgttcctgtacaaaactccatgtccatcgaatgaagtagcccatgtctggacaagcccaatagcctcattgtttgttaatgtctttttgaaagaaannnnnnnnnnnnnnnnnnnnnnnnnnnnnnnnnnnnnnnnnnn

SEQ ID NO: 61666 - DNA, 973 bp, Oryza sativa
atgtagatactgatataaaggcaatcggctgatgatgatgtaatatagcaatataatcctgtataaaccaatcggctaacaatatgatatagtagaacaagtattgatccgaaggttaaagcacccatcggctggaggtccgatgtcatgaaatccacaagattagattaaacaatgaaacctttgttgccatcggctaaatccaacttatatgtatatgcaatccttatgagccgatgcaacgtccatgtaactcaccagctgaaaccccgatgaaacccttactggcaatcaataagcagtctagagattatggttctaagcacgacttagtagatcaaacttaactgatgcaacactaagtatgaaaagaaacacaatatctagacaatcaagccgttgactgattttcagggtggtagatgcctaggctaattgtcggagcccaaaactaacaacttggatccgactgagattattgtatcaatccctggatcagtaaaaattgatacatacaatataactggttctttattgcatatgttaaagtcttacaatactaagggttttacaataataggtactcacctatctaattagtacacagcggaagtttctatacattctgactagtgaggtaaaaccctcagggattttctaagttatcggggtcttcgtagtaatagtcatatgggtcctcctcttgacccagatctgaaaaaggggttataagagcaaggatgagtattcacaatactcagcaagttatcatggaaatatgttatgcattgacatataatagggttctttgcaaaaagcggtattagacaatctggaaaagttatagcagaatttataaaacatataaactttagatttctaaccagggtaccatatgagtcccagtactcaactccatgagtacggctattcgaatagtttcaaagatattctactgcagcagatgtacgtt

SEQ ID NO: 61667 - DNA, 2104 bp, Oryza sativa
cgtcggcagctcatagggtggcatgttagtgcaaagggattgctaaaatggaatctaggtagtatgtagatgattgaaacggaaaaactcaccgagatcggttgaaatgacggattgcggcggtgaagaacagagcagcgcgggggcggcggtgctcggcttggtgcggcgaggtaaaaatcgacgcagggctttggttagggcttagtatactagaacatggtatgatataggtgttctaagggttatttagggcggaagatggatggagaggggtggagtcgatcgcgcacaaggtgttcgaccgacgggcgagggtggttgatgagatggattggtgaagcagagcttcggggttgtggggctatggttgttgatgatcgatgatggacagggaagggattggggtcctatttatagggctaggaggagcggatgagctcgggcaccttcatcgccatggatgagctcgggatttggatgaggcaaaggtggcagaggctgagagagggcgggcaagatcgatttgagtggcgggaggccacgttcgaatacttaccggcgaaggattgacttgaccgtagttggaatcggctggcgacgtgttggcgccaatccgagcacgacgcgcggcagcggcgagggtgaaaatggccggctcgggggtgaatggtttgaattgtgagaggggataccaccatctatctccaatccaaccatgcggcaagaattggcgcgattcaccccgggtagaagcaaaatcgcactcggcggcggcttggacgggtgcgcacggcgtcgagcggcaatttcttgcggcgatcgtcgtcctggctttgtcgtcgtcaagattggtgcggcgacggtgggctgagggcgtcggacgggcgacggcgcgccaaggcagtcgggcacgtgcaaacggccccaaggccgacgcgcggcgacacggcgcgcagcaaaatcggatgccagtgcggtgtgtgcaaggggaggaagaagtaaagaaatccacggtttttgagtggggtgtggtccctaggatcaaatctaaactttgtgcaagattggatggagttgggctgctctaggtgggctagacattctaccgaacaccttatgtgcaatgaacagtagaattcagaatttttgaatatttcctagaaaagatttgaattcaaactaggagtttggaaaggtttcactagggtttagagtatagcaaatctccactaatattagggtaagctaaagaaataatctatggtttgaatttgagagaatttgctcaaattcactagggtttagaataaagggaataagttagagtaaattggttgggttataatacttaaaccaattttaaataaaaatcaaatagatttttgaaccaaacaaatttaattaaaagccagaatgatgcagtcaaattttagtttaaaatttgaggatgtttgtcacaccccgaagttctcctcccaagcctaaaatttaatttataaatgatcctaagaaaatgcaggtgcaaatcaaaagaaaaccctaagaaggtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatcctttttcctttttctttttctttttcctctctttttcctttttttttctttcgaatgggccgtcggcccattctctcctttcctccccccctcctccctgctgggctggccgcaggccgaggcccagccaggccgtcccgccgccctcctctccggggtcgccgacaggtggggcccacctgtcgggtccttcccccacctcccgccgctctcgctcgcgccgccgcgctcgcaaccgccgccgcgcccacgtctccgcctccttcgggccacgtcgaccacgcacgcgcgtgcgccgcgtttcccgcgcccactcccctctctctcccgctcgcgcccgcgcccgagatggccgggattcgattttcgaatcccgcctatctctcctcccccactc

SEQ ID NO: 61668 - DNA, 28387 bp, Oryza sativa
  unsure (1)..(28387): unsure at all n locations
ccaccctcggtgaggcaccccctcccctcttttcccctccctctccctcctagccgccgctttagcgccgccgcccgttagtcgtcgctttagcatcaccgcccttcggcgccgcctttgcgccgccgtctccgccgtcggttgctgtcgtcggcaacgcacgtgcgcgtgcgcacgccgtcgccgtgaccggtcggccggctttgtgccgagccgagcctagcctgaccgccgccgcaccgtccgatcggccccgggccgatccgggccgtcgatcccgtggatcggcggtggatcacccgcgtggtcccggtccacggtagaccggccacccttgagtcgctgaccagtggggcccgcatatcggcgccgcaccccctccgtgctgacgtcagccctggggcaatattgcgcaataaattgattaaggcttttctttaatagtaaaaacacatagaatcttctaaaaatcataactaattcatccgagctccgattaaatccattcaagtctcagtaaattcataaaaatgtgtagaatccattaaaaatggctttgttatctgtttcagtagtcttatagcatgttttgcttgtgtgctttatttgtcgcgtagatttcgcccgtttcgtcgattcgtggtttctcgaagacgttgctgtggttccatcagtgcgagagcaaggcaagtcatacattgcaattgatcatattgtacccaatttacaaatgtcccgcatttctattaaatattgcattgttttacaatatcatgtgggattggtcctattactcagctatatgttgtttcccttacgccattgataacttgggtattaaaatgactagatgttggtttaggagatgcttagccatgcttagttcaactagtgcacaaagggggatcacattaaagcatagacttgattattggtatagctttgatttagtgccaccgtaattgtgttggttaattaaaatacacgtcatggtgggctgtgggtgcatggtcttgctagtcgcacccatggcatttaaggaccggttcgcgggatgccctggaagaatttatcgtacttaccacaagctagcgtgggcaacggctgggcttgtagtgtagcttttctctagccgacgtacccaggcgagggtgggcgtgatggagttgggtcggccgaggtgtccggttgatcggcttccggattcaccgcggcacaaaaggggggctgcccgttgcctgctggggacgggggcgaaccctaaggtgtggtgcgatcggttagagggggttatgcgaagggtcctgtcacggcctctttccggtatgtcgtggtggtatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttacggctttcaactactgcttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttcccagttgaggatgtctcgaagaggttggtttcgtcgctgccgtcaaggatgcctgtggaatggagtcgcccgctgcaggagtcaagccttcaggcttagctcgcttttatctttttccgctgcatttgtaatcttttatgatgtttgtaagacgtggatctgaatgtcaacactgtcgtttgtgtaccccggctggtcctggacggggattttaatgcacattctgcttggaattctattcgggaatttctgggcgtgacaatgttacactaatctaatctagtaacgcgatttagccgataccggcagaaaccctaaagcgagagacagccgatatagctaaattgatatgctaagactagattaacagagacatgataaataggtaggcaaatatatcatctaaaccagagcaatccaagaggtcgaatgtaatgatgcagccttgaacgacgccgatgtagatgagacaattgcctggaccgacggaactttggacttatcctttcgtcggagatcgaagacgatgcagccccgcgtcgggtgccaagttccgccggaacgtaaaaaacaaaagtagaagtaaaaagggtggcgatgcgccgaattgtattgatcgtagcgatagattacatagaccccgggtgtatatatttatacccatgggttgatacaagtccttgtcggacaagaaagaaactaacctaaagataaaaggaaaatataaagtccttatcggacactaaacacattttcctaaagataaaaggaaactaacaaattattcctaattaatagataaactgacatgccgcatcctctttaaactcggtcacttaaggataaacttcatttagtagattgattttcttaaccgaatatagcaggaatccgactattggcgactttataactcccatcggctgattccgagatgctgcagccgataatgattctaagccgatgacgtctttgccgattaccaaatttcactgttaacacgcgccccgccccgggggggtgggggggtgctgttcgccgattagctttttcgctttgcagatcctaaaattccttcgaaccgaaaaccctaactgagtacggagctggaacgtactccctcagtcccaaaaagaccaacctagtacaacgaatcaatgtgaccctttctaataaaatgaatcaatgtggcccctcctagtacaacgatgaagttgccttttgtttttgggacggagtaaatactggagacgtcttcgaagcgaaacggctgccaaggagaccagctgttgggcttcaagaagtccggcccattttgggtagctcacgggactcaaggcccaaacccatatagccagaagtgggccatcctaaaactaaccgaattgggcctcatttaattcctcgattcttctgacagacgcatccacgagtggcacgcatggaacagccgctccccaccgccgcggcggaggcggccgccgccggcggcgacggcgaggcctaccggatccggccgctggagctcgccgacatctccagggggtttctgggcctcctcaaccagctctccccctcgccgcccctcacggaggaggccttccgcgcgcggttcgaggagctcgcggcgctgggcgccgaccacctcgtcctcgtcgcggaggacgccgccacgggccgcctcgccgccgcgggggccgtgctcgtggagcgcaagttcatacggcggtgcggccgggtggggcacgtcgaggacgtcgtggtggacgccgccgcgcgcggccgcgggctcggggagcgcgtcgtgcgccgcctcgtggagcacgcgagggggaggggttgctacaaggtcatcatcaactgcaccccggagctgacggggttctacgccaagtgcgggttcgtggagaagaacgtccagatggggctctacttctgaattctgatctaggtttcgtcttcttggatctctctgcctactacttgttgtacttagttaataaggaattttatgtcagttattgctccttgtatggatggatggatcactgatcaatgtggctaattccatttgcattgccaagatgtgcaagtttatttaattgaatggattgttctctgcatttatgtgcaaatctcattcttgcaaatgatttcaatgagtaaaagtaccataataatcgcaaacaaaatttatagtgcaaacctgtgacagtatggtttcgtattacatcgctcctgcctttgagaaattgagagtgatagtatcacttttaacagtttctgagtcgtatgaggccatcaggggggttagcgtggctgataaacaaaggttcagttatgttgcagcacttaaattgctggaggatatcaatccttccttatttccatcaatgacttgacacagtgtggtttgatctgatcacctctttagtttggaaacatttaggtagaaaagatttcaacattcacaagtactgttgtaattgaactcagtgtctactttatgagtaagcgctgttttgaatgtattcttagctttaggttggcgctaattaccttctctttctgacaaaaatgctccttatgttcatacagcattctttcatctatatcagaatttttagcataagttcaataccacatccaaagtaccctttagaacagtaaagttcagtagtatacaaaggtatatcaaaccaaggaggtgcatttgatacaagtaagtcattattcatgaggctacaagtaaatcatggatgcttgtgttggaagagcaaaacttctagaccatgcaatgcctagtttgaagttatgaacaatccactctttgcttgcgatggggaagtttatttattcttgtaaggtaacacttactttcatctctcttaatcctccactcctttagtctattattatgtttagttgttgattacttgatttcatactccagtttgttgacagcgatggtcctgttaattaaggcatgatcatatctttttaaatcaggtctagaggctaagattctttccattgtgttatagtagtggctcagcgagattgtgtcatactagtaactactattttgaatgcacaagggcaagccaaccgaagtcctagtgatagatgaatattctgtgattggttggcattataccaaggagtagtgggaatgtaaaggtggaaaaatgtctgaatagcgtcagaaaggttacataattcgaatagtatggtagtggatccctgaatcagcttgtgctggattgcttcttttgctttcttttaccaccctggtttccaaaatttgaattgacctgacttttgatcataatgatctttcaaagaaaaaaaaaaacttttgatcataatgcaaccagctggtgatcttgcctatcagcctatgccacaagtgctctctgaaattcacagttcatgaacctcatttggaagtaacattattaccaaaagttcacttttaaaatcttctagaggcagggagccagctttgactgcttattgtccctattagtatctgctttgcatagtactctcgctttcgtgttgtaccgtcaaaaggtttatcgttactgtttatgccattgtgatagatcatagatggcctctttggctttgtcatgatgcaggtgcaagtgctgagtcgccccctatcatagatggcaccaaagcaggttcttcccagactttgataactctggagtctggaccttcacacatggagaatccccaaggtggaggaattattgaggattttgctggcactgcatctcctgcgtcgtatgtctgaaccaccacaatgcattgcatcgtattcattcagaggatgagccagccattctccattgccagatccacgcgacagtacatttttccatcccaatcaagacctgacaaacctgaaggtaccgtcatgtggccagctcttctcctcccttgtgccgttcaagttgtcacagactcacagtgctttgcattgtaggatccgggacatgatttctctgtggtggccatggcaacaaacaactttgctgctcggttgcagcacgaggtgtggtgtagtgcagtgttagttgctgcccacttttaattggcttccactgttgcagtggctctcctcatcatccttcccacttattatcataggcacgctgctgccctttttaccactcttcgtctctcatccattccaattcttgtgcatgcagggctgcaggcactatctctttctcatctgcttcataccaaacctacgcttttatcctgaagaaagactggcaggcaatatgggtttcttgcagtgactaaaaccaccttcgttcagtgttcatcgaggacatggaggtacggtaccgttgtcgcgttctgcacttctgcgttgcatgcttgtttgtagactgtatgtattgctgacaccaccacggcatggcgacggcttgcgtgtgtaggggtgtaagttgttaagccgtgaacccacttatagatcaaaataagcaggttcatggcttgttttgttttataagtgaattttacgggttggccacttacaaactcctgtgtgtgtgtgcgcgtgcgtccaaaaacaaatgcaacacaatgttgagctttctttaacaatgaaaatggtgaacaggtatgtagcctagtgcttgtagctctctagtagagtttatcagctcctgagttcgactctcctcgggatgaatttccaatgttgatttagcaaaggatcactttatggccctttggttaaaacatgtgttaagaaacggacttatgatgaatatgttcttgagtacggagcagtgaccttaaagcacgggttaaggctcaaccatggggagcgaaaccgtgtgttaagagaccaaggtttaagacatgatctatggtggacaggccctcatgtacggggtaattaaggacctcaaagcacagattaaagctttgtttgatttactttaggattattataatctaaattattagaaataagctgaaacaaacagatagcttattatgatagattattataatctataaaccagattactataatctaatctagtaattcactataaatgtgcttattttagattattaggttgctaacagctaacaaacagcttataatccagagaaacaaacagctcacagcttattctatgtcggcttattataattcagcttacagtaattcgactcaataatctagattataataattttaagctgaaacaaacagggcctgaggctcgaattatagaggacggatccacatgttaaggatcaggctcgtgatctttctcagccggctttggttaagatttattattcttagcttagagcaagtttaatagtatagccaactactagctccaaatcatttatagtcaatttaatagccaatttatacaataattacctataaatatatactacactattaatatcttgggagtccgtgctgtagctgtccctataaatatgtagcccactactcttctattccctctttcatctctttaaaatatgtttatagttggcttatagtctactattgtacctactcttaaaaaacagtgggtgtggtctttctcatgccggtctgagcttgtcaaagtttttttttcaaggactaaactatggcctggtttagttccccaaaaatatttccaaaaacatcacatcgaacctttggacatatgcatagagcattaagtatagattaaaaaactaattacacagttaggagggaaatcgcgagataaatattttgagcctaatttatccatcattagccataaagtaacctacatgtgctaatgacggattaattaggctcagaagattcgtctcgcggtttccagacgagttacgtaattagttttttcattcgtgtccgaaagctccttctgacatccgataaacatctgatatgacgtccaaatttttttttttcgcgaactaaacagcccctatgtcatggtgtttgggcttataaatagagctaagcttgtggctggtttttggtcggtcgctggtggcttgcctttccgggcaagagccaagagggaaaacaaaagagcggcaagacggctggggtcggtgacggactgacggctgcaaggcgacgcgacggcgacggcgactcagcaaaagttcctccatgatcctctcaagaaaagggagaaaagcttgttgatgttgcctgctcggcctcccctttttaaccgtgtggctggatcgtcttctgacttgtaatcaccggcccgtgaacgatcagtggccgagtgtgagtgacactgtttgcgattgctcatatttctctaataagtcaaaataacttattaaaaaatataatttataggtaaaacttttacatatttattcatagcgacttaaaaaattaaaaaaacattaaaaatatcttaaaattaactttaaaatcaagttggaaaattcaaatttggtttggtttattaggctaactgacggggctctcaatctagaaaagaaattctatcagttaatcacatcatgatatttacttggtgctttctagttaagacattagacttctctaattggcacccaagaagatttggacatgatgtacagtacgtcctaaagagacgtgagttagcccatgactccgcaccgttttgtttctgcatgggacgcaatgatcgatgggcatagtccggttaaccgcagctactaactaaaaagttcattgcaaagagtagcaggcaagtcctcaccagggtatttttattccataatcttaaaattttagtagtaatagtaccgtagtagctatagtagctaattaaccgtctagcaagttaatagataacgacgattgcaaaattttgaccttgaagataaaaaaagagcttttgaagcttgtgcaatctgctaagtactcttgatattaccgtgctgacgtgttgatgatagacttgcactatctaatcatggtgtcttttgtgaccatcattcacttaattaccctgcctttttcttttccaacttctacatcggcctttcaaagcagtaatctacataaaaccggaaaaaagagagcacttttttatactttgatgaaacactttacatcatgaataaccaagcactataaagtactccaagaagcaacaaaaaatttcaaaagtccggaggaaagaagcgagaaaaatattggttggcgcagttgcgtcgctttcattcaccgtggtggccctcgcgcgcacgaaacagatgggggccttatcgccgtcgtaatcacgggagcggttttctcagccgtcggattggcaaggggcaccgatccgacggctgatgttgcgcccacaagatagccggtgatgcagacgttcactcaaaagataccgccgcctctaggaaattggtaggtacactcacacatgcagggaccactttgggttttccactcccctgcaagaaatgaaagttttctctataagagcaagtttaatagtatagcccactactaactccaattcatctataaccaatctaatagtcaattcatataatagttgcttactactacctctgtttcataatgtaagactttttagcattgtctgtattcatatagatatgtgtctagattcattaacatctatatgaatatgagcaatgctagaaagacttacattataaaacggatgaagtatattattaatatatggttccacctgtcatatacaactgcgtcttggaatccatgctgcagctggctacagatctgtagcccgctggtcttctctctcatcttttatctcattaaaatatgcttatatctggctaatagtctgctattgtacctactctaatacatctccagtaaatatataaaactgttagaggatgtgatcttctaccacgcatatggatgcccctcgcccagagcccgacaagggtacacgtcacgctaccgcttgattgactggggagccgcctaccacggaccatggtgtcttccctcctcttctcccttcctctcctgaacaatcgcagtgagtcagtgtggctgggcttattgaacattgtcggacaatgggcaccccatgtcgtagtttgacaactttcgcctaggcctcatcaaggtgccaacgaggtggtcaaatgtatgtagccgtggtaagactactctattgaactctaacgagcacaccagcagctactacggtctacggtggaatgttttggtgtaaccccctaggtgtagcttacacggttgcgcggaggaggcaacctgggtgaaggtgttggagatgacgctaagaggcgatatcggcgatgcacttcaataatgtgagcttggtggatgggttcaacgtaccggtgggaggtggcgttgggttaagagtggttgattggctaaaggtaagatgggaagaaattcgaatagtggtgattagagggaacattaaaataatgaaggggtacaacagtactacgtggtatggtttgaggatttaatttgatagtatcctctatttctcgaggtgtacgttacaggtgtgctcgtaaggtttgtggtgtacgtacatgcagtgtgcacgtgtgtgcatcttttgtatagtaaaataaatatgtatatcttcattaatttttgaaacttgataagaaaatttcataaaaaaacctaaaaatgcactgtcaaacagcatggttttccttattatttttttaggcccatttgaattataggaatgaaaaaacaaaggaataaaaaaagattttaataggaatgcaagtgcaaaatagaggattggaaaatacagaaaaaaacatataaatgatcgtttgattggatcacatgaaaaacataggaatcagatgagagagatagactcaaaaggaatttttttaagaggttgaacctcttgttaacttttttctaaaatctctatagaattatttgttccacgagaattttaaatgatatgatattattcaatcctttgtttcaaagcttatataagaatttttcccatatgattgaaatcattgcttctcctccaaagcaaaggggcccttaactttttcctgagtgtatctggatatgcgcaacgggaagtcagttagagcaagactaataatatagccgacctgttagctataagattttttgtagccttctcttagcctacccatatagtagatagctctttacaattaatataggtcccacttctctatctcgcagagtttcttgggtttttttttctaagccggctataagtttacagctcgcttcttctctctcctctcttctctcttctctcttctcttctccacctcagcatttagatttagctggcttatagcatactactattattcttagtatttgttgcccacctgatcacgcgccgcgcgggtacttgtgcagttgtgctagtagtagtacgtgggggagaaaccgttatgaccgccgcgccccccacccacccacaaaagcgtgcgccgccgccggttttctctcgcctcacagttcgtccaatcgaatcgacagcaagtactactcctaccagtagcagcagcagcatcagactgaaacttttctcacagtactagtctctcagatcccccgtcagtcactcactcgcccgatcgtgctgcccacgcattcataccgtcggcgcagccagccgacgtcgatcgatcgccggcgaaaaccggcgagccgacctggccggcaaaggctgctgctaccgcccgtggtttcggaggcgacccctgtggccggatagatgagcacgtcgtacaccaccggatacagatgccaggagccaggttagaggagttgagatcgacagcgacgagagggacaggaattcgccaaacagcttcaacgcatgcaccaccgttcgctgaacctgaaactattcagcctctgtttggaacagattttggtacagattgttaagacagactcgctctgtttttaatatataacgccattgtttttttaaaaaaaaagtgtttggccacttatattatttaaaattttgtgtaaatataaaaaaagttcaagtcatgcttaaagaacatttgatgattaatataatcacaataaaaaaatgataattacattttttaaaaatagaacaaatgattaaacgtatcttaaaaaagttaacgacaccatatattaaaaaactcctaaatagaagctataattgtatgagatatttcttatccagattgtattactaaaaaaaatatcctaaattcttatgttttatgttttaggatggatgtgttttggaacggcggtggtactgtatacttaataatggcacgatagattaattttttaaaataaactttactagaacaacacggtggatggattttttttttataaatcatatttttaccaacgttgagaaaatattttgtgataaaaatctgaaaaaaaaaagaacattagacttagatcatgttatgaaagcttttgcaaagccatagtttctccctaacgatccggattctattacccagattacgagaaactatacttgtagaatttacaaagcgaactaaaaatagctgagatttcaacatatagattctatgaatacgtacttacataatccaaataaaaagagctatgggactgctcaaaacagtgaccaggattattcgtgaacattgttgcgatgcatgtacttcacaaaaacagggtgtagcaacgagaggaaacaggatatggaggctgtctggatgtgtcatttgtcaagcaaagggggatgcaatgtacatgggcatgcattcttgcaagcagacacagctgcaacttgcacttggtgtgtactatgacaaacagagatgagacaaccatctatacacttgtgagttactctcctctccttcattatcaaaagaacaggctaattaattaatcaagctttgcagctacagtagtctaccactaccatgtgggaccccaacccatcatctttgtgaactctgaagaatgcatgccactgctccaaaatccaatgccctcatgttcaatttaccagatagaccagcgaattcatcagcaaagaaggaaacgaagcttagaaaaactgccggtgcagatgcttctgctgcatgccttttgcggccgttcgtgtgttgcgcactgctgcaccggtcatggcgattgattgacttgattgatttagccggcgaagtgcttctgcttgctcgccgagcaggtgcagctggaacggctgtcgtttaacaccttcagatgaatcaagaacaagaacaccgtcagcaacttggatgatacagtattacagtatttgattgattatgtctcagtctcagacaagactagctagctggttagttatgtatggttactgatcgaactgcaaacctcatcctcatgtgagcatctaaaaagtgttcaatagaaaaagaacatgccatttttttaattaactagagtaactaggagatcgatgcaatctggatgtgcccagctagccactactactactcctactagctaattacagttacccctgccctcatctggagggtaacaacttgatctaaacatcacctatatatcccgggacaattaggcaagtcgcagttctgaattttgatcaaacaaaattgggagtttcagactcatatatgttaccttgacctgcttctggagctccttgatgtagtccacggcaagatccaacatgtcagcagtgttggtttgctgcaagtaaaaccaaaacccaaattcacaaacggtcagctcatcagctagtactagtagtagtagctcacactggagtacagtgttagtaattttttttcacagcggatcagagtcgtggtccttccatggcagcagcagcagccaaaatgaacccaaacaggggaaaaaaccaatcatggagtatagcacacaaggtgttcgaccgatgggatccccctcaccttttccatgttggggacgagctcctgcagcttccgtatccgctcgctgatccgcgtcctcctcacctgcaagcgggagacgattttcagctcaggaatcgaaggaaatggatcgcgtgccacgccacgccacgccacgccacgccatgccatggcgtgcgcgtggcggcgagaggtgtgcgcgtgtgtaaggtacggtactgacccgctcggcgatgctgcgggggtgggtggcgcagccgcgcttggcgcggatcttgcaggggacggcgtcctggaactggaggaacttctcgatggcggccatctccggcgacgcggcggcggaggcggaggaggggggcttgctgctgttcttggacgccgccgggaggctgagctgccgcggcaggtcgtcgcgggggcgcttggacgggaggctgctgtccgggaggagcgacgtcgccggcggcgagggctcctcccaggcggaggaccccatcgcgtacccgccgccgtagccgccgcgtgcggcgccaccgccgttgctgccagcctccgggctgccgccgccgccggcgagctcctcgtcctcgctgcccatctccgagatctgggacatcaccgacccctgccgcgacgagaagctgagctgccccttgagccgcgggtcgccgccaccgccgccgccgcccatgcccgctcttagcatattcccgtatcctataattggtaaggatattaatggcgcctctcgaattccagaaatggaaaggctagcagccacctcatgattgctactacttcttgcaagatcaaggtggagtggagagggaggtgcaccaaccgttgtccatggtaagatggttgaggaagccggcgggggagctgctctgccggaggaggctgttgccggcggcggcggcggtggactccgtgccgccggagctgacggtgcggtagagtccctccatggcggaagccatctgctgctgctgctgatgcgactggtacatgagctgctgctgatgcgaggccatggagtcttccggtggggcgaagtgggcggcggggcggggaggcttgttgtcgtggccgccatggccggcgaggaagcgcgcgaggacggtgtccgcggcgtggtccgggctcccaggccgctgctgctgcagctgcagctgcagctgcccaccaccaccaccaccaccggggaggacgaagtcgccgcagacctccccgagcagcgtgctcggcgctgacctgtaccgcagcaagcccggcgagctcatctgcggcggcgtccgcaccccggctggctgcaggctcaggtccttggacaccggcgcgccgtacatcacccacccccacccaccccactgatctctccacacaccaaaccagcaactcagctcaagctcaagctacgatcgagacgagggctcgtgattccgctacgaaatttcttgtggatgtggagaagagaggagaggagaggatttaataatggcgagaggtagggaggaggtgattggggaggaagatgtgggagtgagagcggagaggggtatttatagcggtggaagttactggaagcaaggggaggggatcgaggcgtgcgtgccctcgtggccgggtcagctcgtcgtcgtcgacgacgacgacgacggcgacgtcggcggcggctgcggctgctgctgctagcttttgccttagctacagccaccggcctacttcactgctttactactacacctcttgtggaatgtggattattaacactaacaccccaaaattcgatcgttcttattctaaaaaaaaatcgatcgttcttttttttctctcctaattactcacttaaaagacgcatgcaccctcagtgcaagcctgtaacacacgtttgaagaaaggacgaaatacatgtaaactatccttttgcatagaatgattttctgatattacatggttcacgcaaacgcacacacaatactaaccatgcaacatcacaatcacactcacacccctgtgaatatgttccaatatacatactctaaagaacggaaaccagtggcacatataatgatttaaagattaaatagctgaattatttatgataattattcgagagtacacgtgagtaaattaaagttaaaattttgatttaaaatagtttttttaaagaaatttatgtaaataaagttgtacagacatatatttgcaacatttctctttttttatctgtttcatttctactccaattttaatgtaaaaaaaatacagagggagcacaacacaagagcagagtggattcggcccaacgacattttcaccgatccggcccagcaaggttgaatacgtggacccaccgtagccacgacctctcatgtcaaaaatactacctttttttattaaaaaaagtcctaaatatggtaaagggagaagatgcaagaaatggggaaaaggcaaaaataaaatcacgttaacgaggggtgcacatgtgtgcaggcaaagatacagtgctgttgcctgcttgtagcagctgcacctcgctgcactgactgacaccttacaaaaaattgcatacttaattaagattttttaagagcccaaagtgacaacatagtgtttaccatttgtttaattattcagttaagtcactgtcaagctatgctgtgcatccactcttcagttcagcatatgctcaatcaccactggtcaatggaaagcatgctactttccagtttccacaagaggggggaaatattttttccctcattttactaacattttgtcttgagagaatggatgttcataagtttgagcaaacaaaatggccaatgtgagagcagcaatatctgcaggacatgacagaagcaatactgaatttatactactgatgatgcagtggagaccatcagcccatcacaagctgtttcctggggatacttttgtcttgatattaggtccatatttggctgccgtactcctcgttgctttggaagagcatatgaagttcacagcaatttcgtgtggattttcaagaatatctgtggggcttaaggtaattaagattattttctttattggatgattgatatattttggacaatttgtttatagtgatgaattatatatatatatatatatatatatatatatatatatatatatatatcatgaacaaattgtctaagcaaatattgatgtagagagttttattaaaaaaatagtttgagaacagtggtacgcatattttcatttacatagcctggaaagaactggttctaagcaaactaagactagagtagtactagtacttgtttagagatgctgtcatcttatcaagggcgacttggatgtacttgtagcctcattaattcttaatccataacaatcttggtcctaccctgtactacaaaagaggctggatctggcttaactaaatagtatattgatcataatgagttgatgacactgcaatcaagtaatcaactactcctgccctgctgccatctccctcggtgcgattaatcaaactcttctccccatttgattccatctgaaggaatcaaaggaaaatgccatccttttcacccaactcacaagatcttgtgaaccatgtggctccacatgtgtctccaatgctaaatgttctatccctctctctctcttaatctctctataaccaatcttctctcctactttgtgctaagcttgtgttttactgttccattatccatgcagaaatgagaggcaggaaaaaggtgagcaaggaaaaaagaaaggcaggcagtgtggctccctctgcttttgttggtgagccaacaagagacaaaaacatggccacactttggagagtttgggagggtggtctctcacggcataaagtcctaaaaaaggagggaataggaggtgatacggttgggtttgacaccggctgggcagccaagaagcagccactagtcctcccagacctggccaggagggtcttcatcaagaggttgaccctgccacttggatgatgacacaatcagttccaacatttcgttcatagttgattataaactaaaatgcttattagacatataaattaattataggtaaaacttttatatatgtgggttcttcacgatctaaaagcaaacgctgaaaaaaattatgataacaaaatataaaaagacaacttaaaatataaattttgattgggacggataagtaaaaacaaacattagggatagataataataggacataatgctacactagtatttcttatgcagttttatacagagttagattttaaaagtagaaatagatttgatgcgtaacccttactctctttatatacacaatttattttctatacaacattattgatcaacctacatcattactagatttaccacggccaacgtgtgtatgtctctctgatttttgtcaagtaacatatgatgtttttatgcttctatagtgaaaatgggggctctttttagcgtgctctctctctctctctctctctccatagtacatcatatattgtgacttgattcctgttctctttttttttaagtcggtgattattcccatccgtcttggcatataaaacctggcgtgttaacacactcccatgtagcaagtgtcagcagcatgtgtttttgagatatgtcaaatatgaatggaataggttcaatttggcatgcaagataaggtaatatgcatgtttgaagtcggtatatgttcatcctatattatacagcctgttttggaaaaagttgccatgtttatttttagttcgctgtagatcgtatacttttttactctgtttccactttcttgaaggatttttttttagatgcactttcttgtagcagttagaaagcttcatgtaaattttacataggtagaaattgtattcggatgttgccaagctaagatcgaagacccttgtatcatccatgaactaacgttgacatgtttgtttgttcgataaacccaatcttcaaaggtgctcataaggatatggaaagatgtattcaagggtaagagcgctcgcgtatatatgaatgcccgcacttgtaatatatttagaaaatgtattattatgggcatgtactaaacaataattctctttatgaatctattctcgagaataggcgtatcaagaatcgtgtgctctaatattgataaagtgatgaaccatatccgaggatgctattcctcgagaatccaacggcagtaaaaggtcccccaatgcatggagtcatggagtgtatgtgcgtttgtacataaaatggcataattatcgtgataaggatctcttgatggcataaggtatctttgatcaaacgagaacgacctcaccatggatgaatggatgaaggtgttgcaagcaagaaaaatcttctgaagttatctgcaagaacagtggataataccaatataccatctgcagattagtgccaaaggatttgtgaaatgtatgtgtcgccatgagcgcttcatgatcttcacgagaacttggccgtttctggaacctaatgttcccattattcctaccggtggaaattcctcaataatgctcacattttgttcgaatatacagaaggatctatgcattattatctgaagcagtctataccatttatgtactaatgttctgtgatatattcccctgagaataatctcctgaatcctgacagcaattgcaaatttttatgtcttagaaaggtccaaaggaaggtactctcagcagccaattaccaaagtgatcgtggtgcaggaacactattcctctcggtagctaaaatcacgtcacattattctttcattgggataagcttcacattattggcacctttggtcagggcgtatcactacaggagcatgaaaggatgaaaagacaaagataacggaattatgtgtaaaggttgcatggatatttattttgcaaaaggaattcaattagttagtgtggtggtctcaatattttgctgtccaaataataatattttcacaacccggtatcagattctaacacccaccttagataatactcccttcgctccataatggatgttctagttttgttctaagtcaaacttatctaattttaattaactttataataaaacataacaacattttcagtactaaattagttttattaaatcaacattttaatatatatttttaaaagacatatgtttcgtgttggaaatgttgctattttttttctataaactttgtcatacttgaagtttgactttggacaaaccaaaacattttacattatggaacagtgggagtataatctttttttttacactcaaataaccattttttctctcttaattacttggacgctagtgcatggctcttgcacaaatttagttaggtgaaagccctctacttctttgggggacagggaggactccaatctgatctctgatctgaactgaatgcccacataaacacatgagagttagacaaccagcccagacctgagtagcagatgccaagtccagtttttattggcctttcaatgcacaagaggtggtagctgcccacgtaactgcagggcccccgtactgcatagatgtgagggaagtgaagccggagccgtacggggaaacaccggcccgggcaggcaagcatggcgcaagattgagatcgccagccagcgctaagcttccctcccggttgacacaacagcatgaggctataggatctagcattctagcaccagtgcaagccaaccaccaccaccaccacgacgacgacgaccgcggctcaggtgggtaggccggtggccggatacctcacagccttgaccaaagacggcgtcgccttgtggccaccggccggctcacgcggcagagaggtttgcagggtaagcaaactcaagctgcttgcagccagccagggtgcatacatgcaagtttctttttgacatgtactacaagggaggctagtgcaaccaaaatagaagaagagatggattcagcggttggaacttggaacatcgcagcattttaaatttgttgagggtagattctggttacatttggacagcaagcgtactgggaaaagaaagggaaacaaaggttggttcaaaacttactgtttggaatctgagctccaaatgttacagccttgaccttggaccaccctttcctggtatctgtagagcgtcataatggccaaaaccatgaaaaagaacttgaattggatcttctttcccgtactcctgaccatattctgcaattgctattaaaccaccagcttccttatcatgcatgtacacagtaattggcatcctggccacattggtaacggcatattagagcttttgttacttcccgttttcagaaggacaatacaacaagactacacatatatgaaactatccactattgctgttgagctacattaataaactttggtcaaagcctaacaaaatggaatattaatgacttttgggagttgtgttttgaaaaaaaaaaaggaagatccccgcaaaaaaaaaaggaagatgcttaacagtcataacatgacaaaaaaaaacaaacaaacaagacagtataagtggacaaacttatcccaggaatcctaaaatggattaaaagcaaaccaactaaccatcaaccctatataaatatgaccaagagggcataagtattctaacaggttactgcacaaatgtatactgcatttgaaatggtgagagtaaaataactccaaacatcatggctaattctcaccgaagaacatgcgaagccattaacagttctggttcacctccccacacatgtggcttcctaatccgagagacatatgcatcgaagtccccctcaacaaacctgtgaattaatgtcatagcgaagcataagaatgcgtaactcaacaatatttagatgcagagtaactaacagaataatgaggacaggtagaactaaccattcagtctctgcccgtctcttgataaattcatcggcgacctaacagtgacaccatttaaatagatcttttacatgataaattcaccagaaatggttgcgttgcttccagagcaacatttagtatctaagaacagaatggatcaacagtagtacatcagcagaacattacaagcataccattgctcttaagtcatcagccatctttctctggagatcatcatcaggtcgcttacctgacctaatacatgcaccatgagccacagatcggaacaagcaccttccatctccaggaatgcctgagggttaccatgtgaatcaaacacaagtgagcagacgatgcatgctttaaccaaatgcatattgtatagtaattagaaaaacacgcacactgtctcaccagtaacagaataatccgtgcaaacttttttcccatgagcataactagtggacgattcagtagtttgggggctatcagtattattgtccacaggaccctcagcatttgccttcgcaggaactgcaaaacttaggaaaagtccagtgcctgtagctccaactttgtgtcctatgcttcttgaatcccagagaatactatacaacttctgacgtgagggctcatcaagctttagctttagaatattatccctcgcaggttgtctgccacacaactgtttccccgaactggcaaaacatgttcgcagtgattttatgttcatcttaggaggcaaaccaactaatctgatctttacatgataaccgactgcttgtgaacgagaatacttccataatgccatgccctgtgtcagccctccttgtaactgacaagactgagaatacaagctataagtacagcgttgtaaacagacagtaggtgtgtagatagccatctgcttcaggcagcaccgcgccaccaagtataagctgaaaaacatgtttcgatgaccaaaattaagaattagtggaacatgagataattcttacgaaaatcaaataaagcaagccaccaccacaatgaagtagaagatccaccatgacacaacggacctatgatagatatgattgatgtcaacattagtatcaattgaagaggattaaattatttttcagcacaaaaaatagtttcatcgttgacatatccaggaaataaatgtgtggcagatagttattagtgagcataaaagactgaatgtctccaacctctagcaatcgaccactttctgctgagattcgacaaaacaatgggaaggatgggcatgctaaatcataagcgcacacttgctagaacaaaagcaatttgtcctccttttctttgtcacacttgcgtagagaatccatattatcctcgtgaacttctcaggatgtgctacagggagaaattgccctcccaaatcccgagcattcgagggcatgggcagcagcgaatcactagaaaactattctcattaagattatttaagttcctgtcttggccgcgaagccgagatttcgtgctaccaggccattcccatgcccgaattcacaagactacaaccctaagctggtggaaaataatgcattatatgcacaattgaattcagcaagtgccaatgcacccaaaccattcccctcacccgggagagcagataaattggaagatagtagtaactcaaattagtcacaaattgcagaggataatgaagtaaaatccgcaccttagccttcggactgtccgaagcgagcggagccgaggagagacgcctgcaagaatggagctgacgaaagcggaggttattggggacgggagcgtgagccgaagaggaagggatagtggtggcgggagaggctttagacctccgttcccgcgaggggattcgccggtgcacgccgccgccgccgccggcgcagagtcagtcacggccactggcgcgccgccgccgcacgcgaggaggaagacgatgagacgacgcctaatcgatatccaccgcgcatggtagatcggacggttcaggtggacccttcggatatggtagcgatcctattccgaggaggcccacacggaggcccagctttgtttggtctttggtggcccgagaagagaagaggctcgattttgttcggcgggggaaaagtctaatgtgagttctcatataggagtacatttcaagtgcaaaacttggtatatctagttatctaccactttaattattaaaatattttaaaataacccccttgactgttttgaggatagttttcagtgatttggcatctaatggcagtctagtcataagatgaaccaaaaatagatagaggattcaagtgtaagtggtacaaaagaaagtaaacaactgtggtgcccacttgtcatagcccactcttattcttctctttcttctttcttttgcagatagcagcaggaacccgacaagcggtggagacgaggctgatgagcccagcactgatgccatctccctcacttccacacccttcctctctgcctcatggagggccaccgcttgcctacctcctcttcgtgtagctacctctacctcctccgtttatcatccctcttctccataacggcagtggcggggcggcaaggtgggaagtcagagtcgatgtaggattccccaagctctgccacccttgctgttttggcctcaccggccaccgcttgttgtccacccagagctccacaccccatctccctcaacaccgatggtgatgcttagggtatcgatggggaggggatgaggtcctccaaccttgccgcttccagggctccgtcgtctctccgggtagggctcttacgaggatgcgatggcgacaataagggatcgataagggcgccgacgataaatttttatactgcaacatgctcgcctgctccatcgagatggcctcttgaatgtaccttaacgtcatctacctccttaccggcatcgagcgtctgctccgaaagcacctcgacatctgcaagcatctcaagattaccaaccaccgatcccgcaagttggggaaagaaaaaggggagaaagaaagagaggattgttgatgaggagggcagaatctccaatttatgaggattgtgctacagggaagctattcactcttttattataagcatgttttcccatattgctaaatggtatttttttttcaaaaccatctatatcgacattttttaaaaataaatcaatttttcaagtttataatatcaccaattgtgttttctgtctcggtgagttgctactacagaaactcataccattcaaagcacggatgactggtcatttcacccacaactagggctccatatcaagccagttcagctcggctcgttatcctacgagccaaaagcctcgctcagttcgaaccaacatcatttcaaagttacaaatgtttgcatacaatataagtattaaatcatcacaaatttagcaaatgcaccattaatttcatactttcatataatcatctaaagtcagtctaaatatttaggcctatgaccaagtggagtggtgtgacaatgagtggatgggggatgagttaagttgagatttacgagtaggttaaactttagttttgacttgttaacaaacccaaacaagccgagctgtgcgagctaaagtgccatcatccttttttccagccctatccacgacccatccaacctgtgcaaccttggcaccgcattctctgatgttagaaaaactatgttagagggcagtggtgtatcaattcattgtcctccgagtatggaatgctccaaaaaaaaaagccaatgatgccatcgctcgcagtcactatcatgttcgctagcgtgcgagcaaggacaacattggatttttcttgggagcgttccatatttgagaaacggtcgatcgatgggctactgacgtactctctctgttttttttaaaaaagacaacctctgtatccagattcgttgtaatatgttgtctttttttagaatgaagggagtagttttcccaacttcagaggatctggttccgtgcaacctcgtgccacaactctcaaacttgtacaggcaaccaagaacacctgtgatctacattttgagatcaggtagtatgattgatccatgaatcccattatccatcatcctcgagtgagagtccagcacgaaagctgcagctaccactccagcttatccatctcatcatccattcccctcgcaacgaactccctgcctctcgctccgatcgtccgcgccacggcggcgacacgatgaaaccccgatccaactgacaaaattcccaagcgaatcctgtgcagctcgagtagaagagaagagagagtgcttcttggcgagcgagtcaacgtcacaatggcgtccccgctgctgctgctgcttccgctcgccgtctcgtcccttctgctgccgttcgcggcggccgcgcgcgtcttctccgtcgcggactacggcgcggcgggcgacggcgcgcggtacgacacgggggccatccaggcggccgtcgacgcgtgcgcggcggcggggggcgggcgcgtcctcctcccggcgccgggggactacctgacggcgaccgtccacctccgctcgcgggtggtgctcgacgtcgcccccggggcgcggctgctgggcgggaccaggcaggcggactaccctcccgagtcccgccgctggtacgtcgtcctcgccgagaacaccaccggcgccggggtcaccggcggcggcgagatcaacggccagggcggggcattcgtggtcacccccaacccgcagaagaacatcatggtgagctggaacgccaccggcgactgcgagggcgacgagtgccgcccgcggctcgtcggattcatcgactccaaggacgtcacgatccacgacatcaccctcaaccagcctgcctactggtggtgagcatttcttgatacctcaaatccattgctcaattcgtagtagaacagccaaaacatgacaacatttcccttgtcatttcatcctaaagatgataaatccggctaatttgtactccactgccctagatatcatctgattagcaaaaattacacagcatttgtgtagtgatgaggtattcagggaaagttaacaggctatatgcacttgcattccctgcagtctgcatattgtcaggtgtgacaatacaatgatccacaatgtgtcgatatatggggattttgacactcccaacaacgacggcatcgacattgaggattcaaacaacacggccatcactcattgccacatagacaccggagacgatgcgatatgccccaaatcaaccacaggtcctgtttacaacttgacggcaacaaactgctggatacggactaaatcttgcgctatcaagtttggcagcgctagcttctttgacttcaagaagctggtatttgacaacattacaatagttgattcacatagaggacttgggatgcagattagagatggaggtactgacctgtacttgctgttgtgtgtattgccattctgtgatattaggtagtacttactattttctctagcaagctataagatttccgcagcaattaaaatatattagattgttttcacggacatttttttaggaaaactgaaccttatgctgcatttgtaccccgtgtttatatagaatttataaattgctttagcaccatgaaatttttatacagcagcgaacctatcctgtatgctgaaatatttctattgtgaattttcatcaagtaaaaactgcaccattaaggtctttggtctagaaatgagatttgctttaagcctcttctaaactggagttttcattcctgcaggaaatgtgagcgatgtggtgttctcaaacatcaaaatgagcaccaggtactaccatcctttatggtgggggagagctgaaccgatctacatcaccacatgtccaaggcacccagattccaaagaaggcaccatttcagacattcagttcatcaacatctcatcggtatcagaaaacggagtattcttggctggatcgaagcacgggctgcttcgcaacctgaagttcaagaatgtcgacctaacctacaagagatggacaaactactcgggagggctgtatgattacaggcctggatgccaaaagatggtgaagcaccgaaccggtggtatgatgctggagcacatctctggccttgagatcgacaatgtgaggatgagatggtcaagaggaagcctcaaaggctgggatgttgatcctctcctcttccagccatcgacagtcgacaagctgtcattccatgactggcaatcgctggctgtcagtaggtaatggaagagcaagcctactgaacatcacatttgtacaagtatctgtatcacaatctgagtggtgattcttttctgaaacgtgtaaataaagatcacatgaaaggcaatggtcttaccatgttgataatcatcgcttgaatggcataaggttcttaccagtcaataaaaatcctcaagtcccaactccctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 61669 - DNA, 14821 bp, Oryza sativa
atggggcgcaccgcaaggcggtgcaaggaaagcttttggctgagggagatggtgtcgaagcagcggatcgctcctgagctggagatcatccagggaaggaccttctcattggacacccttgagataactagcagttttgatgcctcccttgcctggttgaacagatcgcggagccctgaccgtgtcgatggcgcctcattgtccttgtcattgtcaaccactgaagatatgaagataaaaccctgccagaaagaaatgtgtcacagtgtgttccatgtgtagttctaattgttcaggtacactattgtcggcattgtgtacagtgtcaagtgacaaagtacctcttcagtacggctgatggcgaatcctagcctcgtgtcaccttcttcaagtggaatctccagcggcatctcttctgctatggagctgtaccaaagtcgggctgctttcaccaccccaatatctaccccatggtaatcctcaaaaccatacagggtcgcattcgtgacgttagacagatcagacaaagaacctgagttaacagttgcagacgctgtctctccagatatctgtacattttgaagtgcaaagatcacatcttaataagtagagttaaccaaatcaactcttatctggggttttatgttcatactcaggttcaatctactgaaggttcagttaagcaacaggaaatttaggctgcaaaaagcctgaagcagggagattgtatctgcaccttggtgagaagagcctcactctgcacattcatgaactcgatggggattcctgagacctgcgaggagtagatccacgcgttggcacgggcaagggtgtcctcaaaggactcgtatcgacatgaattcaggtccagagctttggggaggacgagcatcgagaggtagctgctggagttgggcatgcgcaacgagtcacgcatcttcttctcccatgggtatgcaacataaccatcctgaagttgtgccctgctcagggctgatgccactcttgtgctcctagtgccttcatgaatcaagggaaagtcacatactttccatagaaagataatccaaaaaaccacaacaaaagagattatatgtttcattacccaaaagttcacaacgaaatagattatctgtttcttacttaaaacttaaagtcagggatggaagcatctaccagttgttcagaagcgctgaattctacaggaaaacgcacatgcttgacaaagaaaagttgcaccagggcactaacagttataacttctagccaggtagatcaaaagccatatatgtccagaccagcctaatcagataagagtgcggtagttatgtcccaacagtaatgaaccaactaatcaggaggccacaaacgatgactgtttataacgactacaaagtctagtccaccatagaaattccatcttccccggggatatgagaattgagaaaacgagtgaacattacgaggtatctagaaattgatcaccatctagacaaacgaccaatctctaccaaagcaattggcctgacattgtttccgaaacgtcttccatattctcccatactttatcactattttctttccactttgcttccattatcttttgtcatgtagctatcgttcttatcattgataactacaggcagattagttttctctccgtgagagaaagacacacacttatgcaaggaaattaggcctgcaacaacgcgctgaaagatcagcttatcagaatattcttggtgggggttttgaacctcaaagagttgacagcaaacttgtctttttcacaacaggtgtaaaaacacatgtagaggccaagaaaggcacaaaatgaaaacaagattaaatgccgcatctgtcttgttgatactcctgtttcgttcgtttcactcttgtttatattttaccaacacattgaatgaacacacacaagaaaaaattctcgtaatgaaatgaacacaccgaacttctctgaaatcgatttgatcagcaaaaaggttcagttcataacaccaaggatgagctgaagcggcagaacatttctatacttgaatcaacttgaaacagtaatatattttttggttgaattcgtctggaacagcaaaattgcaaaatgcgcggcaaaacggatgaactattcagatttcagagcgatgagcagtgagcgaagtagtttaccttgcaacaagaggcactcgctttcgaggcggtcgacgaagccaagaacgtagttggggtcgtgcagggaacgcagcacgtactgcttattcccacctccgccgccgcctcctcctccgcctccgccaccgcctccgccgccgccgccgccgccggagtgagggaggatgcaggcctgcagctcgctgcctccgcggacgcgcacctcgacggaggtgtccccgcgcttgaacgcggcgtgcatcgccttgtgcagcgcggcgcgcccccccttgaacggcgcctccagcaccgcggtgccggggccggggccgccgccgcgccccacccggaccgcctccaccacgtccccttcctgcaccacccctccgccgccgccccactcctccgccttggagctccccgccacgcactccagcaccaccacctgcccccgctcccccgccgccgccgccatcttcctcctcgcgtcctcctgctccatcatcgatcgccctcgacctcgagtgatcaacctctgcaacgatcgcgtgggccaagtggggcggcgactttctctagaatactctgcgcggcctcgtgctcctcgcagactttgcgccccgcgcggccgcggcggcgcgcgcggcgagaggggggaggggttaaagaagaggagaggagaagggggcaagtcgccgtcgaggtggttgacgacgacgaccaatcgcgccgcgtcacgtttcgtttcgtttctcacctctcgcgcgcgcgagggccgctcgatccgttgctgcgtggcccacatgtcagagggagaggggggtattgcatagtactctctctatccaaaatgtcactgcatatttcaattttttttctatttttaaaaatacatagtataaacgcagtctcacacaacacgtatacaatagccctattaccacagacgtcttgctacctgggtaggctgattccaccaccacagttaagttacgctcacttcgtgcatattttatttttttagtttttttcaaatgagattaatatatttacaacatctatgttctagataattagattaaattattgatcataacttaagaaattattttaatacttattggttacatgtatgtatattattagtttcttggttttttcatatgatccacgagtgaattcctttctacttttagtaataaaagaaatacagtactcttataatttaaacttttagatggagtacagttggaattttgatggattgatgggatcggcggccgcctcgttggattatctggcctttggatttgatgtgtccacctccgaattgaatgcgattcggtgaattcctgttcacttgttcaggttgttcgtacagtgcagggcgtgttttgattactccgtttttttatggtcacgagttgattttgactcctgttcttttcctcttaccgatttaagagtaatgcttgcaaactattacgtgtatgcttgcaagcttcttaaacgttgcgagttctgcaaaaactaagtttcttataataccttttttttcttaacgaaacaaaatttcaattttaaagtactctacgttctaaaatatagaagcctaatactagattgaacacttaatccggtactataaatctagataattcgaagtaccatatgatgtctaattagttctacgtaattggggtagctaatttattcatttgtacacccttgaatattatctcaaaaaccagataatccataatcgattcagagctgattcctttgtaaatttgactactatttcctattgatcacatatgttccaaatttccaagctaagactttgttggttagatgcgattggagagctcccaaatggagtcaacttcatcagattgcccctgtggacttcccaacccaatggctatatgtataaacgatgatgaagcttggaagcaatggcatatgcagagcccgccagcggcaagcaatccaggtatcaaattgtgcgacaaattgcaaatacataggcacataagttgtactactggaagaaaaagaatcaggagctcctgatggacagaatccaggagtatatatatctaaccatctggcaactcgtatgaagaattttttgtgtacctggtaaacaagtaatataggaaaaatgtgcacgtatgaactgctggattccgtttgataaattaagccactaattaaaaaagagcgatagattcaagagcagagagacgctgactgtgcagatccaaatggcatattatacatcggagcagataccaatgacgaagatgaacagcttgaattggtcggtttcatcatagacataaataaagtatgtagcaacttgcatcgatattttttgtttacagaaacagcaggagccaggatgaagctaccaatttcgtctcttcctgctctgaaatgccgaaacaatggattggtcagcgtatcaaccaagtttttaaaagaaaaaaaaagagctgctgcacccggttaaagaaaaggggacatgaagttaactgacgttttacacgatgtgcatcttaaaagaaatactatggatatatagtatcaaagaagctgactgtatttgatccctaaaaagcggacaaactgaaaagttgcagccgatgtgttctcagatgtaatttaacgtccaaaagtctttcagtaataaagaaacaactaacaaaaagaaataaagatctagagaataaacagatatctacagtgtatctggtaacagaatactgaattacagttaatacacaaatcaaaatgaaatatagaatatcaatttgctgtatctgctgatctggcaaaggctgtcagcctatcacctagagatgtactccctccatcctaaaaaaaggcaaaccctggctatgaatctgaacatgtccagggtttgtcttttttttttgggacggagggagtattgcactaatattggctacggttctgaggactagcaacagcaaagatgatggaagaggaagacaaaagtacacagtacaaagaaaaagaatatacatggaagaaaggtgcactgaataaagtcacatatttgatagtagaataaatttaacaaaagctgtggaactgaatttagtcatgtattcagtgtacctgtaattggtaataactgcagtctaaactctacatccatctctttgtagctctgttccttgagtcttgctggctttgccgtctagtccttttaaagtctccattggtggatatacgttgcttctgtctaccgaccaaacttgtttcaacattcggatctatacggttctcttttaatggactagtcgaccgaagcttgccagctgatgagttttttgtgggaaaacatgcgctttccattgagaatctagaactacccttgtattcagagtctccagcaatgccatcatcaaccttaagatgatcatcaaggtattctcttggtgctacaggagactcagaatccgatgatgatgggctagtgctgctcatatcataaagaacattacttgacatcactggcagttcagagcagctagtacttaaattgacagaagatgttcttttagcccttgttaattcaacaaccttgagtatgaaacattgaaacaagacatgttacaactttaccagaacacacaaagaaaaatcacaagatgtaagtagcaatggaccacataccatctgctttaaagctgacatgtccttcttcagtttagatatcaccatgttttttcttttaagaatttcttgcagctctgctattctctgcatatagacagatggataacataagtatatataattcacatggttggcataccaccacgacaatttgtaccttggcatcagcagtgctagatgtatgtgcagttgcagccagttcctttatgattgcatccttctcttcgcattctttctgaaggttgtacaattcctgttctgccgccagggaacttagctggatgcaattgaccagagtgtcaccagtcagcaacatttaaagcacgagaaatgttcagattttatcaaagcactccgctccataatgaaggtaatactgaaatgttgatcaataattcgtacattgaaaaaaaaactgtacatgaacaattaacaatgatgacgttgcgcataaataagatgctttcaccacagaatggagtaggatttacctgattgtccccatttacatgattatccaccgatgacacaacactccagcaaaagtctgagaggtctgacattcggcgctcttcatggtccatatgactcacgctggacctatcaacaacatcagattttgcatcgtccattccacagatatcctgcactcgtccaccatatgaaaaggaagtgagatgaaaatacctcatggaacaagctctctgtaaagacataatacctttgtcttgtgaggagtagcagcaatctctggctttgcacacgcacagcatctagctccgtcataatctcctaccttcttgctacccaccaactcagattttccctgctccgaggaaatgaaggtgttgcacttgacatactgctgttgcagggagttcatctcgtcaaacagatcatcaagcttctgctgcatgctttgaagcacctcatcctgcataccataaacatttcttcatacgattacttaaggctgcaagaacagcatgtaaaagccgagatatcgtgcatatagcacattaccgcaaacattagaatatgcaacattcaagtggaacctaatcacctacgaggtactataataaaagtcatatacgcatagcacttggccgaaatgacaagaacacacaggcttcagtatatatgagatcactaaaatcaacaaaggggttcaacacttcaatctattaagtattagctatgtgactaataaatctgggataaggcgaaatatatgagatcagtaaaaccaaaccctaatatgaatcgatcgctggagttgctcgacgcggcgggcctcgtgggagcgggaggaggcagccgcgacggtggcgaccaggagcacgcggtggagcgggctgaagagctcccacgccaccgcctcatccggagggagccccggcgcggccgaggcggcggacgtcgcctcctcggcgccgacgaggcggccctgcagcgacacccacgcgtgccgccgcgggctcgccggctcgcggaagcggctcgtgagggcggcgcaccggcgccgcggggtggacgaagaagaggacacggacacgcgggagggtggcccgcccggcggaggggtcgcctcgccgacggcggcggcgaccatggcgacggctgacgaatcgcgtttcgaattggggattttttttttttttggtttgagcgggtgattttgacgaaagtggttttcgaaatgtgaaatactggagacatcttgtcgaaacgaaacggctgagttgtggagaccagctgttgccttgttgggctttgagaaatccagcccattttggaacgggcctcaaggcccaaacccatgtagcttcaagtgggctatagtaaaactaaccgtattgttttgcacacagttttcacccaataaagtataggaaggaaataagtctactttgcctccctcaactcataccctagttgaatcgtatccctcaaccgcaaaaccggctataacccgtcctccaactcacaaaatcgttgcaaatcaactcttcagacgatttgggaggtggtttcgtccgacgtggcatctgcaaccccgttgactagctgcgtcagcatgtggatcggaccacatatgtcagtgtcttgcagaggcggtggcggtgcctggtagtggtgcacggcggtggccatggcatgacggcgaacaaaggtgtggcggtggaaaccaagggcataggcaagaagaggggaacacgatggaccttaccgacgcaattacgacaacgagaggcgacgggagtggccggcggcgagcttcaaaaggcgacgacctcgggttgatgtcgacgacagcgctccgatgatgtccaagtgaagcagaggtgaggccgagcttctccttcgtcttgcgaacccgacagtggcgacagccacctcaggcgacgacggttgcggcggtgcggctcggctagagcggtggccttgggcgaacatagagataaagcgctcggggaggcggctagggcatgagttcaaaccagggttatatatatataggcggaggagaggaagaccggtctagaaacagatggattcagtgtggaaaactagggttcatcctgagttcgtcgggataagaatatggccaaaattcgcgggatttaacatgatattgatgaggctttcttggagagaaaaggagaggagatcgagaagaatccgtttctgcaagtaatttggaaagagaggtgatggggaggccagacttggaaggtgaggttacgctacagtgcatgggcacgaacaagagatcggctggaggaggaagaatctgggagaggtaaagtagactttttgtactacaagacactgacatattgggcccatgtgttgactcagctagtcaaggggtcaaagataccacgtcagacgaaaccgcctcccaaaccacccgaggagtcaatttgtgatggttttgtgagttggaggatgggttatatccggttttgcggttgagggatgctattcaactaatggcatgagttgagggaggtaaagtagagttattccttttcctatcatccacacgtcggcatgggggcgtgcgcgtgcaaacgagcacgcagttgatgcgtccaccgccgtcccacccctatctcgatctcacccgtgcccgccgccgctttccgctatctcgttagccgctaatcatcccttttcatccccaagtgccactgggaccatcctacttcgtctcgacaagagccaccaaagccgctttccctcggttcacatctttccttccatcctgcataccaactacagcgtgaaagaatggtaaatttgcttcatggataaatagttctttttgccaccttttctttattttggttaaggagatgagcaatgattgcattttattttgtatgcatcatgttggtaacagatattttcttttactttggtttgctatgtaatattgtgattttgggataaaaagaaatgaggtccatgaggtattgaggcagggtaaactccatccccctattcagtctaaacacccttggcgaacaagtcaaagtgatcttttactcttggcaaatacttttcgactcaatgagcctgatcaaggcggtctctagtcatggtaaacttcattcaagctattttacatagctgatgaggtgtttggtcatggaaaactgtattcgagctattttacatagccaatgaggcgtttggtcatggcaaatcacattcgagctattatatacagtcggggagattttttacttatagcagacagacacccaaggagctagccaacggaggagtgtgttcgagtcctcgcatgggaaatgtctttcacccaaggcaatagaagatcaaggaaaatgctctcaagcatagaagattccatgcggaccacttcaactactcttgcaagttggcgccaaaaatctttaggaaccacaaaaatgtaccaatatacccttagggttataagctttataggggtattatagtaactccttgtaagcatttgagggcaaatttgtaatctcatatgtatagttgagggctatataacccaaccctaaccttgtaacagaggaggaggaagaggaatacaaacttcaattcttggcatttacattcgagctcatattcaggatagacggagaatatacactttcccctctatcccaaatcttgtccgtgacctaaggtcacgacaatattgtttcctgcctacttgctactagatgatagaagtaaacattatagatatttgcatatagtttatgttgtgtgtgattgaagtagggttacactgctgcctgctaggctaggctagctaagtgcttgaatggactactgttgggctgtgatgaatagagtactctatattagtgtatttgcatcccctatcttcttatcttttctccttttcactgtatgcaaaggatgccaaaaatatgctagttggtgtggtgcatttagtacttacaatgttgatccttacctaaggcccaatataaccagtcttactagaaatgcatcgcttcaaacaaatagagagtaaactgtacctctaatgcatcattgcttaattctagaacacgaaacatatgtaatggagaggtaataatattatttgactgccttgtagcgactttctatggtttaatgattacgatcaagtcatctttagttcttcagtaatttgtgttactgcattggaagtacatttatataagatcttgttgattgttttcttgcaagagagattgtttataaaattattgtaattttaattgtattttgagtcaatcaaacttttctcaccaaacacattatctaattgatcctgatttttttagtttctgattttagggtgaattagaattagaatcaccaagaatcagaatctactcaactagcttgatgtccgttggagatgtctatccattaataattgtctaaaattgaaattagcttgttgggatgcagtgcagctaaatcatagtggttggaacaattaggtggttctgataaaaattgttaaagatttaacggtatggaatcattatatattctaacactatgttttgttatatgctcacaattagcatattgcaaattcataaggctatattaattcctataacatatggtgatggtatgatgaaaatatttaggcatctgaactttttattcgccatggttacttatctattatgtttgttgatagaggattaacaactgtccaaaatgattcaaactcattttaatgagcacaaagcgcttaaagatatagttttcttcactttgggaatgataccaacagtcgattatcctgactatacggtgtatcactggagaaatgtgaggtagacaatacattgataatttgatatgtgttgtattaataaagtatttaaatttgggtcctttactcatgatgatagtttgacacatctgaaatatgagcgaattgtgtatttctaattgttccttgggtggagtagccgaatatagctctgctattttggatgcaaatttttaagttgttggcatcaactttaaagcatcagatggctccacaatagctctatcgttggaaaaaaattaaatatcaaattgaatatgtattcgaaaaactgcatgggtcttctagtattatcaggatataacgagcagatgtaaatatcaggcattatgtaaaccataaacaagcatgatttatacagaagaagacagagcgagcccccagcgttagatcgtagtcgatttaacatcggggacacccgcgcaacagatattattgtataaagaacatgttctaggtaaacataataaattatagatctgacaatgttgtatgatctgaataggtatgataaattatagataaaatattgcgtacctttgtagatacatgctggatgtatctacgaaattagtagatcaatttgaaaaaccaatctaccaattaccttattgcgtactcgttcgacatcatatgatctgacatgttttggtacgccgcgtatcttgaggcttggatgatctcgatagaccaagttgtcgatgacgatgatggttccgatctggttaggttggatctccccacagccgaagtcgtcgagtagctggttgtcggagagtccatctcttaaacccatctcgtcgaaatcctaaagcaccaaaatccccctacctggcgcgccactgtcgacgtttgatgtcacgactacggtatttggacagtatggggatcgttggtgctaggatatacgcgagactgaggtaaaagagatggagacatggatttttatacaggttcgagcccctgagttgtcaggtaataaccctacatcctgttggccgaagccggtattgctcttattcaccataatcacaccagtacaatatgtgggtagcctatctaactgttgtcgacatggcggtctgaaggtctgactcgtagtcgacaacagggtagccttcctcctcgagctcgcgcccgacggaatcagagacagtgctagatccctacggccggcctctgaaggtaccggatagggtcgatccaggtgtatctctgatgtcgatatccggcggcttgtcttggcatatgtaggcttctatgttgattgtgttgggagttgattgtctcgtggtgggtgttgatcgtctcatgatcggtgttgatcgtccataaccctgacagtagtccccgacttcaatgcaaatgaacgaattcatattatcaatcgcgcgcagactttggagtaactattatcgagctcatgtgaacgttttcggtgagttcagagataacgttagacttcctttgtcagcctcgtgcgggcaccgaaagggtttgtctaagtcaatctttgatgtcgaccgagaaagtacatagcgtacaactaagtctcccgtcttgctgtaatcgagaatttgaattgaagtcaagaaattttatctcggcgggtacaccatgtctttattccgtattccttgtcgagatccagcaaccgttctcgagcgatcaagaaggcgtagagtctgcgacggagctttgtcgacatttgtcgtactcgccttagtcgatcttggtgtagaaccacagagacatggagtcttcaacaatgtcgaatagaattttcctgaaatcaatactcagaaaagaatattagatagaaatagcccccgagcgaacgctcaaaaggtgacaatgttataatatgtatggtaaattgaaaatgaattaaatttaccgaccaatgttttgtgtatgagggtcttctctcttaccgacttcgatcagtcagtttgtagagtcatacactctccctagcccccagccttgtcgtcggagaatcgttctcggaggataaggctcttggacccttgacctgccttggttgaataagcactgatcctagcccccagccgtgaagttggaaaagtcaatttctgattacacggccagatcttacatggccttttgtctctacaggatccgacaaggccttatcggctctgggcgtccccagccgaagatcccttaggttcctcggaggccttgtcaagacggcgtaaagggacagtaggataggtttcaatgctaggtgtcgtcgtggtaagggatctctgggtaaaacacttggcgatattgtgtacctactatcaactttgttgaagtagaggtagtaggagaaatcgctacaccgctggtcgaggaccaggtagtagtcgtaactcgaccacttaaagtggaaatagtgggagaatcgctacaccgctggtcgaggaccagggagtagtcgtaactcgaccacttgaagtggaaatagtgggagaaacgctacatcgctggtcgaggaccaggcagtagtcgtaacttgaccacttgaagtggaaatagtgggagaaacgctacatcgctagtcgaggaccaggcagtagtcgtaactcgaccacttaaaatggaagtagtgggagaaacgctacatcgctggtcgagaaccaggcagtagtcgtaactcgaccacttaaagtggaaatagtgggagaatcgttacaccgctggtcgaggaccagggagtagtcgtaactcgaccacttgaagtgaaaatagtgggagaaacgctacatcgctggtcgaggaccaggcagtagtcataacttgaccacttgaagtggaagtagtgggagagacgctacatcgttggtcgaggaccaggcagtagtcgtaactcgaccactgaaagtagaagtagtgggagaaacgctacatcgctggtcgaggaccaggcagtagtcgtaactcgaccacttaaagtggggcgagagagatcactacgttttactggttcaagaaccaggagtaggaatctcttaatcacctaaaggggcgctaaagttggtttattacatgtgcatatcatgtggccagcatgacgtacatacccaacttatagcatattcggatgtccgctcgcaatcatgtcgggtgatcaagccgacgacgttcacgaggaattatccgttaacaaccttttctcgagtagtccagcgatggccggtgctatgagataggtcgtcggtcttcgttggtaggttgggtgcgataactccgcatttgtcgagaatgttctcggtaatggagtgtactcgaccatcacctactcgagtgctcaactgttcctgaaaaatattttctagaaggcaagatatatagcagataatatcgaatatgtattcgaaaaactgcatgggtcttctagtattatcaggatataacgagcagatgtaaatatcaggcattatgtaaaccataaacaagcatatttatacagaagaagacagagcgagcccccagcgttagatcgtagtcgatttaacatcggggacacccgcgcaacagatattattgtataaagaacatgctctaggtaaacat

SEQ ID NO: 61670 - DNA, 1477 bp, Oryza sativa
ttggacagtatggggatcgttggtgctaggatatacgcgagactgaggtaaaagagatggagacatggatttttatacaggttcgagcccctgagttgtcaggtaataaccctacatcctgttggccgaagctggtattgctcttattcaccataatcacaccagtacaatatgtgggtagcctatctaactgttgtcgatatggcggtctgaaggtctgactcgtagtcgacaacagggtagccttcctcctcgagctcgcgcccgacggaatcagagacagtgctagatccctacggccagcctctgaaggtaccggatagggtcgatccaagcgtatctctgatgtcgatatccggcggcttgtcttggcgtatgtaggcttctatgttgattgtgttgggagttgattgtctcgtggtgggtgttgatcgtctcatgattggtgttgatcatctcatggtgggggtcgatcgtgttgatcctccatggtgggtgtgtgtccccctgtcctcctaggggggcttgtatttatacccataggtgtccccttgtccaagtagaactagggaaaccaatatggatacaattcaagtagtccttgtcgtttccatgtagaactctggttgtctttccttatccggaactccctcctatatccgtaggttgtttccgtataggacatggtatgtggtgggtcctgccgagatttagtcaactactattaggtatgtggtatccataaccctgacagggctgaactgccaatttgtttttcaatgtcaatacaagtcagtagcctttgatagtcttcagtctcaagcttatgtataatccaccaaatatttttattaatcatgagttagtttctaccacatcaatacaagtctcactatgtttgatttcttgtgtttatagaaaataaattgggattctgatgggagttaggtttggtagttaagttgggataaaactgatgaactcagctttgagccggttcaaatttaatttatattcaaatgactgaatctgcatggaatggttgattttactctgctttatccttgattctctctttattgagtagacaaagctccaagatttccatttcaaactaaagatattccatcagtttaaatcttcaagaaattgtgtattttatgcaaactaattttaccagtttaatattctaaagcatcaattatacttttatttgatcgtggtgtattttgtacttgtggtgtatacacattactaattctttctgtttagtctgtactttttcttagttttggttttgggcaagttctcagtgaagtacgatgatgatttaatgatactagaaagcgtgacatcacctttatatcctgctagcaatatacaacctttaaagttatactgataatatttagatgaaatataacattttaaactactactccctccgttttttaatagatggcgccgttgacttttt

SEQ ID NO: 61671 - DNA, 1923 bp, Oryza sativa
ttttcagaattagctgcatcacatgcggatatcaacttccttccaccgttagaagctcggtttttctttgaaggggctccaactgcatggcaagcaaatgttttaaaatgcaaagaaccaaatacagccattgctacatcctaatcagtatcataacttcaccagatatacagcattaaatagtaaataagaaacggttatgcacataaagaatgttgtttggttcttttcgcgataagaggtggaagaattaagctcaaattgaaaatctactccttaaaagaaagagttggtgacagtgatcttgtgctttatgcttatcttctgtggatggatccatgtagacatgtgtgcattatttgcaggatattttttacagaaaaatatatcatgtttacatgtatatatgtcaatagctggctggtagattttgtttcgtttatatttaaatatttgttttggaatttcaagattagaaaatgacataaatttatttcaaaactgttccagcacatgggcactacaccaatatagtaaattaaacaaacaatttacgtgtaggaatagattaatagtcaacaacttaaacaaggacaaaatgtatttgtttattctagaagcatgtatcatttcacaatatgttattgcaagtttcgaaccatgaaaatacatcttagtagttaaagaaaagcatctataaattatcctatacatcatatgagtaagttttgtcagtttatttgaataaatgaaagtcaaacaaccattaagcatgcctgtaccaataatttggtttagaagaaattgattttgcattaacatacacatcatgtacacttgaaaaatagaactttaccagacttcttcttcttggcagaagaagtaataagatcattcactttcttttcagaagctgccgcctgagctgctcttctgggttgcctactagttttagtactggcaggatccccaagtgcatttttcgtagcaccctttttccgtgtctgcattgttgattacactgaatatctccaaaccatctggatcatatgtagaatgcagacaaccactgaccaatctattcagattaaccgtgcaatttccttcagaatgaaaatagcactgcaaagctaaaataagtgaatgtgaggaataagttcacagggaatgcaaagaatgcagttcaaacttaactctagactgccctaacattggaaatttcaaatttcagatgataacagttgacaacaattgcataagaaagcacataatcagatgccgagccatatctagtcatgtgaagacaaaaccttgatatcaccaaattacagaagagtttagtacatcaatgtacctcaaatagatccccaaaaacacagattaaatgaacgcaacaaagcttcataatatgttgcatcatatggtgaaggcacggagcttatttggacacaatagttatgtgtatggagctcatacgcacacttcagatttagtactagcactcttatcctgtttttttcgatttacccacagaaccaaaacccccaaatttttaccgggaacatgacttcaaaaacccccccaattttttaccaggaacatgatttcgaaaaaccccttcgctcttcctgtttgcatttcaaaaacttcaagcagtggcgctcgactttgggattcactccccccatgcgacacagaacaaatcacggatccacgcgaaggagaaatcagtcagaaagaccgcgcccaatcatccaggaggacacggcaagcaaacccccccccccccaacgaagcaaccagtggcacgcacgcacgcacgcgcgcccaagcaagcaagccagaaaatccacactccacagtgagaagatggaggaaggagaaaccccctacctcgtgcgccttccccgcgcgcgcggcgca

SEQ ID NO: 61672 - DNA, 5347 bp, Oryza sativa
tcatgttttgtaagctatatatattttggtaatgcaccacatgtagaactttacggctatgtggatttattctctttgaattatataatttcaataataaaaacaaaattatagtatgtcatatggttttcattgttccattgacactcttgtttgtaatatgaaataagttaatgcaataacttttaaattagctttgtagaactttacaataactcaccaacttgctctacttgtggtgagggactgatctattttatatttttgtaaaataataataataataataataataataataaagtcgtgttgctacacctaagccgatgtagaaggaattctcatatcatcaactatttgctgcttcctccaaactgactaaagaagcagaagctgaaagaaggagaaggcatctgttgccaacaaaattttccagagaagggaaacatgttgttatgatcttccttgtatgcttttgcgctggacttgtgcctaggtatatgtatgcctggagacaagccaaaactctgaactccactcatgaatatatgtcacgtagtataaccatataccccacatgctgcaagttcttccaataacttgtaaataatcctatcaaccatccaaaagtagaatttaatcaattagaagaatataatcatttgtcagtctatatccaaattaaataaccaacttaaaactatcgactattcatagcatcaacaacatctccatgtctgtcaacaaaacaccgtccattatccaattccgcattagaattagggtgatcattttagactaaagccatcatgttatagattagaaataaataatctatgattctcacacattcaagccatgagctagaggcctgttcttgtgccgctggtgatctcttgctgcctaggtagtgtactttgctagctacctctttggtggtcccacattgggaacggtataattggtggttgagctcagtttgtaacagtccaccctctagaacaacgtagccagcccatctgacgggtgggcctacttatacatactacccatttacactttcaccatcgcttcatgtaaaagggattatccgggagtgatatgtttggaggaacaagtcgttataagttggttccattcttgctaaactagtgaggtggtattaaacatgagcacatagctctcatgggccacaaatgcctcatcctaattgagccaggatgtcacagttcaaccttagtacaaccgttcctagttgatttctttcttttagtttgagaaagagtggtgaaagccattttgtaaataggaagcaagtaagcaactaggcaaaagcaaaaagagagacatggagaacggaggctcagagcagctacacataaaactaatgatgatcttgtttgagtttcaagttggtcggtctgccaccaccaactccctcaaactataacacgtggaactcacatgtccatccctctcgaaaccaaatactttttaagggaggaagttatgcattaatgatttagttgagtccatttcaaatcttttatagctgagatataaaaagatgaaaaaaaaacatataatttaattctaaattaggctctaaactgaaaatagatttctttttttgcaatgtggcgatgtgattttctaaattctgtaacaacgtacatgcattttgctagcaacgaaaataaaacaagaaccagccagcaaccaaacttggtgatgatttcagttgacaacttcaattctgttctcctctcatcgatccctccagcacattgcacttgtccctccagccatgctgagaattgtatatctcacttaccacttgtcgttcgagcttgatgttcctgtttgaaatgccgtaccaatttctcctaagatcctccaggtaatgcggtgctggtttgtcttcttttcctccatgcatcccattctcacaaaacaaaacaagattgaaccccaatgaagctcagttgaagctgtatccacattatctactccttatgtcttgattcctctcccattcttttgtaatggttcaacagttcaatttctgcatggtatctgcttcaactttggtgcttgcaggtgtagaaaaaggaagaaaacaagtggttgtggtaaaaatcaaagcgaagtgtttggttatttataactgatgaaaaactttttcccccctgtaactacttccctttcaatacatatataaatgctagggaacatatcatgtgcacaaagtcttttcatgtacatactatgcacaccaactaacaaattttaccaaaaaaatctagaaaaatttgtacaagtacttccaataataatacacttatgtgaagtcttaatctcaaattcattatattttagtcataaaaaaagataagaattctgagttttgagagtataaatctgttataataaatttgaagatgggacttaagatataaatttaatactattaaaagtacatgtataatttttatagaatttttgttgatattttctagttactatgcatagtgtatacatgaaaagacttgtgtgcatatgatacgttccctaattgctaggcataagctatcatattttttgtaaagaaagagtcatgtggtcaccttctacattatattcatataagtggaaacccttatggcacctgttcctttgatataaaagagctataatattagtttgcagttttcatgcaaatagaaaattatttaaaacttacagctctgttcaaaacttatgaaaattaggtgcatcccttgtgtgtttctgtggttgtgtgtcttcttttgaattacactgaactaaatggtgatgatcattgaacccttgcgctttcattctgactttatacaaaaggatcaaccggaaagagttgtatagttaaaatgcattggttaatatgcagtctcaagctatctatgcaatcactgcatctgaggagactaatccatcaatactcattaggccgtggtgttaaattgagtctcctcttatccttctcgatgcatctcattcctacactacgacattcacgttaacttctatcctcatgtgctttaagctgatgcaatggtgtgctaccacctctagcttctggttgcactattaatgatgcatgggaaggaatacatagtggtttagaccataggagtttgctagcgatctactcctttatatgatatatatgttggttggagtcttggagcattgtgcaaagtttctattgacagatttccaaccaacccaagcatgcatcgatgaaattgacaatgtaatcactaaagccgttgatgaaagctcactagtataacagcgcactccgtacgtatatcatctaattggagcactgtatatgccttatgaaaccgaaggcattattactgaccatattgatgaaagatttctagctaatatatactttctctgtttcaaaatgtaaggatttctaggatttaaattttgtaccacgatgtaaggagatccctacactgattcccactattcaaataacttcaatggatgaatccagagccaaccaaatgctttgaaagggaatctaatccattcaaaattcaaaaaataacaattaaagtaactaaagagtaatcttttggcctaaccatagtacttgctaaacaaccaagaaattcttatattttggaaaggagggagtatatgatagtacaaacttgttatcatatcaatcactttcactatttttttaaccaattatcatacatttttaaattttgtaaaacttactttcgctgtagcattgatcatacaactattccaacatttttgttcaactagctaggattagtgtacaacaatatctgctggacaatttattcacattgctgataatccatggcaaatgcaaggaattgcaagtatgaacatacccagcatgcatggtagattggtagttggatccatctaacctgcagaatgatcatggggctgtctgatcccctaatttcctcccaaatgcatccatgcaaatattactggatcacaaaaattatctgcatctcccaggattcatcagtcctgttagtttctccaaatcatatgaggaggctgctggggttaaaatgttgggtgtagagatttttgctgattttaaaatgatgttcatcccatgcaaatgttgcatacatttcctgatttctctgtagcttgttcagcacaacggacagatatcctatacacaccgccgcattcggtttgttgatctatcatcaggtgagtttgatcaaccatgcattatgctcacttagtcacttggatcctcgtagcagaaagccaaagcttctgcgttgagaaaaacccctatatcttctcctaatgcatcccattctaattaagatcacgagattgtggtaacatttgtgctgcagcctgcagcgtgaggggaaaagaaattgatttgatagttgtggtttttgagatccatgtgcaccttataagcttacattatcttgcactgtgttagtcaatactgccaaatatgcactcctgctttttgtaccgaggctcaccagtgagagggtaagaaatctggaaatggaggtatttttggcatatgagagccttaactccagaagcgatcctccaatactctctactggtagtacaagtagaaatgatgtaaactatttgatattaagggtaaattagtaatttactaatacaatgaagctagatcgatattaaaatgactaactttgtctttttttttccggctagattgatttgtggtcattcattatgctggcatcactcatatatccatcaaaaaagccaaaaaagtaggaaaacaaatgtttagttactgctaatgacgattatgcccctcagcacctattattttggaaaatatatgtctctccatgtttctactaacgctaactaggatggtagtaaaaatagatgcaaacccttcgatcaaatgagatcagtgattcagattgctttctactacaccatagtgggctataactccagcattttttggcaaggtatgcagtgaaattgtagcactatcactgtacctcaaatggatgtattgaattccatccatcgcttgataaaaacaaattaaggaactactcctataccattgtgttaaaatattgaatatatgatgagtaaactgcattttacacattgtacactgctttgcaccatatttagcagatttaatttcactctgcagcagagtatgccaaattcagtttattctagcgtacatcaacaattgcctatagaaatctcaattgcagccagcgcactttttgtttaaagtaggtgtaacatc

SEQ ID NO: 61673 - DNA, 5186 bp, Oryza sativa
tgagtcaacaatacctcttaatcactatgccttttacttcatagttttaattaacgatgaaaattgctatggaaattcctgacagaccgagcgttctttccttgtaagttgtaccgtttccattttttgcaatacatgagatttgatttctctaatttcttttagcattgttttgatatcaacaagttaaattgataaatactaaaaatcatcgatcggccaagcgtcctttccaaagagatgttacgattccaaccgttcccatccttatatagttacaattaaccctggtcactgttaatacaaactttggtagtatttgatggattacgtcaagagtaccttagtttctattttcagatctacaagactagaaaggagaacttgtggtgattctaccaagaggctggtacgtagttccctttccaaatcacacatcacaattttattgataattaaacattgtctctgctccttggcgaactaagacggcatcttctttttttattttttttagaatggttatttttatccgatctactcagattatcactgtaaccacgagaatgcacgccctctcataactaagacggtatacaccttcatttcgtttgaactagaaacgaggctagttatcttttagtggctcgtcgaggaagtcatctagagcccatgaaaatactattacagcgggctaacctatggagtcatcaaataatgctgttcatgcgacatggccacaattctgccgtgtcctcggctgctcggccatgggtctacccttggagccaagctgctatgctcttgttctactgcagtactgcctctcttggaaaaactcttgctttctgaatgcttcccattcttatagaattcagcagcactttgttttgcaattttgtgtatcgtaaacacaacaattttcgcgcatataacttttgcttagtaaagtggtgttggattgaggatcaggatagaacatgagatgcagcgggagtttttatgggtatgtgtcgctattttattctgtgtgtgctggtgctacctaaaagtatattattattattattattattattattattattattattattattatattgttatttcttttggttttgtcattagggaaaattccagatttcttaattagtgtcttacttgggtttgcttgacaagaagggtgacatatcatatatcggcaaccctccacaatgaaaagcagaaatgtgcatgcaacaccacgtggatgttggccacgttggttctaaatcctaagcatatcttggcattggtctttttttagacttacaagtcagtttatgagttaaaatatctaagcctaaataaataataattttttgtttgtctttcctaaaaccataagccacttttatactattaagctaaaagctagctaggttgaagaagtttttttttacttacaagagaaagaagtatgactccactcttaaaattaggactttaaatccaccagcttataaattatataagccaaaaaactgatttaaaaggttaagtcaataagcctaaacctaaataaagaggccatggccagcactaaggatattaattgccaacctagatgtgtgtgcacttgtacaagctagtactaccttcattttgaaatgtataatattaacttttggacatgacatttgattatttatcttattaaaaaattaggtaagtaatgttgtaacttgtttaatcactaaagttacttaaatataacttatatttttacatatatgtactaaaattatttttaataagacgaattgtcaaacatcaactccataaattaatagtgtgatactttaaaaacaatgagattaatatttggaaacatattttttctacgatgtgaagttccatgttaatatacatttttcaacttactaatattttttaatccttttcacattgctgtcaaacatttatttatttttaccaaaacctgtaacacggcattacacatgatccaaaatataccacccaatgtaggatagtagcggctaacgacacaatatttatttactctcttgtgaaaccctgtcgatctttaaatgttgaaacagtgatatatctagtctcatcagtgatttgaagggcaaatctttaatgtttcttgccgttagtgatatctagatctcatcagtgatttgaacagttgtgtcattgccaataaaaaaaaatcagccagaaccttctttcacatttcccatgcaaagaaaccggaaaagaaacatatgctgctccaaattcgtctttctcattaacctagagtgagctatgttagctacctctttggttgacgagctcatgagttgaacctcacacaatgttatgggcattgggccgtaggtcaaggtttataggcagcccaaaccaatcaagttagagataagattattagttagttagtagttagagataagataggataagattaagttcttacttagggatcaagtttgtaccatctatataaggatgggattgtatctattatcaattaagcaatgaatatcaattaatctaatctctctctcccagcaatgttcttctccttagcctgaatctacatcccttctccaggagccgacgctgcccggctatcttcccggctgtagttattccgtcatggtctgaggtcatgacatctgtcctagtgtgagatgcaagtgtcgcacttcatgctgaaagaaggtcaggaatcaggaccgatcgatgctgaaacactcccggtattatcgttgtgccttttcttatcttcctcaatgcatcccatccctacaacagatcagataatagggtgtgaaccaatgaataagccacagttgcatacccatgcattttgtggtagagattactcctcgctctttaactgatgtgtggcaactgcttcaagtttagttcttgtaactgtagaaaggaagaaaacaacgaagtggcactgataaaaatgaaaggcaggtgtttagttatttataactgatatgaataagtggtaggttggtgaatgcttttttttccctgagagttatggtcaccttttacattcaccacctgttggtttgagaaatcatcaatcatatttataatttactcctctgttcaataacttatgaaatttgagacatgtccgttgtgtgtttctgcagttctggtttttttttattcacacgattcgatggtttcaagattataattatttgatactatttcgtaccaggaataaaaatttgttccagaagacaaaagacctagacatcaaacatgaattgaccacgacatgataagttgttcttatgtgtaaaccaaaatgttcatatctgtccacttctctgattgaaaacattcgcaatattgatatacttcgtccatcccaaaataaattaacttttgtatacaaatctagacataggttatgttcaaattcatatataaaagttggtgttagatttgactagttcaaggggtcaatgataatcacatatgcacatgtattgcacacattccctttttttctgaaatgattatcatgtattaccaacattattcctctttttccgtcaaaataaaaacattattcctcttttctgttatcatggcatcgtattttttccccaaattttgtcacatcctaatgacacccccctccccttatattttttgaagaggaagactttcatgattgttctgttctaatattagtctcttccttggggatcctatgtgagaaaatatagatgttttacaatggtttctctttctagtagaataagaaactctattaatcaaggtgtggaacaagttcaaatgaagtgctgtaggtgcatgagcatactgtccggaagtacttgctcattttggttttgtgagctcacagagaatctgatcatttcttcttcatcacaaatgacagaacttacaggctcttcacctctctactaaagttagtgtcggtgctgctatcttagtttctgaaaagcccacacctcagctctttcgaggaatttatatacttctactattctggctatatgtaaaagagttaatccatacagagttagaacgcacgggtttatgtgctggtgctcaaccaatctaaactctacatgtgggactattattgctcggctgggttgttacattgagtctcctctaatcctcctcgatgtacctcattcctacattatggcattcatgttcactattcacattttcacatctcctagagccattccacctttgtggtaagctgatgcactactgtataaacttctaacctctgatttctttcactactgatcgagcatgtaatggaataagagattttttacggtccttgagggaaggaggtaccatatcctgaccgtcaatttcgtgcgatccaacggcctggatggtatcggtacccgcgtctccccgagggcggtaccgaatgcatttcatgggtggaagggtaaggtggtaatttcgcaataacacccaacccagcgatctccccggctcctcgcctctctcgaacgccgatttccccttctctctcaccgacaaccgcctaagaacagatgctgccgggcgccggcttccatctcctcctttcgcgttcgagcgcggacgccgatgccgttggctgccgtctcctccgctcctccgcatcctatggcaccctccccctccccatccctagcgcctccactcctgccacctcgtcgccagatccggccgcccccgtggtcaagggcgccagatgccgacgagctccgcagggaggaccggggggagggtaaggggttgtgttggcctcggttcggtgatgctgctcctcaccaaccatatcctcagcgctaccgggactgtgcgatccgattgtccgccccctcgccttcctaggatggttgcggtgcccccatgaggccctgacccaccgagtttcttcctctggtcatagactctccacggccgagttcatcatctacgttttcccttcctcttcctgttaaggtcactaggtcagtaaaattatcccaataccacagctgtagacaagactgaaccattgggtcgattctatatggggacatttcaaattgaatgtgtaataattcttgatagtaaatgttttatgtgttaaacgtatgtgcattata

SEQ ID NO: 61674 - DNA, 6075 bp, Oryza sativa
  unsure (1)..(6075): unsure at all n locations
tcttcagttagaatttcatttgcatatcttcagttaggggactattataggacctgaaaacaggtaagcaatttggcactacacttaattagttagatttttccagctgctaatatatatcctgtgtatagatatgaattacgaattgctagctattcatttgcatgtttgcagatgaactgcacactatttgtcaattcatgtgtgtgcatggaaattgtatcttagttgaatagaacttctcttgtttattttgcactcaaggcgttcgacggaatgcccatggtataattactgactgtcttataggtatataattaacggtctcatcgtttcttggcattgtcagaaacgacatgctggcctctcaaattctagattagtttctgttctctcaataaaaatgtttcagctatgtttaggcatgagaagttttatttctgacttgtgcagtttttttctctctctgttcagcagaaaaggaaaggcatgcagacaatccattgtggcacaggctcacagctgatcctagatgatcaaaattgaagaatatttgcatgtggccagtaactctcttttgtatgcttatctgaggcttaggcctgtcagtatgtaacattatgtaatttgaaactatgtaatctcagtacataattgatctgtacttgtcgtgttgtttagtcttggagttggttgtgttattttgtgtctggatgtgattatgactttatgactgattgcttataaactacctgtcgtgaatgttcacaagtactggcgaggttctgccaaattttttaattaaaatttgacagcttttaaccgatcatattaggaccaacgttaactaacataagcgttgatcgatgatctttcttacctaagaaacaccgatatgaactgattatctccttctattcagtattaaattcctatgcagcatgggctgcttgcatgcatttattttatggtctgtttaaaacggtattgttccatacatctgattttatgggcaaactggcaaagttaaagcaccttcgatacatcaaactaggagagatgttagaagactatcaggtccgacaagcaaaaggttacacagtaagtgcctctgtaaactagttatcaaggacctagagaatattgagaatgaagaagaagccaagaatgcgaagctggaggaaaaacggcatctcggctcattatctctagaatggtcagaggatgatggcaccaacagcagagaagattgttcaatcattcttgataaccttgagccaaattctattctgaagaacctaaagatttcaggttatgttggtgctaaaatcccatactggattgcaaaagcctcagtgaataatcttatcagcctagatttgggaggttgtaaaaattggaagaaactgccatctcttgcagaattcctactgctcaagcatcttcgattggacaaccttcagcttccttcagaattcctactgctcaaccaacttcgcgcgacggcggcggagacggcggcggcgggctcgatgcgcgacggcaaccttcagaattcctactgctcaagcatcttcgcgcgaccgcggcggcaggctcgatgcgcgacggccccggtggacggcggcggcgcgacaacctcgatgcgacggcggcgcgacggcctcgatgcgacggcggcacgatggcctcgatgggcggcggcgcgacaacctcgatgtgacggcagcgcgacgaccacgatgggcgacggcggcgcgacgatcttgatgggtgacggcggcgcgacggcctcgatgcgacgatggcacggcgcagacagccggcatggacgacctgatacagcagaaggaagagaggagagcttatttttgtttgcccgatcatacccctgttaaaccaacggttagattagattggtaccttatggtgcctcgtacctcatagtacctcgtggtatctcctcaaggatagaaaagatgctcatgaaagannnnnnnnnnnnnnnnnnnnncagtagttttctagttatctactcttggatcttatatatatgttggtaggaggtaaggagcattgtgtgaagttcatttctgtcgacatatttcaagtcataataccgaaatatttcagtacagaaaaaataaaaaaaaagcatatggtccatccagtctaggcattgatggatctgacaatgaaattactaaagatcgttaatgaaaattcattagtataatataatattacacttggtatatcatccaatggtagtaatctcccttaagaaactgaagacgtaactaataattgtactaatgaaagtttactactacctccatcccataatacacagctacctctattcaaaagctacctctgctattcaaatttaaatagcataggtagctataataatatggtagtcattataataccatcattccatcaagcattcttactattgttttacctattctttgtacatttttcaatttcaattcatagaatttattttcattatgacattgatcatacaactattccaacatttttattaaactagctagctggtgccacaatatcacttggtacaatttaatctagttactgataaatccatggagtatatgagaaattgcaactatgaacatacaggtcgttgctactctttctggtgtcttactgcataaaaggttgtgtgaggtcagtcaatgccactacgctctatggattgcgagtgatcgatgcagtctttgtttcacgtcctttttctccttcccaaatgcatcctacgcctatatttgtgatgccactggcagttgatctgcatcatctttaggtagtttgagctcgatctgatccatgtttgtgtgagttgctactagcttgtaaataaattggtatatatacaccctagatagagtcggaataaccatcagatatagatggacttgtgactttagatatgagtatttgattaaatagtgctggaatctggatgtgtggaaggtatatataggtatataggtgccctccattggaccactagtctaccataatattagaattttgaatgccaacataccgaaaaattttgatacttcaaaattaatcaacatgctgtcagcattttcttactcaaaattattaattaaggctcatacttcacctaagcagtgagcaacagtgttcatgtttctcctcagttggatgtctatatatacaacgtagccagtgctatctagtttatactacgactgcttctgatgctgaattgctcgtgctgtttttctctttggtttctctcttttcctcaacatatgtgtatcattccattcccatggcacaacatcatcattgtggttaacatgttcatgccaaatacttgctagcacacctattctctggggtcgttgctcctggaaatgattgtaatcttcgatctgaaccaaagtttatattaagtggaatacattccatgtctactaaatgcccctgctccctagtaaagatcatcgtcatttggctaccccgtttccctatgcatgcatacattccaatacgggctataacatatcattgttgatatctgtatttccttaaatcaacactctccctctgtttcatgaatttcatctgttcatgtagaaacagcaagtgaaaaggttgaaggagtgcagtggtgatgtttctaattgttcaggagatgtctaaagaggtaatgcaaattgatataaaagagtatggtacctcctctagaataataaaatcatcggtagaacaaattatgtccctccattcttgtcaggacgttgctggttgatgttgacttttagatgtcattcatcccatgcaaatgatgcacagactttccatgttgttgagctcaaggacggaaaagttacagacacacaccattgttaggaagcgataggcaaacaaacgataaagaacaatagatcaatcacagaagacatgagatttaacgtggaaaaccctcccaaaccaggagagaaaaaaccacggatgccagccagcaaaaaaatctttactatatcgagggtgaggttacaacgccgcacggcggcttacgagaggtatatatatgaggtggaaccctaaaaggtattacgatctgtaccgcggggcctccgcccccgcacccccgggcgtccccaggtgcacaacccaatgggccaacttcagcctccgcttcactagggcagaagctggcttttattaagtgcaaatgaatttggatcacaactcaacaaccatcacgttaggttctttgatatcttagaagtggatcttgttcaaccatgcaaggtactaacttggatccttggaccagcaagccagccaaatcttcgttggcctctagagaggcaagaatagagggaacaacccatgcatgtatcttctcccagtgcgttcaattccaaggtcacaagattgtggtaaaatttgtcatgcaaagagaggggataagcacttgactggatatatagttgtggttccagagatccatgtacaccttataagctgcacattttgccttccactttgctagtgaatgcagctatactttcaattaacattcactaagtcggttgtattgtcacgtggtgtggagtggccctctagtgagagggtagaaaatggaggtacggtgttagagactgttgacgtcgaatcgcgccttcacacattgagcacattatgtgcaacccgcagtggcacacccggagacgagccgcctcaaggagcggtggatgctcaaaagaacacccaggagggaccccgttagggtgaacacgcgccagtttgtcctagactccggcaggccagttaggacgtcctctaagccgtagagacgaggatgacaagcaattggggaatttgagtagaatagactttgggataggtagcaagaaggaggaagatgtagaatatagagggtttgggtaataaattgattttgataattaatttattgttgtttcaatcggttttgaccccttatatttgtaggaggggtggacttgtttctcagggtcattttcatgtccaattcggcttagaaatcaactaagattcgagaaatcctagtctcaaaaaaggaaacacgagaaatacttaattggactcggactttgtgttgaaggtctgaccacgcggacacctaaggtctgactgcagttcattgtccggtttgaccggccacacaacggaagtcagaccgatctgtttgcactctgttttccttcttaatcaaattccagcagagctcctgccgtcgttttcctaaaaaaaacaatggaagtcagaccggccttcgcgggaaagactcgatagtttccaaatttggcaagttgctataaatccaaactagtaccaaatttgagtatcaacggagactccacaccaccaagtgccaataattatggtcttccaaatgtaaatggatagtgatgactaatgagagccttcactccagaacttctattggcaggggacgtggtgaaattgcagcattatgactgtacttcaaacagagttattggttcatacaggtggataggagcagttcctttccttgcatcaagtttcagggatgctaataattattttgtaaaatgatcttttttttctatttgtaaatctagataagaacttgtgaataaaagtgatataacgagcatgcatgtccaatctccagtcccatgttggcaacttttctcaggtctacgtgaattaatctatttaatccagaatatgtgatgggttaccatgtgtatgtgcagaaggttctttcttctttgatttgtttcatctgatcagcttcctgttaattctaggatactgaactttagatatcttacatgatcaggtaggcaacaacatttcaatgatcatataagtatataactgctacgtagggacataatcttatagagggtcctcccttcatgtttgtttatctattaccggtggaggctatttttagttgttaatcatgcatggtgctcacttagatccctataccaacaatcccgagcttctacgacctct

SEQ ID NO: 61675 - DNA, 4099 bp, Oryza sativa
ctctagtaagagggtacaaaatgaaggtgtggtgttcatgagaaacttgttcacaagtgagtgtccataagttcatgctaatgtgaatggtactccctccgtcccataatataaggaataatgggtgaatgtgacacatcatagtccagattcactccagtatgatgtgtcacatctacccattatcccttacattatgggatggatggagtagtgatgattgtgtaagatcaaagtgtgttttgttccttattctgtgatgaacaattggcatctgtgattattggttttgatatttggagattatcgtcgaagtggttttggagataatcaattttcaggtgatgatcggattctgttattttatgtgtccggtccgaccgggcggaggttgccggtcagaccggcgctatgtgtgcggtcagaccggccaggcccgcggtctgaccggctaacgctgagtcggtttcggtttcggattggttctttggatatccatgattgtttcatggttatggcttctagatggatactatacgtatgtaatactgttgtttgctaacaatgagtcaagttgaggatagcttggtctcggaatatggtttctttgtttgtttcatgtgtaggtgactcgatgcctcggcagagtatttgcggtgatggaccgggagtcggcttggtggtaaaacgatgtccgtggtggtcagatatcatgcgggatactaaggctagagttgatgcacgtggttggtgaagattccatatggcatacggtggaagtattgtgtgtgtatgggatgcggagtcgaatttggaaggagtccaaatttggtacgattggttatgttaagtttgtgtcttgtactagagggtttcctaaggtgtttaggactcttagtatgagtttggttcgtggttttaggctgcctacctcatgtataaatagagggggagcgtgaggcttcccagtatcgctttttggtatcactttggagagcaattgagttgctagtttagttagggtttcgagtttagtcgaaatttttgtaaggagtgatgttgatgcactttgtgaacacatagagaatcaataaagtcgtcatctactttaagagttcttcgatttatgtttcaccgggtttcggcagtctaactggcaactcaccggcggtcagaccggcggcaagcggcggtcagaccggcgggagcacggcagtcagaccggcggcggcaacaggcgcagcaggcgacatcggcggtcagaccgggtgatctataccggtcagaccggcggcatccactcggtcagactggcagatcaatctcggtcagaccgacttctgtcgaattcgagggtaacttttatttccgctaaaagttttcggttcttgggtataccaaccattcacccccctctggttggcttagttcttgtgattcgatcctacagactgatgagtggccttcatgctagttttctgggaagggggtgtaggtgaaatcaaagcatatatactatatatgtgcctttaaaatggtgtagtaaatcccatccatcccttttttttaaagttaacccagatgaactagctagaactggcattactgcaaaaagtttatacgctggtcctcaacctatctaaactcaactctacatgtgggatattaatgcccaacgctatgctatttgccacattgagggcttatttggttcacagcattttcaaaacgtagaaatagaataaacgtagaaatactatatgaatacatgtgcagacctatggattaaaaaatacaagaatttttcctatgttgttgagcaagccaaccaaaggaatgcaaatattaggttagagtggattgttttttcctatgcttttccttcaaaaatggaggaatggaaaactttcctatagttttcctatggttcattcctatgaaacgaatggtagtttaaaacccatttttatccctatgcttttcctttgcaattcctttgaaacgaataagccctgagtctcctctaatccttctcgatgtttctcattcctacactatggtattcatgtttacttttcacagtttcacatctcctggagccacatcacctttgctgtaagctgatgcactgcttaactaaaacttcaagcctcaggttttctgttgaactactgaatatgtaagggaagaaatagatggcagtctggatcactggagtttgctggttatctactcttgggtctaatatatactccctccgtcccattttaagcacggccatgagtaactttaattgtccatcttatttaaaaaaatgaaaatattgaaaaacataagtcacgcataaaatactaatcataaaaaaattcaaataagacggatgatgaaagttgaaaaaaaaaactcatagcagcgcttaaaatgggatggagggagtaagttcgtaggagcttggagcagtcatggaggaatttgctctaagagtatggacgaactagtataacctacaaaaacctgtcttctatattctactttctttttcaaattttgaagtgtaatttcaatcgatatttgggcctaggagtagctgccctactcctatatctgcccaagtcataataccatcagtatatctttcagtacagaaaaagaaaatgcagaagttccatccaatccaggcattgatggaactggcatgtggttcaagtacagagagaaaatgttgagtaatcagttggttcaagtggaggcatgtggctgtcccctaatttcttcccagatgcatacatgcaaatattacttatttttaagataatggaatagaatatcccagcctttactcaaaacgagttacaaccaattattataaagttacactcaaaaaagagtgtagttcaacaaaacattgagaacacgcacttaaaataaaaaataatccatctaagataaggagaacacattattgaaatctatttgtgaatctccaaccataattggcaaaaagttgcataactattgtctcaagcctacggcatgcaaccttcataaactcgtcatcttcatcataactttgtagctgagcccaacaccgaagccaatttgttgccttgaaaattacatgtatatatgtaatagatggtgatttgtcaaaaaccaaatcattcctactcaaccacagagcccaacatattgcagagacccccacaagtataagcttactccatataagcttactcattttcttgtccaccaccaaaagctaaccataaaaaatatatgatatactactaggagggcatagaccaaaagaatattgtattgctctccatataaaccttgcataatggcaatccatgaaaagatgttgaatattctcatttttcatataaaaacaacatcttaaactaccattctaattctgtcttgctaaattgtctttggttaacacaacccctttaagtaagtaccacatgaagatcttaatcttaagcggtatcttaagcttccaaatcattttatttctctcgatatagccattattaattaaagcaagatggaatattacttgatcaagatattcagtcatctccattcttgtgcaggaggctgttggttaatgtagacttttagatatcattcatcccatgcaaacgatgcacagatttttcatattgttgaggtcaagggtgttgttgagctcaagggacagaaaggttatagatagacaccttcaccttatgttcgttgatgtgttagcaatggagcatgttcaatcatgcaaggtactaacttaactggatcgtcagagcagcatgcatgccaaagcttctttggactctagagcggcatccaatgagagaacaaccgatgtatcttctcctgatgcatcccatgcctagatcacaagatcgtggtaaaaatatgtgctgctgtgagaggggaaaagcaattgatttgatagttgtggttttagagatgatccatgtatacaccttataagctgcacattgccttccactgttgctagtaaatgcagctttatactgtcaattgtcattcactgctgccagttgtactgtggctctctagtgagagggta

SEQ ID NO: 61676 - DNA, 2167 bp, Oryza sativa
tcaggtagctgatcagcgttggcatgatcatataactgctgcattttcactgaattataagctataggactatcatgtatctgcatagggtttacgattccgagatgaccttctattccgggctttggcggtatgatagttttcgcaaaatcaggttgaaaaccggtagattttgaacaaatttcataaactaaaatttgaatacaaattccctaagtttaccagtatgctcgcaaaaaccagtcagctttagcgaaattccgagcgaaatcaggtgtagaactacatcccctctctattctattatctgggctaaatactaagtgggcttactgcatggaattcggcccaggaaagtgttttccttttttttaaattgttattctttttctttcctactataaagtttaagaaatacaccgaatacaccaattttttgaaaaatttatacccaaataggttctataaatatcatactatttatagggttttattttttttcctttttatcaattcaaatttaaatttggatgaaacccatcaaaattctaaacggcttctactttcgggctacgtcaaaacctcggtttttcgtggaattcgactggtttttgttaaaattgtgaacccttataaaaaatattatagaggattctcccttacagtttatttatctatctgttacccatgtaggctatttttagttgttaatcatgcatggtacgaataagcaagtttaatagtacagccaacggctagcttcaagtcatctataatcgatttaacagccaattcatacaatagctacctataaacatatactatattactattaatatctggtcacacttatcatacacatattgtgtcttggagtccgtactgcggctggctataaatctatagtccgctgttctctctctctcatctttttatcttcacaaaatattcttatatctagcttatagcatgttattgtacctgctcttagattctagtaccaacaatccggagcttcggtggccttctataggggaatgagtggggagaacaatatacatatcttcatggtagaagttactaccacatctaatttcatacatgacatatactattaaattaattaagaggtaacatgtgtaataggttgcctctaccacacaatctccaatatctctaacactctcacatatttattaaagtttgtgtaggggttgctccttgcataagagcaagtttaatagtatagccaaatgttagctccaaattatctatagctaatctaataatccattcatataatagttacctataaaaacatactacaccattaatacccggtctcacctctcatacgcacacaacaacttagagtctgtgttgcacctggctacaaatctgtagcccactttcttctctctctcttctcttttcttctcgatatgtggttatagctcgcttatagcctgctattatacttgctctgagaagtgaatatttcgctcttatctttcttatctcctccacctcatcatttagtactactatgtatttcctccgtcccaaattataaggcctatatattttatacattcttcaatgacatactttgaccatcaatttatcccatgttatgtttccgataaatataaaattagtatcacgtgaaagtactttaaaacataaatataaatctagtgatataatatacataatatttattagtcaaaagttatcaggtttaatttttcttaaaaagaaggtgctatacaaattaggacggagccagtagcatcttgtggctcgtacttggatggctatagtacctgccgtattccgagatcactatgattgtacaaacaccggcatgcacccacctggcatttgctggcgcaacggaggtcatgcaggtgcaggcgcctcgagttccggcgcccacttcgcccgcaccaatggcggccaccccccattcctcgcccaaggccatgcgcgcccgccgtgccacagcctccctcctctctccctccctcccacccccgcgtctcctctcctccccacccgccccgcatctctccatcggccggatcggcaggagagcgcggccgtacgcacgtacgccgtccccgcggtttcttcccccccggcgcccagcccgcccgccgggcgg

SEQ ID NO: 61677 - DNA, 3552 bp, Oryza sativa
tgcagccctggaaggctgtaaccatgaaagaaaaacaaacaaacacgcaacctaggagaaggtctagcaccaagccagccgccgctaagcgagatcgaacgccgctagaattttttttgttttcgttttgatttgatttccgttagaaatggcattccccccaaaatttatgaatttcgcctgctcggttttaacttgccaacaacaattattaatgtatcttgctttggagaaaattcgtagctagatagtgcatattggaggtggaatcccttgatttgatcgccattgttgtgtttgcaattattctaattagcttttttttttgttttttgctctgctaaatcaattctgcttacagtagtaggggatgggcgtgatatctcggaaggtcctgccggcgtgcgggagcctctgctatttctgccccgggttgagggcaagatcaaggcagcctgttaagaggtacaagtcgatccttgctgagatcttccccaaaacgcaggtaggttgggccccttgctgcatcccccatctctgtcttgtttgtttgttctgttcatgtgtggaagccgcattatcggactaatcgatgctccgcagcttagctaatttacttgttgttgctgctcgtatgttatcatgatgtaggatgaagaaccgaatgagagaaggatcgggaagttgtgcgagtattgctcgaggaaccctctccgagtgcccaaggttcacgccctctaccttcttgtggagctaaaaatgtttctgtcaatagtcagattgttcctgtcatgctcttgttgttgttagtcatgtattgattgacacaaattcacctcaatcttttctcaagaaaatttcaagctcagttgactccatttttttttccaaattgatgtatgagcagatcacggtttccttggagcaaaggatctacaaggaattgagaagtgaacagtatggctttgcaaaagtggtgatgctaatataccgtagattgttggtttcttgtaaagagcagatgtgagagtcttctttttccccttgttttgcccttttcctttaacgagttgtaacatgctggttctattcatcagatgttaatactatcatttggtttgctcaatgcaggccactatttgcaagtagcttattaagtattgtacacactcttttagatcaaaagaggcaggatgatatgcgcatcataggatgtgaaaccttgtttgactttgcagttaatcaggtatttccgttgcctggtgatcagtgataccattcctcaccagcagaattcttttgaaagacatgatgtatctggttcatgcttttatttccgtctattttaggtggatggtacatatcagttcaatttggaagggctagtcccaagactatgtgagctatctcaagaagtaggagaggatgagcagaccattgccctacgcgctgcagccctgcaagccctttcagctatggtaaactttactgttaagccatatcaaactttcgtcatatgcttcaacctattgttaaaatgaagaacgaatgagtaggaaggaaaacaaaagtatgggaatactgttaccagaagagattcaaatcatacttcacatataacatgtctagcactgattgcaaaaatggtgaagaagtgactaggaaggtaaaaaatgtccaactactgtgtcagaagagattcaaattacacttcacttctaagcaaacactaacacgtatgctgcaaaacacattagtttgcatctgaggtttcttgcattcctacgtgacgaatgggagctcataatcattaagcattaagtactaactacatatattattactatcaacttacttcaggaactattttgcaacataacttctagattgatacattttgttcccaccatattttttttttcgtaaaactaatctgcaacagtatagtgctttattgctttactgtaaattatctttcacaataatgatgtaaatggatgctttgttctcttttttgtctactttatttcgcttcaaatgtatgcaccaactattctaaacatttataacttagcgaaccaaatatttttgacagtgattatatcatttagtttcttatgctgtgcagatttggttcatgggagagctctcacatatttcatcggaattcgataatgtaagttatatctgattagtagttcatttccttagttttgtgcttatgtatttcataatcatcagatagcatcttactttaaattgcatacgactcaaaaatggaatatatgtaattaaaccttttagatagctggatctggataatctgtggacttggactgccataatagttaggactgtccccttgaggtggactatctaaatcctacaccagctactatggttttttaaatcttatttatttatgcatatttagccaaacatcaactagttgttgctcataagatgatcagaaatattattgaaataattatgtaactgggtgatgcatacagttttctttctgctctccattttggctaatttcaggtagtaggttgctagcacaagcatattacagttccaaatgttccatcatggttttttctttgttattttcattcttaggtggttcaagtagtacttgaaaactaccgacctcagaagatgcaaaatgatggtcaagttaccaaggattcaagcgaccagttggagcaagaagcccccaaaacggaggactccaaagcagaggactccaaaacggaggactcttccccctttgtcatctctgctgtccccttgtgggagaacatagttaatgttaagggtggagttaaccttactgtgtaatattatctctttctactctgttgatttggtttgtcaattcttctttttcagtaggtggtttctgaacatacttgtgtgatgtgcagggaggaagcaaaggatcctaagttttggtccagaatatgtgtgcacaatatggctaggctttccagggaggcaacaacattccgtcgtatcctggagtctttgtttcggtacttcggcaacaacagttcatggtcacctgaaaatggacttgctctgtgtgtattgttggacatgcaactgttagtggaaaacgcaggtgcttcatttgcatcttttccacacagatactaacattatcatatgcaaagaacctagatatttatttttgataaaatacttcctacaggacaaaacatgcacttaatgttgtctctactgataaagcatattgaacacaagaccatggtgaagcaacaggagatgcagcttagtatcgtggaggtagcagccaccctagcagaacaatccatcgctcaggcttcagcagcaactataggtgccataagtgatcttgtcaggcatttgaaaaggacatttcatattactctcggcagcaaagattcggagctagtaaaatggaatgaaaagttccgaaaggctatagatgattgtctaggacagctggcaaagaaggtatgttctttttctctccctctgcgaacttctatgttttcctat

SEQ ID NO: 61678 - DNA, 1069 bp, Oryza sativa
aaaatattgctagcactcctgttgtagctagatcaactgcagctgctgtttatcgtacagctcaaataattgcttctgttccaaatattacctatcagaataaggtatactgtcaaaactagaagatagaagactatctccttgctgcagtactttcttctgttttgaagacttatcttcttgtgtatgatgtcaggtgtttccagaagctctgtttcatcagttgctcttaacgatgatccaccctgatcatgaagctcgagtagctgcgcaccgcattttcgctattgtcttggtcccctcttccgttgccccctcgattcaagcaagtgtatcaggtcaggctaagaaacatgacatgcagaggacactctctagggctgtctcggtgttttcatcttcagctgccatctttgacaagttgaaaaaggacaagcactcagacaactcacaaggtgatagcagtggcttgcatagtatcagtgaagagtctagtaatgccaaacgttcgaacctacctgtgtctcaaagtcgccgacgtagcatgaaaattcctaatttttccatgaagaggggtccttcaatggctatgagagctccttcagtagccctgagagccccttccatatctctcagagttacttcgatgtctttgagagcaccttccatgtctataaaggcagaccatggttcctcaagccatccagaagatgaaatggtaccttaatcaaatatggcttgttcttaaactctatatgtattaactaaaatcacataattgtttctgcattatcttgaatgcactcaggaatcagttttgctgaagctgagcagtcgccagatcacacttttgctttcatccatttgggctcaagcaacatctcctgaaaatactccagcaaactatgaagccattgctcacacttatagtttgcttctattgttctctggagccaaggtaatcctccttattattacatctatgatctatcatacgcgttattgatgatcatcctaactaaaccctactatcaggggctagtattgattaatttttgccaagcttgag

SEQ ID NO: 61679 - DNA, 6799 bp, Oryza sativa
atctcaaagagaccgtaccctatcctcgcagataacctagcaggaacagaggagaaactgttgttccttgtgattgttgatgtgttatccataattcctgagcccatgagctaaactcctgaaagaacgctgaaaatgaataccatagcattccattgctcaacaatctcctttaggatactgaagaatctcctttaggatactgaagatggcgcacaaagcagcgaaagcaagcgtatacagcatgttatccctggtgaatatagcctgtgcagtttcaatgtgttagtacaatataaaagatggaatgatattgtgctatattattaatgcagtatcagtaacaaaaccatggcagagaaagttaatggttccctgaaagagggagataattgtatagcaaagatgatgtgttcatcccattggcagtagccagcaggttttcaatttcgatctcggccatttcaatacatttttggatttttaaaaaaaattaactaaatttgattaatttttttatcaaaatcataaaaaattgagaaaaccccaaaaaaaacggctgagataatcatttgcccgggagggggggggcgaaatttcatcttactgcagcgagggaccttattgtcatactgtttgatatataaaccaacaccaagttttgggaaagcaaaaaataacattgtgttcttgttagtcagcacatttaccacatattataatacaagttacaacgatgcagattaatactttataaatattcccgtataggctgctcaacattttcagattgtaatgatatacaaccagaataataatttgttctaacggccttcaatgaggattggtaacacaattcagcataacagagagtaaaactcgcaaaatgcaccaatgctgtacgcgttcatatggatatgagaattgtaaacacggtgaagagaaacctaaacattccagagcacataaattaaggttcgctaattcaaaatttggattttttaagacataagttgaggttgaggataagacagcagttcttgctgccataatgcaaaattctttctcagctctttgctgcaaaatttctaagcttctatcttctcagcaggtgcctcgatcacgagcccctttggcctagccaagaggtccgtgtactcctggaacggcgtcttgataaacctggtctctctccagaagtcaggagtcaggaacccataggtcttcatgagacaatcgaaggtggcctgtcaagaacaaaaagttcaggttatatcaattgaggcactattcttgacatgtaaaccgaaacatttgaaatgtaatggtgtacatgaaattagaatgctatctaagagtctcatgggttcaccaattgaaatgcttgaaatgtaaatggaaacatatcatgtttgattgctgcaagtatgatagctattttcagcaagctacagcatgtacacatgaatagaaacagcgacaacatttaaagccgcagaacaattcatgactactaacaatcatccaaatgatcctcagtaaacaaagcagtttactgtttgcacactatgcaatgataaaccatatttctctactgatacagaacaatacagaacatccgaaagggaagcgatgctatgacaaaaccctagattcctaaaatcctagtcaacagaacttaacaaaggatgtatactagtacttaaacaggacaatgtagtcaatattattacaatcgaaatgcatagcaacactaagcacaacagcacggatgtcaaacaacaatactaagcacaactgaattgtgtgataaggtcggacatgtcaaaatactactacgataatacaggcataacaaaatggtggaaatgagactatctagctacacatgtcctcaatcacaatcagtcaagtcattctacacagatgtcctccatcacaatcagtcaagccatttctgttacattcaaatctagcactatcagcaaacatttttcatttacagagaaagaattctaagataagcgagcatttctagggaggaattcaagataccttgacgaagttgccgagggtcttggtggagccgcgcgacgaggtgaagacgtcctcgatgccggcgaactggagcaccttcttgggcacgtgcgccgccacgatcccggaccccctgggcgccggcaccatgcgcacggtgacggagccgcacttgccggtgaccttgcacggcacggtgtgcggcttcccgatcttgttcccccagtaccccctcctcacgggcacgacggagagcttggcgaggatgatggcgccgcggatcgccgttgcgacctccttggcgcacttgacgccgagcccgacgtggccgtcgccgtcgccgacgacgacgaacgccttgaaccgcgtgcgctgcccggcgcgcgtttgcttctgcaccggcgtgatcttcatcacctcgtccttgaggcccggcacgagctgctccacgatctggtgctccttgacggggagggagtggaggtagatctcctcgatcttgtggatcttgttctccttcacgaggcgccccagcttggtcacgggcacccacttctcctcctcctggcgggggccgcgccgcccgccgcgcccgcccttgccgcggtcgccgcgcccgccgcggccgaacccgcgcccgaacccgccgcgctcgccgcccctctcgccgccgccgccgcgctcggccatgcttgcttgtgctcggatcgccggggcgtggagatgcggcggcgtgaagggtgggagagcggaggggaggagggaggatggcggcggcggcggatttttatataaggtggccgtggagacgacggggttagggttttcgctgagaagttgggccaagccgtgggcctaattgggccgtagtttttgggctcataggtagatggttatgggcctaaggagcctaaagtgtggtgtgttgggcttgtggtgggtaagacttgggctgtgatgtctagtgttctgcaagtggaaaaggttcacttgaggtcactcatcctgtcatcgagtttcaaaaccgtccctggaccggaatgcttgcatacctaatcttgtaaaaccgagtcacattagatcccaaggtagtactgagaacagttttggctaacgtgcggttaagtcagcgtgggacctacatgtcagtggcccaatcttcttattatacctccccccctcctctcttcccatctctagtgccctccatatggaagcttctacgtgcggtgtcggtggcatgcggcgtgcagtttgagtggcgctgcaactctccctaccgaccccctatgtctaggaccttggcatcccgtacacattcgccagcctcggtcgtcagcaccccttcattatcgccgccattgttctcatcgtcagattctccactgacctcgttcgaatcttcggcgactccatcaccctgtgctctacccgcctcgatgccatcattgtctacctcatcagcttctggctccttgacatcggcaacaatgctacataaggaccctgcatggccttcctcgccaacctcatcaccatcttcatctgcctttgacccctccacgttggtcatcacctagtggtcgatgccgcctaggttcatcggtggcagggaggaagcctaatagtcggcggagggtagggctgtcaaaaaagctcgaggctcgcaagctgctcgagcttggctcgtcctaggctcgagctccagatgagccgagcctgatcctttccctaagctcgcgagctttgtcgagccgagctcgagcttccaacgagcatagtaatacataatttttgttgttatttataaattagaagatctaataagttatttgtatgccttatattgacattatatatttattttttttttcctcttctactaatatgatgaactagaaattaattattttttaaagattatctttgaaatatatattgttttacttaaaaatcaagctcggtagttaagctcgagcttggtcgagctcgagccgagcctgtcagaaagctcgaacattttataggctcagctcgagtttgtatcgagctcgagcctagacagacgagctcgctcgagctcggctcgtcgacagccctagcggaggggcgctcgcgcctccaaggtgtccgtcaggaacgagaaaccaacgaagcaatacgctgtggtgtttaacaccgacaatgacatcggcatcaagcaagttcctggcttcatcttcgagtgcgatgaccagaactccggaccattcggccagaccgacatgctcttaggactcgggcgcgagaagttgtcgttgcgcctttcatgttcgactattgcccatcaccggccacatggaggccaggagagagatgggaagagaagggagatagatgtggaagaagattgggccactggtacgtgggtctcacgctgactcagccgccacatcagccaaaactgttcttaatactgtcttgggacccactgtgatccggttttacaagactatgcattttgggtcagggacgaatttgaaactagaggacaagatgagggatctcaagtaaactttttccttctgcaagttgtccatgcagcgcaactgggaatgatgctactcggctgcattggggcccacatcacaagccctatgcaagatgaacttcaaatggaatgaagctaatggttatctttcaccgctcttctaaaggctttttgaacacatgaattttattttataggaaccaaatcatctccataggaataagaaaagaatatgcattaaatacaaacgaaatataataagataatgtaagtatattattcgttgccataatagactggtgttaagttgtaggaaacagaagatgagagttaaaagagaagcgtgtgctacatatatataatccgccacaacatgggttttaacaagatgctaatagtgttagtatatatttattgctaactataatacgggatctgtaaaagtggttctacatatatatttatatatttattggtaattattatacgggtaaactgtaaaagtggttgtgcatgatgtgttaattgttatagttagcccttgctgtaaaggagcccaagaggcaaaacgtatcatccaaagtccgttgtattcatacaaaaggattgtctcactttgaccatatgttggtgggatcctttagaacacatgagaatttacattggtcagttaactttcctcaaaattctcgtgatattcctttataccactaaaaaaacatctcctttgttcaggcagactaaaaataattcctaagaaagccgcgcatagtacaaaggaaattgaagagttggttcgaataaatagtcgggtgtgtgaaaatgaattttcgcagacgggcctaggtcccgtatgcaatttttttcacccatcttaattttcccttctctctctgtctccatattaacattttctctcagtttattctcctcacctttcctcccactctcacacctcccccttactttcacacccaacgggagaggccatccagtgagcaacgacgacgattggccggcggacgacgacaatgatgaggagaggcgtggtaggcggacgacgacgggggtggctgtcacgcccagaaattcccgaatagaattccaagcagaatgtgcattaaaatccccgtccaggaccgaccggggtacacaaacgacaatgttgacattcagacccacgtcttacaaacatcataaaagtcttacataaatgcagcggaaaagcgaaagacaacaggagctaagccttgactagaactgcagcgggaacaccactccacaggcatcctcgacggtacggacgaagcctactcctcggagaaacctccatctgacacatactcgtactctggggttgggaaaaaaaatagagcaagactgagtactacccactgtactcagcaagtcataccggaataggggtatgatgcagggaattatcaaaggagagctagagtggttcatttgcataaagcgagcatttataaacagaagttgaaagatttaaacagttgtaataattaattaatattaactatccactatccaacgctatcccacgttgcaacaggcccaaccatccacctaaactatccaaattcaaaagattacactaggatgagactaatcacggtgaatctggttgaccgcccataaccgcgggcttggctattcgaatagttttactctgatcagaggtgtacaactgtacccacaagacacagccccacgacatgtttccgtgcgccgacatgccaccacgacataccggaaagagaccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgcgaaccggtccttaactgccatgggtgcgactagcaaaaccatgcacccacagcccaccatgtgatttattttaattaactaacacccaagcggtggcactaatccaacaataccattagaaccaacagtctaaacattaataggattttccccattgtgcactagttgaactaagcatggctaagcaat

SEQ ID NO: 61680 - DNA, 9085 bp, Oryza sativa
  unsure (1)..(9085): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatattattcacacaaatggacaactgaataacacaaaagctatcactaagaactgtacctgtttcttgcatggtgttgcagagtcacagtagttttgatcgataatgacggggttccaaacattttccatgatcatgttctggaaaacaatgtacttcgcgtacccccgaccaccctgccatgtcttgatgcgagctccgttggttgtgccatatagcctgacagtgccgatggtgacattgttgacatgagcttcagagttgtgatcgcctaggctcccgatgctgatgccgtgtcctggtccgcacaccatgttcttgacatggaggttctcagttccatcctcgatcgacatgcaatcgtccccggtcttgattgtgcagcctgtcacttgtacatttttacttctggtgatatggatgccatcggtgtttgggctagtgcctggtgctgtgattgtcaggccagagatcctaacatttgtgcaatcctccactgacatgtggatttgttggctgtttagtagcttcaagttctccactttcagatttgaacaggagtagaatgtcaaggcctgtcagataaaattaattcagattttgtcagaacaaaatacccaaggttcctgcattgggatgtgctagaagattagaaatcaaactcaccgttggagattcagtgcatgcctgaaagaaaacaaaagaaaaaaagtttcacatcagatagttccaaaaataaaatggaagactgtaaagctacataaattcagagcacttacaagtttcgcattcgttttgcaagaattttgccaccaaatcttgccatttccatcgaccgtcccaccgccagcgacagtaagaccaattacaccattgaacataatccagtgcctaatagtttccttgctccaatctgacctctttggaggagccaccaaagtaccctctatctgaaaattttcaggaacataagattttcgagtaattgaatttcacatgaaagtaaatgtaagtgcacgggtgcatctttctcaccatgaacgtgatgctggatttgcatgggccagatagtgtaatgtgcttggtgaggtatctcttgccctttggaacaagaacaatagaaggttgcaaagaggagcaagccgcagcccatgcctttgacaatgcctgcaacaatggtagtagttcagttttgctattcgtcagtcgcctgttaataaaacaaagacattatacggtgtcgcattgtacctttgtatcatcatgttgtccatctccgtaagagccatgtttgcgcacatcgaacacagccttcttcgactcgagagacgactttcctctcagactatcatctccattagtcaaagaggatgcattcatgttgaccttggcatgaacactacacaagaagaaggacatgacaacgacaaatgcagagaaaaggagcacattgcaagccatctttccaggtgtaaaatgtgtactacaattcagacgaaaccactatgcagagatgcttgcaaagtttgcagtttcggtcttgtgagatgtgttgctgaatgtggcgatcgatggagaccaaggattcaatcagggggtctatttatacgcgccgaaagcggttagaaatctttggatcttctcaactcaggttgcttgttgttgatcagctaggttggttcagatatttggagcctagtaccactagattctgtcagcatgggaagttgggaactgagacaaatgtgcctgaatcctcactcttgttgcttcactatgtggtctacttgtatggctaatcagtaatagcttccaacttagctaatcctcctatggacagttcagcactaagaaagcaaaatcaaggacacttggagcactcatgggtacagataatcagctcaaatataatcctacacatttcgttagtgctgcactcttgagaaccactaacactaattaagcttacatgaaaactgaaccctgacagatgtacgatccacaggcttccatttgcagtttcacaagtcattatgtgcctaatggctttgctaatgacatgttatcaggaaaaaatggcatgtgtatgggaatgtcaacgtggtataatctagatgtagcagcatgatctgttccgatcactcgtctctgatgaatctagaagcataaaattcaggtataagatgtttagctcttagctgagaatggaaacgtatggggctccaaggtagcctatggaagagaaaacaatgcagatttcaggagatttctcacagatatcttaatgaaagtatggagaattcatggagtaatcagatggacaacctgcttccaagaatggggaagaacagaaatttttttaatggatttctggaaatagtatgcaacgacgttcagaggaccatgcatactgtgtatggaatgtctgacagctctggaactaccattctcaagcttaattggggatgttttgatcatccttaattggttggtaaatcctttcatctagcctactaatttccttgcaaaaagaagtacctcctaatttcatacaggaattcttgtcttagttggtcttattttatagggtaatttggaaccataccattataatttttcaaagtttgagatatgccatcggtatctcaatgacatgtcattatattagggcatcaaacaattgacaacccatctgtaggtcgtaactgagataatacaagaattgctctgaaaccatgaaagaatgttctgaatttttacataatggattaaaacctggtctctacaccaacaaggaatcaaggatgtacacggccaaaagtctaaatatgagcacatagacccactcccctttacaagagggtacacaaccatctagataaaatcatttaaacaacaaactcaaggagaaaagaaactacacatctattctctttctcacattccaaccaaacttagaaaagaactccaatctctagattccaatggcttgcagcattctttcagcctattgccatgattctctttaagcagcagcgaccaatgttgcgcccaagatgtcccccttgaaaatcacctataaaaatgagttcgttttcgagccattaaagactgcaccattttctgtttaaccataccgcccaacacaatgccactataccaacaaagatttaatattttagcctaggttgaacaccatttaaaaaaaccaactaccaaaaagatgagtaacattattaggtgaatggaagaatgttctggattatatcctatcatatagaatctatagtttttcaataatattggtagacagacttctgacacatgtcgatgcattaaacaacacatctcaacaacttaacatgttccaaactaagccctataatataatttacttttggttcattcttctatcatcctcaatttgtcctccaatcctcaccccccccttctctctctctcccactatttgctttgcgccgaaggtccagttagggtttacagtttcgatgagtacaaatctactggggggattaaaatatttcagaatgaataattttgaaattttgatcgagttcgaataaattttgataaaatcataaaaattgatgaaactttcaaatgaaatattttcatgccgaggggtggagctcggaaattttgaaccaaaactgcaaacactactacaacttgtcagctccaacttttgttcctcctagttgcaaagcatcggagaacttctcggtggatctatttgatagttttatgactgaaaatcaccaaagttagcgcttggaggagacacggcgcgcgtttttttggcgctaagagcgcttagtgctaactaacagcgcttagcgctaactttttttctttattttttctagataaaaattcatcacgtttctgtttcttcctttttttagttgactgaaacaaactttcaaatacggatttgaactcagatttaaaaatttcaagtcaagatttaaatactatccacttagattttaaaaaaattcaactcagattttgaaagtttcaaaaatcttgatttgaaaactttcaagtcagatttaaaaaaattcaagtcaagatttgaaaaatttcaacttagatttaaaaactttcatctcagattcaaaaacattcaactcaaatttgaaaactttcatctcaaaaattaaaaactttcatagtacaatattgctagcagtgtactctttgaggtgcaatccctgttcgtggggggtcccatttgcgttctctacatctcgtccttcacaccatctcctctccatagtccatccccatcaaataaattaccattgtcttcatcttccagcatgttgaatcatcccccatgcgtcgttttgctcggtcggaccatcctgtcccagccccattatagtcctctcatcactttacatcctctggttggccttgcaaattcgtctgctggcaaagtccaagggaaccaagcttgcatggcccttcggtggctagtctctctgcttacatgcgtccatcagccactgcatcaagcttttgtattggatactgcattcctatttcctccattttgatattccttataattttcatgtgtattcgagaactaatgcttggttccattttattaatggccccgcttgattattccaaaaagaaatatacgttgtgttcttagggggttctataatacaataatgcactactacctccgtcccataaaaattgaatttctagggaattaaggacatattagaaggatagacaaatgactacaataacctatttaatgaacacagtacatgtacacattccatatataaacttgattaaaaggaatgtcaaaacaatgggttagaggagatggaaggaaagaagattacaaggaaatgtaatcaatttactgggtcccacattagtagaaatacaatttttatggacaaaagttcaaagctagaaattcaatttttatgggacagatgtagtaccagaaatcactagtttacctatgctttgttttactagggaaagacaaaaaaaatgtagggaaggctttccctaccatgttttgtagggaaacaaacgttggcaaagaaaaatatccctatgattttgcacgagaaaacgtaggggggaaattgttccctatgattttttatagtagggaaccgcatgcctacacggcacattctctagtgtgtagaagttgttccactacatttgttcttgaacttttacatagtagggaatgtttaattcatgtttttagcaaacccgaaaatcatctcccagtttaataacaaccgcatactgaaatacaactaacattcaaaatcagataaattattccactcaattcaccaaaagatgaccaaacaatgatactaaatatatcagaaagtgataatatatcttacagagtacatattgcctagacaatcttgcagccaacaactaattacaacgttctacatcattatgttctcacaagattcaagccatccaaacaaatatccaattaaaaaaatagctcgcaatgggctttgatcacttatgtgaggcttcgagaacaagaactcagtacaagaactccgagtgttgcttcacacacggttaattttttagggcctctctatctagtatatacctgtacacatcatgtatccctcaagaacccagagagttgcttcgcacactctgtcaatttagggcctctctatctagtatctatctgtacacatcatgtatccctcctaagatttcaagtttaaccaaagttgtagtttccgctacgtatttatcctcctactctacatataatcttctctaaagatcatctgacactctacatcctccacttaatctgatgttccaaccagctccagatcaatttttgaaaccacagggcaatggactgacacaccagatttcttccattctgcattctggcaggtgctcttggcattactgctacctcccttgacagtgagattgacattctccaaggttatgccatggcaaggcacactgttgctgcaatgcagcacgatggcctcctctgatgcacttgtgcccctgatgttcttgaacagcaaattgctcacctccactgcagatttctgcaatcaaaattatctctagttaagctaaaccgtgcagacgaattcaataataggtaaagaaattaaattcaacttgatcatcatgattttatgtcaaaaattaagtttaactttgtatacctgttgcttgcagggtgtagaagagtcacagtagttttggtcgatgatgatggggttccagacattgtccatgaccatgttttggaacacgatgttcttcgctgaaccctttcctccctgccatgtcttgatgcgagctccattcgttgtgccatacagcctgacattgtccacggtgacattgttgacatgagcttcagaattatgatcccccaagctgccgatgctgatgccgtgtcccggtccacacaccatgttcttgacatgcaggttcttggttccgtcctcgatcgacatgcagtcatccccggtcttgatcgtgcagtctgtcacctgaacatctctgctgcgtgtgatgtggatgccatcggtgtttggggcagtttctggtgctgtgatcgacaggcgagacatcttcacgtcggtgcaatcctccactgaaatctggatttgctggctgttcaccaccttcaggttctccactttcagaataaagtgcttccctatgttcttagcaacacagccacaggcatgtccaggaaatcatactagcaatcactgctgctttcaaaattttcataatgaatactacctacatccctcaatgtttgacgttggacgtcaaacaaaaaagaacggagggagcactttgtaacactttaattttgtaccatggtgacttgtatataaaactttactgtatcatgatgattatgggggcagatcatacacaggacagtaaaatcaccatctacatagcaatctggaaagttacctctttgttggtcattggtaccatgccgccccttctccaaacaaattaagttcaattattcaaagaatgaacctaacaaggcataataagcaaattatgaaaaaatgaacataacaaacaccagattaagcatcaactgttcggaaacctgagaaaggaaattagagttgatttttcccccttcactcttagagtatgaatgatcaatgcattagaatgtatagtaaaagatttgttcctggaaagaagacaagatgatagtaataaacaaaaggggcaaaaacaagtgcaccacctagtgatattgccgctgcaatcttgactcctcatcctcctatttttcctaggtttattccacacaaaaaaatataatatatcaaaaattggaagctgaaccggcttgtctagctctgttggtgataatggaggagaaattaagagaaatggaagaacgaggaggacaacgcatatgcaatggttttaccaccatggagctccaccaccttcttcttcttcaaccgccggttcggtcaaatccaggaggaggcagtcgctgctgctactatgcaacctgattcccagtcaatggaagttgccgctcgtcgggggatggagcaacaaactgcacagcgagctgtccgcgccatggaagaagctaggggcaaccctcatcgccatcgccgccgccgtctcctcggtcaccgctgccgccgtggactcgacgcgggcggccgctgcttccatcgcgctggatgcagtgcccaccatcaccggccgctcgtcgccctgcccttgaatgcccagcctaacgccgttcccgccggagatgacgccgccgccgccgccgtggggactcgccgcggcggcgggggatcgttttttttttttgttgttttttgtgtgcgtgttcatttcttttctcgaaaaaaatggcccatgaaagattccagcccggcccactaagaaactactcctcgtaaagtcgtaaggcccagatgacgcgagagcccgatcggacggtccagatagacctgatcgcgctataagaggggcgcaccacgcactcgtcgcaaaaccctcagccgccgccgcccgagcagagaagccgccttcgccgccgccgccgcactccaccgcgcgctctccgtctccggccgccgccaggtgaggaggatctcccttaccctaccctctctcccctctcttcctcgtgtgcgtggctttactttaccccctgtgatcgatcgcgctcgaggacgacgtccctttcgcgtgatcttggttcttggtgtgggtctgatttgctgctgggttgaacccttgtgattcctaccaactggggtagacgatgagagtgagagtgcgtgcgctctgtggtatttggatggaactagaattcgggaagtgcttggtcatatcctttttattccgcatgaattgttgctgtgttaggctagtgaggcagatttgttaatttatttttgaatctaggtatacaacgtcgagtcctttcagtttgaaatgtctcgcagctagaacctgagttttttttgttgggtcgatgtgcagtagaacgaagagaactttttttaacaaaaaatttggtaggtactaccatgttagatggagtagttgtagttttagtgaaggttttttgttactcatattgtttagaaaccagtaaggcagccatttcgtttttcatcgtcagattggcagcttggtctggtttttgcttagatatgttcttttctttgttggattcttaatgctcaagaacctgcagcttgatcagatcgctgttttctgaagaagcccatgatagtagttgcaattacttgatttgataa

SEQ ID NO: 61681 - DNA, 2643 bp, Oryza sativa
gaaaatacaatggaaaaacatttggtagttgcactgtctttaggtttgttgttaacaaaatatttaagtaatacaaatttcttctcatattttgcagacaagatggtgagagtcagtgtcctcaatgacgctctgaaaaccatgtacaatgctgagaagcgtggtaagcgccaagttcttatccggccctcgtcaaaggtgatcatcaagttcctcatcgtcatgcagaagcatggtatgtcttctctcagcgtgtactgttactgatctgtagacatgaagctgtgattgattgtttatacacaatgatgtcaggactcatgccacaacccatactgttacatttctgactgcaggttacattggtgagtttgagtttgttgatgaccaccggtctggcaagatcgtggttgagctgaatggacgccttaacaagtgtggtgtcatcagcccacgctttgatgttggtgtcaaggaaatcgagtcctggactgctaggctgcttccctcccgtcaggttagttcacaaaatcgaaaccaccaacttgtcaagagacatcacttagcttaagttacatcgcctgagaaatacttcatcacttagcttcagttatttctgtgaaaatgccctctgactttaactatgatatgttatgtagtttgggtacattgtccttaccacctctgccggaatcatgaccacgaagaagcgaggcggaagaacgtcggaggcaaggtgctcggctttttctactagagatattcatctcacatggaagattttctcaggtgttagcaagaagagctttgttagtagtgggagtctgagaacttgttaagattattgtctcctatgtctgaattaccccccaatctgtttttattttgcttggcgactgagtgagctgctgtacttttctccatcgtatgatggctcagaatcttgcatgatgcgtgcctgcctttttgatactcctaatcttttacaagttactataaacttcctgggatcttttacaagttactgaaaacttttctgcgagctatttgtgttctctcggtttgttgctttgctgctctgcctaatccgctcacaaaattgcacgattagtggggcacattggcgattagtctatctggtgaagacagtacgcctgccccagaacaaacgtgtgtagtcagtcctcaaattttaaacaaaatataatgtaattttgcaacatgatattaattgacttatcaataaaaaaaacacattcatataatagcatttgtaaatagttttcacttttttagacatgattctatggtagtatagcatcgaccgatttgatgaccaaaacatcaaataaatatataagaatataaggaatcaatatacttattatgggcgtatctctataaaatcgatcacttctctcaatggtttgatgaccaaaacatcaaatagatatataagaatataaggaatcaatatacttattatgggcgtatctctataaaatccatcacttctctcaatggtataatcaaatcttattatgaaaaagatgaattgagcgacgggacattaacctggatttagccttcctctctactatctactggctagacatcagtttagagcaaagtgtgaactctgcttctaaccatcaataagattgactcgaacaagactgggttcctatgaaagagaggccagttcgagggtgtgcttttaggtcttgatcgagagtaaacatatgtagccgttggaaattgaagttctaattgtatgtactacgtcctccatttcatatgttaatgaatcgacatatatatgtgtgtctagattcattaacatctacatgaacgtgggcaatggtagaaagttcacgtaagtacttagagaagtttaatagtatagccaactactgtctctaaatcatctatagtcaatttaatagccaattcatataatagttacctataaatatataatgtactattaatatctagtcccacctatcatacacacatttcgtcttggaattcatgttgcagcaggtggctacaaatctgtagctctgccgctcatctctcttctttcatctcctcgatatggttcatgttgcaacaggtggctacaaatctgtagccccactgctcatctctcttctttcatctcctcgatatatgtctatagttggcttatagtctgcacctgctcgtagtgcacctcattatcggcagagagctcactgactactactccgacactagggacagcaggttccccgtgtacacgccgacgtgggcgcacctcgccgccgtcgccacgtcggtgtggccgccggtgatcggatcgtacacccgcatcacgccgccgccgtgccgtgtcccgccgctgccgccggcccacacccagaagacgatcctcccgtcgtcgagcaccaccactggctccgccctctctccgtcgcaccgccatggccgccggtggtacggcatggtgaccgtgtactgcttcgaccagtgctgctcgccgtcgccggcggcgaggaggaaccacaggtccagggtggcagctcggtggtcgtcgatggccaccaccagcgagcctcccagctcggccagcgtgacgcgggggcggtccggccgggt

SEQ ID NO: 61682 - DNA, 5207 bp, Oryza sativa
aggacggcgttgagcaggtccactggcaggacgccgtcgttgggggtggcgacgagaggatagttgccaccatttccgccgctgccgtcaactcgccgccttttccgcggcggtggcgccattgctgacggcgtgcaggttttgtcagaagtgaaacagtagctcactcaccttatacacaagggctgacgagcagtccgaatactagacctattataaggctactacttctactagtctatggtagtagtaacatattcggagactgaatctgatcaagtcctaaactcagagtttaattttgtttagcggttaattttaagtcaaggtgaaattagtttgatgtctctagaatattatcatgcctggcgatacaattacccgtgagtatcattggaaaagatcatgtcaatatactctaataacaattttttttgtaactatttgtattatatttgatagagatagatccacaatgggacatccgggatatatgaaaaaaaaaaagacgcgactatacagagaccgtatgctgtatttaaccagagacttcactctcaagtccggttgcattgtctaccacatctttttttcttcttatagaatttttttttaaattacttatctgatctataatccaattataccattatgttcgttacaatgaattaaatgtttacaataagatcttacatgattatattttgattaaaaaatatctatgttgtaaattacttttattaatatgtaagttacttttatcatatatatatataaattacttttaaatttgatacttcttatacattaataatgttatgagttgtttattttattatcatttttagtcaatttcataatttgtgttgattaaatttaaattttagatagacttatttttttacccccccccccccacaatggatttacttctaatgtcgtgataagttattttttttaagttagttctataatatatataaattacttataaactttattgaatttacttttatatgtctaagaagtaatttaatgatatctaaaagtaatttagatatattataaaagtaatttgtaatttttcatcaaaaatataatcatgtgagatcttgttaagaaaatttatttgttacgaacataatggtgtaatcggattcgtaaatcccatgagtaatttaagagaaaattttatttgaaacataggtgatagaaatgtatttctctacttatttgatggactagtactatagttaagtaaaattttccaatcaatgtcctgtcgctggttagtactaaatcgagatgctcttgatttagatttaccaaaaaaaaaaagtccctttcttctagcatttgaggattcatatccacagccccttctatttcattttctcattgtttggtgaggaaaaagagaaccaacaaaggtctctcgatatttcaactttcagagaaaaacaaatgtcaactatcagagaaaaacaaactcctaaccttttatgagactcatataatcatatctttctggcacgatcttgcctcgtgcatatatttcaactaatctacatgtccatacatattttcagaattttcgtaaatcgaacaggtgcaagattaaatccaaataatggaattggacaattacgaggaattaaattcgttttcttttgttgctcctactgaacatcttatgcttttgttgtacaagcaaaataccaaattggcattctcagaatctaaggaacccaatgggcaatggatatggcaggggaacctccttagctactacattgccatccttttctactccacctattatataactctgccaccaatctttctactaaaatattgttagtaaaaaaaatgcatagcttggttcacttacaatccgaaaaaaaagtcgatttcgtttgttagtaaaagatgcttagctttgttcacttacaacttgaaaatgaagtcgattttagtttaattttcaacctgtgagtgggaaaagggttgcttccaagttccaaatgtattgtaggggcaagtttcaatgaagaatttgataatttaactttcaaccaagatttgaagaaaatgtcaactgtcaaagaaaaacaatctcctattcttttataatacatgtgtcatcatatatttttggcatgatcttgtgtgtgcatatctgtggctaatctacatgtcaatatatcttctcagaattttcgtaaattgaacaggtgcaaattcaaaaacttgggacacacatatttttattaaaataaggcattcctccaaataaaaataacctggtctgattgcttgcgcgtttcaagatttttgctctggaaatacttagcataaccatagagtgagagctactattataatcaaaatagatgaactgaaagaacaaaataaactgaaatatacatactatctgtcagctgtgagtctgtcctaaaaggtttccagaaaccaaaaaagatatacttgttccttcccctattcaactaaggttgttcacttgcttactcaatgcattcccccaaactttcaataagatatacatgatcaatctttggccatgcgaaaattcccagataggaagtctgtcccttactaagctctctttgagccccaagtgtttcctttttgagctaagagctcacatctgaagtatctagacagttgatttttgagagaaacatgatcaaacaagagcataggtcatcatattgtgtttcaatggaatttttgtgtaattaactttcactttcaattaggctatgttaatatttattcttgaggccaggttgtacatcagtcaggggttcagttttcatgtaagctgaactctgaagtgcagcagtactgaagaaattttattgtttcaattgagcatctttgctaagtaaaatttatctcctaatgtccttttttctctcctagtggtgaaatttgagagcataaatggctaatttggaaggaattatccttaaaaggtagaccttttgctgaagcaaaacagaaactcaggattcaggcacaggtgtgttcggcacccaagtttcccaaccactctccctcgttttccgcgcgcacgcttttcaaactgctaaacggtgtgttttttaaaaaagtttctatacgaaagttgctttaaaaaattaaattaatccatttttgaaaaaaaatagctaatatttaattaatcacgcactaatgaatcgctccgttttccgtgcggcacccatccagggaatccgaacactgccatatatttcggttcccatgctgacagaatcttgtgatactacaccccaaaaatccacaccaaactagctaatcaaccacaagcaacctgagtagaaaacatccaaagatttccaacacgtatcggcgcatataaatagctcccctgatcaaaccaatggtctccatcaatcaccacatcaagaagcagcacatccactttacttcatctctgacttgtcataacttgtcaaatttagtctgagaaatggcctccactgtgctcattgtctctgcatctctccttgcactcttcttcttcttgcatagtgctgatgcagatgttggcagtaatgtgttcagcatacagagctacggggctcatggagacggacgacatgatgacaccaaagtgagtacaatgcaatgacaccagaatatgtcaaaaggtttttggttcaggagcaaatcatagtttctgagatctaaccgttgttttttcttgtgtcaccttgcataggcattgggagatacatgggctgcagcttgctcctctgcaaaacctgcagttttgctcatccccaagggcaagaaatacctgatcaagcacacaacactgtctggtccatgcaaatcaagcatctcattgatggtgagttagaattgattataaatgcataagtttatatacatttctttgtaagaaaaagaatctgaattccatttctgcgaaattttcaggtgaagggtagtttggtggcttctccagagaggtcagactggagcaaggagaccataaggcactggattctgatcagtggtgtcactggtcttactgtcactggtggtgggaccatagatggaaatggcaagatttggtggcaaaattcatgcaaaaccaactcaaagcttccatgcacagaagctccaacggtacgtgtccttacacctctgcttactaccatgaacattccaatgcagcaacaaaatcttgatgacattttatctcacaaactctgtcttatttttacctatcgcaggcactgacattctactcctgcaagaatctgaaggtagagtatctgaaggtggtgaacagccagcaaatccagatttcagtggaggattgcaccgatgtgatggtgtctcgcctgtcgatcacagcaccagaaacagccccaaacactgatggaatccatatcacacgcagcagagatgttgaggtgacagactgcatgatcaagaccggggatgactgcatgtcaatcgaggacggaaccgagaacctgcatgtcaagaacatggtgtgtggaccgggacacggcatcagcatcggtagcttgggtgatcataattctgaagctcatgtcaacaatgtcaccgtcgacaatgtcaggttgtatggcacagccaacggagctcgcatcaagacatggcagggaggaaagggttcagcgaagaacatcgtgttccagaacatggtcatggacaatgtctggaaccccatcatcatcgaccaaaactactgcgactcttctacaccctgcaagcaacaggtatacaaagttaaaactgaattttggacaaaattacgtttaacacggttaatttcttggcattaattaatctgtgcagtcaaagcttaacttcatatatataattttggttgcagaaatctgcagtggaggtgagcaatgtgctgttcaagaacatcaggggcacaagtgcatcagaggaggccatcatgctgcattgcagcagcagtgtaccttgccatggcataaccttggagaatgtcaatctcactgtcaagggaggtagcagtaatgccaagagcacctgccagaacgcagaatggaagaaatccgggagtgtcagtccacagccatgtggtttcaggaactgacatgaaacatgaacatccatgtggtttcaggaattgatctgaaacatgaaca

SEQ ID NO: 61683 - DNA, 4570 bp, Oryza sativa
gtaggagtattatacatcgtggagctagagagacaggtgtatatattcagaagaacatgtacaggaggaatacatgacatgtacagaagtgtataggaatttgcaattgagattatttcttgtaactcgtaccactctaaatcatggcaaaatataatcatcaatgttgaccatcagatgaggagcatcagtaatttactgtttgcaagatttttctcctcttttcctctagtgtaattaaatcaaacattgtagagttgctgtaatgcttatattgacaccaaactgagaaattggactacatctgttaaaatgaaaaaccacacgaatcggtctgcttcaaaaaggactcgtgcagcattcggatatcaaatcaaacaagcgatgcaaagtaagtctcatcccatcatatgaaagaacaacaaaagcaatacgacatctcagatgctcacagcatcttcacaactgaataacagagggcacacatgatggcaactcaaagagttgcgtgaaatttatacaattacaaccagagcattcctccacagtaccattgcgttaagtaaacacatcttgttgggaaatgactaatgagaccgtcaccacaactggataggtaataatttctggagacaggcatgaaagtagtatcagatttcgcacccgtttttccattttgttagggcagaagatacataagttggcaaaacaaccatgacaggaaatcataaattaaactaaggataggtcaaagtaaaaaacggactatttcagctacctgaccaatcgtccagatgttaggagcatgcagtccacggcatttacaatcacaatagaacacattttttgaacaattttatctgcattgctggaaagttcaccaccatgaacctagtaaccttgattagccatacatgggatccccaaattcttccagtacgaacttacatctggagaacattgtacatggcggttctaaagacatacaagatttgcagtacaggggggatcctgatacactacagcctaaactctacagaatcaccataccagcccttctgcatttatcgaaattaccacctacacagagacatattccaaagcaaaagtggatcacatttgcaggtccattgaaagagacgatgcggttgctaccttctcacggaggttgaacttcctggctatatatggtcgaacatcctcaacgccaaccaggctttccaagaatgggagcagtttcaacagctcctgatcattgggatcatcaaaccagctttcaataggaatgccattgtctaactggaatccaaaagcctgtaagcaggacatcagtacattattcatgtccccataaccataacaataatagttgatggggatctacaaatatggaactgaataaaatgcataatttcagaactaaaaggtacctgctactgctaaatataattacttaattagagtttgaactaccagtgaaagccaatagcaagattttgctttgtaatttatattactacaaaactaactctagttgcaaaaatatagtaccaatttcgaccaatttattgtctaaaaaatgttagtttcattatgaaaatgccgtgagcaaaatatatgatattaaattgtagccaaggttaactcttgaggttgaaaagtaaacaagaacatttttttttttgctggaggtagtgaactttcggataatctttaagagaccctgaaagtagtaaggaaactatatgtcacaacaattagcaagttactggagacacctagcaaagttgacagcttcaatcacaagttcacaacccctggtaactgatgcacacctatctttgtagtcgtccaccactataacacaatttatatccaccaagaaacaaataggcatttcaatgtgaatacaaaccactaaaaccaggataaagttagcatagattgaagtattgaacagatgttgtcgcacaaaaattgagatagctaagtgcatacctgtggagagttgtcaacaatcattatacgagttaagtcacgtccaagaactgttagatcctttaagtagtttccctccacataaacacaggaatcacggtaaacacgatgacggaacaactttcttttaggatcaagaacattgagaagctgttctgcataaatgctttgacttgcagtgaaaatgattgtctcaaacaaattggcaaccctctccaagaactctttgagatagggacggcatcggacatatattgtgtgttctctgaagttaaaataaactggaaatgcgaagtcagcatcctcgcatggttcaagagttgaatgcacaagtgtttctgcattgtttggagtgacacaaaatgaacatcaaaggagaaaggaaaagacaatttcgaaaatatgtctagctggttataaaagagcacacatagatcaaacaaaaatgaacaaaaaagaataggataaaactaggataaagctaaatcaaggtttgtttgtgggggcggtaccaactgctatgtccaaggattactgccacgcagcaggcaaaaatcaaacaccaacatcaaatgtatgttgactattaatatttcatgccaatgaaggtatggtaaattggtaataataaaatcatgatgcatttgaaagtccatcagtggctcctgtttaccagtttccagcctttaggtagagtactagagttatttgaattcaaatttgtaccattaacaccaattcatagatgcaggagacaatgatgaagttaaaataacagtaaacagatgtagctaacttcatccattcactaataactattattacataaatagactcctgcttgaaagtagttggagttaatcacagaaatggaacagaaggctccttagtgtagtagtgaacacaagtgctcagacaggaagtatatattaccatccagatcaagtaccagggtagttgtaggacaactccgagtttgcttggggagtaggacagggcgaaacttggggaccactagtgataaatcaggcaaatccttgataaaagcatatggatcaaaatcatcatattcctcagtgtcctcaggatcaacataaccttctgttgagattgaatcttgactatgttcatcaatgcactccaacttggactgctgcatggcaagatatattgctgacacttctgaagaaaggtttccgagttcactgaattcatcctcttcaagcggtgtgttacagaaagctgattgtgcatttagtgtatggtgatcgctcccaacacaagtcttaactgcatggctagtggattcagatctgctggtggtaacttcttttctaccttgagcatgtgttgtcctttcttctactgagctaaccgaacccaatgtatcacctttatgttctaagcctgcatgattaacgcttcaagaatcaactactggagcaacatggtatggagagcaaaatgagcaccacagccacaatgaagtcacatagaaacagcatgcacgatgagacatgtactattactagggcacaggttccaacaatagatgacaacaaactaattttgataatcagaaaggaaccctttgttgacagataaaccatctcgttaaattgaaatatccacctgtgagcaaattaaattcaaaacttgcattgaaatctgtcagagtacagaattcctagtgctaatgctggagctcataatatttatataataacccctaaaagtcataatttctcatggacatcacctaagacaatgcaggagtgaatattccatttcattctcaggcaaacaagacaacacaatagtgtaaaagttatgatatattttccactcacaaaactagtaaaagtttttcgttcaagaatttgactgcagcatgtatcagggcaggatcattttgttgggttttttttttttgcaaggatgtattgctgaatgttgatagcagttagaaaaatctttataccctgaaacttatacgatgttatggttcacagatgtttaaagcgtcctagtccaaaacttaacaatgacggcatcaaaagatgaattcaaaatatggcaattatatatacctttggcgaagttactcgcaccacattctttctgaaggtgatatgcaggggaaaatatggaattgcatggcctcccatcaacattgtcatctgactgctgcccaagtagtaaaaataaatgcataagtagttacgtacgcatagcaattataccaatataaataataaaggaaaaataagttccaaattttgttgtgaaaactttgtagtgaagcaacaccgtacatgccaatgcacgattatcaggtgttacaaaaaggctaaacattatagatgatctaaaacaaccaaaccaaaagagtacaatatttttcagatgttaatttggtagctcaataataaaagtgtaataatcatgtgccggaacaggcattaagtagttaatgtactgttccccctttctctattctttttggacgaaatttactctacagtggtcaaaaagaaaagtagccaaaaaagttcacttcagtcaaaatatt

SEQ ID NO: 61684 - DNA, 2375 bp, Oryza sativa
ccaaccggtttcggcgcgaataaatagaccccctgatcgaatccttggtctccatcaatcgccacatccatcaacacatctacaaagtccagaactcacaacaacactagaatttctgcactgttcatcgtccgaaactgtgttgacatatgttaacagttggaaagatggcttgcaatgtgctcattttctctgcatatgtcgtcgtcatgtcgttcttcttgtgtagtgttcatgccaaggtcaacatgaatgcatcattccatttaactagtggagatgatagtctcagaggcaggtctcttgagtcaaagaaggtggtgttcgatgtgcgcaaacatggcgcttacggagatggacaacatgatgacacgaaggtaaaatgtgacaccgtataatgtctttgttttattttcaggcgactgacaaatagcaaaacttaactaataccgttgttgcaggcattggcaaaggcatgggctgcagcttgctcctcttcgcaaccttccattgttctcatcccaaagggcaagagatacctcaccaagcacattacactatctggtccatgcaaatcaagcatcacgttcatggtaagaaatatgcactcgtgcacttgcatttactttcatatgaaattcaattactcaaaaatgttaagttcctgaacattttcagatagagggtacgttggtggctcctccaaagaggtcagattggagcaaggaaactattaggcactggattatgttcaatggtgtgagtggccttactgtcgctggtggtgggactgtcgatgaaaacggcaagatttggtggcaaaattcctgcaaaacgaatgcaaaacttgtaagtgctctgaagttatttagttatgaatcattacactctttttcatttttattttggaaatatctctaatgtggatattattcttctcttcttttcagccatgcactgaagctccaacggtgagttttcttcccaaatcctaatcttctagcacatcacaattcataaaactttggctattttgctcaaacaaagtctgacttctttttcatctgacaggccttgacattctactcctgttcaaatctgaaagtggagaacttgaagctactaaacagccaacaaatccacatgtcagttgaggattgcactgatgttaggatctctagcctgacaatcacagcaccaggcactagcccaaacaccgacggcatccatatcacaagaagtaaaaatgtacaagtgacaggctgcataatcaagaccggggatgactgcatgtcgattgaggatggaactgagaacttacatgtcaagaacatggtgtgtggaccgggacacggcatcagcatcgggagcttaggcgatcacaactctgaagctcatgtcaacaatgtcaccgtcgacaccgtcaggctatatggcacaaccaacggagctcgcatcaagacatggcagggcggttggggctacgcgaagaacatcgtgttccagaacatgatcatggaaaatgtttggaacccaatcattatcgaccagaactactgtgattctgctacaccctgcaaggaacaggtacaaatctcagtgatagcttttctgttattcagttatccatgtgtgtaaataatgtgcatgcttataatttagtggttttgtatcagacatctgcggtgcaagttagcaatgtggtcttcaagaacatcaggggcacaagtgcttccaaggaggctatcaaactggactgtagcagaaatgtaccttgtcaaggaataaccttgaaggacgtcaagctcactatcaagggaggtggtagtgatgccaagagcacttgcggaaacgcaaaatggaagaaatcagggatagccctgtgctttcagtaatctatctatctatctattatatactaaaagtccattaaacttcctacaaacgctctcaagccgccacgtgagactcctacaaacgcttctaagccgccacatggcgttctaataaaccggtggacccaatatttctataataataataaatcgctagacctactattttcaactattatatttatctttagaaaaaaatcccacaacccacctcttctcccataggcccaccctctcatacgtgcgtacgtacgtatacatacatactctaaatagattgtcgtcacgaggcggtggcggcagcgcagcacggcgcggggcagagggcagggacgagcgcggacccgacgaggccgagcatgccgagctgggaaaaaacgccagcggcggcgatggtccagagacggccggcgaaggaatctaccgtgcaccagcggcaggtgcagctgctgcatcaggtacgtgatcatgttcgtgttg

SEQ ID NO: 61685 - DNA, 6411 bp, Oryza sativa
aattatatatggtagtatatgtaatgtcttttataacttaggccatatttggttaatggggctaatgcattagtccctccattttagttcctaagaatccaaacaaggtgactaaaagtgcatattggattatataggggctaaagtgacagcctctttcttctttctccctcagtccacatgcctttagtcttttttagtccctgatccaaacagtatgggacaaactttttaatctgaggactaaatgatccaaacaggcctaagttttttctctttccatatgaaacttcaagagtcatgtcttaggtaccataagttaccaaccccaatcttcaataggtaattttataaataacaattaaattcattttgtaatgctaatgaagagactcatgaaaaacaatcacaattttgaaacattgcagatattatttcgctggtatactgtccctataagtttctcaaattcatcctacatacggtacatgctcgcgcgaatgcgcgggctaccttcctagttaataaaacaggaggatgatctgaactcgaatagattatgtacaggtgtatgtatagaatgaaaggagaaccacattatgtacaggtctattattatcttaaaaaaaagtgatgtagaggtgcacatgagtaaaatagttgtaattacgaatagttgtgaattgtttattcttcgattcatatcattatgattagaaatagagcttcaaaaaatattatgattcatccttcaggattgattagatcgagtccttactttacttcgggttcaaattatactacctatgtaaggcgatgaacacaacggcatagaagatctgcttagctccagtgcaggtccaaaatattgatgagatgcgggtgtgacagtcagtttgatcctgcaactgacataccgatataattatactagccgatgccaatactgaccaatgtcaatagggttttgagcaatcggctatatgttcaatgtagatttctacacttgagtaaataatgatataaaacaatcggctgatgataatgtaataaaacaataatataattaagtagaaaccaattgatcaatacgtatagaataattgcttgttccaaaggttaagcatacatcggtttgtgatccgatgtcattaaatccacaagattagataattagtgaaacctttaatgcaatcggctaaaaccaatttgtatgtaatccttgttagccgatgcaacgtccagataactcatcagctgaaaccccgatgaaacctttatcggcaatcaaatccaattgatgcggcactaaatctatacctatacctaattaaaaaataagtaaggcttccagttgatttttttcgtccatcattaaagggtgggcccacgtgattatttcgccgctaatccatgaatctggatgcattacggcgatctcagacgctaggggcggccattcggtctaaccgaaaatttcggtctcggtcttcggtctttcggtcttttcggtctttgaaaagtgaagaccgaatttcagtgcaaaaatgtcaggactgacaaattcggtctcggtctttttggtctcggtctcggtcctgaccgaaattcaacaatattttcatatatgcaaagaaataatggaaattttcaacataaaaatcacaaaaaaaaaatttgtaagcacttataagtaaagactcttattaggttgcatgcctagaagaagtagggatgtgaaaattagagtttaattctattaaacatagtggattgtaggttgcatttagatattttttggtaagtcgatctttttggtctattcggttacccgaggagactaaccgaattgaccgaataaaattcggtatttcactacctaggaccgaattgatgactaaatttctcggtctcagttttgttgttcggtctttttccacccacccctatctgacgcttctcaaataaaagagaaacgaaaaaaaaaagagaaacctagcgagcagcccagccaagacggcagcaggctggcccaacaaaaagcaaacgcaacccagcaaccagcccacatagcagagaagcagcagcccagcacagcacagttcagcccacgtagcagagaagcagcagcccaacacagcacagttctgcgtgatactatagcaactgagcactgtagcacgagtaataccacctaaataggattcttgcctaagactattaacactaaataaattttgggcccatgtctaccaggaattagataaaaaagggaacaatttcattattttggaaaagtaaaaaaacaatcacatgtctttcttttttaaaaaaaatgtaaccaccaacaaaatgaattatttaccgacaaaataaattaattttagaaaatagaaaacaatcacgcgtctttcttttttaaaaaaatatatagtcaccaacaaaatgaatcgtatttacatccagattttttccctcgtcctcatcaattttttttccattcatggtatgtttttgttctgtttttttagagtgagagctattatgtgatacaccaccttttttttctttccattcatcacgatttcttttgattttttgagtgaaagcaattatgcaattagagtgcagtgaggttgatctgatagctagcgagaaacatttcttttactattgctactctttgcagtatgtaaaaaaaagtgttttatcaatatcaagtataaaaatataaccatgcattgcaaccgactcataataatacatgaaaaaaataaatactttttgggtttcaaactttagtatgtataatacataatttcattttaaagtggtattaatagctttcttataatccatgtaaatggatttagaacaacaaataattatgtcatgttagcgtcttacttgcaccgaaaagattcaatttaactataaggatctcaattaacctagtggcattatgctcccacacacccattactatttatttttgtcttcacccagtgcaacgcatgggcattttgctagtatgaaaaagaagcataaagtctaaacaatcaagccttttactgattttcagggtggtggataccttagctaatctagatctaagaaacaatttaactgataaaaaaaaccctagaaaagatctagccgatataggtaaattgagacatcgacttagattaactaagatatatgataaatatatgtttacatcgacaagattagggtgtcgaagccctagcctcaccgatacaaacagccacaataagccttacccctcatcagagatcgaagccgatgtagcctaactcaaaacaggaacttgttgagaaagacgaaaataaaaagggtatcgatgtgccaaagttgtattgatcgagagatagattacaatgactccgggtgtatatatttatacgcatgggtaaatacaagcccttattggacacaactcaaacttttctaaagataaaaggaaaagcacaagtcctgatcggatactaaacacactttccaaaaacaaaagggaactaactaactctgcttaattaatagataaattgttatgtcgtatcctccttaaactcaatctcttctaaataaacttcctttaattgattaatttccttaaccaaaaccaagaatccgactgctagtgagtgacaattcccatcggtcaattccaggactctgaagctgatatggtttctaagcaaatgatgacctcggggcttaccaaattttggcgctaacatatgccacccaattttggactatgagaactcatgcttcaaaattatcttctttctaatcttgataattccaaaattgatcctcttatgtatctcgcaatcagattttatgagctgatactgtctgcattagagctaggctgtcaaactcgtggtaaaagaatttgtctttgataggtgctgacaatacttgaaatgcaagatctgatcgcaatggccgccgacgctccgatgcctcttggaatgaccgtgacggttgaggagaccccgtatgatctggatgaccctactactagcaaattagatgcagatcatcaaggcttcacgactactcgcccttgtagaaccctaaaagatgtgagtacatacgaactaattccactctccttttccttttaccgtgtctaagaaagacaatcaatgtgatcgatcccgcatagcaacagtcggctcggtgttagtctagcctcttttctcaaggtggtgtctaggagtcgtcagacagcctgtccagattcgtagtactagtaaatctcttatctgatcctaggttcttatattttgggacgaagggggtaactaacaccacatgctcatgctaaacgattggtttttttgcaggtcttgtttagcatatttactgttgccatggtgatcacctatgtttgcctggtaatccacgacgacctctccttgatccagacattgttctttctagtggtgtgggttatccaatggctagttatttttgtgatgacatacagcgcatttgatgatgcgaatcaagagtatcgcaaaagatacaacttggtcgtagtcaacgcttggttttgctagttcacattcaatagggtgagtactatgttatcaatatgtatatataggcaataatattatatttgtaccagagcatagagtgaccattgagcatggagttacctgaaaactgtcgacgggggagacccgtagactatattctaaggatatttgggtacgttggtatgaggatctacgcgatacgacatcaagcacacaaaaagacaaggattaactagttcaagcccctcgtaaggtaatagctctaatccagtttatatgggattatagaggaaaccacagagtacaaaagagaataactaaactccgagattactgacgagatccttgtcgagagggactcgacaagatctattggcgaatagacttcaagtcctccggattacttatgtggttgcgggtgtcttgcgctcaggattcaatgccctataccccttagggggtatgtatttatacctagatcaccttgatttccaggtagaactcggagacatcggaccccgcacgatacattatagtcttctctccctctgagtaggatagtaggatattgatatggccctacttgtgaaggatatttcccatacgaattgactgatttccttaactcacacgaatcctttccgtatatcataagataagacatattgtattcatatatctcaagactcataggatagagggtatgcattatcttttaaccctgacaaaaacaataccatcagcgaacacagcaaaccaatagtcatctcttgccaaaaaagatcataataaaaaattatcaaaattttctcagttgacattcagattagttaaaagcaagcattcacttaactacaatccacacacatccagcactaaaaatgaaaacactctaccaagcgttcagcaacaagatgttcacagcgtcacagaaatagtagaacaacatgtatttgaggtaagcaaaaaattatatacactttctcttgttctccatactcacataaacagtagcatatgacaatatgtatttgaggtaaacataaaattatatacactttctcttagtctccatacatttttgttctgatttgtatattgactttgtaatactgtaacagcttcagatgggcaaaatagaaacattccacctgttccacatacagatcagagaacagccacggcccctattcccgtgacatatccatactttccagcaaaccaggagattgatgatactccatctatttaatattataagtcgtttgacttttttccaagttaaacttctttaaacttgacaacatattagtatttttaacacaaaacaaatatattgtcaaaatataaaatgttagatttaatgaaacgaattagttcatatgtctagtcatgaaaccttaccaattattattggtggtgactttaatctattacatagacctacggaaaaaaataatgataattttgataatatatggccttttctttttaatactattattgatggttttagtcaaaattatatctggacaaataatttaccagtgttaacttatgaaaaagtagatagagtgctaatgtcaacggagtgggaacaaaaattttcactgtcctcgatatttgctcttaatagagacatctcatagagacatctcggatcatgctcctttactcctaaatacaaaatcatcttctgtttgtaacagtcatcaaaactttaaatttgagttgcgttggctattaagagaggttttgtagatatggttaaggaaatctggtcaaatattattgatggaaatactcctatagagtgttagcaggcaaaaat

SEQ ID NO: 61686 - DNA, 1149 bp, Oryza sativa
  unsure (1)..(1149): unsure at all n locations
taaacggagcacggataaattagttatgaattttagaagattcactgtgtttattactataacaaaaagtacttaaatcatttattgcgcaataattcccagggctgacgtcaccaaagggggcgcggcgccgacatgaggggcccaccggtcagcggctcgggagagagggaaaaggggcgccggcaagcgggccccacttggcagcggctcaaagggggggtagtccaccgtggaccggggccaagcgggtggtccaccgccggtccacgggaccgacggcccagatcgcccccggggttgatcggacgggcggcggtgacccggctcggctcggctcaaggccggccgaccggccatggcgatggcgacggcgcgcgcgcgaacgcgttgccggcgacggcaaccggcggcggaggcgacggcgcataggcgacgcgaaggcggcggcgctaagcggcggctaggaaggagagggaggggaatagaggggagaggaagcctcaccgagggtggccggcgcggaggaagacgacggcgaacggcgacggcaagccacgggaggacgacggcaaccggcggacgggcttcggggtgccctaaggaaggaggagagagagattagagagagggagatgaaccacggcggccggcatccatggccaaaggcggcggtagaggtagaactcaccggagcgcgaggggatgcgaattccggcgacgaatcccggcggaggaagggcagacggggtggagttcgtccttgcgaacccgacggcggcgacggcgcggtgcggcggcgagcctagcggcggctagcggtggccggagcggcgggaaaggtggcggcgggtgggtgcacggcgcgggagcgatggggagcacgagggagttcggcgaaatggggaaaaagagagaggggacgacggcgcagcttaaatagggagagagggggccggacgtggccgagggaggcgggaatcgccggccaacgtgggggagtgggggaggagagagaggcgggattcnaaaatcgaatcccggccatctcgggcgcgggcgcgggcgggagagaaaggggagtgggcgcgggaggtgcgccgcatgcccgggtgtggccaacgtggcccggaggaggccgaggcctgc

SEQ ID NO: 61687 - DNA, 6397 bp, Oryza sativa
cctgtcgttcaacgcgctccggggcggcgtccccggcgaggcgctgggcgggctccccggcctcgagttcctcgacctgtcgatgaaccacctctccggcggcgtcccgccctccctcgccggcgccgtcgggctcaggttcctcaacctctccaacaacgcgctctccggcggcatccccgacgagctcaggtcgctcagggctctcacggagctccagatttccggcaacaacctcaccggcgccatcccgccctggctcgccgcgctccccgccctccgcatcctctccgcctacgagaactccctctccggcccgatcccctccggcctcggcctctcctccaagctccaggtgctcaacctccactccaatgccctcgagggcgccatcccgagcagcctcttcgacctcggcaacctccaggtgctcatcctcaccgtgaaccgcctcaatggcaccatcccggacaccatcggccgctgctccgccctctccaacgtgcgcatcggcaacaaccgcctcgccggcgccatcccggcgtccatcggcgacgccaccagcctcacctacttcgaggccgacagcaacgagctcaccggcgggatccccgcgcagctcgcgcgatgcgccaacctcacgctgctcaacctggcctacaaccgcctcgccggcgaggtccccgacgtgctcggcgagctcaggagcctccaggagctcatcgtctccagcaacggcctctccggggagttcccgaggtcgatcctgaggtgccggaacctcagcaagctcgacctgagctacaacgcgttccgcggcggcttgccggagagcgtctgcaacgggtcgaggttgcaattccttttgctcgatcacaacgagttctccggtggcatcccggtcggcatcggcggctgtggccggcttcttgagctgcaacttggaaacaacaatcttactggtgagataccggctgaaattggcagggtcaagagcttgcagattgccctgaatcttagcttcaaccaccttgtcgggccgctgccccgtgagcttgggcggcttgataagctcgtcgcgctggacttgtcgagcaatgagatatccggggagataccaggtgatatgagagggatgctgagcttgattgaggtcaatttgtcgaacaaccggctaagtggcgccatccccgtgtttgctccattccagaagagcgcggcgtccagcttttccggcaacaccaagctgtgtggcaacccgctggttgtagactgcgggccaatttatggatccagctatggaatggaccacaggaagatatcttacagggtggcattggcagttgtggggtcctgcgtgctcatcttctctgtggtgtcgttggtggtggcgttgttcatgtggcgtgagaggcaggagaaggaggctgaagcgaagatggctgaggcgggggaggttgtagtggcagcgccgcaggtcatggcctcaaacatgttcatcgacagcttgcagcaggctatcgacttccagagttgtgtcaaggcaacattcaaggatgccaatgttgtgagcaatgggacattcagcataacctacaaggccgtcatgccatccggtatggtagtctgtgtcaagaagctgaagtcagttgatcgtgcggttatccatcaccagacaaagatgatatgggagctcgagtgtctttcgcacatcaaccacccaaaccttgttcgtcccattgggtatgtcatctacgaggacgtcgcgttgctgctgcaccatcacatgccgaatggaaccttgcttcagctgctgcacaatgtcgacaaccctgacggtgacaaccagaagcctgactggccaaggctgttgtcgattgccatcgatgtcgccgaagggttggcattcctccatcatgtcgccaccattcacctggacatctcttcggggaacgtcttccttgactcgcactacaatgcgcttcttggtgaagtggaaatctccaagcttctggaccctttgaagggcactgctagcatcagtgcagttgccggttcgttcggttacatacctccaggtctgaaatctgaattttgctccacaactgaccactaaacaagttcctttttgttcacaaacataacaatatgttgctgttgcaattcctccatttcagagtatgcctacacaatgcaagtgactgtgccgggcaacgtgtacagcttcggggtggtgctgctggagatcctaacgtcaaagctgccagtggatgaggagttcggggagggtatggaccttgtcaagtgggtgcactctgcccccgcgaggggtgagacaccggagcagatcatggatccgaagctgagcaccgtgtcgttcgcgtggcgcaagcagatgcttgctgtgctcaaggtcgcgatgctgtgcaccgagcgcgccccagcgaagcggcccaagatgaagaaggtggtggaaatgctgcaagaggccaagaacagctgaggacccagggcagggacagcatatcctctagctgtgaagattgctcatgaaacgagaagcgtaaacaacaaccccgtgcggtaattttttggcgatcggttgaccgatcgatcctggtatataaatccaacgatgccgtcttcttcggtgtacataaccttcattagggggggggggggggtatcccaagtcccagccaaacagtatgtatcatagatttgagcacagtggctgctgtactgctagcaacatgcagagtggagaatgtttggtacattacaaatctggtcggaaaccttgaaaaattcaggcatcctgttgctcccattacatgctgagcttttggttgaggtggttgtgcttgtgcttgtgcacctatgacctattctcttttctctctatcattccacagatagtgtagagtggtctcctcttctgtaaagttttttcttcactatcaatgcctgaggggatccctggcccatttggctgtggacctgttgatgagtgatctggtctcatctctatgtgtttgtatgtacggcttctgaatccaatggtccctttcgtggcagcttgggcttgaaccttttggacgaaacaatgacggacaagttgctgcctgattggagaaaatctgacgacaatgcacttgtgagattcagccatgtttcgcagacattctggcatgatagttggtgacttggtgagatagcttacaaaggcaatgatcggacgctatcgctcaggagttggtccgggaggctgatgagccacgaaattaggtcaactagtatgttgatcccgcgtaactacgtggctagcactcatttaaaactattttatatatggttttcttttaaaataaatactcatctcattgtcctaagttttttgaaaaacaaacatatcatcatcgaatttctaaatttatagtaaaagtgacgccagtcaccacctcttattcctttgccgtccatttacttgatttatcggcatgtcatggctatcgttcaaacctttcaaaaatcaaaccttatttattagtttttagagttcattgtctcaccgattccgtttttatatttttagaagttctataaaacgccgtcacactactcctttgcaacatgcctgctacccctcctttttattgtcattgaaattttaaaatttaaacctgatcatcgttaggtttcttttgtttgtttttaaagtcctgtcaaccgacaccgctcaacccttttacggcttgcccgccatctctcctttttatagtcattacaattttaaaaatcagccataatcgttattggtgttctgctttatagtttaagatgtcattggactccttttatggttttaatggatgataatttagataattttaatgataatttaagtttatttgaaactcatattgaaatccaattttagaatttatttttttaatttgaatctcaattaatctcgtgttgggttttatatggattctattctcaatattctttattttatattccgaattttagttgtttctaaattatattactgtctttttttcttcaattaatatgaaaatttttagcctcaaaatgaacatggtgtctttttttaaagccatctaataatatactagacagatatatgtttcttaatgcatagattgataactgtaatattagtactaacaattactagcaactagtaataaactctagttttatttttaaccaagtgaagtcctaattgcctaattggtactccactctactcctcctaaattgcctagtgtacgatgaggggccatgaaagcaacgacagattctgcgtgtcaaaatcgcgtcggtcaatgattcgtgctgggttcctatctttgatcaatccttctcccattgggtgcgacaaaagcgattgcgactttccgcggcaacgatgattgagggcgtctcctcgatttgaaatgtggggatttcatctggatttggttggaaatgaatgtctagtaggcatgcagcatgatgatttggccacaatcgtttttaaacttttagaattaaaattagggatttttcgttggtctttagtcttttcattcatcattacctttcgaccttaagagtacaaacataaaaggtcttattataaaattattttccatagcttcggttagattttttagataatggaatataatatcccggtatttgttaaaaagagctacaaccaattattacaaagtatcactctagaaaagagtgtagttcaaaacaagtagaacacaccaaataaaaaaaaagaagatataagctggagtcaataacttcaaattcagactataaaccatagcacagataattgtattcaagattgcttaaatccttccaaaattcgtgctcctttggaacagaggagctttgcaggaactgaactgataagtaaatttcatagaactatatatattttgaacaaattatgataaaactatgtataagtcgttatatcatccaacaacaaattcattgttgtgtttatcgcagctacatatttaaggtatcgaattagaaaatacatgtttgatgctagttttaccataatattacaagatttataactccagcgggacaacaatgctaaggaaactcaactctaaaatctatatattttataacttcattgctaaatttgtagtttcaagatactccataaatatatagtatggtgataaatttgataaaatttatagttttgtgcctccttaaaccgttcgcagttggcagttgccagttggcactcatatggtactgaaagattggatttttctcatgaaccgtttgtttgttaaaccttctactatggccaatttttttctttaatttccttcacaagttcagatccatgtggccccaacaaaaaaaaggcccaaaactagcccagtataatctatggagtacgtgaaatagatttaccagcaaacgtatatattttttgaacgaattacagaactatttcatactgaaatatgaaaacagcttccaaatttcatgaaacgtgaaaacagctttcaaatgtcacgcgagatcgctaatcacgtaccagtagccacatcctgctacgttgcacatttgcactcattttaattcatgacaacatcaataaaaaaccgcaaattttacctaaaaaataataaaaacaaaaaaaaaccacagattaacattagccaacacaaggcatgcaagattacgacgagctgagctgagctgacgacagcttaagctaagctttcgtcatcaatggctgcaccttcacctggtccagcaccggcccgcacggcgacacgccgtcgccggcgctggtgtggtagtaggagctgtagaacgtcaccctggcgcgccgcccgctcgccacgaacctcaggctggcctgcctggcgccgccgccgccgcgcgacgcgtagggcacggccgccgccgccgccttcgccgtcgcgttgccgccgccgccggcgacgacgacggcgtgcaccagcatggcgccctcgcagccgtccctggcgtcgccgacggcgaaggagaggttgtacgagcggcccggtgcggtgcggatcacctgcgcgaccgcgccctcccgcccggcgacgagctccacggcgcgctgcccctgcggcaccgcgaagtgcggcgcgtcgacgaggcggacggggcggagcgactcgacgatccaccccggcagcggcgacgtcgcgtccttccgcttcggcggcagcagcacgccggcggtggagttcgggatcgccgccggcccggcctcgaagtcgccgttccggatcaggttgtctgcagccagcaatggcgtcgtcaaatccaagaagaggaaggtcaccttccatggatg

SEQ ID NO: 61688 - DNA, 3664 bp, Oryza sativa
aactcgacctgggcgttcctctcggcggcgcggaacccccacgcccaggcgtcggcggcgccggcgccgtagagcgtgcgcacggggacgtcgccgggagcggagaacgacggcgacacggcgacgcgcagcgcctcctcgcgctcgccgtcgcgcgcgcaggcgcgcgtggccgcgaacgtgagcgcgtacgccgcgccggggcgcaccgccaccgcctgcgccgccgacgcgcgcgctcccaggcggagcgcgtgggcgcccggcgcggcggcgaagtacatcccgccgggctgcggcccgccggagacgtactcgacgcggccgcgcagcgcccaccccggcagcgagtccctcccgacgatcaccgtggcgttcatcttccgggggctcatcgcgaagttgccgttcaccagcacgcctgaaaatgccattgtccttacattctcaaacatcacagccatgagatttacagccgcatcgtttggcttattcggcatatttataaatgaaaaataatttgtaaataaaacttttatatatatatatatatatatatatatatatatatatatatatatatatatatatatatgtatttaacaatttacaaacaaaggctgaaaaataaactatgataaaaagacatcaaaatcaattccaaatttatattaaaaatttaaattttcacttgtaagtataagtataagcgaaaagttgagactgttaattatttattgcaagaagagagattcgacaacacaccattaccatcggcggtttgagcttgagatcgaggaggcggaggggcggcaacggcggtggccgcggaggaggagagaggcaggagaagaagcaggaacactctagccatgagctccattatttttgaggtttaaggtttagagtttataatgaaaaatgcagttcgataatttgattagagtgatgctgatgctgccatgtatatatacaggatggcagagaagacaacagtgaggaactgaggacacgtgtacttggaccggctaaagctgctttagagcaagtaacttgctgtaattaattactcatccactcaaaattactgaccactaacaaaaagaaagcagtgcacggtaactcgagagatatatatgggttagatacgtactgaaggccactttggagccagtagcttgctccaacaaaccagcttaaataccttgctaaagcaggataattataattaacagtacatttcctctaaaaaattaacagtacattaatctctcgccgtatccatcgccggagcgcagaacgacgacgaggcatgtcgccggcggcgagccagaatttttgcctgatgggccgtcaacgtctgcccggcccggcccatctaaggtttcgtcttcaattttgctatatatttgtcgacaaattttcctccaaaaatttaacagaatcgtactgtaattacattgtaagttacatgtaattacactgtgactataatgtaacttgtatgtaacttttaaaaatctcttcgtaacatgttatttcggtaaaattaatagagatcgtgggaacaaatccttttacatatgtgtgtgctatgattttttttcttcttcaccagaacaaatcttgtaatagatctaacaattcaaaattacggaaacttacatataagttacactgtagttacatgcaaattacagtgtaattacatacaagttacagtataattacacaacgattgtattataattatatttgtcaaatttttaggagaaaatttgtcgacaaatgtgtagccggtggtcccttcgtctcccccactctaagtcacccacgtggcgccctcccattggacgacaggagcatcaaccctcctcgtctctctcttcctgatctcaccactttgtgactcgtcaccgtctcgcaaccgcaactccggcgatggcgtcgtacggatcggcggcgtacggcgacggcgacggggagaagccctcggcgcaactcggccagcccctcctcccgccgcccaatcagccctactacgccttccccgcgcaggcatacgcgcctccgccgccgccgccgccgccgccgccgccgcagacgctggtgttcgtcccggtcacctccccggtcctcgtccgcctccgccgcctccgcccgcgccgcgtcccctgcctccgcgcgttctccgcccgcacgctcccgctcctcctcttcctcgcgctcctcgccggcctcgccttcctcctctacccgtccgcgcccgtcgcccgcgtcgaggggctccgcctcgaccgcttccgcgtcaacccgcccccgctcccgtccgtcgatctccacctcgcgctccgcctccgcgtccgcaaccccggcctcgtcctcccgctccgataccgcgccgtgtccgccgccgtctcctaccgcggccacctcctcggctccgccgccgcgcgccccggatccggcgagctcggtgccagagggacgacgtacgccgacgccgaggtgtgggtggacgccgggagggtcgtggatgacgtcatcgacctcatcggggacctcgccgcggggtccctgccgctggagatcgtgaccgaggtggtcggcgctgtcagggtcttccgtttcgacatccctgtgaaggtaattttcattttcttgtcataaattttacgaattacattgatttgccaacgatcgattgatatcatggtgatggatattgtttggagaagtttggggcttttgaatatagctagggagagtgttaggctaaatcgtattattaggtttatcacggcagagttaaactgttcttctcttattaaacaaattgcagttcatatgaggggctggggctgctgaatggtagttgatatagttaagtaactatagggcatttgtcaaactgattcttcttgaacctgtaattccacattggtttagaaagtttataaaaattattaaaatttgctaccattaatatgataacttgtctccttaatctacatgctcccgatgttcttagggttaattaaggaatagttccattatttgttaggatatgctatagcacttgtatggacagaattcttgtgcttggtgtatcagtgataggataggattttgcttgcagctactatgttacgaggctctctgttttcattcgagttttttttgggtcaacatttccattttgaagttggtgaagttaaagggccatggttttcctccttttctttcatggtggcaatgcaaagcatcttagtagaaaagacaaggatatataagaggtggtcatttgtcaaacagcgcattgtaaaatatctgtcttatattagtggtacaataaccgagctaacaaatttcataggctgtctctaagataatgatatataagttgcatatgctgatgacatgcccatctgcattatatgagtagcatttgttggaaccaagaagtttagatttagatgaaaaggcctagaaaattatggctttctacttgaatctggccttgaaccatgttgtcccaaattgcaaattaacgacatttaggaaaaaagtgaatttcgttttctttcaatcatggatacattttcttaagcacaaaagataaattgaacagaaaaaactactaagcatgcaaaatattactgct

SEQ ID NO: 61689 - DNA, 4645 bp, Oryza sativa
  unsure (1)..(4645): unsure at all n locations
atgacccggtcacttcccacttaggaacctagctcctatgggagttgttgcacatcgcttcggcgagaccttttcttcctttttttttctcttccctccagagtgttccttgtgaatcaccctattgtacatactctttcttattcttaatgaaatgaaacgcatggctcttgcgttttcgagaaaaaaaatgtaagaaataataatatcataaagctaactatagaagaattagacagagtgacaaaattgtgaggacaatggccaaatgtttgagtttctggatgacttgttgccacaaggttgagtgagaattttttatagtttcagagcctcagttagtggcccctggaggggtaatagcaagggggcaggaggagttgtagaatggacgatacagagtggaggttaactgaagcacatgagaccaaattgttatcagactaaccctacaatggaagagtgggagtggtataataagcaatggaggagtgggagtgacataatagatgagggcagtgctgaagagatacttaaggggaacaggtttgaagcattgaaggaacataattagaaatttcttctcaggattttatgcataacttagcataggcagatactgaccctagtttcaatctgcttggaaaatgcaatactgcaaattagttccacatttcacaataggtttttcccctccaggtgcagaacataagcatttactaagttgtcggttattgttcaacccggggcatttaactttttgccacttttaagatgtggcaattaaggatttgccactcacagtttatgacatgtgggccctcatgtcctatgacatgttggtccagcggcaaatccttaatcgccacttgtaagagtggcaaatagttaaatatctcgctaacccttggttgaatacttaagccagaaatgatgttagttttattttttttagaaaataaacgacagagagctgcatattttgaattaagtggataaaatgtttggtatagacagcatagactgaactcgaccaaagggccaagaacttgtcagaatgttagcactgaaacaaaagtaacttaagttttaaaaatgtgcttcataaaagaatgctttcactatactttatttatcttgttttctgattgatctacttaaatattttgttaaacaatgtgagaattacccacttgtacacattttcaattcctaaaatagatttttgggccaagttttattgttgtcacataggtactatcgatacctccatcttccaagaaaccatactattaatacctccattttccaagaaaccaatcaatttagttctttcttattgtaagtgtaattttcaatgcatagtcaagtcttgataagtttagggaatctaattttgcatgaacaaatatgtatcccttcatgttcaacatcacatgaagtggttaatctgctaacttaaaagtattgttgaagcagctatactcaaaattaggattagatgttgatctcaaaacaagaataaagaatacactagtttgttaattaaggtaaacttaagaactttgtctaatgtagatgaacagcttttcctattttttctgaaattgttaactaaggcagtgccacacagtgagagtgagtgctgtggcaggctgatgctagcctaccatgccaacatgcactagatgaggtgggcaaacatgaatcatatgggatggatggctctaggatgccaaagggccaaggagcgaccggatcctctggctgatgccgtgtgccatctaatttgtgcttgttaggtttggtgaacagtattgtgttcgacacgaagggagatggagctgtgatctgtcagttggatatacaattagtgcatcataccccttcacaatttgttccttcgtgtatcagttgatgatagatcatacagtactagtaggtgctgagatgtcttcgcttttgaatcttcatggttggatgggtcgggattttgtttttgttttgcaagagtgtagatataacaagtcaaataatgggcaataacctcttagcattgcccatatttcaattctcaattggttagataagtcagaataccaacctaaatgctgaatcctctacactctacagcactacagcaggactgagctagctcttttcttaatggaaaaatatgtcatcccatcattttctcaaagagtgttttaccatgaacttcttagtagtggtggtgtacaactgtagcattatacatttgcatatattttgtgttaaaccgctaacatttttactaatccaggggctcataacatgctcagtgaatgtcagcccagatactcagaaaatcataagtcaggattgctattgaggtaatgccttgatcttctctcttatagtttgtactgcattagtttttaatgcaggttatgagtaacatatcaggattgtcttatactgttgtatcttttgtccagtgacaatgcatttgggcctctgatgtaagatgggcgtgcaattcatacctatggtttgcagctattatcaagttgcacggcctgctctatgaaactgcttgagtatgtgcatgtaaatagtttgtaccatgttattctatagacatgaataataattatacgatcccatcgaatttgaccactctctgttttaacctattccaccactaaagaatttttatagcattttataaaatgctatatctgtattggtaaatactaccttaccgaatatgtaacatagccaatatagcagccagtcatggtgtacgatttgacctaaacatgtatggtgtgattgtaactcagtaatttaagatttgcaaaatttgaactcagtaatttaagacattcataatttgaatataagtttgacaaccatggatgtttgctccaaaatgcttaaggtttcaacatctggtccagtctgtctaacagtctgtatacatattctttttctgcactcaataaaagtttggaagtcctgtagctgccacttttttttttttttggtattgtgtgctgtgctaagcacgtcagtatcaaatggagaaggcaagaagggttggggtgatgaacctttccttgcagctggaggtttagacccaccatactaataatttcgacccatgagtattcatcacattctgattgtgcaatagtcctgtccttctggtcaaatggaagaagcagaacaatatgggcacaggtacgtgcatctgactggaccttatcttgttctgtacccattgttgtgtcgatcacgcaaatgtttgtgatcatgcacaacaaaaacctgaatatacacagtctgcttttcccccccatctgctcgtatttcaggaaagagaaaaaaaaaacatcagtgtgatggtccatgcacgtggttcctgcactacacctcaccggatcacccagtgacactgtgacagccaggcatcacctactcttgcatgtgagttgtttctctcacccttctgactgtcccaaatgggtcacttgtatagtatactcacttcgtcctatgaaaaactaacctctgtagatgaatctgtacaagcatttattcagattcatcgttagaagttattttttttttcacggagggtgtatagagtaacattcacgtgcaagcacacacatggggtgaccttttctgtctgtgaaagaccctttgtttgtttacactgtatccacatcaagacaaagactatgcttttgtagccaagttttgcaaccaatctaccggtggattttttattaaaaaacctttttaactatttaatttttagttttaaaaataaaccctctcaaaacttatttctgaatctgaaacttttttaccacgccaaccaaattgttgtgacaagacaatactatcatccaccggtgcaaatctgctaccagcaatactgtcaacactcaacatagattatctaaaccattgattcatatgctcttctgtcagtagaaacaatattattaacccacgaattctaatggtaattatggtgatggcataaataggtttgtttcgttagataagaaaatgtggaaggtccaaatcatttctactatgagtatcagcaaattaatagttgtcacgtgtttgagttagtgaagttacggttgcctctcaaacaatccaattccggcagcgtaatcaaacaatttgccagtacttgcccgttgatatcaagcactgtagcatagacccaaactatttcaaatccgtcaaatttataatgcaatatatccaaataacccaaatcaaaactttggctatctgcctttgatgatagagaggatcccggtcccagtggtagaggtactgttgtcattttctaattgaactgatatgccataccacgtgtaacgcacagtgccagaaccaaaacattatggacatagaaaatgggatagttgcagccagatctccaacaaaatatataaaaagggaagctaaaagacaattatatcaacaggtctgatgtctgtgctagttgcatatttgatcatttgggtagctagatagatttcttttttggtatgttatcaagcaaataataattccaatgaaaaagcaaatgacatgaaacaaagaanaaaaatctaattaaatattttgt

SEQ ID NO: 61690 - DNA, 2420 bp, Oryza sativa
tttactagagctgctgtacgaatacgaactacgctatctgccatccgactgcgttatggtacgtatatcatcttcgtaattttcacaaaatcgcccaactacctgcatgatgatttcatacacaccaaaacatgaattcaccgcttcaactaaaagcaatcaatgcaagttggattgatacgatagaaatgaaaaatatgtgtgaatctgattagtgcagtcagctctctccgatttcatgtcgtttttgcttcaattccttgtcagcaaacggtcgaattaagtagtactagtactgtactgatggtatacgccatttgtcgttaacaaagtactccctcgatttcaaactataatattatgataaatttgtagtgttggtatatgttcaatccaatactaattattatattttgatattatattatattacaccaaattaacttcagctatttacgtttttccttctttgataaatgaatacgcagctgcacatctttgttgccacggtctccttaattattcacgcaaattttacgatattttcagatgaattagttagttaaattccgttaggcataaaaacaattctcgtgtttcaaaggtggcaggccttactgcagtttaattgtgaattttatttataggtttgattaatttttccaactcaatttaccaatttctgataagtaaaaatttcatctgattgatgcgtgctcatgagtcacgagtagtgaatagggtggtgccccgttaccatctctagataaaatagtgatcgatcgctggctcaccagttcgactacacgtacggttaaaaaataactctattatatagtgtattaaagtgcttttaaaagtatatataaatgtagatgttcataatgtgtacataagcacactctatctctataatcatcttcagaagacaggtacgttacctaccataaaaaaaagttagttataaatataagtatccgtattaaatctagaaccaagggattaatgagttggtagggaagctatatttttgaacgcctaatatatcgctatggcgctatgttgttggtttgtgactattttatttcgccaacattgctatatttttggacgcacgacagcctagctatgatgtcttcaaaatgctggcttggcaggatccacctcattccaggctcttgccgcagcagcagctggacactgtttctccctgctagtactagctggttaccttttttaagctaagtacttgaccgtgcacattattttcgaattaacatataaattttaacttaatttttattaacatgttttttaaattgctaaataatgtctatgtgtaagttgctttgaaatatcgaacaaatctattttttaaatttataatatttaaacttaattagttatgcgctaataattttctagttttttcagctctactttatcttcatcttaatctatcgcaaacactatcttgcaccttattagaattagatgaagctatataatgctctactaggctctacggtgacagttcatcgtcgatgtgcatgtttttcttttctttctttttttttccttcgctgagatttttagtgtggctatataagctatgatgcgggacccaaacaatgaaaataattgtatagggctctaggattttatacttttacttttaacgacttgagttgatatgatgctgaaaaatagaaaacaacggaagaaagttgaaataactttaaaccaacctttatattttaaatatagctgaagcttgtaagctaaagagctgccaagaacatatatgaactatttggtttgctctagctccatttttcctgaagctagagtccaaccaaataattttagctttattcaaaaagaagtgaagctgacaaaaatgctctataaatgaactaaaaaggtggagctaggtttagacagctccactctaaaccccaactcatagagttaaatttgagagttggagccctaccaaacacgcattctatttggtaggcctctaacttataaatttaacttctcatttgatagggctcaatatcttaaatttaactttaggagttagggtttgaaatggagttgtggaggtggagctgcctaaacccagtttcacatctctagttcattttgtaaaagtatttcaaccaactccgctcgcattttgggtgaaactgaaaccgtttgattggactataatttcaggagagatagagctagagctatgcctaacaaacccttaatttatcaaatctcaatgtaaccatttccgattttatctacttcaaatggagtacaattgttcgctactttcacaaactccgatgcaatggttactctaaaattaaatttattttaaaacaaataaaatgagctaaaaataaacttattatgagata

SEQ ID NO: 61691 - DNA, 17782 bp, Oryza sativa
atactcctatcaatacgtgaaaccgggcttaagtagccactccataataattcgttcaaatccaggtattttagcgtgcgagtgtagttagtttagatactgaaagttttatcattatcttaaaaaacttatctagggattatcccatccagcgtcaggttcttttatttatttatatatatatatatatatatataaaataatactccatctgtcccccatatatatatatatatatatatatatatatatatatatatatatatgggggacagatggagtattattttatataataaaaatagaaaaaaataatcaatattgagccgagatgcaaccccacgataaaacccacgcgagggagagaagccaccccatcctccccacctccctcctcgccggccggagttctcgtctccggcgaccgccgccgccgccgccctcaccgtccggtaagcacctcccctcctcgtcctcctcctcccgcgtccgctcgccggcgcacatgcattgctcctatcgcacgcatcgtctcggctcggctctgtcgcgatctcgagttccagacccatccccgggagagagaggagggggggggggggagcgccctaccgtcacgggatcgtggccctgctcgccgtgcggcctcctccatccatggcctgatcggcggctgattggtacaccgcatttgcggcctgggtgattggctagtatttttgttctttgtttgggggtgaaaagatgaggaggagaggttggggggaaagggacgggcaaaaaagggtgaagaaaataaatcatatccatccctttcgcactaccgtttgaattttttttggaatatatatgtgtgtggtttgttcggatttgggaggaaagtgaggaggtggatgctcctgatttccgtgaggaactttgctgctgttggttgcaggtggagctccggtgatcgacgccgcgatgtcgaggtctggggccatggatcttgcatctggactcggggggaagatcaccaaggatgaggtcaagtcggctgtcgatgagtaaagcatcttctgctctttgtttctctgcgttggttgattattattttctctctctcttttatttttgttggcatttagatttagatttagatatgcaggtttgattctggtgatgtactgtacttgcatgtctgctgtgctgtacttgaatgcatctcttcagagttcagggttcagaattcagtttgtatgactgagattaaacaaggaaagcacagattcactgatttcgtaatttctcactgttgtttgctcgacttttcgttctgcacccagaaattttcttcttcttttttggtggtagcagttctggacatctgaaaactcctgatgcattgcacctatttcatcttattagaatagtactaggtttttatcatgtgtattgaatgtgatgctttgtggtcgcccatcaggccatcactatataggctacttcaagccatgccaacttgtccatacgtattgtactcccctcccattaatattccaaagacccagcaataaatataagatatgagctttttctaccattcccatgtcttttactccttctcatttgcttttatttgttactgccacaaagtatgctcgctcatctttctgaatcaataatgagagtgcacccacgtcatcttctctaatgtttcatcacctttgtcacctctttaatccttgatttctcgtgcaaggtcaaactatgctctatggttaatcaaggaaaggagtacatactgtggcaccattacagaattattaaaacaagcttatcctcttttaaactatctctatctatgccagttttagcacattctattaagaatttgtcaatacattcaatatttaccctgtataaaaaacatatcaactgcttagcaagaattttattgacactcagaaaaaggatttttgtgctcagaacttggcctgtattttactgttatttattttaaataaattggttttgcaaggtatgagaaataccatggatactatggaggaaaagaagaagcaagaaagtccaactacacagacatggtaaatcatcttagtctctcagaagacagaattattacatttttgtgaatatcttattttgtaaatttgttgctttcctactcaagtcattttctagatgctcagttaaaaggattatatctgcataatttgcttcaactgtttgtctgtaatttgcttcaacttttgcacgataaaaagctgttaatcttcagttcttcttgactagattataaatttaactaagcacgactgattcaaagagatatctaagacaactcaaatattgtgctttttaaattgtcatgttgagtgttgaagcaagacagtacacatattctaggttctgctgtttatgctatatgtcaattgtattttagtcacatatttctaattgaacccctctttattctgtttgaaagaaggaaaccttcaaatttagagtttgtgacaattttttgtttgctgcatcacccatttaccccatgctaattggagataattttgggtttttcagtttttatattagcaactaatgcattaatgccttatcaggttaataaatactatgatcttgccaccagcttctatgagtatggttggggtgaatccttccactttgctcacaggtgagggttttagagagatcatctgtgctcattgtaatgaaatacgagaacgtagttgaagttttgcatattacctgacatctagtgacagaaacttgtcatgttcctgaatgttttagatggaatggagaatccctacgtgaaagcattaagcgacatgagcactttcttgcccttcagcttggagtgaaaccaggaatgaaggttaattttcctatttaaacctatcataaagatttcctgctggttctacactacaacattagaatgaaagtgttaacttcacttccctactgtaggttttggacgtcggttgtggaataggcggaccactaagagaaattgccaaatttaggtttgattcatgggccttctgtccacttgcttgtaatgtgtttgggccagaaattttaatatgcataataaatatttgacatttaaaaattaaacgtgtggtaaattgatcttggataatggtgccaggacaacgtcgttaagtatcaaccctgtacttcctcattatatgttatttttttgggtgaagatggcattgagctcattgtttacttagggcatttctttttcccaaatatcagtgttgatgatccattttctgctaaaatactgtcctcaaaagtgtggaaacttctctttttttcccctcactatggattatgaactagagatgactaatgtggccatgatctgctgtttcctgcagcttggcttcagtcactggattgaacaacaatgagtaccagataactaggggaaaggttaattgatgttcccttacttaatttgatttactctacttctgcatatggttaagaacttcagattagtaaacagttttcagcgtttgctgttcatcacattactcctgtgttgacataagatttttgttttaatatccaggagcttaatcgggtagcaggagttagtggaacttgcgactttgtgaaggtatagttagctaaaatagacattctttttggctctttgcctctttcccccatcttttagtagtcaatcatctatttgcagctgcatctctgtgcaaatgttatttatccctttccagcaaccatcacatattgcaaattaccttgcgtagactctctgcacttgcttagctgtacagagaagacttatttgacaatatatataagctgaaggacaaacagttacattctacatattggtctctatacaggcagacttcatgaagatgccgttttctgataacacttttgatgctgtctatgccattgaggcaacatgccacgcacctgatccggtatgattgcaaattattgcttgtatattaaaactcatcatcaactttaatccctccttgcgacacaaagtcaattggttttttcatgtcaaaggttggctgctataaggagatctatcgtgtattgaagcctggccagtgttttgctgtgtatgagtggtgtattactgatcactatgaaccgaacaatgcaacacacaagaggatcaaggatgaaatcgagcttggcaatggcctgccagatatccgaagcactcaacaatgtcttcaagctgcaaaagatgctgggtttgaggtaatgtagacgctgtgctttacctctcttttgtttgattgtgtgtttgggtttacctgaggaaaacccatggctggaagagtagcccacctctattgttagtttagaaactctggccagttacagcagttttctttcaaagcagcacagtttcatgaacacttctgttatttgttattcctttcccatgggcataatttttttttctgtgaaggttatttgggataaagaccttgctgaagattccccggttccttggtacctgcccttggatccaagccggttttccttgagtagcttccgtctgactactgtggggcgtgcaattactcgcacaatggtaaggccaacagatacatctgtagtcattctttattgttgctacaccttatgttctgagttgattgttcaagatgcacagtgaaatcaagtttgatttgtcccttggagtaaagcgtactatagacattctttcttatcaaattcctccctctgaacagaaaaaagcttaaaattgaggagttggcatcccaaagagggtgcattttagtgccactccattgtttcagtgacatgtggcctaataccaatgaacattcgggggcacaccaatcttgtggtggaaaataattaatgaagttttaggttccctgctgcctttaaaagtggttttgagaacaatggttcatgtaatagtttatgtaacatgaaaacctatagaagttctaccagggctagctagaaaagtcattctttggacatttacaataaataaaacaaacaattatactaatagctagcaaagtttaaaagtactatactattttttttctagaagtatcaaatttcgggtagacttgacataatctgctcagcagatgtgctaaattgcttgtatggtaaattcgatcaaaactttgttacactgaatattcaaagatcaggctgctttgtccactgtaactggccataacagcctgatttaatcatggtatatattcactcttgattcgcatggaaatggaattgagatcctcttctgttattttttaggtgaaggcattggaatacgtcggccttgccccacaaggaagtgaaagggtatctaactttttagagaaggcagctgaaggtctcgtcgaaggtggcaagtaagtctgtctctgattcatatttcagcaccaggaatcagaaaagcaacataattgtcacgaattctggaattccagttcagctgtctgtttttccatttcctctcctgtttaatacttcatgcaaagttctaatgcaaatatattaactacaggaaggaaatcttcacgccgatgtacttctttttggttcgcaagcctatctcagaatgagctcccagaaccacatttcaggtagcatacgattttcgccagccaattaaaacatggccaatatcttctgcaatgtttccctaagctcatattatgtgtgaattcgcagagataaggcgaggagtttgaaagaaacatttggcggtcaaagaaacacctgatgaagctcaaagcttgaagagttcttatgcgtacgaagagatgctgaaatgtgtttaactggtgaattttcgtctgttggtttgccgtgtaaaaaccgtttgatcaaggcacttgtctgcagggtgcctgttttagtctaagacgatgaactgactggtttttgtttgctcgtttctaagttgttagtgacacataagttaagtttgcagttcattcgccagtgtgtattgtaactttgcaataaggcacctgcttgatagctttcttttcatattgttcttcgacaaatataagtgatgattattacctgtactttctcagtttcacaatgtaagtcattctagcatttcccacatttatatttatgctaatgaatctagatagatatatatgtctagatttattggtatcaaaataaatatgggaaatgctagaatgacttacattatgaaacggagggagtactatttttttagcattcgagggtataattttgaagcatgctatagcatcaagattacgggttaactttctttagttaactcatgctctttattttgggttctgttttaatcagtttcgaggcaaaaggcatactacaacagagaattactgtgcacaagctgctcttgatcaattcaattttgcacaacgtccatctttggcataagcagaacagagcgacagataaaaatcatgtaaaggttttttcaaaaatcaatagagataaattaatggccaaaatccatttttgtgcatacttttttttttcaaaaaaataataaaatacacggtagagataatatatttacgagtttaggacggcctgtagagacaaaaatagtcatcacaggaacagtccatcttgtgagaaacgcgtttttttttctttcaatttttgcatttggattgggttggagattaaattaccattaatagattgagagcgaatgaattggtgccacgtgtcaagagaacgaacgggcttgtcgcaggagaactggtcactgttgagatcggctgatccgattaatcctaattactcctaaccattaatccaactataaattccttaaaaaaggactaatccaactcccctaaactgcatgcatgtcaccgtcaccgtgtgaaaaaaacccccaaaaaaaccccccggaaaactctatcctgattagttctagctagtaactaatccgatctgcttaattaaaccccttcagttaatctgttcgttgaccaagtttaattcaaattcaattcaattttaatttattttatctgcatgcgaatgcatgagatcactccaatttatccacatcttatctccattaataaaatcctctatatatactcgaccacctcttggtcatcttcttcctcatcatctccatttgattgatctcgtcgtcgtcgttgacgtcatcaatggcgggtggtttcgccgtcgaggccaaggtcgccggcggcggcgagcggcgggagttcaaggggaagatcacgtggtacgtgtggctgtgcggcatcatcgcggcgacgagcgggctcatgttcggctacgacgtcggcatctccggcggcgtgaccgccatggacggcttcctgatcaagttcttcccgtcggtgtacgcgcggaagcaccgcgcgagggagaacaactactgcaagttcgacgaccagcggctgcagctgttcacctcgtcgctgtacctcgccgcgctggccgccagcttcgcggcgtcgaggctgtgcacgcggctggggcggcggcgcacgatgcagctcgcgtcggtgttcttcctcggcgggacggcgctgtgcgccggcgcggcgaacctggcgatgctgatcgtggggaggatctgcctcggcgtcggcgtcgggttcggcaaccaggcggcgccgctgttcctgtcggagatcgcgccggcgcacatccgcggcgcgctcaacatcctcttccagctcgacgtcaccatcggcatcctcatcgccaacgtcgtcaactacttcacctcgagcgcccacccgagcaccgggtggaggtactccctcggcggcgccggagtgcccgcggcggtgctgttcctgggctcgctggtgatcaccgagacgccgacgagcctcgtggagcgcgggcggcgcgacgccgggcgcgccacgctggagaggatccgcggcacgcgcgacgtcggcgacgagctggacgagatcgcgcgcgcatgcgaggcggcggcggcgctgagcgcggaggagtcggcgtaccggaggctgcggcggcgggagtcgaggccgccgctggtgatcgcggtggcgatgcaggtgttccagcagttcacggggatcaacgccatcatgttctacgcgcccgtgctattccagaccatggggttcaagagcaacgggtcgctgctctccgccgtcgtcaccggcggcgtcaacgtcgtctccacgctcgtctccatcgtcgccgtcgacaagatcggccgccgcaggctcctcctccaggcctgcggccaaatgctcatcgcacaggtaatatattacatatattacacacgaagcaatttagcctttaaacatattacatatttgtatatatatctctatttctaaatatataacacagttggcttttaaaatatagttttttctactacctccgttttttaatagatgacgccattaattttttcttacatgtttgaccattcgtcttattcaaaaattttatgcaaatgtataaaatataaatcacacttaaagtactgtgagtgataaaacaacccaaaacaaaataaattataattacgtaaattttttaaataagacgaatggtcaaacatgtgagaaaaagtcaacggcgtcatctattaaaaaaacggagggagtacatgtttatgttaccttttctttttaaatatatgatgcacttaaatatatctttttattatataattttactataacttccttttaaatacactacacatttaaattttgaaacatatattaatttttaatataaacttttacataagtcctctcccagttcgagaaacccaaaaaacggcaagaggttttccggctagctccgcaagatggtggggacgacctgtattcgaagcctcaccccttctaattatctgatattaggtcatttcttagcattcgcgttcctttagttctacaaactaacatgaaagatccatggcagacagcggtgggggcgatcatgtgggaacacgtgaaggcgaacggcaatccgggcgagaagtgggcggtggcgatcgtggtgctcatctgcgtctacgtctcgagcttcgcgtggtcgtgggggcccctggggtggctaatcccgtcggagacattccccctggcgacgaggacgacggggttctccttcgccgtgagctccaacatgctcttcaccttcctcatcgcgcaggccttcctctccatgatgtgcagtatgaaggccttcatcttcttcttcttcgctatctggatcgttatcatggccgccttcgtcttctggctgctgccggagacgaagggggtgcccatcgacgagatggtcgacacggtgtggcgccgccattggttctggaagaggttcttcaccgatgccggggatggcaggattggtaactgctgatggatgggtttgaaatttgatttgatttgaagatccattgatgaaatcaagtcaaattgaaattagttttacctattatttatgagtaatcggaatgtagtaatttatttgggtgtggatgattatgatgagatgaactacgtactctcaaattcacattcaaattattgagaggcatgcgtacatgtaccgatttattcctcgagcgagtattcagtataattgcaaatgaaggcaataatatatatagcaaatgtacatgaacagaattgaacatactaattcaaacttttcctgtatcaagatcgtggtcacacagtttcttttttctaaaaaagttttctttaactcgttttgtctttcatatacatgtctatagcacaaaactatttaaaatgtgaataatataatcgtttttcataatcaaccaaaggccggctatctgaaacatgaatatagtttacggattcgcttggaatttttttaacctaaatcatgttttgaacataatcatctttatgtattacgagattagcctgtgatatctgaatcactgctagaaaatcgttggggattaatttagatatacgaactatctcatgataggcaaaatatccgaatgttatatgtgaaaataatgttattagattcgccatgaaaactgcttaattttatgaatttactgcgttcttaataatttttatgagtacgtatataattacaaatacaataaataatgaccaaatatctgcacccagttatgtatgtatgtttaaatcatggatcgaaatgtatctctttaactcaccgtactgttcatgcatgttcaagtcatggattcagatctatcgtttaggttccgttcttcttgttggatgaagattaagatttttgtagcaagcttttcaaactgctaaactgtacgtttcgtgtggaaactttctatatgaaagttgttctaaaatattatattaatctattttcaagtttgttataattaaaactcaatcaatcatatgctaatatcacctcgttttacgaaaaaaattaatcttcatcttcatctttgggagaaaagaatataatctttttgaaaaacagctcggcacagcaaatttctattcgcttttgcatttgtaaaccttggttagcatgtacccatgtgtagtagttttgtatcttaaatagaatccatgaaaaatatgcttataagtaatttctagctgttctcaatcgatatccactagaaattatagagaaaaaaaaggcaaaatagaagatggattttaatctctcgcgagagaatgtgcatttacacacccatttttctcttcgatgcagtacaaacaatgatgaaagatttccttaaaaaaataacaatatagtgtacagtgattatttatcactcaacaaaacttatctgaacattgagaaaaagaactaataaattcgtatgtacatgtacattgtgcatgaacgtttatatatatatgctggactgccctttttttttttgtcgatttgctagtgagcttaacttgaaaactgatttgttgttttggggttgggggggggggggggggtggaatactggaatattacaatatatacatatatatatatacatatatatatcctaattaaaagctaagtattatcctaattgtgaactagtagatgcggtcttcccggctgaagcgtctccgacatggaaagggattgaacatgggttgcagttgctgaagacaggacttatatggcgaattggggatgggaccaaggtcaggatttggcgggataaatggattccccgagcctcctctctcatgcttatgggaaggagcggacgctgccgtcttcgctgggtctcgcagctgctgaaacaaggggaaaagagctgggacgttgatctgatcaagcacgtctgtcacccacttgatgtggaagagatcctgaaaatcaatttgtcgccataccaggatgaggatttcctagcttggcactacgaaaaatcagggattttctcggtgaggtctgcttatcgtttagcgtggctgaacaagttccatccggatggagaaggcagtagtagagaaacggacggtgatcgctccatctggcgaagaatttggagtacacctgtgccaccaaaggtccgtattttcgcctggcgtctagcccgaaattatctggctacccagaagaacaggtgtaaacgaaagctgcaagcagttgcgacctgtactatctgcggccagggggaggaagacgagtttcacgcggtgatttcatgtacccggccaagggccctccgtgaaactctgcgggcgagctggaggttaccggataagcgttccctgtcgaagctaggcccagggtggcttcttgggggactcgataagctgagcgaaaacgagcgggcgcagtttctccttgtcctatggcgagcttggtacctgcgtaatgactgtgtcttcggttctgggcaagcgacggtaaagggctctgcatctttccttctgaatctatggaattccttgtgcccgtctggcagtgcaacgctggaaaatgagaaaggaaaaattgtgtcggagggaagacaaagtgatgtgaatgggtgcggggaaagaacccaagtggcaggtgtgtggcaggcaccagctatgggatgggtgaaaataaattggtagcgtcggcattgttattcggaacagcgtggggaatgttttcaccagctatgggatgggtgaaaataatctattttaataatccagcaaataattaaaaaaatagagcccttactatatgtcacatatgccagattacctaatggaacgtgtgctcgttagaagctcacatgcctttaagtttctagttcatttccggtgtgtaagctagggattttttttaattttttgaacctttttaattttaaattttaaaaacaaaccctttcaaaattatttctaaaatttgaaccttttaggcacactagctcatctagtgtgacaagatgacactggcacaccacctgtagcggacgtgacggttttatcctgccacgcgtggccaaataacgctgccacaccagtgagtaggggtggaatcatgaaagcttggtgcaagggaacctcggcttggcttggctcgctacaaacaacgagctaaaactgcagctcggctcggctcgtttatgggctcgagccagctcgagctagctcgcgagcctggcatcaagtaaatctcaagcaggactaagagaaattgagcaatattttaccacatagaatgtgtaataaagtgatatttttctttaatatgtcatcacaacatataaatagataatatgacaatcaaagttataattttcaacaaataaatagttagaaaaggtgtaattttttttgcatatgaccctattgtaccgagccaagcgagcctggcatcaagtaaatctcaagcaagactaggagaaattgagcaatattttaccacatagaatgtgtaataaagcgatatttttctttaatatgtcatcacaacacataaatagataatatgacaatcaaagttataattttcaacaaataaatagttagaaaaggtgtaatttttttttgcatatgaccctattgtaccaagccaagcgagctcacgagtggctcgtgagccagctcgggcttgggtcgtttcggaaacgaggtaggaaggaggcttgggcttggctcgtttggctttcgagccgagccgagctatgcgagcccaagccaagcttgagccgagctcacgagcccaagcttttttgtccacccctaccagtgaggtcggtccccgccggtgtgaccagcgggagtggcatgacggtattgttttgacacgccagtttagttggcgtggtcaaatgttcaaatcttgaaaataagttttggatggatttatttttaaaattaaaaatgaaaaatgttcatttttttgggtaagctagggtagtaataataaaaaaatagtaataataaggtggttaatctctagctggactgactcgccttgactgaaccaaagctacatttttgttttgcttgggacaagcaggagttgagggggagaaacacctggctgatgttcttatgtttcctcattgcatcatcactcatgctatacaattgtgccattcatttttgctaaacttgctaattattccctatgcccatgatgtatttcctcgttgcgttgtacagagaaggacaagaattaatggctggggtggtgtagggccaagcagggtttacaaaactgcgcggctatcacacgcggtaacctttttagtttttgaaaccacggtatgtctcacggttaccacacggttttttgcggtaaccatgtggtaaccgcgtcaaaaacggtaaggggaaccatggggccaagtgcttgttacatacggtgaacttggtgaatggtgatataagtgagacaaccagtgagcatttgttcaccaacatagatttctggcagtgcttttaatgtattaagtgatgtgcctatatcatgcactgtttcacaatgtatattcttcatcttctttttctaaaacaccatatcctctattctatatatgatctcttatatccttatcctccaatgtaatgcatgtgatgatacaacctgttaaaaggtgcttccagagcaatacaattgcatgaaatgcaaacattagtgttgaaagacaaatctttaagtatttattggttatgcactatttggaattatttgttgttcattacggatgtctgacatggcttcaattcagttatatgggctgttgggttcactagcaattcctgcagctgccattgcaaccactgctatagtgtatcaattgttggggatatagtaattgacatatgtgcttcaagtttgttcctattagaatgaaaagttggacttgcttaatacactccatttgtatctaatagccaaagtagcttaggatcaaatgcatgcacatagtaattgtaaagttctttgtgatggtaattagctatgataatgcaacctcatacatgaatgctatttaaataggtgattttatttagatttatatgacatcaagtttcaactgtcacgcatgatgatgcatgactttatttttaacatttgaaccattatactattacaattcagtaccagacaccaccaacggtgggaatgctcctcggagcaatgtagtagttaggatagataccacatatggatggcaagtttaaggccagcaaagcttgagcttgagcttgagtctgatcaaagtagacaacaccgacctgctgcagctgtagttgctgcacaatcgcctgaacgctactaatggcctggtagtgagattgttgcgctaccagcctgagctgttggcaacactgttgctgcatgacttggttgtttatcaattgaaacgtagctggttgccagaagggggttgccactatgctatgctgttgccttacgaactcactgcatgggctgagcacttgttgctgtagcaggagatgcgattgtagttgatattgtctataactttgactaagagcatcaaaccgtgcagaagcgttgcatgcaacaatagcaaggagagcaaatacgaaaatgatcttatttttgaggatctactactatgcttcaactataatgtttgaattgtgtgaaggatgaggagggttttcattatgcttgtctatttatagatgtttccctatcggttgctttagagtgttagttttgcttgatgctatattaggatctaagtgagtcatattatttggatattctgttaggtgcacctaaaaatgttctttgatatcatcatcaaagtaacttttatgcccatcatatatacatgatggtgagcaaaaaaataatgacatgactcatcgctcactttatgtgtcaatgtgataaggattgcaacttttgaaactaagtttgttatgttttgtaagctattattttgataatgcactacacgtggaactttacgactgtgtgggtttatgctctttgaattatataatttcagtaagaaaaaaaattatagtatgttcaatggttttcattgttccattaatactcttgtgaaaacttgtttgtgatacgaaataagttaatgcaataacttttaaattaactttgcagagctttacaataactcaccaacttactctaattgtggttggggattgatttaattcatacttttatagaccaaattgatattgtgttgctaaataaaaattatagtggtgttgctacacctacacagacacagaaggaatcctgatatcatcagctatctactgcttcctccacatggactcaagaagcagaagcaaaaaagaagaaggcatttgctccaacaaagttttccggtgaaaggcaacacattgttctgaacttcctggcatgtattatgtgaatctagcaaattaaccaaacattgacacaatgcgacaccttgtaatgtagccgtgccgagaattgtatatctcacttaccattgtatatcacacgtgccgagaataggagattgatttttgccaaccaaaacgctctaggcagaccaattgggccacatcaaggcccatttcaagattattgtggcttgttcggtctaaccggggacggtttaatgaccggttcatagaaaaaccgaccggttctgccggttcaaagcgggtcatatgcatgtccggtctttcttttgaactgaacgggttctggttttttccggttgaactgtcggcccgttccggttttttccaccatgtccccaaccctccatgtcacctggtttccatagaattaattaggctgccaactagacaaaaagttgatgtggcaacggaataaaagaagagaaagaagcaaaaacatagaaaccaggtcgcatgcgcgacaccgtttcggcgggctgttccaaggcactggaaactagctaaatccgcgttgggttggatgactcgtttctctccccccaccccacccccccaaaaaaaaatcctcgcatctcgatccgctgcgccctaccccgtcaccatgcctgctgcgcgcctcccctcccgcgtctgcttgcttgcttgccacagctgaccctcctctgttaatgttacatgcaaagagctactaatttttttttgcctatgaaaactggtatataaacgatgcaatggggaggtagtgtccatatatgcatttattgatctctcactgctctagacaccacccatggacaccatgggttggggatggcctaatcgaccaaggtgctttgtcgcttcaagtccaacaaaaattacttcacactttaaatgttgcacaggttcaactaaatagaaattaatcttggttggcagcatgcatgacattgcacgatgcacatttactctttgcacaaataaacaaagagacattttgttagatgatgatcattttgagaagacccaattttcttctctttcctaagttaataaaatggcacatcatgttttttcctacgtggcatatcatttaatgctatgaaaaaccattctaagtgaagcgctgggatcaccctaacggcatatgtttctttgagaaagagagtcatcatatttgtttgcaatttgaataatgccaaatatataaaaattggagtttaaaacatcccctgtgtgtttctgtggttgtcttcttttgaattacactgtgctaaatgttagcgctggattgttggactatttcaagggttttaataaatctcatctattttgttacctcaaatccatcatgtcctaatgaccataacttttcgaagaaaaactttcgtgatctgttccaatctaaaacatatgagatatcgaaattatctcaatattggcataatatacaaatgctatgaagcatttttagttttttttatgagaatataattacaacatataatgatcaaatatctgcgaatgtatgtttaaatcatggatctatctttttaactcacgagtggggttactgttcatgcatgttcaagtcatggacaccgatctatatcttactgcattactttaaagttgcatgttcaaatcatggatcctgatctatcgcttattactttgaaatttaaattatgagaaataaatgagcgaactgaagtaccaagagaaatgacctatatggcagttcttgattaaggagtattaatattttactgggaataatgaaatggctactcgaagatgtttataggggcaaagcagtgcaaatgtgcaattgccagccagttaatttt

SEQ ID NO: 61692 - DNA, 1414 bp, Oryza sativa
gggcagtaatcacaataataagggcgctggttcatctatagctggactgactccccttgacttaaccaaagctacatttttgtcctgcttgtgtcaagcaggagttgatgggaagaaatgccttgaagaaagagataatggccaacactgtggcagctggcggtgcacacatgcatccagttactgatgttccttcttgtgttctatagaaaaaagcaagaatggatggggtggtgcagtgtagaatgttagcttgttacataccgcgaactgatgatattagtgaggctagtagtagtgcattagttccccagcataaattttttacagcgcttttaatgtatcaagtgatgtgcctgcatcatgcactgtttcacaaagtattcttgacattattaatcttcttttttctaaaacatcatatcctctgttctatatatgatcacttaaatccttctcctccaatgtaatgtatgtgataatacaacatctgttaaagatgtgtttccagagcaatacaatagcaggccatgcaagcattacagtcgaaaggcaaatgtttgattattcattggatatgcacaatataaaattatttgttattcattacggatatttgacatggtttaaattcaggtatatggtctgctcgacagcgaatcctccagctgcggctacaaccgctgctatagtgtatcaattgttaggggtatagtaattgacatctgtgcttcaagttcgttcctattgggaatgaaaggttgaacttgcttaatgcacttcatttatatctaatagccaaagcagcttaggatcaaatgcatgcatatagtaaaattgtaaagtccctgtgatggtaattagctacgataatgtaataggatttatcctcatagaggaatgctatttaaataggtaagatgattttatttagatttatatgaccctaagtttcaacagtcacacatgatgatgtatgactttatttttaacatacgaactattatattgttacaattcagtaccagacaccaccaacagtggcaatgctcctgggagcactatagtagttagggtagataccacatatggatggcaagttgaaggtcaacagagtttgggcttgagcttgagtctgatcaaagtagacaccactaaattgctgcagttgtagctgttgcacaatcgcttgaacaatactaatggcctggtagtgagattgttgtgctaccagcctgagctgttggcaacactgctgctgcatgacttggttgtttatcaattgaaacgtagctggttgccagaagggggttgccactatgctatactgttgccttacgaactcactgcatgggctgagcacttgttgctgtagtaggagatgcgactgtagttgatattgcctataactttg

SEQ ID NO: 61693 - DNA, 3761 bp, Oryza sativa
acccctcctcccttggcaaggagctctgggtgaaaaccttgttccgtttttgggacggatgacgacggcgtcttttggcgtcgcgaccttcctgagggcgtcgttttagagtcttcgcgtcgtggtggtgttgttggcccggtggcgatcggtctcgcatagcgacggccggttcggtgctcggctcccctctctgtagcgtgtgtttgcggttggcacttggttcggggcgtgtgctctagtgcacatccttcctcgacaaccagctatcgatgtaaaaccttttcttgtaaccttttcttccaatcttaattgaatgacctccttcggtctttccggcgaaaaaaaagtggccaacacgacaagttagcaacacccagcacctgaccgccgagagtttccgcactccgctcgcctgcgcggtgcaccggtgacactgtaccgaaccctgcgcaacccaatcacgtaagctcaactaaatttggcccaaccaaatgctcgctgctagtactagtacaagcgataggggggtctagaatgctcgctgtccatatattagatagataaactggtgagattttacagtcgacggcttgctgctcagcacttgcgctatatagaaagagaagtaatcaacattacagagaaaaaaacgtgcagattggtggcaggacacatattagttcatccagcaaaactttagactgtcacagacaacaaacgctatgtcacacaatgtatgtatagctccctctttgggatgtggacagcggacgtacagggttactatcagatactgcccaatgcaaaaactacaccagtacagaaaaattacagtggaacgcatacatctgcatatgaaaaaaatcgtcacactgaaaagaatcgaatccgacagatttatatagcaggaaaggtggtgctggtgatggctgtgttgaagatggcttatctgctgattcggtagaaggtgcaccattgtaacggtgatattagaatcaagatcacttgtcgcgtccgtcatcaccggtgctgctattttctcggcattgtctgctgcttctagctataccctctaagtgtttcagcaggagcaccttcaaatgtaggagctccagaggttccttgagtcagggagtgccctgcattatcgggtgccttgaatcataggagtgccatgggccattggagaaccttagcttctacctatccatcattgacccatcgatcagtcctcagcttcaggggtactatattgctaggcaggccaagttttcgcaccagatcttttaattgcaacaggaggtgcagatagaggaggccgaaaaacactgcagcagcatcagttccttaacagttggtgcgtgatccagctccttctgtagcatcttattccgcgttatgactaaattcctcaatgatagacgaccatgggctgaaaagtgaaagatcctttgtaagtgcttgataatacatatatttgagcacatttagtcaaataacaaatgaattctttagggcaacaacaacaacgaacagattgaataaaaaacacttaatggtttggctaaactcatgagagaggattggaaaatatgcaaatccttctctctctctctctctctctctctctctctctctctctctctctctctcttaaagaaatcaatgcacatcctctgtatttctaacaggttcatggttcattggtctgctcaagccatacgccctaaaataagtctaagcacatattcctattgacattttactgatcatgctatagcttgcttaaacatacataatcgaaatatgaataaagacagtgtatagcacataacttatgagatgcaaacaaggaaacataaggttttatcatgtgcatgcatgaacaatttgccactccatattccacaaaatgtgatcaaactggagaaggaaattacagacacttgtgtgtggtacaactctctaataatgacacttttgcagacgagatcatgtgggtgagaacttaatttctttatcacaaaaacagtcattgacaagaaccaaaattcttaatggaaacatccaaatcttttgaggaagtagcaacgctaattaaggaagacctagacttacggacttttgccttcaagcctccctaatttcctttctttctttccctccgatgtatccttaagttgtattctccccctgatctaagcccctttaaaacgttgtaacaactcttttttgccctttttccttctaatataaccggcagccctcctgtcctctaccgtttcaaaaaataatagaaacttactactgataaattttggtcaaagtaacataccgacagcctagtaagttcatggtttccaacatggagtgccagacctcgtagaatttctccatgtaaaagcacgctttatagaagtcgcagcagccaatctcagcaatgctagcctgtctggtggactctgtggcatcgataaagtctgaaaattcgttgacaaacttcaagatcgatcccttgcatgccatctgccatactttcttgcttagctactggtaaattaagggtgtgtttagttgggaaaaaggaaatttttaggtgtcacatcggacgtttgaccggatgtccgaaggggttttcggacacgaatgaaaaaactaatttcaaaacttgcctggaaaccgcgagacgaatcttttgagactaattaagccgttattagcacatgtgggttactgtagtatttatggctaatcacggactaattaggcttaaaagattcgtctcacgatttcccctatgactgtgcaattagtttttctttttatctatatttaatgcttcatgtatatgtccaaagattcgatgtgatgtttttggaaaaaaaatttagggaactaaacgggcccttaagaaagtgtgtaacatcggtagcagtagtttcttgtcccacatcctggcaatggtcattgtcaaaagcatgcaagtgtccttttcaagtcatttagtactttgcagggtgagattgaactccaacctgaggaatatcagcagaagtttgaattcatgaagaaacacagaatagtttctgtcaatatcaaccagtacacgtaatttcacaatacagtttaaatagaagcatatcaacataaagcaactgagaaataatatgcacctggggatgaaaacggagcggatacggacggataatgctcataccatattcgttttcatattttttttaccggatacaaaaacgaatacggataactcgaatacggatagctcgaatacggaaacaaatacggattatctcgaatacaaataagaatcgaatatgatcggacacgaatacggaaacaaatttttctcggaacacgaaaaccaactcaacttctaatagaaacaaatatcaacatatataattagctcattttatataaaataaggtataatttataaatattttttaaaatttaaataatattaatagtatggactagtgttaagagataaactactattaaaatctataaaggtatattgaaggttatagagttagaaagaaatggggtatatctcatgggtcctgcggatattcgaatagcactgttcaccggatatccgaattattatccgtatccgacggaaaccctgataccatattcgtattcgtatccgagagaaaatatccatattcgtatccgtatccgaaatatccgagaattatccgatccgaaaggtatccgtatccgttttt

SEQ ID NO: 61694 - DNA, 3422 bp, Oryza sativa
cggtgctcacgaccaagtctagtggccctgcataattagttttgggagtattacatatttacgtctcgcactaaaaaatgtcaacaagatgcaatgttctaagaataaacatataccattcgcgacactaactggattgacatatcctgcaaggcaccgacatcctataccaggatggctgaggataaggcatgtgcgcacatatacctacaaaaagggagtgtcaacagttacaacccgatgtaattcaagataaccataagaaaaaggtaacacccctttttcttctttgcaaactttattccataagaattcgttcatgaaatgagataattaaaagttacacacttacctgtcaacaagtcagagaactccatctctgacactgacaccaatcacaacaagggatacaattggtcatttcagctcaaggggaggtggcttactgtaacagatacccctcctccagcagcagcaactctagcatatcttctatcatccatttattttctgaaacacgcccggcgattcttttttttcttgaaacactggatctccgcaatctgaaacattgccaatgaggtggtctaagatgaaagtttggtaaaaataacttacccaatgtgcaatttaatataccaaagagagaatgggttaaccagcttgattttgactaataagtaaataatgacataaaagctataatagaatttttgcaaaagggcgatatgagactacaggtcacataagtaatattgcacaacaagaccacatcgatcacattgcatcaaccaacaaaaaaatcaaagatattcaggaagcacgaagcccttacatggatatctcaaaggcaacaaacacacctatacatgtataactggaaattctaagatgacctttatttggaggaaaatggatcatctgaagcaaatgatgacccacttcccccaaaacctgataaaggatatagctgttgtgaactgattctacaagatttagggtgtgtgctaagcaaagcacgtccaatgcaatctaattatctgcacgatcacaaccataaataccattttattgaagcaaagcagtactgagtaccgacaatagcatgcttaactagttaactggagaagataatattctactgctgaacaagctgaaaaattaggtctccaacacactgatcaaccaactaaatgctcaaaggtgaaagcaaagaacaacttatccgtacctgttggagccgtcgcaagaatccgtgcgccacttcagtgatctccgatttctgccgccgcgttcttgatccagccgtattcgccaagaaccccgcttctatctccgacttcggcggggtgattcttcatctccgatcttcggaaccgccttcttggcctctggtcgcgttcttgaggttgccccgccaggacctcgtgcgctccgaaacttctcgccgttcttgttgtactcgtgcattcttggattccggccgccttcttgccgccgatatgaacccttggacgccttctttgtcgtcgtggtcccgtcgatgctggggccgccgccgtcgaagaagccgtcgccgtggacgttgggggcgccgccgtcaccgtggacgctggggccgccgccgccgtggacgctggggccgccaccgtcgccaagaagcagtcgccgtggacgctggggccgccgccgtcgccaagaagccctcgccgtggacgctgcggccgccgccgtcgccaagaagccatcgccgtggacgctggggccgccgtcgtcgccaagaagccgtcgcggtggctgcctctccccgaaccggctggtcaccatcttcgcctcttgggtcggcagttcgacccgcgttgttgacgcatatgctatctcacggcctcaacacgtaaaaggaagtacagaattgggttcacatagtccgacccatcaaacgacacaatgttcaagcgtccaaccacgaaccaagaaacacaagaaaattccacggcaccgacgatcggcgctcagcgctgacactcattgagcgaaatgtgaacatgtaggtcctcgctgagcagggaacctgttaccgcaattgcggcaaacgaatggcaagatcagacgatggtgctctaaacgatagtggcgccacatgtcatccctcgtgaggcgtggtactgtcaccgtctcatcgtcgtcagaaagaacacacaccctgcacaagaatcggtgaccacgagcccacagagaaagcaccggtggtgctggtgccccagcctggatttttcacattttggtccttttaaaaaacttatttcgcaaatagacccctagaaaaacttatcctaaaaatggtcctttttggggcgccagagtggctggcgccgtcgtccaacaggacagtgccagcctctctggcgccgtccccctgccgacgtggcggggcgatgctgaggtggctagggagtgcgccagagtggctggcgcccccccccccgaaattttttatttttgttttatttgtttgatatttttttcacgcttagggacacataaaaaccaaccatagaaaaattgaactcaaatggacgtaatatgtgacctgtagaatttttcctctcctctcctctctctccgaactagtgcaaaggagagatgtgcaacttttttatttttattttattttttgatatttttttcacacttaggaactcacaggaatcaaccatgtaaaaaataaactcaaacggacgaaatatgtggtatgtggaattttccaaagttctaccgaaaaacttctctcctcgaaaacacaatcttgcaagcggaatttggaggttttaatatcgccgaacccggcaaagctagagagaatcggatgtaacattttctatagatgtccgtgcatatattatttgcctgattccgagtccgtatgagaaagttacgcctattttattacatgacatattttgtccgtttcggtagagttttggaaaatcctacaagtcacacattttgtccgtttaagtttatttttcacacggtcgcttcctatgttctcctaagtgggaaaaaaatatcaaaaaaatgaaataaaaataaaaaaaattacatctctatgtactgtttaacttatatatgtcatttcatgtggttatattttgaattagattaagtaatttcatatagtggtagagtgcattatgtttaacatgctgatcaaagggttttactaaaggaattatggtctaattttagtgaaggtgcaaagtagactgagtggtatgctagctattttcagacttagttaagtggtagttcgagtttaaattttttttgtggttggttgtatcgtgatcctaagtgtgaaaaaacatccgaaaaaataaaataaaaatgacaccgttgcaacttcatacagagaaacagga

SEQ ID NO: 61695 - DNA, 3502 bp, Oryza sativa
cgccctcctcctgccacgtcggttcgcgtgcgccactgtggccggaggacggcgccagcctctctggcgccgtcccgttggatgacggcgccagccactctggcgcccaaaaaaggaccatttctaggataagttttttcaggggtctatttgcgaaataagtttttcaaaaggaccaaaatgtgaaaaatccagctgccccagccccctgcccgttctccatgtcttcgatgtgatcacacgtgggggagaggaggcgttgacgtgggatgaccagtgggagagagaggaggggttaatgtggggatgacaagtgggggagaggagaggatcgtgttgcctaattccccttttataataggtgagcagataactatgtgcgtcaagccgtcgattaatgtaccgttgatgtacagttgcttcccgtgtactttaacgtgacagaaaaaactacaacaccagttagctcgattggatccaaacaaaatatttataataacaaaaataacttacatatttggactccatctttagcacatgacaaataattttagtaccgaaagataaaaagatacgggggctgttcagattgatgtcattttcagccatactattttttttaaagttgtcaaaaaaatatctacgtttagtttgttgccaaatttggtaaatatataaaaaatcttaccaaaattttgacaatattaccattttggctacaatctgaacaggcccataaaatatcgagagagcgaggtcaagtaactcaattgattagtttctgtctacttaagtcatacatttggtctacttaagtcatacatttggtacatatatgcttgtatttacgattcatttatgtgattttttcggtccgatttttatccggcgtacgtcgccacctccgtcactccgattttgctgcgcaatgcggcccacaaagtctggagtctgtgcgccaccagcctgcagatcgctcctatcgctacaaatcagacgggggagttgggactcctctctgtctcgcgtcggcgagccgttgacacagtggttccagggcgcaccgtacagcatggatggagcaatggagagtagtatcaggcgcagcagattcttttttcacctgaagatgtacttcagcacttaagtctttacggatgtgtataaggcaagcgattaaataaacaatggtcacagctgatcataatagtgattattttttaaaagtatacatatatatggttatcaaattcatatactctgtatttatatgtttttcaataatgaaattttattttggcctttatttcaaacataaatctatatccatatatctttatctatacctaattagaaaataggtaaggcttccgggtcgcttggttccggcgtacgattacgaggatgacggcctggatctcgggaatcctgtcgtcgtcttccgctgttgtctcggcgccgatctccatcgtcgtcgtcgatacggcggcggccatgaccagtattgtctggcacccgtcgttcgcgatcgttgtgatcgtgatggttgtcgtggtcccggtcctcgtttgagcggtctcctcgatttatgttatcatggcaccgtgaagagacatgacgccgagagcgattcacgttgtctcgtgtgcgtcgtgcttctcggcggccgttgatttgatctcggagatcgccagtgccgcgaggtggaggggagctcgttgaggtgattccctccctccggatcttcaccattggcctcgccagttggtggctgctcctggtgtgctgcggtagtggcttcttcaaacgcgttgctgaggttagtcaccgattcccgtagtcgttctgtccaacgctcgaggtcaacgttcagaacgggatcgtaaggagttttcctcagtatcgcttgaacagccctgatatgctgggctagagtagttgattgattccccacttctgcgttggcgtgcgctgacgtgccaacgtcatcgatagccaatacctcccacggcgcgctcgttgtcgatgacccatagtcctcaaggagatgtaagaccgatggttcatgaggatcgatatcgattaccccaacgaatcgatctgaagttagagtcgctccttgttccttgctgttatccctgatggggacatatgacttaggagacggagctttcatggcgccgagaaagactttgcagctcgagaggtcatgattctttgtcttgtgaataggacaatagacatcctgagttggagaagtacgttgaattccatgttctttgcaggcgcgaatttcaacacggacgttgaggaaaacccagcaatcttgcagagtgtgtttcttggttttgtggataggacaccaagaccttgtggcttcggaagtcatctttgtcgactcgtggttcatgtcggaaggacaaggtttgaccgtatcagaatccttctcgagcttagatgtcatcgatattccgttcttcgtctcgatgggaggatttttcgacatggaatcgccttggttcgtagccactgcgttctcgtctccagtcattggaggactggttgagatcggcgtcgtggtgtaaaccgggaagacgatttcgccgacttgagtccataccagcattgttgaagcagggagtactgaggctagtgctgacgttgttgtcgacgaagctggatgacatagtagtagaaccttgagtaccaaggccccctacctggcgcgccactgtcgacgggtgatacccgtagaccagatatagagggtattggggtacgttggtacaaggacctacgtagtacgacatcaagcaaacaaaagacaagaattatactggttcaggccccttgataggtaataaccctaatccagttgatgtgggattatatggtagaaaacacagattacaaagggaacaagggaacttgtcggatccggcgagattgtagtcgagttgtttcgactagccctcgacgatttggctcctcgtaggctccggcttcataggctgtgtaggttgtgttggctctgagattcgatatcttaaaccctccctagggggtcccttttatatcgcagatctagaggtctccacgtagaactcggacgtatcagaccctatacgatacgccaacgacccagttctgcccgagtaggattcttcccgtctataaattccgtgaaaggtttccttacaatatacaggaaatattcgcatgcgcgtggatatgacatatcgatatgtaacgtatatcgaagggcaaagggtatgcctaacccgtaaccctgacaagcatcattttaattgcttatgactgtttattaatttaattctagataaactaaaccaactagaaatttgcctacatatttctcatgatgtgtatttattttatgaccaacgttgattataaattcatataggttttatttatattcatgtttataaattatttatgcctgacagtgacgtaattcatgaattatttctgtttaact

SEQ ID NO: 61696 - DNA, 5758 bp, Oryza sativa
tcctgcagcccaaggaaaaagtataatatatagcgatccaaaacgtttttacccgttgcaacgcacgggccattttttttagtaatgataaaattataatcggatagtagcgcacacaggtgcatcaataactttttccacattattaatttgatttagagaaaagaaatcatagcatcgaaggagtacccaaatttgtgggggccaacttttcatgtgtactcctggtaaaggcatcggcttcatcaccttagccttcaagtcaaaaactccaatatcacgtggcatttgtttacggtcccaaaaaaaacttaaattgtcttcagtgaagtagatgcaatctgcacctaatccggggatcctatcactcaaaaagaatgttgccgagttgctaccaatgaagattgacgcgccaccaaaatcatgcacctctctccactcgcttcctctaggacgctcgtcaagaataaatgcttggaattttactgttggatcgggtttaagctcaggctccggctccggatcatagcggtagttgtggacttgtgggctgcattgtaattgtccttgtcattttcctcctcaatagcagtgacatcgtcatcgctttcagagtcacatcgatcggtactatgctccctcaaaatgagcatcaggtttccgttcggtgactcggctaggtacttcctaatgtagaggggcaggccgtcttcgtctcgggacataaactgtggagcaacgtttcttgggttaaatggtgttgtgacgtcatcatgttcccaggtttggactacgccatctaaggcccctcacagtgctcctagctgtagcgtggcttagtactgccacgtaggtttttttcacccgtgtcgctcggccacgcttctctgcttggacgctcgtgagtaaactaggatgcgcaaaaccaagcctggaaaagggaccgcgcagaggaatcgaggggaggcgctagcgctgtgggcgtcattccctcgccgcccggtgctctcgcgcgggattcggccggcgaaatcccctattcaccctcccaaaatcccctcccgccacaacattatttctcccgccacagataggattggaagagaaaaagcaagaaaatcttgaagattggaagagaaaaacagatcggattcacggcaaaatcatcacagaaaaatcatcacagaaggcggtgccgccgaattccaccacaaaccaccactcaagtcaactcaaatcaccccaaaccacgctgaaatcaactcaaatcaccccaaaccaacagatctggacagtgcaagaaaagaacagcagcgacggctcatgctcctcttcctcgcggcggcggcggctgccgggctcgccgcggcggcctgtgccgcgcggctccgccgctccccggggtccggcggcgctgctcgaggtccccttcggcaaggtcgtgcggtggaggcttgccccgctcgagcctttcccctcctcctctgccgccacacgaggccagcgccgcgcttttgcccgccatcagccgcttgtctgctcccgtctccggccgcccgtcggcgacgcatcgtccactcccgccgctcccaccgctcccgagtccgcgcgggaggagaagcgagcggcgcggtcgacggcgaggcgcacggcggcggcgtcctcggcgcggtcgccggattcgcctcggccaccggagggaggggaaggaggcgcaggggagaagcggagcggcggcacgggaggagaagcgaagcggcgcgggaggagaagaaggcgatggcgatggagtggaggaggagaaagtcgctaggggtaggtggggaataaatttcgtcccgtaccccgtgtctacacgcttgggtaacgctgcactgtgggttcggttttcttcacttgtggctccatccaattaagccacacatagtatgggtgcttgcactgtggggtgggtgtctttgggccaacttttttggcgagagctacgggccccatagctcgcactgtgagaggcctaaggtgaccatgtagaattgtcctcggtaaacgatcacatcttcatacatgtgtcgcgtttgcaagggcatccattttgcatcacgcccacgagcaagcacaaccctgttccttggacaatgcatcatcatgataaagtattcaccagaactagggtcccacaacgggacggctttaaggagacgagatgaccggatttcctccgcagaaatctcaatgtcggagcaccatccgacaaacctggtgtggccctccggccagtaggtttccacgaatgaggctactttaaacaagaacctagcttcatcaccgtcagttcttggaagggcatcaaagtaaccggtagtggtgatggatggcagcgagtgttgagtgccggagatggggttaaggaggtgcagcccgcacttgtcatctgttgtcacaagccaacccttcgccgagccaatccacatacggctttggatggcaggggaaggcagggtgattgagcgacgccgtccatccgagaaagagtagaagtccgcgacggctagatgttggggggaatcaccggcggccggtagcatgagccaaggcggttcaggcttcggatgaaggcggaggttcatgccgtatccgccgcccgcttccacgtcttgcagacggcgccaaacttgatccagtctgcgaggactaggcgggttacaaatgttagagtttgtgtcgaatatgtgtacgtagtcggttacagtttaggacttggagttgtaataggtattaggactagagtatgagtcggactctatcctaggatccctcataaatagaggggcgtgcctgttgtaaccgcatggcgacttagcatagcgagagggagcggctgccggcgtcgaccggccgtgagtcgttgtaactctgatacgctatatatgatggatcggggaggagcgcccgtaatcagtgccccggagatgtaggctacggctgaactccgttaccaaatatcgtgtctcggtgtcgtcatcgttttggatctcctatggagttttcttccgtatttagctatcgatgtcgatttcggggctggttttataacaagtggtatcagagcctgcgggaggtccatggtagaggcgcgatggaggtgctccacaccgcgtagcctgctataatgcccagggaggggcattggcgcaaggtggagcacggcggcgatcaacggagtcttgatcggtggatcgaacacttctggcggcggccggaaccgtcgatggctgccttcaacagggagatgactagacatggtgctcgggttgatggcggcggaagcgattggcgatccaatcggtgggtcggacacttcgggcgggtggcttggactttccggtgagctactctcgatagggagacgtgcggccgcacgctcgggttgattgaagctggaggcaatcggcgttctcgatcggtggattcgaacactctgggcggggtggcccgggcctttcgatgtgttgagttcgacagggagatggctagacgtagtgctcaggtcgttcggcggctgggaagacggcatgcgacttgtcggcttcggctcgcgactagattgatggcgttcaatcgaaagtcggagcgggtggatcctataggttgttttggaggtgttgacgaggtatttgcgtgacaaactgctacggagaaggcgcacatacgaaaagcaacggaatcaggcagaagggcagtcaatttcagaccgtcaatgcgctgatcaatcatgttagcacagcaataagcattggttgcaactgaccggcggtattcgtcaccagcgaggttcagcgggaggctaggtggctgcgctagaggtcgtacgggtgcgtggaggctgaggaggtcacggagatggcggtgtgcacgtgttggtgttgaagccgggaccatggaacgtggccagagcccgagtagcaggaagtcggattgcgcaggactcgatctggagaggttgtgacatggaaggagtcggatatgtttccaactcggatgcatagcacaacagagaaatagattgagggagagacctagtcaagcacggaaggggaatcggacgaggactacgattcgttcatgaatcggactcgatttttcccaaataaaagcagcagaggaccacaggattgcaacaacgcaatcgaaacaaatcatctagcagagggcgagattcgtacccgattttcgcagaggcaaaggtggtttgggcggcgaggtcacgggcggctggagacgcgtcattgcaggtaggcggcgcacggcggcgtggtactcggcgacgttcgtcgcagctcaggcaggagcttgcggcggcggcggcggcggttcccggcgaggaaccggcggcggacttcggcggcaggcgctcccaggtggcaggcggcggcttcccaaggtaggcgacgcggcggctcctcgcggggtcggcgcaggtgacagcggcgggaggcggcggcgccccaggcggtttctgaggtggggggcatggtgcttcttgcggggccggcagcgtgaggagcaggaggcggcggcgcatcgggaaaagcggcgcgggcgcggtttctgggaggagcgaggaagccaaaggaagaagggagacaggatcgatctgtttttctttgactggtggttgaccaagtaaaagaaaccggtccggttttttggagaaagaaaaaaaaaccggttcggtccggctggtactgttcgagttagtcggtggggtcgattgaaccaaggcagatcaatttaacagggcaacagctgttgagttgattatcgtcgatggcggtgacggtggtttccaaatttgagatggtgaagttcgatggcactggaaatttcgttctctggcagatgaggctgaaggatctgttggctcaacaggggatatccaaggctcttgaggagacgatgccggaaaagatggatgctggcaagtgggaggagatgaaggcgcaggcagctgcaacaatacgcttgagtctctcggattctgtcatgtatcaggtcatggatgaaaaaacaccgaaggaaatttgggacaagttggcaagcctgtatatgtccaagtcgctgacgagtaagttgtatctcaaacaacagctgtatggtttgcagatgcaagaggagtcagatcttaggaagcacgtggacgtcttcaatcagttggttgtggatctaagtaagttagatgtgaatctgtatgatgaagacaaggccataattcttctgtgctcgcttccaccgtcgtatgaacatgtggtgactaccctgacgcacggcaaggatactatcaaaactgaggagataatttcgtcgttgcttgcacgagacttgagaagatcaaagaaaaacgaggcaatggaggcttctcaggctgagagtttgctggtcaaggcaaagcatgatcatgaagcgggggtgtcgaagagcaatgagaagggagcacggtgctataagtgtcatgagtttggacatataaggaggaattgcccgttactgaagaagaggaaagatggcattgcaagtttagcagctcgtggtgatgattcagatagcagcagtcatgagattctcacagtgtctaacgagaagtctggagaagcgtggatgttggactcagctagttcctatcacgtgacatcgaagcgggagtggttcttttcatacaaatctggtgattttggtgttgtttacttgggcgatgacacga

SEQ ID NO: 61697 - DNA, 1431 bp, Oryza sativa
cgtgccgggactaaggaagagtttgatttcgcttgggagcctacatgagacaggttggttgtatcaggtggattttgatggaagaccatgaatatcatgaaggacggcaagactgttatgactggtgagagaacaagctcatgtttgtacaagttacaagggaatgctgttgcaggtggagtcatggaagatgggtatgctggtgttgctgtgcacgatcctgaaggcggcgagcctggcgtaagctctacgggcggctcggcgtgagctgcggcagaaccaactcaagtcctggtacacggaggttcgagcaaataacagattcggattggcgtggcatattcgccaaggtggagtttgttagagtttgtgtcgaatatgtgtacgtagacggttacagtttaggacttggagttgtaataggtattaagactagagtatgagtcgaactctattctaggatccctcataaatagaggggcgtgcctgttgtaaccgcatggcgacttagcatagcgagagggagcggctgccggcgtcaccggccgtgagtcgttgtaactctgatacgctgtatatgctggatcagggaggagcgcccgtaatcagtgccccggagatataggctacggctgaactccgttaccaaatatcgtgtctcggtgtcgtcatcgttttggatctcctatggcgttttcttccgcgtttagctaccgatgtcatttcggggctggttttatatcaacaaactcgatcaaaatgtccgtgggaagtttggtccaatccatggaggagggagtcgatgaacacgaacacgtcgcacgagggagtagttaccaactcaccacagagatatataggccgtgcaactatgcaaagccatccgaaacggaaacgtcgtaggcagggttttccgatacacgtacagacaaacaaagcaaacagacctggatcgaaatcttatcgcgcagtccaacacccgagttaatgattttcgcgccccgctagctcgcccgcgcggtgcaccgctgacgctgaacatgtctcctttctcccgatcccagcgctgcccccacgcgcgcgcacgtacgcgtaagcccaactctttttggcccgtcctcgaccgcgcgcaggcatgctaccgacgccggatggaataagttcacttcatgaccctcaaatgtgatcgaaatctaaacgataaccctaaactacaaaaccaaaatcagatatctcgacccccaaaatcctaaaaccggtacaatttgactccctgagcggttttaggaggcggttttgctgacgtggcgccacgtggtgcctatgtggcaatattgaccgaatctttgttacacacggcgttgacgtggcacctacatggcggtagaaataaaaaatatacgtgggacccattaatcattcacacaaaaa

SEQ ID NO: 61698 - DNA, 2982 bp, Oryza sativa
cctgatagctcgcgtcgcgtgtcccgaggcacgcgcgtgcgcaccgccgcacagggcctgtttctcagatgtgcgcgaggagggagcggtgctgtgtacttgtgtgtgctgatcgcgattatattgcgttgaaagaattgttagaagaggataacactactactacagtagtcaatcgtggtagtcatgcactacactgaagtgactgatcactgttgcttgcatgattggattgactatttagatgccgagtagtaattcggatatctcatcgaaccaggttacaaaatgcatgagagcaagttgtttaatagtatagccaaatactggctccaaatcaactgtagtcaatttaatagtcaatttatacaatagtaatatataaacatatacacaatagtaatatataaacgtataccacactattagtttatggtcccacatgtcatacatatatttcgtcttggagcccgtgctgcaactggctacaaatctgtagcccactgctcatctctatcttctttcatctactcgatatgtgtttatagctggcatatagcctactattgtatctgctcactaccacacttgagaactaccctgtgggctgttatattttctatgggttccgcaaccaacccacaggaatatgtatttttgtgatggttctacttatccctacagaataattcatttttctggcggtgcggccctacaggtaaatgagactaaggagaagagagagataaccctaacattcgcccatcccccagaagacttcggcattttcttccccaccgctgccaccctcccatcctccgccccctcactggatctcgcccacgacggcctccgctcgctgactcaagggagcatccaccttcgccgcacctcctcgccctaacgccagggagcagcgtcggccacctccccgcgcctcgtcgccccgacgtaaggaagaagcgccgacacctctcttgcccttgtcaggtgaggagcaccatccccgcgcggccgcgcccctcgtcgtctggctttggccggatccactctcccttcatcttatgtccgttcgggcgggcaagcgtgaacccaccgagtatgcggcgcagctcggacgcatcagatctggcagcccctggcacaggcggtgccagatccgtctacgagggccgaggagagtgggcgatgcctccttccccctcctcgatgtccattgcctcatcctcatcttgaaagataagcttttttttttctccaaattcttgttatcctgccatggcttcagatccgtgctccccaccgtagtggctacagattgggaataggctttccgatctagtgactagagatattgggttcgacttgctaagatccggtgatgcctttgctttattataactagccgggtggcccgcgcaattgcgcggctagcacccaaacaaatcatatattttttaatatgattttacttataatttattaaatagccatctcattgtcttaagactttgaaagaccaaatcttatcatccccgtgtttctaattatatagttttttaaaagtcacaccagttgctaccccttatgtcatcttcttctttatttgcttgctcgatctaccactatttctattcattctccttggaacctttaaaaattggatcttatagtttttagagtttattatcacgttgggtttcgtttttataatttctagacatccagttaaacattgccattatactcctctatggctcgtccactgtctcttctatttattgtcattgagatttttaaaatcgaatataattatcgtttagattcatttttactttctagaagtcccgccaaaccgtcagcggctttgccattgtacttctctacggctcgcccgttgcctcccttttttattgtcattgagattttaaaatcgaacatgattatcattattttttttactttttagaagttctgaacctttaaaaattgaacattatagtttttagagtttattgtcttgttgggttttattttttataatttttagaagtctcgtcaaacgatgccactatgctcctctatggcatgtccgccgtctactctttattgtcattgtgattctaaaaatcgaacataactatcgttgggattcattttttattttctagaagtctcatcaaccatcggcggctttgtaactatactcctatataccccacccgctgcttctcctttttattgtcattgagattttaaaaattaaatatgattatcgatggggtttattttttttactttttggaagtcccgtcaaccgccttactcgtttgcttcacggcctgcctgtcgtccctccttttaatcatcattaggattttatttggtgttttattaacagtttttatatgtcgtatcaaccaccaccacgctactcctttataggcctgttacttaatttatctcgtcatgtgttttagatggtcttttctttcaatagtctttatttttatcacaaatttttgttatttataaattgtattcctaactgaaatcttatttttctttttctaattcagaatttatttttttcaaattttaattaatatcgtattgtgttcttttaatttttttattttttattttcaatttcagttgttttaaaattttattcctacttgaactctcttttagtttttctaattttagatattattatatttttttattctgaattttaattaatctcgtattgggttcttatatggattcttcttttaatattgcttatttttaatttcaaattttagctaattttaaattgtattcctacttgaactcttcttttttttcctaatttcgggttttatttttatttttatcctcaattttaattaatctcgtattgggttcttatatggactcttcttttaatattccttatttttaattccgaatttcacctatttaaaaattgtattc

SEQ ID NO: 61699 - DNA, 5399 bp, Oryza sativa
gcattaaactagttagtttgctcataaccgatttgttgtgcaattttgagatggaatctgaagtgatttggggtttgaggggagtacaacgtaggtgatacatatgcttgactttgtcttgtggacttatttaactactgcaaactatttttttttcacttggcatgctcttttttgccaatttgctaacgccattgctgtccttgaaggtccttagcgtgagcaggcttggcgtggcctaagcctttattcctcttctgacagaatcacaaactgaggtaaatcacaaattaattcatggtacattctacttgtatactgcatcattgctaatcaattaggaaaaagaacagaagtggttgatcctaatgacaatgcagttactgaagctgttgtgaaatatggcattaaactagttaatttgctcatgaactgattttttgtgaaatgttgagatggagtctgaagtccaatgttggggttcaagggttgttctatgtactggtgaagtggtgacacatatgcttggccttatcttgtggacttatttaactactgcaacagattttttttctcttgccatgctattttttgccaatttactaacgtcactgctatctatagtatgcactgaactgaagctgttgatgcaccatatattaatgtactgcttgtttctagaggtagcacagtgtacttcaatgtttttgtgactcgggaaaatttatgcatgtcagaattgtcttcagaatttctcaattgacacatcctaaaatacttaatgccttatttttcttgttcctctgaatatgtcagtgaaggatatatagtttgtgcaaagcctgttgcttaaaagccccctcctcaatatgtagcatttcaaagacatacaaaagatgataaaatagctagagcttaaatgcttggaagagggataagttatctgcatttgctgtttcatctacttgtattattggtactggaagttgtaactcccataactcgtaacttacagtggtgataaaagattcttgttgaatgtaaattggttataaacttataagttacagggctgaaagtttgcttgtattttgatggatgaatttgtgtgcatgtgaattgctgtgtatatatatataggaaacaactccattgctataatgtgttgagaaagtattgttcagtaatccatattgacatatgaactgcattgttggttttttttttctgccttgaagttaatttttctgacggttctacctttgtttttctgacggttccacgtcaaaattatggggacaaaaacgtgacggcagtggattttttctgtgttcctccatcagaaaaatacccacagaaattgtttttctgtagggaaaccgtcaggaaaatggaatttttccgtggtgatttttctgtcggcaatttctgtcgattcacccacaggaaaataatttctgacgggaaaactatttttctgacggtttcgctcctacagggtaggtcccaaatctggtagtggctctgataccgctatattcgaagggcgtacccagccttagctaaatcttatgctacttggagttctagaacaaacagaaaaggtgctgaaattaatttgaagagagagtggcacagcgcaaaaagcctgaaaggccaaaatgatagccacattcgctgcatggccaacttaattggttagggccacgtaatcagcttgggaaccactgaaacccatttgacagggcaccagtcattacggtctcctggttttcctctcttccctatctccctaggacgacggcggtagacatagagaaggacgacggccaacggtagaggagctaggcaatggcggtgggcctcgatggcatctcggagaggggcgatgtggagggagctcaacttggacctcttatcacgtctggtgagagatgactcagagtaagccctcttcagcaactagagggtaaaaaaaagaggaggaaacaacgagcagccggcggcaaagtacatccgttgcgctccccatcgccgttgccgccactgcgaactttgatttcccaagtccctctgccctgatcctcctttgcgccctctcgagctcgtcgccatctcactcatagccgttagtggcgccaacagtctttcaagcggatcttagcagacgaagcgcatgcagatgacgactgaccatccccattgattccccttatcgttgtcagcatgcaacctcctcacgcgcggctagatgaggttgctcacgagctgcgatgtgactcccaaccccgcgtgacggcataacatccgatgaacacccagacaacgagaaggccaccatggctagttcgttacgctctatcgccgcaacagtccatgtcctcccttttcatccccttcccctacctcctcctttatgatatcctttcctttttttggcgccgttgtccctgagccttccctatagccactgccctggagagatggtgaagaaatggggaagaatgtaagggccctgacataggtttcatgtggtctcacggccattttgactacagtcaactcaccatgtgagtgaaaatcggtcaaaatactgtcctgcgacctcgggtactctggttgtaagttgtgggatatgttatatctggtattaccattcaattacacgatgcaaactcgaagttaaaatgagggaccaaaagtgcacttattccgctgaagtgctgaacattggaccgatctcctttgtgcgtcctaaccgatccaacggctgcccacgcacacgtacgagtaacccagttttatttcggcccaactggtgcccaagtgcccgaccgcgcgtaggtttgctattgccgccgcggatagctctcgtggccgccacggaacgaggtccgcgcgctcgcgattgggctggcagatggatgcctggaagcgttggaagtgggctcatatattaggagaggaacatacaagtcaatagtggtaggcatgcacactgaagactgaactgactgatctgaactgttgcttgcatgattggattggttgtttagataggagtacttggataccttaatcaaatcatactacaacatgcatatggtactagagttctagagtactctctgtatttattttgcgatggagggagtagaaagcaaaggtgttgagattttctttagaagagagagtgccacaacaatgtcttactttttttttcagattattcattggattatcaaaacggattatttggtatatacttttaaaaagaatatgttttctacaaactttttctactatattgcttagatcactcgttttaacttttaaactctttttaatttatttttaaaaatattttggttaccccttaaaacccatcgcaataagctgcaaaataatctgaaaagtacggggtgggtttgaaagtttatactttggaatggcaaccacattgctgcatggccatcttgaggagagataaagactcaaagtattctttccatgaggttctacctcatgttaaatttcctctaatattcacatgggaagaggcatttcataggattccataggatttattcttttgattcaaaaggctatataggaaaaaaaaatcatataggaatgaaattccctaaaatttttatgaatttcctttcaatcaaaaggggtctaagtttgctagccaacaatgagatggctagctactcatagacttactttgtacggcaaacataaccaaaaataccataattagaaccatctcgatctaagctctagcgagctacttcaaacctttcgccactagcgcgcagcatgtcgttcttgttgctttcctttcgtagcccttgggctacggtttactttcccgggttatacggctcatcagagttagcagtggggcataatccacaaactgccttgttgatcgtcgaaatcacaaagaaacacgcaaaattctggcgtggcggccgcggggaaccgtactgcatgccggcaatacggcgaagaagcaccggccccagtaccgtgtggatgcacggcatcatacggtacgaccgaccccgccgggggctgcgctgatgaaagatgcgcttaaaccgggggggagcagtatcagcatcagcagaacgtgacaccccggtcccgcgcgtcatagtcgatccaaaagccccccatgatcctctcgccagagcctggcaccgggccccacatatatcgcccgcccaatcgagcggggccccgaaaagtatcaggcacaggagacgcgatgcgttcgctgatctgaaaaagataaaaaggaccaacgtacgcatgcaaccgcgcggaggagaggaggcgagcgtgcagcggggcagagctaaacacgaacgaaagcccggtggtggcgagttggcgactgagcgcccgtgtacgtcgctggattccccgacttgtcaccgttgcaggcttgatgtcccccgctgcgttcgcccgacggcgggggccgtccgcacattaaccgcttgtgtaagtgagctttatgcgcggtcgtcggaagctagctagcaaacaatgccttgactgttgggggcgctttgggagcagctggcgcgcgcgtggggtcttctccggcgaagcagagcggacaacgtgtggagttcccaggagagatcgagcgagacgccgagacggacacggtcacgcagctttgctgctgatgtgggggcttcgttcactgcgtgcactcggtccgtggaacagtggattagataagaggctccgacgcgagctgatcggacaacggcgtccggctctccgaaaggccggctggagtggagtggagtacaggagggttcagcacagcgccaggccggcttaaacatgaattctgtgagaaaattttgtcatcgatcttcatctcatctctttaaacgtgtattaagagtagttatacctacgggtgtttgctgcacaggcaatgaggtgtatgtgtgtgcatctttctcgaaaaatataaatgtactcgtgctgattttaaatataccatgtaagttgtttagacttgtgttgtgtatatgaattgagaaaacaacttgcttactccttgtttttacatttctgagatttacgagggggatactaacatagtaacatttagagtatatttcattttgaaccacttttaataaccactggtagagaaaccatctttggtcggtcgacctatatccacaatagtcccggttccattaaaaaccgggactaaaaatgatttttagtcccggttaataagaggaagatctttagtcccggttgttgttaccaaccgggactaaaaatcatctttactcccggttgattccatgtcaggctgtgtcagggccctatgatctttagtcccggttagt

SEQ ID NO: 61700 - DNA, 2526 bp, Oryza sativa
atgtatatacgtatatctgatgtgacaaccaaacctaaaaattttgctcatctaaataaggtctgaaccaaccggttgaattggtgttcaatgacggtgcattgatcgggctggccgtgcagtaaggaaattaaaagcagggctagctgggaagaaaggcagtaagacaccgtggacaaaagagtaatagcatatattgactacctccattattgttttctactggcatcgatacacatcttttactttatcgttgtttactttattacaactaggaaggatggaaagatgcgtggatatcttatttattatttatataaataatattagaagagttaagtcatatctcatcatataaatataaaaaaaattatagatttcgtctcataagaaaaaaaatatgttgtaaaatagatagtagactttaatataaacaataaaaatgtttcttgtattaaaaaatcactgttgatcaggatacatttaaactcatctattgtcgccgttacttattagcattatcgctaaatgccttttgaataaatggaactgcatatgtaccaccaaaataagtctaatgcatcattaatacataaaaacattcatcttcgctgcatacctaaatgtttatgtcaacacttaatttttaatctataaataagtaatctgaaaatattgcttctattggttaatggatagcaccgttaacaattagatatgaatgccccctctaacgggtgaagctaccaaggctttatttctcttttgccttcatacataggttccgtatcgatatactcgtgcctctcaaggccagcatggagcacacttttaagacttagttcactgtcaatatcttcaaagacgattgtatcgctaagtaggaagttgagcactattgtcaatggtaccctccactaggactgcctcaactcaaccatatatatgccccatgctatactcatggtaacgcaacaagcactatcatccatgcttgatgcccttcaggggaaagcaagaaaagataaatgtgatgagaatagttctttccataaaaagtatatatatttttattttttagacacaatttgtttgtggtgttaattcaaatttttatggtacagatacaatgctctgttttgaaatgagcaaggttgatccttaaaatcgcaatatttaaccatgataagtcatcaacaatataactatgatggagcggatggttaatggaattttttttatataatatatataccttcccacatctaactgtatactggtgccttacatgcatggccagtataaagtcagatttggtggataagagatttttgatatatttgaatgcaagtaccatgtgccaaaggaagtcgttttggacagcgatatggtctccaaaactcaactttgacttcttgtttctataaaaatatttattgaaaatgatatatgcatacttttatgaaagtatttttcaagacaaatctattcatataatttttacattttcaaactcaacaacttgagagctattcatgatttatattctcaaggtttgacttaaatattgtcttaaacgacttcctttacaagtacggagggattacaaataaaagtagttaaataagtaaatattccactgtattttcttatggcaaagctatcgatatcatttcaaagtgacaacacaaatatttttgttatgtatatgttgtgatcgaagttttttaaaggtatgcatgaactcacatgttctaaaatgacgacaagacctagagagggacaaatagaagttttcaccagaagatcgatcgacaaagagcaattttcacaaataatttatcagcacactaggtagctccaataatgcaggatacaaccatctcagattcacaaagcaaaccaaattattggccccaaaatacatccgaaaagtcataatatcacacacatctaagctagccatggaccacgagccgggccaacaggggggaaggtaacatggcaaccaaaggttgttaacacacacaagaagaggaggatctttcggaaacagctcaacgaatcgtgcccgagatgcagaagaaggccggacccccgggctagctatttactggcgagtactgtgttgtactacacatctatagtagggtggggaagggaaaagacatggacaagaacatgctcagatggctacaggaagttgatagtaatgccaatgtggacggcgcgggggccggttgatgaaggcaccaccagccgttctttctttggacagcatggcccctaaaatccaccatgcatgatcagtgctgtttaattagggttcagccgctcagaggaccagtaagcaaaagttgtgggctttaatttgctttagcaatcagtatccctgctaaaagtgtgcaggttatgtaaagggtagttaaagatgtatataactacatgttcacaatggcatgtcacatgttcacaatggcatgtccttgtgaccaaggagaatatcatagaacaacttcaagttct

SEQ ID NO: 61701 - DNA, 13073 bp, Oryza sativa
ccggagagattactcccgcgccgtcggcctctcgtcacagcgccccgtcccgcacggtagtgcctccctccgttcttcctcctcgctccatctcctccccttagatttcggtagtagctcgagtagcctccccgtagttagccggcgccgccccgactgttgccgtcgctcgccgtgtgctcgccgccgtcgccgcccgagctccgtagcacccgctcgtcgccggcctcgctcggcgtagttccgcccaatccgacgctagcgtcgagttcccgacgccgcgtagatgctctcaccgccgggaatcgacctctcgtgacctcgtcgccgtttccctcttctcccgccgccggttgccgccgccgcaatccgccgccgtcgagcaacctccgacgaatccgagccgttggctcgtctccccttgtcacgtgcagccgcccggtgtgctcgcttttgcctgtatcaccgtggttcgctccgctgctcgccgccgccacccgccgtccattcgcggccgggtcgtcgtctacctcccgccggcccgcgtggcagccacgtaggcgccacgtcggcgccagctcagcctagaccgggtcgagcccaccccggtcggtccctccccgtgcgcgcgttccaccgcgagccgtgaggctgcgcgtgggcccgccgcatccgcgtccaccgcgagccgcgcgcgtgcaccgcgtcccaaccccgcccgcgcgcgtgcgccgtgcgcaccctccgcacggtgagccgagccgctgacaagcgggtcccacccgggaccacgcgtggtgagcccggtccaccggctccctctctctcctccctcccgcgcgcgcgcgcttgggccgtcttgggccggccggtccgttaagctcggccgagctgccccaaatctcttgggccgcaccctagccacccgagaaaagtctatattccctccctcctttcttttctttttcttttccaaaaaggatttaattaaatcctttttccgttagaccaaaaatccaataatcttagaaattcaatatcttcccacccgtaaatccgtttgactccgttcaacttccaaaattcctcaaatctcgagatctatctaatggcacgcttagaggtcattaatagggctttattttcgccgtttgttgagttgttccgtttcgcgtgtagttccggagcccgaagacccgcagtgcgaggatttcgaggatcaagctccagatctcgagcaaggcaagccacctttgaacatcttgagcctatatttgaaatctaattatattgcttgcaaaatattatgcattgataggatcgcacttaatctattgttccgtctgcaaggcagattggcggacctacctaaattgttgcatttgatcctttccttgttaattgttacagcatgtccccttgtaaccacctagttgcgtcttgatattcgtgcatcctgtgcgagtatcgacggacgccttcaaacttataatctgaataacaacttgggtaaaacttgggttttacgaaagatttggaaaacccgacacctgggtcggtgcttgcgaactaaatgaatttccagaaccgcggaccggggaacgtaccgggtgtacggtttcccgctctcgcacttaaggaccgatttccttggaatttcatccaaacataagataagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgttggcatatggtaaacctgtatcggctttcaaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaaggggttcgatgtttgaaaaatcagcagctgacgggatcagctaggcccgggtggccgtttgaaaagttgttggcccgggtggccgtttgaaaagttgttggcccgggtggccgtttgaaaagctgttggccgggtgccaaccttgttgcaatcctaaagagtgacacattgcacatactccgaccggacgagacgcactgtctcatccgagtcgtttgagaagcactcacctaatcattttagaaaagagttcaaataaaataaattgcaaaaataacagcctttccttgaagcctgcattaaacacttatttcccctggcttgctgagtactcccgtactcacccttgctctatataaataatccccccccagttgctgaagaagatgaagtggatcctgctgacgaggagttcttccaggagcaagtcggctacgatgagttttagggtttcggcctagttcccaagtcgtgcctgtgatgattggtccaagtcctggcttccgctttccttttgtaatgcagttgtgagctcgggatctgtccgcagcccaacatgactatacttctactctttaataaagagacctctgttgctgtgatactctgtctccctgtgataccagcactgtttcctgggactggtatcgattaacaggttaatttggagcgtcacgggctagttccggtcgggactagttcggggcgtgacaaggacagaggagacgcagtgggtggagataagacacgatttttctggcggaggtgttagtagccgctagtgaaaacacgatttttcttggcggacgcttaagtgctccgcctcgaaaaatagagtttttttatggcggatctcttagcgtggccgccagggaaaatatacttttgctggcggtccgtagccccccatcactcgttacatttttgctggcggttttcgcgtacggccaccagcgaaaattatagggcgacgccatgaaaaatcgtttttctagtagtatacgtttggttttcaagtttttgcacctaatcgtacccacctgccaagtttttgtaccgccaacgcaatttactcttttgatatatttggtggtccacttgtcatcgaaggctggatcaagtttagcgccgtgttcaagacgtgggagcgagaggcagatacggcaggggatgttgtgtcaatggcctgcaaacgtgtctagcccatgtgccggcctcacttcaagcctattaggcccacaacgggttacaagagtgcgtacgcagagttctgagctcatttgacatttagcccagctaaaaattaaaaaacttggtacatgaaacttcttaatagcaacattcagtatacaataggaactttatacataaaagttggcatagaaattttatacataaaaacctttttcatagaaactagtgttgcttgaggaggatgcaaaataaatgcttgaggatgcaaatgcaatataagtacaaagtaataatgatttactggggagggttctacatggtcaccataaaatctactccctccattctaaaatataacaacttttagccctcttctccaccatcattctattcccaaccaatcacaacactcttctatattcacttttctcacctacctccactactcaaccaatcacaaccctccaccattcaattctatatatttttttaataaccgtgtctaactctaaaatgcttattatattctaatatggagggaacagaacacgacgatggcacgatacctcatttattccaagaaactttgctcccacagcttacggaacaagaggaagataacctggtcctctagctaagtcaggggacggaaactagcgatcgaaacgatgactctgacagtgagggcgatgttgttggtacaaacgagaaagacgatgagaccgattgcaacacactcccacagtgactactctgatcatgagcctagctcacctgggctcacttggctggtgggaaatgttggttttaactgtcaggtggaagaatgtggatctttttatcgtcttgaatttgtgggttaatttgtttcttaataaactagatactaaaatattacttcctatacctatacatagattgtcaaactaagaaaaaaattcaatagagaattattgtttgggctgggatattcttactagttgtctagctaaataataagaaaaatgatactttacacatgcataacattttttttatatttatgaaaaagcaagtccttatatttaagcgatcaatgtacaatattgaattccaacattatttttgtatagaacaacatatatatatatatatatatatatcattaaacaaaaaaattgagaatgtcaagttatatatgtgtacacatgtaacaataatgaacactgtaagaatatcgacccccctacgcttcaacatctgtgcagcaactcactcgacacactccttattgtccagtaatacgtacgtagacggtttagtaaactccttttttttcactcgatgcaaattacaccatgctagcatgcatgatgcacatttgccatcatatacctgccctgccctctccatctaacctatatatatcatcagtcaaatatgtttaatttgctttgttttcttccatccatcaggggccaaagcctgcacctcctgtgtgcacctcaaagttaggcatcgtcaaatgagcagaagcagccgccctgttgttaggagccgcctggctgtagccgattagcgccgccgctgggttgtagaaatctacaatgcctgcagcttccttcagcatgctgctgttgttgccaccgtggccgccgccgccgacgccgtcgttatggtggtgttcagcagcagcattgctagccttgatgttgttaccggcgacgaggtcgacggagaggtccttggccgtcgctgccgagccgccgccgcactgcctcggctgcgtctggtagaacaccttggacacgacgagctcgccgtccttctcctcctcgtcggagcccaggtggtactggtgcatcacccagttggtcttctccggcttgcgctgcttgccgtagttggtgtagagcaccaggatcttcttgtaccccttcagcttgccgccggtgaacaccggccgcgtcttgccggtcttgtgccaccgcgtctcgccgccctgctcgtcggtgtgcaccttccgccgcttccgcgtccccgtcgtgtacgccttcgacgggcggtggaagaagtgccggatcaggccgtccttgccgactcctgaaattaacagcggcagaaagagaacagtacggttaatatggtagagtgccacactgccactgctctcacgaatgagttaagagatgcaaatgtaatcaattatattacgtgcatgcatgcaacagcaggtcagcaacacaacaagagtggcttcgtaatcgtagtatccagttgaccagttccaatgtcctgacggctgacggctgacgcagcataagaccattcagtcaaactatatgacgaatgggcccagttaatgatggttttgggccgactccagcaattctctgattctatctctctccccctgaactgttattgtttagttattttttgcgtcctttccatcataagaaaaatacttgctcggtgtttcaatacatattctctctgttccaaaaataaatttattttacactcatcccatatgtaccaatataaaacaaaaagacataccctcactttatcaaatcttaatgcaattattcctcattttacctacattccagtgcatctattatttactttcacaaactctagtgcaatgagtgttcaaaaataaatttattttaaaataaatgggagagacaaaaataaacttattctgaggtagggagtattacactaccaactttattcgttcgtatagctttgactattttttttctattagtataacaataatgtgtaacaaaaatttagtattgtaaaagtacttaaaaaaactgctcttttgatttttattttcaaattaaatacatatttgagagatgttgatggttaaactttaaagtttcaccgaataaaattatatttaaagaggaggtgggggcgtatttgtgttttgcatctcttaacatagaaatgaaatttcccaggttgtaaaaaaaggaaaagattatgcatgttaactacaaccttaaacttttataaaagtgtgatagacaatcctagaatcttcatacattatttaaccataaactatcaaaaatagattactttttatacaacggactgaatttaaagtggtttagtggagatatggcgctgaagggtgaaactatctttgaatttaaagaattactcaccgataaacttcagaaaatccttatccacattatggagtacttataatataatgtagatagtagtggagccatgctgtgaccctgtaaggtcaattaaccccgatagaatttttgcaatcaagtactattagtaaaaaaaatatttgcatttcgcgcgaggtggatcttgatcttggctcagccactgaatctaggtaaatttggtgtaatataaataaaatgtatatatggcctgaaaatagtgtgcggaactaaataacacatttttatttgtcggcttaattattttcttacagatagaattaatttaggtcagctgtaatctatgaaatgtaaagaaaattactttgtaccatggaaggagcatcccctgcatgcacattgttttccagctcaacacgcatatgtctaacagactaccacaccaatattcccatgagaataccccacgaacggccgctagctccagcaccaacaaagaaaaaaaatgtttgcgttgtaaacgacataaagagccacttgcattggttttttaatcataattaattcttgctagataaaagtatttgtaatatatcattttctactggattaatatatagtacaatggtgacacgtggtttattattgataactgcttatatgaaaatagagttccatgaaaataatatgatcagtgcactataatgtctcttggtgcaatatttctatcactatggtagaaaatagtacaagttatcctgtggaatggaatgcaacccccctgaagaatataatattatatttccaaaagcaggaaaggcactcataataatttaaagtatctgtcagttattcttaggccatgtttagattcaaaaatttttctttaaacttccaacttttccgtcacatcaaatgtttagacacatccatgtagcattaaatgtggatgaaaaaaaaccaattcacagtttgcatgtaaataacgagacgaatcttttgagcctaattatgccatgatttaacaatgtgatgctacagtaaacatttgctaataatgaattaattaggcttaataaaattgtctcgcagtttatagacggaatctgtaatttgttttgttattagtcttcgttaatacttcaaatgtaatttgttttgttattagtcttcgttaatactttaaatgtgtgtccgtatagttcaaaaaaaatttggcacacaaactaaacatagccttattgcacaaatatacaatgactatcctacccatgcaaatacaccattatatataggcaaattaaatactaggaatataaaaggataagggaaaaaccagttcatattgcaacaagtcttttcaaagtttattctccctttgatctgatgttgcgtgtatcctgcatgacgtggacctttgatgcactgtgctgtcacaatcactcgttttcaatgtgaaataaacttttatgcaagtaggagaagcaattacttcaaaggcaaactttagcaatatttatacggtatcgtgctcaaatgcaacaacacacgatcggacatacacgaaattaatgaaaaacgcaaggacgatcgacatgtatataccctagtgtggatgttacaaatactaagcggctacgcatgattgacatatatgaagcaaggtcatcaaattggaaacgaccagtaaaactttatatcaaaatagggaattttaaactgagaatcaaccaagcaagaaaatgttttgtcaggagtacttccgtgacggacagcacctatagtttccacgtcccgtccagatctgatcatctttgcaattgctatagctgatggcacaatgtaattaagcatgcaagctagctgatcgagacaaatgcacttatgtagatcatgaactgatgaaactaaaactgattcgatatatgtcgatgagtcgtaggaaaagcatgcatgtaagtatattatacgtgcctggaagcctctcgggatgggtgtagcagatgccgttctcgccctcgatggtggggatgaactcgtcgatgagggggtggagcttccgcgcgtcaggcctcgccttcccttccaggtgctccagcagctcctggtccgtcgggtcgaacttcaccccggccggcagccccggcaggtcctggatcgtcgccgccgccgctgcctgcaactgactctacaccatgctcaatgccatccaacatgtacacaggagaccgatcgatcgatcgagcagggaggaagctctagctagctacctgctcatactgcgcgcggtggccgcaggaggggcaggtcttgatgaggttgacgtgctgggagacctgctgctgctgctgctgcttcttggccgcggccacggcggcggcggtggccaggttgttctccacggcgcgcacgtcgttgaagctgttgcaccatgtcatggctgtataatccaacaagacgagagatcgtgcagagagagcgagccagaaagcctctctctctctctctccctgtccctccctccggcctacgctttgctcgtcgcccccatatgcggcaaacgttaaggcgagaccccgcgcgcgggaggagggagagagaaaggaggagaggagggaacaaagcggcctgatcgacgagagggagaacaaagagaaaagagaggggagctataggaagcttgtccctgttaaaagctactcctactagctgctaatcgcctaatcctccctgcctgccttcccggcccagctgctgcgcgcggctactgattttctatctccatctggtacagaccaaggaggagaatgaaggtggattctaaacactaatcagagtttgatttgttatttttgttacaacttatagaagttgaatttgaacttgcatatttgtggggtgatatattacatatgaatctatcttgtcaaatttttttgaatttttttcatacacatttagttgacatacaacaaatgggtgtatctacctaggtgattaaaagtgtttccggaggagaatacatcaattctcacaccaacttttcggttggcgcttcccaggaagatcgccacgagctgatctctctctctctctctctctctctctctctctctctctctctctctctctctggcgaggcaggcagaggcagaaccggcagtgcatcagctgtgtagtgcaggcaacaactacagaaagaacactccacaaaaggagcaagagactaggattagagagagatcgagctagctataggggacgtacgtgcaacagctagctaggagatcaaaatgaaaggctaaagcgatcgattaacaggctgaacaatgagcgtttgacagctatgggcatggacggatatgtgtcatgtgtgtcgtcgtcgcgaggtgtgcggcaacacgcgcggatgataaactgacaataaatcaatcaatcaaactccatagctaattaagctaggcgaacagcgagagcgaatcatagaacgcaggggatcgatccgggcgaatgatgcggtgttgcttggccctcaagtctgggcttgctaatgcaaaccgtatacgtgagccgcaaaccaggcgccggattctctgcgcgcgagttgctgcgtgtacatctcccgatcgagatatggacgtccggccaccacacgtacacaccacaccaatttgacggttaacatttacacgtcagaaatgacaccggccggtgttaatatagcttagctgctgctatagcgctggtcgtacgtactactactatagtatagtccatggccaaaggcttgcgttgcaagaaagcacctacacttgcgattaaccggaagacccgtacaccaaacgcatatgaaatgcatgacgaagcgattggtcgaggagaaggttgcgcgaaatgcgtgtactttggctggggtttaaattaaaggcggcaggatgacctacattctcctccgcgcgcgcgagaccccggctggtacggtgcgcgcagggtgtgcgtgcgtgcatgtacgtgcaggtagccgctgcgaaatacgtatacgcacacatatactaaccactgttcatcgtttcaacacggttagctagctctatagctatccaatcagttggtaaacaaactatacacgtacactttgattaatattattccattcgatctgtgatttatggtgtgtatgacgttcgatcgatataactctatcaaactgggggattgcgaataccctaagctatttcgcaatagaatacagatgagagaggagagggttgggggaaaaggcaaaggagggacagagaggaggtagctagatgcatgagagagagggaattagaccggctggccaaaagcgtacgtgtggaggagggggaggaggaggaggagggtggagtggagatggggcaacctgattcgatcgcgaggacgtcccaccacaccacaccacaccacaccgccccacctgcaacacgcacaacaccctactacttggcagcacgattgatcgcctgtcagtcagtcgtctctcgcggatggatcgagtcgcggggggtggcggctgggctggctgcggtgtgcgcgcgcgtgcgtgaccgcgtgagatggggatggatttgggagagagagggacttttagatatgaggtcaccgtagagtgtcttggaagagagaaatgatgatagtagtgtatagagcccagcccccagcgacaaaaggactcctgaacgaccgagccgggggggcgcgcgcgtacgtcgtcgatccaccggtcgagacgaggcgcgtccgcgcgtgtattgatccgtcccgtacgttgatcgatctgggcgtttgggggccatgtgcagatgcgtcgtggcgtgcgtgaacatgcgcacctgcgggatttggaccggtcgatctaagtttgagggcgtggatttgggaccattgatcttcggcgtatcggtccggccggtcgcgatgagctaagcgatacgtcatgcccctggatcagattgacaggaatcagagattagttaattaagtataatactccctccatactcgtaaagacagtgacacggtttccaaaatacaactttgacttcttatttctataaaaatatttattgaaaagtgatatatgtatacttttatgaaagtatttttcaagacaaatctatatatataatttttacatttttaaactcaacaacttaagagttattcataatttatattttcaaggtttgacttaaacattgttctaaaagacttcctttatgagtatggagggagtataagtagtactaggcactactccctccgtttccaattaatcatcgtattataggagcgcaccaagatcaaaaaaaaaaagaaaaatccataactctcatatacttatatttactttggtaacaaactcgatgcatgtggacaattctcactattttctaactaataacaaaccaagacatcactttggttgtaaaatattatgtgcagggatacatgcaccaatattcatttactcccatacacagataacgaatagacttatgtaatgataataatatgatgatcacttgggaataaccccaaaaaagttagatgatgatcaattgggaatagagggagtatattataagacgttttggcatttccatcgctcgtttagatccactaacatctatacgaatttggacacatatatgaagcacatatatggatccatgcataactatattcaaaatccaaacatcttataatgtgaaacaaatgaagtaggtgagaattaacaagggtatttaaggtatagcattatactcccaaacattgccacacctccttacaaaacctagccaaaggtgtggtcataaattgatggccacacctcttagacaaggtttggctaaaagatgggtgtaagacatgtgggcctttgaattgaaaaactatggtatgccataactttgatagtgaaacaaatatactccatatgtaccatatatggcaattttgtactggatgagacatcctaaaactacgaatctggacaggggcatgtccagattcgtagttataagatgtgtcacatccagcacgcccctatccaaattcatagttatagaatgcgtcatatctgacactagattgctatattaattatgggacggaagtggtatatcctagaaagggtggtgaagtttggcaaaataagggagtgacccaaacaaccacaagcataacttcaggctgattacaacgtgttagtcgccaacccttgaggatattatatggactataattactggtattttaagattgaaattcaaatattatgttaaatgtatgatcactcagatttaaatgtcttttaaaggatgtttctactttaaaagtttctatatatataccttgtgtatataaacttaattaagaaaaaaataaaaccgtgtgagcggaaaaaaatagaagtagggtgtttgcgaggggtcattagacttctctctcaaagtgtctaattagtaaagaatagatagatagatagatagatagatagatagatagatgtagatgagtacatggttaggctaccttttagcatagtcgacatgtgtcaaattagtacaccagatggggcaat

SEQ ID NO: 61702 - DNA, 11260 bp, Oryza sativa
ctcaacccccccaaaaaaaaccaaaaaaaagaacagttgaggtatattattcgttttcttcaacgagatttgcaacctatttctacacaccaataatattatttttcacatgtattttctccatgcatatttggttgaagaaaaaaaagtttaatctgagtatataatctcattgtgcttctcaggagggcatataaaaagcacaaagtgtgcacgtatctgcttctccctcgaagagttaaaaataactggtccatatgtatcttgacatgcaagcgtctccctattgttcgactgtgacaatctttgcgttagactacaacaaatatacgcgtcgtcgattagttggagaggtatatgcgtcgttggtaagtagtgtaatctaatcaggtactccactgctactaatactatttaatttaacttgtagggcaagtctcaccatctatagctagctccgtcatgttgaaaaacggaggcagtacttcgatccgagagaatcggaattatgttggagtttgacattttaccacactttttcaacagatgggtatgaaaatgcacaaagacttcaaggatgcaatcacttctccaacttgctctctgactctaccatgcgccttaaattttcgcagaaagctagaaaaaggcacgtttttttttctcatttctcttgatatttcagagtacttttctcaacatcaaggaatgaatgaacgatcggtatgaaatgaacattggcagtcaaagatattactagtaatttctcagtgacagtctctcatattttattcgagagaattttaacccccaaaaaaaatctagagagcagttaattactacgaatacagggattgcttttgtaggactttcatgtgatttggtacatgatggacaacgacatatatcgaccattggcgattagatgttgcttcgtgtgacactgacactggacttgcttctgatgcattccatatatcgcacgatagagtacatgtacctaactgaacctgatgtatccatgtgagtgataccacctctagctaagctaccacgaagaactgaactcgcctagtgaagccaagagacaagacaaatgttacttacactgaagctttttcagaggataaaaacagttaattaaggggcgtcacacgcacaccaaggcaattcggtatgcagatatacaaagctctgacctttactagatcattggctacaactaaagctccgggcatgatcatgccatgatatgtgcaaatttaaagggatggaaagaaggaatcacatgattaaagccgtatgctgtcgcctctgatgatcggcagcttttaatttacaatgttccccagactcctggtagcagtagcacactgtcgcctcatgtcttgagaattgcagatgcagcttggttatcactcagagatcagctaggaggaccactgcatacatgcaggaggatttgtctcaaggaaagtgttttacttggaggagcctaaactgttttgttccaatggtctttatgtggtcgcctaggtgaggcaagcatgcatgcaggtttgtctctactctcaaatgctgttgttctgttctcaaaaaagaaaaaagaagtgctgttgttctgaagattgtcgaggatgatcgatgttctctttgcaggctttgcagccttatattgggctgggctttgcatctatgagtttggatcagcccatttttgcctctgacatatgcatggctcggtggatccacatctatgagcaaggcattgtagttcttcataccagatgaaaagaatcaaaccaaatgcataatccagttaagcacggctaggagggaacatctatttacgtgtatatataactgccacagaacaattttagacccaaaaaactgttctttccgttaccaatgtgcgtctacaactgttggagctcaaaaaagagaaactggaacaccaaacattctcgcatttcttgccagcagaactcccagttcatttaatttttgcatctttcttgcaagaaggcatccataaacggacaacaaacagaaacagagtaacagaccattaccttccttcccttcaaatcccttccttttccattgataaaatccctagttgcgtctcctctaacaaaagatcaccaacgctaaatagaacgaactggacgaagaggacagctactatgtctgctccacaccaccgtcaccacaacatggaattgctggcaggatcagaggaatcctcttttgttgaatatatttgatcgtaccagcaacatgagcccatgcagaaaacaatcgcccagacataagaacatcaaatttcttccttcagacactgtccctgtcttccaattcctggctccaaccttggcaacggcagcacaaggcccctgcagtgacaatgttacattcatcaaatggtaacatgatggttctttgtgcgttgccctgctttgttctcagtttcacagatagcttcagggataaggaagggaatgcgcgctataggtttgtcgcattcaagggattgtggggtcatcgacaatcaagcacctcttgatccacacgttgtagttgaatgaatacaatttctagactttgtccattgaactgtttcagcaatgacttttgtttctatagcgctgttagaccaaaatgtggtgtcttgcttcaatccaataccgtaagagtaagcaaagaaagttctcataatattgctgactattatagtggttattggcagaatgcagtttgtcagcttcccagccacccaccatgacattggctttccactctccacaacagtctggtaatcaaagatcttgctcgctcaaattcatgttgattgatcaaacaggtgtaatcccctcaacatagacagaaaaacatacagtagcatgtatctcaatacttgatattttggctgttgactttttctcatggttatactcctagccaatagaatgaagatccataattccatattttgcgatgctgtttagcctgttccattaagtgaattcatagattaagcatgttagacatgtcataagcagaggattcactatgacaattaagcagcataaactctaaagaaagctatcagaacaaaagtacagtgaatttcttttggaaaacaaggttattatatgcaagtggaaagtaataaacatatttgatttaatctttatggagggaaccgatggaaaacatcactagaaactgtgcatttccagggaggttcacattgtagagattttcttttgccgtgcaataaacctgaacaattgatatgctactcagcagtccataagaaaatgaaagaaaaatgaatagaataaaatcgacatatgaaaatatgaaacagtgcaataacctagctaacatttcactttcccaataaatctacctaacattggttgtacaatatgtcaataattacatttgacttaactgcctagcttgctatgcaatagtttgagctacaggttttgatcatttatcaccaaactccacatatatgaacaattaaagttaatgcttagtatatttacgtatgtactccctccggtttcattttaattgacgctttggacaatgacacgctctacaagatatacctttgaccttatttttctattataatatatacaataaataaatgcatgtttacttttattatagtgttttgaaagacaaatctatatatgtttttctagtttctttaaactaaatatttttaaagttattgatggtcaaagttataaaaatttaacctcaaccatgtccaaaacatcaattaatatagaaccggagggagtaatgaacaagatgtatgggactatggaaaacaacatcgcaccatacctgaacactgccaactgctcgtaacttcaaaaaaaaacagatatcattacataacctggaaaagtgaacaccaaaatgtaagatctatcgacaacaaatctcccacttgtgtaacagcatagaaagagtaagaagtatatgacctctgagcacaatgtttgcttggcaacagctcgcgcatacgatgtatcagtggagtgtagtctgtacctttatttcaatttgaaacggttaactggctccacatttcctcagcttcttgtcttacctttttcttactccaatatgcacgtacaatcgtatcccatgtttccctctcagggatgcatctctctgataacatgtcacgcacaacatgagcagctttctctaaattgttctttttcgataagcactcgacaaggagatggaaagttgttggcttggtagaaattccacgggtacgcatgctctggtacacctgaaaagcccttacaacttcacccttagaacacagtgctgtcaccactgcatcatttatcctgccatgcaggctccaagtcaagcggtttggtcggatgccagcaaaattcatctcatcgaggtaatttgaagcctccaaagcccttcctgcatcacatagcccaacaattagcttaccgaacaacccagcatcaggcttcctcccctggagacgcatccggtctaaaatctccatggcctgacccagacagccctccttacagagcccatcaataacagaactgtatgtgattgtatttggaagcttcctctccttaaccatcctgtccagcagctccactgctgaggcggcacgcccacccttgcacaatccatcgatcagtgaactgtatgttaccacattcggcatgatccctctcctagccatttcatcgaacagtttcagagcatcatcaaagcaagcctcccgcgcgagccagtggataagagtggtgtaagtaaccaccgttggtgcagtgccattcgcaatcatctccgcgaacaggtcgcgggcctccggcagccggccgcggcggcagagcccatcgatcacagtattgtaggagcacgcgtcgggtttggggatgttccgaaaaacgcgaacggcgtcgtcgatggggacggcggcgtcggagcagtgggccttgacgaggacattgtaggtggcggtggtgggggcaaagccggcggcgcgcatgtcggcgaggagggagcgggccagggagaggtgggagtgagcgacgagggcggcgaggaccgcggtgtaggagcgggcggagtgcgggaggccgagggcggagggcgcggagcggaagaggtggagcgcggcgaggggctggtgggcgcgggagtaggcgcggaggagggagaggaacgggggctcgagctcgccgggcgaggggaagagctcgcgcgagcgggagaggagggaggatgcgagcgggaggaggctggcggaggcgaggcgggacgtgaggagggagacggtgtcgcgcgacgggaggacgggcgcggcggcggcggccgtggaatcgtcgggcggggacgcggacgagggcctggcggtggccgcgtcgaagagcgccagggcccggcgcgggtcacgctccgcgcggaccaggcggtggaggtggtcggcggtgagggtcttgggccatctggtcgccgagggggtggccggcggcattgggctgcggcggcggcggcgggatgggcaaagcctgcgtgtacgaggcgggacagaggtgttcggcggaatgctgccctgccctggcaacacgaggacctctagcaagtgcgcgcagttgcgtgaccgaacatttgtcgggccggccaaatgtcaaagaaaaggatgggcctatttcggccatagctgaaaattaattagggcctgcttgggaattaaggacctttctcgaccggaataagttcaccagaggtccctcaacttaacagcgagacttttgagatcccctaaccacaaaaccagaaatttccacccctaaactttacgaaaccgtgtaaaaaaggtcccagggcagtatggatctctagtttcgctgatgtggcatcctagttagcaaaaaaaaataaaaaaaattatagggccacatgtaagtgagaagaaaaaaatgtgggacccacacttctttttggttttcttttctcttttctttctcctcttctcttctcttctccggaagccgccggcggtagagggagcctgggagagagggggcaggggtgggcgaagtggccactggcgagcgcggcagtgggcggctggagaggggggaagaggtggccggtgagcctgcgagggaggagaggggggcggcggtgggtggagcagcagcgggagagaagagagagggggtcgcgccggccgagcttcacttgcgagctcgtcggcggcaatggcgtccctccgcgcgctcccccttctcgtcctgggcatggcgttgtgcgcactcgcgttgttccccttcgtcgcctctgcgtcccgtgacctccgccaccatcccgcgggcttcgtcatcggcgggagagggtagagagggggtcgagccacccgagcttcactcatcggcgacaatggcgtccctctagccaactgttgttggtgttgctgatgctaatgcggcttcctccgccgcctccccgcctgcaccaccatctcgggcagctccacgccgtggtcccgcacccacagcgacgtcgtccgcagcgccctcgctgcgcactgccccagctcctctcccttcccttccccgtctttcccgccgtcaaagcagcacaagaggcacccaaggcggcgagatcgcctccctccgagcggcagcggcgaccttgtctccctccgttcttgcccgtcgccaccctgcccgccggcctctcaggctcgggggaagaagagaagaggagaagagagaacaaagaaaagagaagaagaaaaaaaaagaaaaagaaaagaggagaaaagggcgctgatatgtgggttccaccatatgccacgtcagctaaacgggggaaaattagatcagtactgtttagggacttttttttgcacggttttgtatagtttaggaatggagatttctgattttgtggttaagggatctcaaaaatctcgctgttaagttgataaaccttcggtgaacttattccttctcgacctggtaaaagaaataaaagcccgtaactttcggccacctaaagtaccggagaatatattcaatacccttcctgttcgggagaaaaaattggtagaaataacttatcggagcaatttgggacttcgaagtagacaaatagatagataaaaaaactatgatgaataatcaaaaataacatcaaactcaccaacagatgttcatgtaatgttccacatgttttcacgtaaatcttcattgtagttcgtaaagcaatgtctcggtgcttcttcgtttgtacttatatttcaccggtaattaggaatgcagtttttataggcgatatataccgagaacaaaatggatatccttaaaaaaacaaatggaactgatagatctcgatataaaaagtcacctaataaatctatctattatattattaaaacagctttaaaaggagacatcacgttcgctgtgggagctagaaattctcatattaatcggagaaaaagaaaaaaagaaaagaagagtccaagtagaaatacaatctaaaaatagctgaaattcggaattaaaaataagcaatattgaaagaagtttctatataacaacccaatacgagattaatacaaattcgaaataaaaataaaataaaatccaaaattataaaataaaaggaagtccaagtaggaatacaatttaaaaatagctgaaattcagaattaaaaataaggaatattgagagaagagtccatataataacccaatacgagattagttaatattcggaataaaaataaaaaaaattcgaaattagcaaaaagaaaaaaagttaaaataggaatacaatttaaaatcaactgaaatacgaaattaaaaataagtaatagtgaaagaagaatcaatataagaaaccaatatgagattaattaaaattcagaataaaaaataaaaaatatccaaaattaataaaaaaataaaagagagttcaactgaaattcaaaaaataaaaaaaaataaaagtattaaaaacactatacggtattaattaaaaaaatttaaattagaaaaagaaaaaaagatttcaattaggaatagtggtggcagttgatacaatatataaaaactgttagtaaaacaccaaatagaatcctaatgatgattaaaaggagggacgagcaagacggttgccgggacttctagaaagtaaaaaaaaaacccaattgataaacatattcgatttttaaaatctcaatgagaataaaggagaagcagcatgcggggtgtataggagtatagttgcagagccgccaacggttagcgggacttttagaaaagaaaaaataaattccaacgatagttatgttcgattttagaatcctgatgaaaataaagaataggcggcggatgggccgtagaggtgtatagtggcatcgtttgacgggacttctgaaactataaaaaatgaaacccaacaagacaataaactctaaaaactacaaggtccaatttttaaaggttcggaacttctaaaaagtaaaaataaaacaatgataatcatgatgcattttaaaatctcaagggaggcagcgggcgagccataaaggagtacaatggcaaacccgctgacggtttggcgggacttatagaaagtaaaaaaaataaacccgaacgataattatgttcgatttgtaaaatcccaatgataataaagagaaaagagagtggacgggccttagaggagtataatggcagcgtttgacgggacttctagaaattataaaaacgaaacccaacgagataataaactcaaaaagctataagatccaattttaagaggtttcaaggagaatgaatagaaatagtggtagaccgaggaaacaaaagaaggatatgacagaagtaaggggtagcagctggtgtgacttttcaaaactatataattagaaatacgaggataactatttaataaatcttaagtaaaatcatactgaaaaatatatgattttgtttgggtgctagccgcgcaattgcgcgggccaaaaggaggcactacgttcgttgtgggggttagaaattcccacattaatcagagaaaaagaaaaaaaagaaaaggagagtcatacaatttaaaaaaaagctgaaactcagaattaaaaataagcaatattgaaagaagtttccatataagaacccaatacgagattaatcaaaattcaaaataaaaataaaataaaatccaaaattagaaaaggaaaggagagtccaaataggaatacaatttaaaaatagctgaaattcggaattaaaaataagaaatattaaaagaagagtccatataagaacctaatacgtgattaattaaaattcggaataaaaataaaaataaatccgaaattagcaaaagaaaataaaagaagaactcaagtaggaatacaatttaaaattacctgaaattcggaattaaaaattagcaatattgaaagaagaatatatataagaacccaatacgagataaaaaaaataaaataatatcaaaaattagaaaaatcaaaataataaaataatatcaaaaattaaaaaaaaatcaaaagagagttcaagtagaaatacaattttgaaacaactgaaattgaaaataaaaaattaaaacattaaaagaacacaatacggtattaactattttttaaaaaaaaataaattctgaaattagaaaaagaaaaataagatttcaattaggaatacaatttataaataactaaaatttgtaataaaaataaagattattgaaagaaaagaccatctaaaacgtataacgagataaattaagtaacatgcctataaaggagtagagtggtggcggttgatacgacatataaaagttgttaataaaacaccaaatagaatcctaatgacgattaaaaggagggactttaggcagaccgtgaagcaaacaagtaaggcggttgctgggacttctacaaagtaaaaaaaaacaccattgataatcatattcgatttttaaaatctcaatgacaataaaaaggagaagcagcgggcggggtgtataagagtatagttgtagagccgccggcggttgacgggacttctagaaaattaaaaatgaattccaacgatagttatgttcgatttttagaatcacaatgacaataaagagtaggtgacggatgggctgtagaggggcaaataaagagtaggtgacggatggactgtagaggggcatagtggcatcatttgatggcacttctaaaaattataaaaaatgaaactataagtccaatttttaaaggttcagaacttctaaaaagtaaaaaaaaacaatgataatcatggttgattttaaaaatctcaatgataataaagaagggaggcagcgggcgagccgtagaggagtacaatggcaaagccactgatggtttggcaggacttctagaaagtaaaaatgaacccaaacgataattatgttcgattttttaaatctcaatgacaataaagagaagagacagtggacgggccgtagaggagtataatggcaacgtttgatggggggcatctagaaattataaaaagaaacccaacatgacaataaactctaaaaactataaaatccaatttttaaaggttccaagaagaataaataaaaatagtgatagatcgagcaagcaaataaataacgagataacataaggggtagcaactggtgtgattttaaaactatataattaggaacaataggatgataaggtttggtctttcaaaatcttaagacaatgagatagctatttaataaattttaagtaaaatcgtactaaaagatatgattttgtttgggtgctagccgcgcaattgcgcgagccacccagctagttactcctaaatgaaagaggaaaataaatgcgggagggataataagaaacatgaaactgacaagaaccaagaagtagcgtatataaaacattaaaaaagcacgaaaaatagttctcatcttgctgtcaatgacttaagaaaaagggaaatatttgaattgtccttttttttaataatggaagttttattcagactcagttaattacaccaagatgatacaacgaagcccatacctagcctatgcatataatgcacaaatcccaaagaaaagatagaaacaaccaaacctcttacaagcacaaaagtttaacaaaaacataggtcttagtggctatcaattcgta

SEQ ID NO: 61703 - DNA, 5103 bp, Oryza sativa
tcatctagatccctcgcggtgatggattgcaggtgttggagacacaacccaaactcctcgattccaacttcaccaccaacatgtcatcctctccgacatgggaggagatggctaaggaaggctggcctgtggattttgctgccaccaactggcaagaggggtaggtcactgcaatggagcggcgggtgtcgacgaccccccctccccctcctcaaacattagaaatccaacaacaggattaggacggtatcaccctttggcctttgctagcagtgggcagaggcggagaagaggagggtcgtgaggagggagctagagttggtggtagagagaactcgatatggtgctggaacattgaagattgtggcgcggtgaccaagaagccctgggaggtagctcgacgaaaggctaggcgtcacatccccattgtcgccacacccaccattaggtgatgacattaagaggcgtcggagtagaaaaaggaggtggcgaggaggcttgcatatctgcattggttttgatcttctcctaagagaaagccatggtgtgttttcctttctcctgttccctggtttgtcaactagtagatcaagaagatagataatgatgtgcgttctaacccgcgcatgcaaggcacaagcgagttcctagcgaaggcatgctcacgcaacataccatccgtcttatccaaaccagcttctactgtcgtttgttcggcgcattacgttaagcacttcgtgcgcatggcacaagagcggctagagaagtcacaaggggagaagtggagacgaggaggtgagtggggggggagggattgaggagttggagcataagtgtgcccatggcctctgcattagcctaccacacttatgggtacaataacattttcattttggacatggtaagtttaccaaatattttagtttgaacgctttcttctctagccttccctttctcttcccctcccctctctctcgctcttcaagtttgatgtgttaatgagaaaggcttggctaagttccgagcacgaggccctaggtagagatcaagcatgagcttgagtatatggctcatggtgccgatagagcgatagagatcgagcttagatggccagagcatgaggatgaaatggtgctgataaaggtcaagcttagatagtcggagcatggggacaaaaaggaaggcaagaccagtcctcaaggactatgacaatgggtgacgctccaaggtcattgtagtgggagttgtgcatggcgaggctgcttagggataagatggaggcgggcggtggtgctccatggctgcaacataaggagccgcttttgaacaatacagtgggagttatctgagaatggtggtgatgaggcgatgcttcagggctacgacaatggagtgggtcatagatgtggtagcaggagacactacaaaaagatcgcgagctcaacaccagctcaccagcatgacaatctagagtattgatacgggaggatggagaataagggtccaaattgaaaccttttgcaaacttatatatagtccaagctaaaaataatgccttacccctagtccaaactatcacatcgataaaaacatatagttcactgtgcaatttactatcgaaaaggtaatgatatttcattcctaatgaccgtggaagagtgacgagtacacctcatgagattaaaaccttgggaggctagggaggaaacatgtcaacaggattcatgcctttcaccatgatactatacatacatactaacaccattgataaccgatccacctttttctcacaaaacttggttgagcccgttcttctcttttatcttctccaattcagcacacaactgatgtggcaacttatatagtccgtttacatcatctttttatacttactctaaggtggtgttcttttcttctgaagatgaagaataagttttttacgcaaaacgaggtggtattaacgtatgattgattgagttttaactattacaaacttgaaaaaaaattaatatgatattttagagcaccttttatatagaaagttttcgcacgaaacgcaccgtttagcagtttaaaaagtgtgccacaaaattcttaatcttcatccatctcatacaactcatgcgtgcgagccaccctctacacatgtaaccaaatgtagcctacatacatttctatgacctttgtatcaatatgttccatctaacttctttgcacaaaatgattgaatagatttactgatgaaatccaataaaagttttcaataaaggtttaatatctggtgttaaaaaaatatatctaggtggtgatttggcgctaggtaaggggttgatgccccattttgcctactagtagtgagctaggcggttggattacctcggtggtcaactttaacacttagagggtgtttgggaactagggactaaatttagtccctctcacaaaaggataagtccctatggtagggacttatacttttgtgagagggactaaagtttagccctactttagtccctccaaccaaacaccaccttagtaggcctagtcacacgatggcacgaaagtgacgaggcaagtgccgaggtgactagacggggtgcgaaatagtagtttacaaggtgacaaactctatctttcccaaattagagtgggcgggaaaaacctgagagccctacccagagatggctagggattaggaggacgaattgggttcccaactcactgctactggccaacgcaatttgtccatatcctcaattcatcgattcccccaagtccagttgttgtgcccctatgcgtcaaggctctcgatgctcgaattagtgacacccttgttggtggctttgctttgaacgtgccatctccatgctactagtcgccattaatcatctatacaccgccggctactcaactccaccaccatcctgaactagtaaacaccactttttgttgaatgctatgctccgttgatgcttgagcctatggattttactttttttttctattcttgctctgtttatttactctagtttctgttctacatctctatcttcagttggaactaggggccgctgtgttgaacactactaatattcataatagtattctctccgccccaaaatataagggtgtgtttggtttgtggtcaaagttgtataggatatggccatccatatttataaggatatggctctctatccaacttcgtagtattaggatatatctcatctatccaaaatgtcttatatttttggatgaagggagtgtccaactttgtagtattaggatatatctcatctatctaaaatgccttatatttttggatgaagggagtattattttttaagttgctattgtatagcataggtattgaagaaaactctccctttcacgtgtgataccataattctatttcctccgctttaagacatagggcatgtttggtttaaaaccctaccgagatgtaagtttaggtactaccaattttttttgttaggcaagagtatatcaactctattgattttggcataagttagcatcaatctaaatggctagtactccctccgtcccaaaataagtgtagttttacactgttcatgtccaatgtttgaccgttcgtcttattaaaaaaaatgattagtatttatattgttattagattataaatatgaatagtactttatgtgtgactattttttaaaaaaagtaataaattttacatatgagacggacggtacacggatatacgactgtacttattttagaacggaggtagtatatacaattaaagttgtcaaatgattggtaggcaaaatttaacaccaaactaataacataaagttaatctaataatatattctaatactataaatttggataatacattcgatcatagattcgttcttcatgtgacggagttactatgcattttgaattgatggagtattcatgttgacagcggaaattttctcttggagctactgctcacagttaacagttgacacacacataaattcaccaacaccatcatgactcgcgaccaagtctcactcacccatccactcaagttgatatccccccgttaaatccactgtctgaactcatcactgcccttgtcacacaccaggaaacaaaaaccctgttcagtacgccaagcacatcagcccggacactgacaggcctcacagtcccctgtcacgtgcacacgcccggtgccacaagtccatccgccgcagaagatcccgcgcgagttctaatctagcccccacgcttcgtccaacgaacgcctccctccctccgtccctcgtactgcacgagagagtcgatcgatcgatcgatcgacgaacacgcgcggtcgcgcaccaacaccaacaaacccgtcaccctccatacggcgccaatttccccccaccagaaaacgtccccgcgctcgtcaaaagcacaaaagcaacccccaaagatcaaacccccaagaaatccaagcactccaccactaattattctgcccatccaaatattcctctcgtcagaactcgtaccggtgctaaggagaaaaaaagtcacgcaaaagaaaataaaataaaaagggaagttggattgaggagaggaggccaaaaagaaaaagaaaagggtttggttttattataggagcgaggggagtgtgtgtgttaagcgcggccgcatagaatggaagcgttccaaatcggaacccaatcccggaggcgcatgaataatcatccaccagttcgagtagtggtggcagtagtagtagtggtagcagccgctctcctcctccttctccctgttgccgtgctgttcctgctgtttccccaatctcctcctcattatatccctatctatctactactactcgcctcagcggctgctgtggctgccgcctttttggccttgttcgtggtgttcaagttggaattattaccgctgtttttgctgcgatcggtgttggtggtagcggagatccagccgcacatcggatcgccttttactgggctggcgtgtatattagcgggcgcggcatttcattgttgtcgcgagcgagccctggaagaggaggaaaagtgtgggagtttttccgagcttttg

SEQ ID NO: 61704 - DNA, 3561 bp, Oryza sativa
cagagagaggaacagatgcgcaaggagatggagagacatgatcgtgagagaagaaaagaagaggagagattgctgcgtgagaggcagagagaacaagagaggttcctaagagagcaaaggcgtgaacatgagcgtatggagaagtttatgcagaagcaatctagacgagttagttttcaaattcatattatgtaaactgcaatgcagtgtagtatctatgccagtaccactgtttagtaatataatgttatgcctatatttgtgcaggcagagaagcaaaggcaaaaggaggagctccgaaaggagaaagaggctgcaaggcaaaaggctgccaatgaaagagccacagcacgcagaattgcacgggaatacatggaacttgtggaagatgagtgcttagaactaatggaattggctgcacagagcaaagggttgccatccatgcttagtcttgatagtgacacattgcagcagcttgattcctttagaggtattctgaccaaatttagactttcttagtactacaatgtgccaaaagtaaaagttcactgctagtggctttgtgagaattgtttcagtttcttgtgcatccctaatagagtaaatataaccagactgaaatgaaaaacaatgtattagtatttatatggaacagatctgtagaaatacatgcacaatcaaaatagaatactgtgttatgtaataggtgacactattaggccatgcttggatcttgatgttttgggtaaagtaatctaaaatttgttgccttaacagctgcttcaaattaaatgatgcctagctagtagtgattggaggaatagctcagccatttctacttttgcctaacatttgcttggtagtgaaaattctgttgtaaacagtttcgaatatctgaagtttaaccaaataatgtggtactttgtgattattgattgattattcccttcatccaggcatgttgactccattcccccctgaaccggtgagactgaaggagccattttcgataaagccttggacagtatctgaggataatgttgggaaccttctgatggtaaacctgtgatatattcctttcttgtagtattttgtgatattcagtgaaagagatctgagttcttaaaagttgtgtgagttgacagtgtaaccacaagaagccataacgttgatttgcacattttattttccactagatgctaaattacaaaaaaaattgaccttactgcttttatttgcttggaatcataaatgtaactatcttgcttgtagactcatattctgtccatgcagatggataaacaaatagacctttttgatacattagcatcacttcatcaggtctataggagaggtgttgcttcactttatacagatgcacattgcagcaatccatcttcttaaaaaatttcaaactagtcttttatggccttattagttctttcttgttgagaagacatttgctctgatgacacttgagagtagagacgtttccttatggttttctagtgctaattgaaaatttagtttcatttcatgcactaaatctggtaacagatttacatgatctgttctatttatatttcagtacatctttacagatggtaaatgctgcatcctattctgagttgcataattccattctagtgtgtttttcaatgttctttttaatggaaactgacaaactgttgctaaatgctaactgcattacaggtgtggaaattctcgattacttttgctgatgttctcgggctttcttcagttacatttgatgaatttgttcagtctcttcatgattatgtaagtttttaatttggggaggaattatgtatctatttgtcctttactattatcataatggtaaaaggtgagaatatctttgttggatgtgattaagagctggataactaggttgtttgattgattttaatgttatgcttgtctccacgaatcaagagaataagtaccatggtggatacatatgaatatgagtttacacaatctcttctatttgttggattatttcgtgtcgaatttgtttactagtcaatttacacattctttttccaaataatatgtaagttatacacttgtactatgaaggactttcatgcagtttatgtgttatgtatgtttgtatctcttgggttgttaagttgtttaagtccaattccataagacactggatgttatcttaccaacgttcttggactatgtacattctagttttttgttgttaccttggactatctgtagttagcatttagctttagtcttgaaagatgtcatctttggactgctaatgttgaattatgtaaatttttagcagttaactatgcttatcctgattgatcttctcatctctttactaggattcaaggttgttgggggaactgcacattgctctgctgaaatccatcataaaggatattgaggatgtctcccgaacaccatcagttgcattagcggtgaatccagcaggtggtcatccacaaattgttgaaggggtgcgcatgcatttgtctttttttcaaaacctctagctttttatcttttagtttccttttgttctgtgtgctactatgcttaaaagcttcagtatgttttcataggcatacgcttgggggttcaatatacgaagctggcaacgccacctgaatgttcttacttggcctgagatattacgacaatttgctttatctgctggttttgggcctcagttaaagaaaaggaacgctgaagatgtttattatcgagatgataatgaggtattacactatctcatactatatacatctattcgctctataagataattccatattgaaaattttcatgatatttggtttatctcagtgatccaaaaatatcatgtgagtactctgcatctaatactttgtatgatgctcggttttctgagattcaaaagggccaccgggatatagtcagcagtactaaggttgcgtcctattgtatagtgtgattcttgaaatttagtgtactgaatgtagggcgatgagtgatatcggtcaaatattggtgagtttattttttttcaaataattaattaatgaaggtgcttttattagcagataaggattattttattttttaaaaaaattggtatattctttttgtctggtgtgcttcaaagttctttagatttacccggatctactccttcagacctcggttctagtttctgcctagagatcctcctatcagattttttctgatggatccatggattctttgttaatggagtttccaacttctggattgcggacaagcctagtcagagttcacttgtttattacaaagatggtccaataatatcattcgtgaagttacttttttttatgttgaagtcaggtaattatataacctggtttgaaaacaagcccaaagttgttcaagttcatacaaaaacaaaagagaaaagaccactgggatcaccagctttccaacaaaggcatcacacatctgcctcagtgctggggactaactagtatctgggttggaaactaactagtatctggcaagtgaacttgacagcttcct

SEQ ID NO: 61705 - DNA, 3881 bp, Oryza sativa
  unsure (1)..(3881): unsure at all n locations
catctatagctgctgccttgtcaagggatacaaaactttttgagcgaactgctccttcaacatactgtgtcaagtccccttatagaaaagatccagctgattctgaggttgtgctgtcatcagcacgtgaaaaaattagggcttttcagaatgtgatttctgactctgaagctgaaaaggaggctaatgatgccgagagggatgaggattctgaatgtgatgatgctgatgatgatcctgatggtgatgatgtgaatattgatgtaggagatggcaaggatccccttattggtgttaaagaacaggatggagtaccgattacaactatagtagatagcacaaagagggaaaaagaaaaagtggatgcattaacccaatcgagtgatcttactacatctggaaaagaggctcccaagccttctttaggcaagcccagttcagcaaatacttctagtgattcacctgtcagagcctcatcagagtaccatgaagtacctcctactgatgctgaagataaggagattgatgaaagtaaccaaggtgaatcttgggtccacggattagcagaaggtgactattgtgatcttagtgtcgaagaacgcctcaatgccctggttgcacttgttagtgttgccaatgaaggaaactttattcgtgctgtgctggaggtaataatcttacttaaaatatccttcaatctttgctatttttctcattggataacacctgatcacttgtctttcaggaacgtctggaatcagcaaatgccttaaaaaaacaaatgctggcagaggcacaacttgataagaggcgttccaaggaagagtttgctggcagagtgcaatataattccaacatgaatttgaaggctgatgtaaatcaagaaaatgctactgagagtactccaactccatttcataatgttgataaacataatgatggaaatacaggggttgtggataataataataatgagataattgaccataacagtaatgcagctaatgcatcttatgagaggaatggtttagggcaggacatagctgcaacaccagatactttgtcagttcagcagtatgcttatgctgataaaacacggtctcagttgagagcatacattggtcatagagcagagcagctctttgtttatagatcgctgcccctaggacaggatcggagacgaaaccgatattggcagttttcaacttctgcatcaccaaatgaccctggttcaggacgaattttttttgagtgcagagatggatactggagggttcttgacacagaggaggtagccttttcttttaaatatctactgattcaacttgattactattattgctctcgagtaaaaataatgtcacattttcgactatgtgacgtcaaccttagtgaatcatgaatatttatttgtattagacatactgaaatggtacatgtagatttatcggcttatcgctaaaaatgcctccatgaaactatagtttccccgtgtcttacaaatatattacaagagaaataagttgtcatttacattttggatgtccttgaaactgcaagttagattgatatgctaatttgtatttctatctttttctatacgctataattgttcgaatgcaatgtgttaatccacgtatgaggattgtaccatattcacattgcttgataaacatatgaatttttgaaccaattacatgtccgcatgctccatgcacttatgaggattgtaccagattcatgtttcttgataaacatatgaatttgtgaatcaattacatgtccacatgctccatactggtatctaatatcataatgccctctggtcttaaactacacatagtgcaacagcaactgcttgttgaaatataaaccttatgccagtttttgccaccaaatggtgaattcccttgtacttgggcttcacactgagctatttatagttttgagtttaagacatgcataatattgtccgcgnnnnatctgcatttttttttaccacaagtgcctgctcttcatgcttttgcattacagtggatgtgtagttcatgataacctcattaagtagaaatgtgattgatctattgtcaatgtttttttttgcataatgagcagcattttgtgccagaactgtacataaatcgcatgctctctaaactttggacattgatctaataaaatgcaggcatttgattcattagtagcttcccttgatacacgtggcagcagggaagcacaattgcattcaatgctacaaaggatcgaaccaacctttaaggaggctattaagaggaaaaagagtgcagttgtagaacaatccgctggaaggtatctaaagaatggagctacggaaatgattagggcaagttatcgtagtgattttggaagcccaagcagtaatctttctggtgtcacttctgatagtgctatagcatattcagattctttcaaaatagagcttgggcgtaatgatgttgagaagactgctatttcaaaaagggcagatgtctttataagatggatgtggagggaatgcaatgattgcaaattgacatgtgccatggagtatggcaagaaaagatgctctgagttgatgcattcttgtaattactgctatcagatttacttggctgaagaaaggcactgctcttcttgccacaagaattttaaatctattcacaatttttctgaccacgcatcacaatgcaaggataagctaagaactgatcataactggaagatgcaaactgcagatcattctgttcctataggagtgagattgctcaaattgcagttatcaaccattgaggtcaagtaacatgttttatgtttgtcacctgcttctaagttgttttttttcttttaccagttgaactgtttggaaacgtgttaatatttttgtttacaggcttctattccaccagaagcaattcaaccattttggactgatggttatcgaaaatcttggggtgtgaagttgcactctacaacttcgttggaggaaatatttcaggttctggatttgctctcctttagttaaaccagtttcctttttgactggcatacatctattacctttggttgcaaacttgaacatttgctggctataaatagctggattacatggttgacttgaggccttaaacaacctcaaacaagaatcaattgagaacaacctcattctttgttaatacatgttgaattgctaaaatagcttgtctcaccttagttatcattttatgatgcgggattttccatcaaattgaccaggcacatggttgattaaaccatgtaattttcatccttactgcagatttgaattaatatattgaactaccagtcccaaggatgaaagacgccaaccattttctttaagaatttacaatttattgatggctttcttgtatcttctttctgtttccttcttctgaaaactaatactacgggggtatatttataggcaaaattggttctgtagcatcgaaagttcccatttttacttttatagcatcgaaagttcacagcttactagaatagcatcgaaagttagctctgtttctcatatttagcattccgtcaacaactctgttagaatctcatcggtttcctttttttttaaaaaaaaacatgtgaaataccagccgtgccctctccttcttccacctccagcccccctctcctttctcttcttcctcctccaatgaacgccaaccggatgccatcctcgaggctcgagcttgtggctgtcagcacgctgacgagctcgaccatctgcacgtctgcacattctcaagctcgaatgaatggtggtactgcagttggttcggctgggcacatgccgatgccacagatggaagtacacggtccatgaggacctgttg

SEQ ID NO: 61706 - DNA, 3979 bp, Oryza sativa
aggggcaagggggaataagtgacggaagttctaacggagtgttaaaagaagtaacggagatcacttttgatgctattgaagtgaaccacaaactttcgatgctataaaaacaaaaacaagaactttcgatgctatagaaccaattttaccttatttatatgattcatgttatgacagtatgatacttgtgtgtttgtcagtatatctgattgtctgtacagatgcatggatcacatacatattattttgcctttgacccttgatacctctttcatttatcagctttgcacctcaatatcacggctgatgttgtttcacttccttgtagatgttgacactgctggaagccgcaataaaacgggaccacctatcttcagaatttgaaacaacatctgagttgcttaacttgaacacacaagataatccatcccagaatcatgttggattgtctggatctgctgctgtacttccatgggttcctgacactactgctgcgattgcactacgaatgttagacctagactcagcagtatcatacatgcaaaatcaaaagatggagagaaatggtggagatttcatggtaagttttcatgttagacctcaaagtttctgtgctctggtaatcatatgtactagatgttgtagtttgtctgttaacttctccggctactgcatttatgcaattaaaccatgaaatgttgtcatatgttagagattatgatttatttgtacattctgcactttgttgtttgtaatgctaccatcagtttcctttcagtttgtaaattgtttcctctgtttgtgcagaagcctccatcaaggtttgtggctgttaagaatgcacaagaattagatccactggaaacaaccggtttagacctttttgatggaaggtgggctactggtagtggccgtaggggtcgtggacgaggaagtagagggggtagcaggggaggcagaggccgaagtcgaggtggaagggtcccaagaggtattagcatctcatctaggattggatttaaggatgaaaatgaagcctcaaggaagaacactcgtcgagggcgtactcgtggccgtggtcgtgggcgaggacgtcgaactgttaggtcacggcaaccatctgagggcaaaggcagatcaattcccaaggaaaatttgttggggagctttagcatgcttagcaatgcaaaggctgccactgttgaggagtctccaaggagctcaggtgctgatgaatggggcttggagaacagaaggccatatattgatggtgatgagaacagttctggatctcagttagatcaatcagaagataatgaggaaaatggccaacccatggatgaggaatatgatgagcaggttccagattattctagaggctattctggtggctcaggccccatggcatgatagatgatgatgtgagcgaagaagaggatgaagatgtggagggcgatgatgatggggaggaagatgatgcggaccgtgcagttgatgatgttgatgctgagatggacgaggatgatgatataggtgatgatggtgaggatggtggtgacggtggtgacggtgtggaggcgaatgctgatgaagatgaaggcggttcctcgtattcatcggagtacagcgactaagattggccagtagaggccttagcgtcctatgccgttatccctaaatttccaatagatgtctgaatcaagtactgttagtgggcattacttgcccttgtggttaaaatgctagacgcggaccagaggtctgtgtgatagataggcatgtagtactgatgttcagtactgcatgcttcttttgattttcggcgtagccgagctgcccaaacaaccgggtagtgtgaagctgtactttgctggtttaaggtgttgggattgatgcgtacaatgtgccaaggcaaagtaccaagtttacctgaatggttgcctttacatattgttacaaaatctcttgcttcgttacatctattattatatgctttaggtactggactgctgggtatacgcttggagaagcctacggctacgcgcatcatgcgaagtcatgtgatggaggaagattttgcctgtaattaagtgaaggtagggaggcgcgaaggcgaagctaatgatttagcaatcaataggttgtgcaagaaatgaaattttagtcatctgttattcttttacgggtggcaatggtgcaatcatttgttctgtcgatacgaggttagatgctggacgtacagattttttttttctgtgcttaatttgtctgcatttctgcattggacaaatccagctggagtagcgttgacaggaaaatcaatgaagaaatgtgttgggaggagaggcaaccagttccctgcgacgtcggatatatagactggagtttctaggcatgtacctaaggaatatatttagaaaatactcatacatgatatgctttgaagtatgcacatgtaatgtaaaaaaaaaaccctaatccatcggatatataggtagggtttgtctatttttaggacatagtagtacctaattatcctagtgtcgatggaaaaaaacaagcactgggagttctgcttagctccagtgcaggtccaaagaattgctttcgagttttgagcgtgctatttggtttgatcctgcaaccaacaagaaaccaaagatgaaacaaagttaaatctataaacaacagccgatcggctgggttgccgatgacgtatcgttcagtattaagccgatgtaacgtgccgtcagaaaaaaccatgggattagattgaacgatttaaaggtgctgataacgtggattaatatggagcaagctttataggagtaaatactctagtgggtaccaactatataggaaataggaaggagggataagtgactaaaaaaaggttcttttataatccacgagaccacgatgatgattcggtgaaaaagctgaaaagaatctgaaaacatatttgtttatttcttgtgagaaaaatgttttcaatgtagtactatatatatacctccacattactttttactaggaaaacatatttgtttatttcttatgagaaaaaagttttcaatgtactatatatatacctccacattactatttactagtaaaaaaacgtgaatattaggaaatgacctagtatcaaataattagaagggaggaggctttaaacccagaccgactagcccaccaccttgtggagctagaacaaagacccctagacgtttctctactatttactagtacatacttaaaaaatgatcacttattttgaaatgaattttgaatgcaagttattttgtaatggagagagtgcttgacaccattgatatatgttgttttaactttgactataaaaatcatatttgatgtacacaaatcaggtggttacatttagcatgtaacgtaccttagtggttaatttattaaaaaatttgatagatttgttgcagtactataaataaatatatccgtcaaaatctgaatagaaataacagctggtggcaaatgtttgggaacaaaggtgctactaagcaaaagcaacttctgttgcccaatgatgacgagaattagagctactcctgcacaaccacccgtacaacgattgatgcgtttcatcatacaacaactattataggacaaagaccgttttgagtcgtcatattaatataataatccaatctggtaaggttgaacccatcagattagggtagctgaaaaatcgatcaagtcaaggtcctgtccagagaagaagttattcaaacgctctaagcaacctttaatcctttttaagtaataccctgcgcgtcgtttgcgcataccggccaacctgctcggctcaatttggttgttggctctctctcgaaccaaaagcttaacgaattctcgcgtttcggatcggatgccgccgcgacaaaccggccttctaaaaaccgtgccgtgttacgtcccacggcggcgccagcgacacaag

SEQ ID NO: 61707 - DNA, 3534 bp, Oryza sativa
ccacggcgcgcaccatttcttcccacccgctgctgcttcctcgcctttccgataagaagcttcgccgtctcctcctcctctttcccttcctccgccgctccatcaaaaaatctccacaaggcttaagcagagggagggtgagggattagaaacaaacaacccttcggagaaaatcacgagaggcttcccgagggcaaagtctccgattcattcaggtccgactcgatcggcgatccgacgaagctcgagcaggtgagggagacggactcggactcggagcacggaaccggtatattagggaggctgaagagggagcttgagagggggtctagccttaagctcgaacgcggggtggtggttgtaccagcagcagcagggaatcatggactcggagcactggatctcgagcctcgccgccgccaagcggttctacgcggcgcagctcggtcacgtcgacggtatgcggccatctcgacttttccctcgaatctttgtttggctttctgctgttgctgttgctgatttgtgatttgattcgttggattgggcgcgcagatatggcggggattggaatggaggaggtggagatggagatggaggatgatggcgagggcatggagctggagctggagatgcagctggaggaggcgacgtggccggacgtggcctgcccctactgctacgaggaccacgacatcgcgtccctctgcgcccacctcgaggaggaccacccctacgagccccacacctcggtgagctcctcgccgccatgccctgcgccgcagggctccttgctctgacgctctgatgacatgacgcacaaagtctggcaaagctgctccttttgttcgattagtaggaacgctgtagctttaggggttgacttggcgaatgaactcaatatttgggctacttgtggagttgcggtagtagcaaacttgcggggtatcttcttgaaatagccaaaattcttgagatgatagtattatgcaaagctcctctagccttgagttcttgcctctctatggcttggcttgcaatagtttgtgagcaaagaggtagaatctttggtatctgtatagtatcagtcaactacggagcataagcttatggattcagaacttggctgaaaacactagcgatttggaccgggaaattgtgattttgtgattcgtaggtagggaagttgtgttgtagttttaagggcaaggataattatatatttcttataagaactgtagattatgcttgactgaaggttttaaatcagtagccagcattgttcacttctgtagttgactgctctagcttgtagttgtgtgttctatttcaaggcctacttctgtaaacaaggtagctaatttcctttttatttgattgccactatagtacttatgtcactgcgccgactgtgcaccctactcttggtggacagctgctcagttgtcataaactaaatgttcatgaataccatgacttaaaaacgtaatcctctgttattcatctaacttcagcaacaggagttgattttgcaatggcacaaaataacctagaaaagttaatgatggtaatgtgatttagatttaaaagactcgaactgttgtgtggggtccatttttaagatttggattcattttattctagtgaaacagaggtgtttgagaatgccatatatatacttttaatgttataatctcgtctgaagttcgagatgttaactgcagaaatcctagaatctgaaataaccattgtgcttatttgaatctttcgctaagtttagtatcaaataagcacattgggttcaaagtatattaaatcagcaccttatgttcatatattgtgcatataaaatgtgcattgtgttcttctcctgatttatttgctttgctttgctttcagccctgtcccatctgcttcgaaaagattacaagagatatgttaaatcatatcaccatgcaacatggttacttgttcaaggttaatctccttccatacctattctgttgcacaagcatatgctaattctttgataaattttcttaattatttaggaatgttctgattcctttttcaaaattatttgtgatgtacagagtggtcgcaggatgcgcagattcgatattcccgagagccaggcactttctttactgagccgagatctgcgggatgctcagttacaggcacttctaggaggtggtcatcgtcagcgaagaagcaacactactgccacaaacatttctgctgatcctctgctttcttcgtttggcctgggcttctcaacattggattcagaggaacgatcaaaagcaccagttcctattcctgatgatacatcaattcataaggatactcctgctcagccatgggaatcaaggtatatatatttacactgctcagccgaatcacattagtggcctgatattcttccacctaaaaccccactactaacagcattacttcaagaatcatcctagtttgtctggaaagcatagcaaacactattgagtattagccaattagttcccatgtcctgccatgctctatgatttatttttcagctagcactttcacaaactgttcacagttaccttcttgtctgagacaggtactgtcaattttgttacatatgtcagaaagactatcaaccaccagttaaacagttgtgtccttgtgattttttagactgttcactagctgtacgcttttacatttgatgaaaacagtccatattatgtcaatgaattgttaagtagctctaagattgaccatattcacaactataaaggtctacataatacttgccgtttcccctagcattcagatggtcagaccaattaggtaaagtagagcattcaggtctatatatgtgctcagttagtatgtttcaaaccagcagcttataaactccttaagagatatgcaaatatgaaatatttattttttccatggcaggatcgactcatcgctcacgagtgaggaaagggaacaaaagcggaaacaagccactgacagagcaacctttgtgcaaggcctggtgctctccactttatttgaagactgactgttcaagtagccctagtttttcttgctagatgcatgtttcctctcgctggttcccataaaagcgcaatgttccacctgatttggtgaatctgatttcgtcaacagtgagatggatgtgcttctggtgccccgttgttctttcgcttcagtaaagcgcgaagttgatttgggcatgatacacaccttaatttatgtcagctgccctgtaccattgctttttatgaattaacgggtagccacaccttgactgtaactcgttgttgtacctctccatactgtctaggaacattggtttgtacaaacataaaagctgttacatgttgtacaatgcaaaggcaaatgcagaagcaccgtttatatcgaatcaactcagcaaaaatgtctccagggttagcaattgggcagatactgatgtgaaacacacaaaaatgctgtgcttggagtcttgggaccgagtctctactttctttt

SEQ ID NO: 61708 - DNA, 2351 bp, Oryza sativa
cgagggttagtggatagcaaatgatgtcgatgggcagaaggaaattataacttccgctgtcaatcgttgcagcggcggatagcctcaatcagtacgaaatttaaaatagcacgaaataactaaaaaaactcgttccagtggtgaaacgagcatcttaccaatctagttgctgaaaaacgaggaaaatataaggcaatgacttgagaagaggaaacgacagctccgcacacgcataattgtgaacacgagcggcggggcaagcccaagatttagttatacgtgtcactgtcagaaaaccgcggttttcgggattttgaggttttaacccggcttattgacaaaatttatccaaatttcaccagtttttcatgaaaaccgacaaaatacctcggaagaggtttacgataacggtacgttgtataaaacctgcgcagcatagccatcagcgggaacaaaacacattgaccagatagatgtagaaccattcggattcagcatgctgatgctcgaacgagccaacaaatggcatttctaatgacagttgggagtacaaaattactatctcaccacaatgaaggtgtatgtgcaggtatgcgcaaacagcaaacaataaactttacaacaaaaagggcagccacctcaagagatctacgcacggcataagcaggtgcattccgataaagtttgtacagctctgtttcgctacaaaatttctaataagctaccaaatctcgaaccatgaatataaaccaaattgacaacccattcgatcgactgtatcatctctaccatagaaatccatgtgtaaattgagttaagaagaatcaagataaagagtcctgtacatagaactagcatccatctaatctaaactgggaagcctgtatgaacctgcggagcaatctcaattttagtttaagtttaaacagcatttggtaaaactatttgaccatgagcaatctatgtaacataccttgagaagggcagcgttccaatagaataccatcaaggcaggtcattttcagaaaaggaagatgaatccagctgaaagaaaaaattgcaaatgttcatgatcattgctaggggacatgatataacttgaaagctagcaaaagcactagcaatagagagttaaaaaaaatgcaacagaggtgctaaaggcaacattaaaaactgacagattgcataaatgatccttgacaaacaagcagtaacaaaccagcttttatcgtgataagcctcacatcttaaattggagcaatacaagaaaatttatctcaaaatgaatttatcctccaggcagtgaagtgttggcacttaattccatttatcacatatgttccaggttgagtgcccataaaagtagtgatcaactttcttaatttggaaacaaccaattaaaaaaaacaatttgctaataaccaagcatcaagccaacaagtttggacatcagtacatcgtaatatgtgcaacgtttcgtgtgagtttgccagtagtatcgactcaaatgtatggaaagtatgaaagacagcttaataaaactgaaaagtgaacacactcgcaagtgaaaatcatttaataaccctattagcttataagctgcatgttagagaacacgtccaattcaatcaaatgttcaaacagaactaacaggactaaaacataataactgagattgtaataaccaatgaatggagaataatgggataaggagcctcaagatgtaaatggttatcaatcagtttcagacatttaatgagctgaccttagggatggattatgtaccacatatcatacctcaaactccatgtgatttttttccagtaatgatttgggaaatatgtagtcccctactaaatgcttcattgaacaggatcctcgtctgcatctcctggagtccaggcagccatgacaacacagctactggtgccataacaattactccaaacattatatcatataggcgtgccaaagtaaccacacttctccagaccatctcagacctcctcagataaggcttgaataccagagcaatagatatgattccccagccagtcggaagaaaagccaaaaggctggtaaaggtatcaatgaattggaactttgtgaattctaacaacagaacaatagcagccaccgttgcaccaacaataatagcctggacaagccggtaacgtatgtgcttctttgctgaatatttgtcgcgaaagtaagcaactgtcacaagagccacaaaagccagcaggacacatgcccaggaaagaaggtagacaaggatgcttttgcttgtaccggcaatgtgtagccgataaacaattgcatattgaaagaagaaaaaccgaaggtccaat

SEQ ID NO: 61709 - DNA, 2867 bp, Oryza sativa
atgacaaactgctgattaaggacagctcctagcgctgcattatttgtggagttagtattgctgctgatgaaagcctcaagaccactcagtgcgagataaaagcgcccccatacaaatgcatagactgttagcaccaccatcattgtgttgaaataaaacccgatggttgtataaaagaaagagagcatccgaaagaaatccaatctgtgccccagtctataaacgtctctgctcaaagtttgctcaccgttgccactagcaaccttggcttcaaacatggaaacctgattgagccccacatcccttcctttaccaacctggatgtattcatggtgtgtaacattacccccacggagggtacaattgaacccagcaaatatatcctcactgatgtttataactcttgatgctttactgataccacctcgtcccaagaaccaaagacgatcaaagacatctggatggccataatgcattcggaccttcagtggatctgccagaacacgctgccccagagtaacaaaacttgtttcctgggcagacatgaaccaagctagagaagacacagaaccagtgaaaacatgttcccgaaccccaaggatttttggcttgcgaattccataatggcgattgaactcctctagcagatttctcatcttgagagcttcttcaaaatagttgtcttggttcatatcaatagtttggacagcatcaccccttgtgaagatgagtgcatgattttggttctctggtttgccttcaccaagcttcagtggtccaggcaacttaacacgataaatctcaacctcccgctgcagttgctgatcatatttcacaaggacagagaaatattctgtttcaccaccattggagttcttttcatcaacataggcaacacgtagtgcttcataattcttcattagctctaaaatctcaaaagcatgagggtcattcttagctttctgctgaccgtaaatctggcatgcaaccacataagtgtatttcataaggacagtcccatactcgctgcctttaaataaggtgcttacactactgcttgccctgctcaatgcacgtgacgaagatgtcctgctgtaatatcctgacccatcagaacccacttcccgtctcgaagatcctatccttgatgagcccatagtagcaagctcccgggatccagtccgtaagtcatgttcagatgcagaatcaagaaatgtcagcatcttgagagcttcatagtagtacatcattcccctcacagtacgtgatagtgtctgccccctgtatgaaacccagtgccggagatctctcagcctctgcttctcactgtacagctccttgatattagacatcccctcacgcttcatacgttctacaaagaactcccattcatcaggatagatttgttgcagatagtacaggattgagatgccatcttcattctccttatagagctggtccttgctgtacaacacctcttcattgtagtatggcgtcaagacgctgaaggccatcatcttctccacctgggtggcccgtggtatgttcatgaacaacgaattactgaagaaagcaatccttcgacgagcttcaaggttctttgggacattgatcatagaatcccttgaggtcaggattgtgtgcatgcgccttacttgtttatagaaggtggggttcttctcttcatcaggcagaacaatagtgtccacgaagagaagcctcgtaggccttgactgtgctaaaccttcattcctcagttgttccatgctccttttctcagcctggaagtcacgaatcagaacatcatagagagtctgcagagcattgacaatcttggtaatgtccttctcaggcttcagaagtaagctcaatatagcaacaagctttgcatgcacatttggcagtacagacatcttgtactccacagtgaacttctccatgctcatggattcatcaaactcatggaacaattgtgtcacaatcccatgatcctcagtatcatccttgattatcttaagcagtaagtactttgcactatcatatacctcaatcactgcacatctacgataatcgttcttgcagatcttcctccaaagcttgcgatcaggtccttttacctcctttgcctgaccaagtgcaagtgatagctcattacagagcaagaaacatggccagcggattacacgcacattccacagctcaggtgggagctcaagaagctcaacttcgcgatcaccaacaatgtcctcctcccggaacttagtaattatctcattccaaacaagagcgaatctccgtgcctccacctgatttgactcgattttccggaatgatcgactgaagccataacgtagctgtagcctctgccagaaatttcgaagccggttgggcaagaaactgcgttcattcacctgctgttcctctggcataatgttgaatgacattgcacttgcaaagaactggaaccgaagacgcagctgtttcatgtccctgatctcccccagatgtgcaaatagccccacaaatgcacccgtcagtgaagagaagatagcataccaaatttggatatccatgagatagatcaacaccacaggaagccacaatacaaacacagcaaatcggttgctcttgccaaagaactcatgccaagcgtaatcaatctttttcaacttatatatttcctgtgtaggtttcacgagaggcctgatctggagaaaatagctgaacgcaaactttacagcaagcagaagcacccagaagacagaatacttgacattatcaaaggtgccctcacgcaaaccgcggccaacaaaacttcggctctgaaaccaccatgtaagagcataacatatcttccagtttgtctt

SEQ ID NO: 61710 - DNA, 14489 bp, Oryza sativa
  unsure (1)..(14489): unsure at all n locations
tttccgcacgcggctgcggtcaggaggcgtgcggaagaactgccgcgactgctccatgggccagccgaggcggtcgaacacgtcgcggcgccagaagtactcgttgatgtcgtcatagtttcgccaggcgctgtggggcgcggtgccgttccggctggactcgacctcggcgcggatgacgccgtagatgggcgtgacgacgcgggtaaggaaggcgttctcgccgtgcacggcggggttggcggggcggcccgtggaggtgtcgatgtagccctcgaggatgcggtgaagctcgagcgccatgtggtggtagatgtagcagaggcactccgggacgaagcggagattggcggcctccccccacacgagcaggtggagccccgcgaagagcagatcggcgcgcgggtcgccgtcggggacatacacgttggggcggcggccgaggaagccgcaccaggtggtgtagttgcggaggagcttcctgcggagggtgcgcgcgatgcggggctcgagcgtgtcggagaagtcggcggaggagagccgcatctgcgcgttggcgaggaggagcaccagatgctcccgctggttccgcacgttgtcccgctggaacccgaagaaggcgccgagccagtccatgaggtcctggccctcgcgccacgcggagtagggcggcgggcggagcccccccaccgcccggagcgctgccgccgccgccctcacatccgggaaccgcagcgacgggtgctccgcgaggaggtcgtggatggggatgatgttgtacggctccgccgccggtgaggcgccgcccgcggccgcgccgccgcggcgctgggaggcccgcggcgtcgtcatagtggcatttgggttttagggctagatctgggggcggattagccggcggtgagggagggaggaaggaaggtgagctgggttttggaccttggggctggtttgaaaattgaattctctcttagctggtgttgtggggaaggaggaggagatggaggggcggaagcggaagacggaggcggagcggaggagcccaaacggagggtcgcgtgagaaacagaggacgagcatgccggacgcgtgcgcttgcctgacggggtggaaaatgcaaaatatggcgcaggatggcgagaactgccactcgtgtaaaaaaaagatcttctgaagtagtactagctactagctgttgccccttttatccggggtaaatttttcttgtgcgcgtggcgcgtaagtatctttcttctctgcgataagcgtgtatgtatagagatcccacgttttatttgttacagtttataggtgacgataattattttctgagaaaaaaaatatcagaaggattagtacgcctctctggacatcatcgtggtcgattaagatggctatcatcagtgaatgcgccattaaaacacgttttgcggtcaatatagtggttcattaaggaaaagtatggctttaaattaagacggtcattcgcacaaccattagctataattgttggtgcactagcctgtttgctacctccatctctctaaatggtggtgttttttggtattttgtcactactttcaaacttatttttacaaaaagtattaaaatacaactatataaaagtttttcataaaagttctattaatgtttttttgcattttcaaatcctaacattttactttccatctattactacctgttttaaaatgtcgtcttttctagatggagggatttttttaaaaaaaaacaaggtaatcagtaaccatcagttacacactgaaatatactcttacgcgtcagaggatatgtatttgttttttctgatcatatgattatataaaatattgaataattcctcgatttcatgttacataatgtgttggactgtaaatagattaatgcaaggacgtatgtatatgttccatataagtgtccaatttatatatatatattagtgaatttagatgagaaatggatatgccgaaacatcttatagtgtgaataaacggagtagaatataagcggttttgaggttagagtgaaaatgatatatattactctataaagtatttcaaaagcagatttctagacaaaatctacccaagataattatcaccggtggagaaattgtcttcactcccggtttgtaaccccccatagtcccggtttcccaaccgggactacgaatccgggactaaagatcgctatctttagtcccgggtgaaataaccgggagtaaagatgtcccggttggtaaataaagagaggatagggacaataccggatggtccccttttctttttttttgttacttttttattttctcacgaatcggatggcatgcacatcccaaatcaaacctcaaatccccaaataaagtaacatcccaaatccacatcacaaatcttaaagttattatacacacaaatctaaaacatcacaaatcctaaaaaatttacatacaaatcaaatacatcacatattatacatctcaaatccatacaatgaatcacaaaattacatctcagtgaatcacaaaatatcaaaaaaaaagagagaacaagtaactttaggggagggaggacgtttgtgcgcatgtgctcccctgcaacgcacgtctgcgccgcacgccgcgtgtccgtccatccaccgcgtccgtgcggcgcggcctcatacgtctccaggggagggaggaggaaaggaaggggaaggaaggaggagcggcctcatccgtctccaggggagggaggaggaagggaagggggaaggaatgagaaaggggaggatctgtgtaagataggagaggggaggagggggagaagataggaggatcgatctgtgtgtgaggaagtggttgtgattgtggaggagaggatgagaattagggattatatactatgttgaattttagtcccggttggtaaccaaccggactaaagatctaagggagtgtttgggananantcncnacttttgttttntnananggctctctcccanacacncctaccactatcaaccgggactaaagtggtacttaagtaaagatcctcggtcccctgacatgcctttgacagtggatgaactgggactaaaaatcatatttagtaaagatcaatttttttaaccgggattaaaaatcatttttaatcccggcttttaatggaaccgggactattataaaatttagtcgaccggtcaaagatgatttctccaccagtgtatcatgtagtacatcataccaaacataatgtgaaaaaaaatatcgctgacataatcccgtcctagtaccgtatccatatccaatagtgcgacaccgaaacaaccaaccaacaagaccgtgtttacaccctagaggttgggaaaacttgtgattcgtcgtccctttcaaccctgatgatgcaacggtcacacagacgtgaatgtacaattcatacgaatttgaaaggtccattatttatcagaaaagaaatcgaaaggttcctgctgcaatcgcctttccagtgaattcctcgcctagtcgcctttattttttcacgtgaattcctgccgaacgcgtactctctcacggtacgtaaacataaagggttaattaaaccacttgttcttcccgtcttatactagtatcataggaacagtacattagcagactataaaccagttataaacatattttaaggagataaaaaaagaagatagaaaagtaatgtggctacagatttgtaaccagctgtagtacggactttaaaatgcatgtgtgtgtataacagataggatcagacattaattatatagtaattttataggtaactattatatgaattgactattaattgactataaattataaataatatgaaccaatagttagctatatactgttaaacttgctctgaacttcatcttgagtgccggcggctggctggttcttttcgcattaacaaacaccgtgtgcggccgcatccaaactcccaaagtccatgagcgaacccgcgtgagcatatacaacttccagtccacaagcctgtaatacggatcgacacttcctccacgcatgtccgtttccacacagcacagtacgtttcatgtactccctatgtcccacaaatactcaaaccctaaattttcaaggtgggtttaagaagagatacaaatgaccaaaatacctctaattatgaagttatattggtgaatgggtagatgaaaagatattgaagaaataaaatttctaaatttggaaaccaatggtagataaaagagtataagttggtttattttagaataaattttaaactttaggagttaagtttatttcgggacgaaggtagtatgccaaattgatgccttgtcctggttacgacggatcatagatccttcaatattcgagactgctaacaaaaagaaatattactcccctccaacttactattgcattggtgtatgtgaaggtgggaaacacgtatacattaaagtagaaaagttgataaataactacatcaggatttgaaaaaaatgataatatttactcttttttattggtatatgtcggattggtaaaaaatgaagttgttttgaaagcgtacattaaatagtcaattcataaaaaaaacaacttgcataaagtgatgtaatgtcttgtatatatgagtttttgattttgcataaaagcatcacacattcctgagtgcaccactaacacatgcttaaagggtggaaatcggcgacaaatctgtgagctcactaaattcatattaaaatcactagtatcgaagctctaatatcccgactccatcatcatgtataatgtaaaagtatcttatacccgactatgagcggtcgaaatgacgaatcaaaatggattagagatgacaaggggatatttcccaccagggaatgcatccccatctttattcccgtccccaccaactgcaatgggaacatcctcccatagctccttacccgcttaaaaacatatttatactttgatatatattatgtcaatatattagtagatatctattaatccatatgacaagaatacattattgtccacattcactaatcatagcacgctaaaacatgtatagataccacatggctaccatccctctttcctaataggagaatttccataggaaagggatgtgggcattgtcatccctaaaggctagaatggacatatatacaagtaggatgaaatctttgcttgtagagagagaatgagaaaaatgttttttctttaacgagtacggaattggtttcttcgtagctttcatatatccaaaagtcacggcttcgtgaaaacctgacgagaaaatattaattacggacatgacttgttgaaaacaattggaaactagtataaaatctacttcggttgaaagcaacacaaaatttcacatacaccggacgcaatagtgatttcaatgccttccttttcacttcacactatgaaaaaaatatggtccatgcaaagtaaccgattcaatatatattctagacaaaaagaaaattattttacagtactatatacatatattcttgaacatttttctgattaagacgcaaaatttacaacaattctgttagcatgtgttttaaactatgaaacgatacgtttcgtgcaaaaacttttcatataaatgttactctaaaacatcaataaagccattttaaattgtataataattaaaactcaattaataatatgctaattttttttcgttttacgtgtccttaatccttattttcatccgttataaacggggcctcaaagtcaccataagtaggcacgataaggttgtatatttccgaaaggagaacatgagttctagatccgtttggacgcagaaatattctaggttgtttttccctgtccatgcatgttgcctttatagagaaaagaaaaagaaaagaagaagaaggcttgctcggtcagcccactcaaccgccttggctggattctctgtcccatcggcgtggccctatcatcacctgtgcttgggacggtgccgcggtgggattcgccatcgaacgggcacggcgtgcgcgtaccgcagcagcgaaacttcaaaacctggagggcgaagccgataaacgcccatgtgcccgtccgcccgcacgtcggcagcggaaaaaggctggaaagccggaaaaagccgttgaacgtcaaaggagacgaccgttaacgtggcataccgaatttctagtactacttgcgtgctagtagtagtaactaacgtggacgtggtattaccgaatttcgccatgacctgggggtgagtacctgacagttggactcgtgactcgtctgcgcggagaagcatctgcctgctctgaggtccagatccggcacgaccggcctgggcacttccatgtgacccggccgcggggccctccacggtttgcctcgtatagcactctcctcgcttgccgtatgctcctgcgtgtacttgtccgttgtgtagtacttaggcggtgtttggttggagggactaaagtggggctaaactttagttctctcataaaaacataagttcctacatagggacttgtacttttgtgagatggactaaatttagttcctaattcccaaacacccccttacatgtaaagggcatgtacaatgaaggccacaagcataagtggttttaagacgtacatcacgtaggatagaaccatacaaagatcatactgcccggtgaaaaccactccaaaacgtatcttgtatttcagtctctgtttatttatatatcagcccttatgttgtatgttattatcaaacctattaaaactttatattttagactctataacaaccaaaataagtacatactatgcacccttaaacactatgcggacccattgtcagcctcttccccctctctttttaattctctctccctctttccccctctctctcttgagccatctctctccctctctcatttgccatatttgccggcgagctccccatctcggtggcggatccgggttctcgacggcggatccggacgcgggctcgacgctgccgtcctcctcccccacgacggtgcggacgagctcgccgacggcatggcgagcttggcggtggcgggctcgctggttctggcggcggggccacaacgcgatagttcctctccccctcccttcttcgcgagcgtcggcggcggatccggacgcgggctcgacgccgccgtcctcctcctcccacgacggcgcggacgagctcgccgacggcatggcgagcttggcggtggcgggctcaccggatctggcggcggttcctctccccctcccttcttcgcgagcgtcagcgtcgggaagtagcggtggcggcggatctgacaaccggacgaggcgacgcacggggctccagctctgccaccgcgtggcctcgggccgtggcttcgttcttcctgggctcagacgcggcgcttcgagcggttcctccgcaagcgcggaatcggtaatgcggagccatggtccccgctgccacgggtacacgcgtccgatatagagccgtgagaccatgagcaagagccacacgttgtaaatggcctaagactacgaagggtatgcttgtggcatggcagccagcgaaccataataacgggacccttatgttgttattatggtgatcagtattttcttatgttgttattttttaatgctataaaaatcatataacttgatttattttgcatcgaacttttgcaataataacatcgagttctaaagatttgtaaattcatcgtgaaaaaaattgtggtcaaaactcgtataattcagtcactactaatagttattaaaaaagatagatgtagcatgagatatggagtagttatgtaatattattagggtgcttttgattaggctaaaacgagaagagttattagcacataattaatttaatattaaataataaaaacttaaaaatattttttttaaaaaaaaagttattatagcagttcggtaagtgtaattaccaaaaacaatgtagtagccaactcaagaaactgattcaaactctagatgaatctattactactacgtcaacagtaagaaaacatggtatctttgttgctttcaaagttaaaaaaaaaagtccatcttgattcttgattactaaaatatccgaataataatggcaaaacctgtctctcaaatcctaataccagattaatcactcccctaagaagaagaattagagagatttattccacacctttaaatatggaaaatggaaatggaaacaattttcttgtatacagaccattttccaaattttaccatatatttacagaaactactattcttttatattatgttaattaccacatttttaagtatgccaaaatctatggtacatttctttctttgacatatagttagaagcccatgaactcttcaaccaaatccctatatggaatactcctacaaggttaaaaaaagataatctatagtttacatagtgtaacattcaatttatttcatcatattatatacttgtacaaagttaaatgtgtgattttagagtttaatattttttatatttattacatgtttttaatcgatatcgacatgtttctgtctgtataattccgtttccggctttccgatattttgaatttcgtttgtatttctagctgtacggttttcaactctatttttcgagaaaaatgtgattatggaaatggttgaaacgttttcggaccgttttcaaccctatcgggatgaacccctctctccatctcccatgcaaacattaagtacacaaataaaatagtttcagcgaaaaatgaagggaatcatgcagtaacccatactcctatgccagattcataagttgttcgggaagcacacggcctccgaggtttaatacatgtaacctgatgtaattcagcaacattgggattgccacacattcgtttctcagtaaaatactccagagagctagaataccttgattctctttgccgactgtgttcatcgttttgacgtttatcatttgtttatgtgccacataagagcgacgaccctcactataaaaatgttgcaattgatctggctattaattcactggtgctacgggtttccgacataattctgagatgatgagaaaacggattaaaataactttgtcgacaatgaggagatgccgtactcctgtctttggtcggcgcaacaggatagaccgatcaataagagtcatgtagctcctcctatccacaacaagcagctgaagaaaaccagagtttgttagactgttacaagtcagggtcatctcgtcgtctaaaattagctgaacaaccccatctgtccgaaagaacgcctgaaacaagcaaatgatgtgtgcacaggagataggaccaaatggttaagtatcttggatgtgtggcggtacttttaacaaaagcacaaatcacggtagctttcggtcttggattctgcgggaaagaagaggagacatgcatgcatgtcagcatgtggggctgaatcgctgagaaagggggagaggaaagggccatgctcatctactgatctatactacatgtgagcttgcccgatctgattcgctaggagaacagatggaaggcctggtatgcacagcaacaataatagatcctttcttaattactccctccatactagtaaagaaagtagtttataacagcgacacggtctccaaaacacaactttgacttattgtttctataaaaatatttattgaaaagtgatatatgtatacttttatgaaagtatttttcaagataaatctatacatataatttatattttcaaactcaacaacttaagagtttttcatgatttatattcctcagttttgacttaaacattgttttaaacgacttttttttatgagtatagtgggagtacgtgtcgacagaagagacaagttcaagtttgaagaactcaggctataggccgggcagctgagaccaaattaatcaagttcagactgaagaattcgcaacaaggacaaataaggttcatgacatgaagatacataaaggccaatttcaatttttttcttcaagtttctaactttttcgtcacatcgaacttttctacacacacaaactttcaacttttccatcacatcgaactttcctacacatataaatttttaactttttcgtcacatcatagaaaagttaaaaatttaaagaaaaaagttggaatctaaatagagcataaacacagccttaagttccagttctagctaaagcctcaggtacgggtcatatccacttgccctgaaaagtcagaacatcgcattcgatcaatacaagttagcgcgtaaatttagctgaactctcttgggggttaaccgggtaagcgacaagttaaccatagccgcacatgaagtctcagatctccgcaggggggaaggagccgagccgagcgaacacacacagcaccgaatttcctcgtttttccctacccgtcgcactcgtgcccaacccaacgcgtacgtagctgtagcggggtggctgtctggctgagctaccaacaagccagtgcaagtgggggatcggttttgtcctgtcatttatatatatgtaagcatccagcctgagatttgggtgacgctagctgatcgctgactgctaccgtgatatttatcacgcaattggggatccaagcacattaacaactatagacgacaaccccgatatgcatggctcattgttatattgctatttgtcaccttcgatccatcgatcatgcggtgtttgtatgtaaggctttcttacccccatagatttgctgctcaatttgacttgaccagctctggtgtgtgagatccaatccggacaacgggacatgcatgcatatgcacccatgggtgagtgctcttttttcttctgggacatgtcagggtgggggcaaattaaaggagatggagatcgagccggtcggcctttaccgggagagggcttggagctggaggacgcttttgatgccacgccacaagttgcgaatgcgtaaatgggcttcaaagcaaagcgcgcgggaatgccggatcgagcacggcgcggatgggataaacaacacagcagcctcgatcgccggggggcggggtatcgcggttttcgcccttcttttctgacgcgatcagagcggctacaatagcactattaaccagctgtaaacatattttaataagataaaagatgatagataagagcagcaggctacagatctgtagccagctgcagcacggactctacgacacaatgtgtgtatgataggtgagaccatatattagtagtatagtaagcaactattgtattaattgactattagattaactataaatgaattggagccagtagtgggatattttattaaacttgctctcagtcgatctaatctttgccgggtcgagcagacgagtaccgtgtatgtagatgcagtcaacggagagttttatgctacgcaaatggcagtataaatacatcggaggagattccagcgcccagtttatgattctagagtgagaaaaatatgttacatggtcccgttagctagcttagttatatatccagtgccagtatatgtcgttgacaatgttgtaaaaaaataccattgtcaagggcaaaccgcaaacagtgtcgtgccgcatccattgctggagaaagggtttttacccacggttcgcaacccccctatatcatgaatccgagactaaaatgcccatctttaatttcggttaaaataatcggcactaaagattcatctttattcccggttgcacggaactaaagaggagaatctttatgggtaacgccagtttttttttcaattgttatttgaatattgatttcacgccaaactcaccaaactcatcaaaatcacaaaatcatcataaattccaaatcgagttgctccctacatctccaaatcaaagtaacaacatcacaaatcataagattcatgtcaaaaattatcaaaaaaatacatcacaaattctaaaaaaaattacatcacatatcaaataacacagatccaatgaatcacaaattcttttttaaaaaacaaagaaacccccaaatcgagtcctccacttgccgcaagccgtcgtcgcctccccagcccgacggccgccgtcgaccccgcccggcggctgctgccccttctcccgtcgactccgctgtagaagatatgtggatgaggaaagagagagtacagagtcagcgagagaaatggcgagagaagatatgtggatgaggacgtctcgatctgtctagcgctaagagataaggatgaggaaatctaagtatgtagtctctggttcgatctatttaacacatgggagggagatatttagtctcggttagtgatatcaaccgggactaaagatcatatagtccccgtgtacttttaaatcgggactaaaaatagtttctagtccaagtttttagttgaaccaggactattgtagattttggccaacctataaaagatagtttctctagtagttgtgatcacatgcatataagggttgcagttgttcgtaagatacacggtgttacttcgcaaagaaaagcaaatgctcatgtattgatgtacgtaagcaacatgttcacaaaaatgatgaaagcatagcaagagctgtctcgagcgttgtcattgtaagatgccagcttttctcaaaacttgcattaatttggagtgcacaatactggattgaaataaagaatcaaatctgtttattatatatattcttttccttgtctttttggaggcagatgcaaccatctatatatcctcagctatggcggagatttaacaacccaaactgttgagtttaggaaaaaaaatcaaatgggaaatagaaatgggccagtgtgtgggcgagcgcgccttgcgggccacgaaaccgtgaacgacatgttccggcctgcccacgagtcccgcactaatcgatgtaccccttcgtctcggcccgccgccgcctcctccgctcgagccgcaccgcgcagccgccggcccaaaccctatggctcgcaaagcgcgacccgcggagcctcctacaccggggcggaagggcaggaaacctctcccctcccacgcgccgccgaccgaagccgccgccgccgccgccaccgccgccgcctctccagccgcagccaccgcctctccagccgcagacgccatggaggccgaagcgggcggcgtggccatcgtgtacgacgcgctcccggggctgacactggcgttctcgccggaggaggaggagcacctagagggtgcgactgccgacctaggcggcgcgtcgacctccgcctcggctgcggtggtggaggaggtggaggacgccaccgcggcctactccgtgttccgcaacgagatcacggcggctggggacgcgctcgtcgatatccccgcggcggatttcttctccctcgacgtgtcggcggcagttgaagacgagccggccaccccgcgtgcgttgtcgccgcagcctgctccggaggcgacgctatcgggttctctagctcccgctgagcagccagcgcaggggtcggagcgcgcgtggtttcggggagggaggcggttcaggagccctatgctgcagcttcacaaaggtggggataattttggctttgccatttgttagtttgaatgttggaaaagaacacgatttgtaaattgatttgatcagcttagagatagttcaattcgaattttagcttgggtaggcaatggacttgtttcaatgggcacagattatgcgaatagtttggaactgattttagtttggttctgaaatcttctcagttcagcctaggtggagattgatatttttttaattgtattttgatatcaagctactcgcgatatgctctttcatgacactcttgaagtgttgcctggaaactatggtgttataaacttgggagtgtccacatggtgttaataagcttgagtcagtttatatggtttcaggctggacattttgactgacgcaatactgacatattgtctatttcttacagagattcttgacttctgtgactttatatcaccttctgctgaagaacaatcttcacgaacagctgctgtgaaagctgtctccaatgttatcaaacatatatggcctcaatgcaaggcatagtaacacacattgtccctctcttgccatgtgcgcacgcatttgatcagcattagctgcaagtcatttggtaattctcgttttgcattgcaggtggaggtcttcggatcttttagaacagggctgtttttaccaacaagtgatatcgatgtaagggattttctttttgtgctctccagtggatttttgagcatttaacttgctgttctgttgagttgtatgatcccctggagcataacatttactttgatagcaatgctggaatcgtcatacttaacattttgatggatgaaatagcaatacaggagaaaaagagtaaacacagaaggaaggtgtagct

SEQ ID NO: 61711 - DNA, 5873 bp, Oryza sativa
atgctcttgcaaaagcattgtctcagaaaggggttgctaaaaagatacaggtccatttttcactctatttaactctagtttgcaacacttggtatttgcaagactttttcttttattttgttaaagaattactcaaaacaaagccaaagagacaaaaatgcattttttttccaatgaaggaaaagtcaattttctgtccaactgaaatatgcatgacggataaatagctaccttgaaagagaccaaatcccactgtttaaactttcactctgtgctgcagttgtcagttgttattgtcaatcaagtagattccagcttacttatttttctggtggaccattttttttttctttcatggcaggtaatagcaaaggcccgtgtgccaattgtgaagttcgtggagagaaaaagtgaaatagcttttgacataaggttaaattgtgtttctcatcaaatattcctttgtttctagttttttgcgggaatgcttatcgaataatttccctttttctttttccagttttgacatggatggtggaccacaagcagcagacttcatcaaggtactttgtgcagacaaattggctaattacttcactggcagcgtgtgttcgtgaagctaattcgtggggcaaatgattgcatatattttgaacatcatttttactctgtactgcaggattatgtgaagaagtttcctgctttaagacatctgtgtatgattctgaaagtttttttacaccaaagagagcttaatgaggtacaattacttaaaactattagtcgttccattctaataatagattgtttgtaattatggcatttctagatttccaattaccatttcactctttttggtaggtctatacgggtggaattggttcatatgctcttctcactatgctcatcacacatttacaggtaaagctgagtctgttttgtactctaacgtgataatggcctttttttgtatacctgaattgatttgagttataattccttaaaaaatggttgaaaggtacacattgtgtttttcctgacatttaagatttttcttataaatacttaagacacctaacaaacataaatttgggttgtttatacactgcatcgctaatttgttcactgattcagtctaccatatattacttactatggataactgaactttagtgctaagtgttctttttgttagttgatctggggaggcaaagatatactggggtatcgtaaaaaggagcacaatttggggattcttttggtaagcaatacttgttttaaatgtttaacagtaatgcaatgttttacattacaatgctttgacttccgttgcatgtaaagttccattggaaatattcatttcatcgtggtattaaccataatgcatattacatactgcttccgaccatatcgttctcagtatacacttttttacgttgtctttgctaatggaaaggacatgcattctctttataattaagggggcatgacacatgattgcagctctttatagttatttttccccttcatggcagatcgcattatttgatttttatggacgcaagttgaacaattgggatgttggaatatcctgcaattctgctaggacctttttcttgaagactgataaaaagtaaggtgtttactagcgggcttagaccaaatgaatatacaataaaattatcatcttcttagtattttgttcaactgaaaaaaaaggataattttttcagtattcttgtgtattgctgtagaacaagaatatctcatttgcttctaactaggccattctgttaaacacttaaaactgttgaaaatctgctctgtaaagatttataggtgaaatgtcattatataactgaaagaaaatttgatgcgggtgcaactgtttgagttgctaaaattttgactttgttgtataagccatggaacttgtttactgatcctgtttgtgtctctctgcttttcaagctttgcaaatcctgatcgagcataccttctagctattcaagatcctatggtatgatctttggccctttccttttagtcttggttagctttaacatctccagcttcaatggatttacctattgtttttcttatggcctaggtaccagataatgatattgggaagaactcatttaactatttcaaggtattatttcttacaatgttgtttgtgctgtggttgtgatacttgaagtattactcgtttactgtttcataataatatatgcaagcaatatcgatgaaagtgttcctatcttataatgagcctgttactttgctctcaatgccagtttcctgggtatggtgcttacatggtatttcatagcaattttgctaggttatacttgtgttatttgagcaatgttccgtggtactctgtaatggtttggtaccctgtcactgtcagtatagtattttgttcagtgatagagtgatagtccatgttctgttaagggtaatcaatctgaggttatctaagggcactaacagttatgtcctcaagttgtcacctgtcctgttccttttttgccactgttgcacgttcgttaccaaagttcttcaggttttcggaccaagtttcttgaaaccataagaggtggtgaaactggaacatggtataaactagtaccctttttctgttaccagaactagttatcttctttagtttgaaacccgaagcttttgcatatctggattctggagttagtgatataactactggaatttcaaatgttgtggaccttcgtggtatagatgttggtccaaatgggaggtttaagtagggtggtatggccaatggtccaatcttagtttacagaataagtgaacttcctagaatttgcaacatatagttattggacattgatgtttgaagtgtgctgtcacattatctatcacgccacttctatgtgagcttttggcatgtttatgaaaaactataaatgcaaaaaatctgattgagtaatatttttttttgactaactgattgagtaatatttgttaactgctgcaggtgaaatcagcattttcaaaggcttattctgtgttaaccgatgcgaacttgataacaagcttggggcccaataggagcattctgggtaccattgtcagaccagactccgtgctcctagaccggaaaggctggaacaaggacgctacaatacctgacatgttaacagaaccctgggaaccattaccccgtcagtttgatagcgataatgatgcagtctataattggcatgtgatagatgatgaaccactgcccaggaatactcgatcctcatcggaggacacaaggccatcacctacacaaaaaaggaagtcttccaaaccaaaacagagatcgcggaaaaaggccaaggctgattcttcgagtggtaacaatgctgaaaatggtttcaagcgggggaaaggattagcacaatgtgatagatcgcatcaaagtgcaggaagcagcagacggagcaaagggccgagagagtatgacagatttacaaataccctcccacaatatactcagcacattagtaggtggtgactttaggctgttactgatagcatttacagtacagttcgggattgggagatcccacgaggttttgacaggcagaatggcgccttggcagacgtcgaagttcaagcagctttctgtagccatatgtatgatttattatttatttgtttgtctaacgttattcggtcctttgtaacgccgatgaaaccgatatattcagttatattatcatcgtatgaactgcaatttcgccaacttgtctatggcaaagtttcagactattaaaaattatctttggctggaacgtgaattcataattcataacaagacgtcacttcggtgacatccgataaaaataattcataacaagacgccttgaaaggtttaagttttattaaacgaaagaggaacataatttagattgtcgcagctaccaatcacactaaatacatgattggaagttaaataaaatcaagcttatagtcgaatgaaataaaaaggttccaccttcttttcccagtttagaactgaacaagtaaacagctttgtttaccgttaccacaacgacactgcaagcttaatacagctagctaccgtcttttactcgtctttcttctgtgcgaatcctgggggaaaggactccagccttttctattccgctcaaaagaataaggaaatataacgagaattgtatatgaggaatacaggataatcagctatcaagcactttgtgttcaaatatcaagcctcttatacctctgctctattttcctttcgagagctgctcctatgttttttccatagtataacggaaaaaaaaggtcaatcaacaatatgacaggttaaataaacattgaaagtaaaaatgcaaaacaaaagaagctaataaaccgatattgtaaggccacccaacaaacagctgacaggatcaagatggtgtaaactcgtcaaatatattcataccgcaaagacataagtttaccaggttacaagcaggtatgtccattaaaagtgaggacatatgctagcatcatcacttaactaatctaccattcttattcagattgacccttcagctgaaaaaaagtagaaggatttgcaccaatctgctggctaattaaaaaaaaaggaagccagattgaagtggccttatggagagctgataagcttccagtccatattagaagtggagatcctttgtgagaccagtgaaacatctcaatatgactggttcattctgcactaacctgaccattctcgtggggatgtaacattgctacctgcattgagcttatcagccatggcaacagagtctgcaggttgggctgcagttaccactgggagagctacgctctcaactcgatcccgtggataccctaccacactagctgtttcaaacatatttccaaatggctgattatgcacgacttgtggtcccaaatgatgaaatgccatcggaccactcgctggatgctgaggcagaacagcaacaacagtagcagcacagttagaaggattcttgaatgtggcgctgtaggattggccactaccttgaacggcataggatgccacactacagtggttgggcttgcttggttgaggtgggcatgagctcaggccgtgttgctgcaatggttgtggctgctgatgctggatgttaaggtctgtcgatggaagcaaaactgtattgccttggccataaaaagaaggcatggcttcatgatgcttctgctgaggtgaagagtatggcgagtgcacaaccatgtttctcagaagtggctccgttgtagcactggcaggcttctgagaagagtatggaggatacaagacagcgacttgaggagcactttgagcctgaggagatgatgtttgctgttgaactagctgtggtggaacttgctgaatattgtattgctgcggttgcaccacaaggggctgtgttcgccatgcttgtgactcaacctgctgagcaggcagatgtagcctttggtcctggggttgagggtacaattctgtcacctggctagatttctgagataggtcaactgcaaccctggcttcaggattctggatttgtgactgaataacatgtaccgcggattctgatggttcactctctgtgcacttaataggattttggctttgcatataatacacggcagcttgactcggctgctgctgatctggttgtgtgctcaaagagacaggcactagttgctgcaaaatataaccattgctgctttggactggcacagcaggagattgcattgcattaacttgctgaagtggcatgaaagcaacctcatgttttgcaacttgtgtgctgtgatcattttcccttccgaatgtt

SEQ ID NO: 61712 - DNA, 2184 bp, Oryza sativa
cccatgtatatgaatgggctacagttcctttcgggccatgtgcatgggtttttttttcccaaaaacatataagcccatttaaaagaatgcacatgagagaaatatcattaccctcgacctgctaaatgggaatgggataggctaagactgaaatagaaatgaccgtcgataaaaaggatttcgtgtgatggtgtgagatgctatgcaccgtggtgatttgtaacatatataccacagagatttggaatggcatggctttatgcacaacaccataagcataagtgatatctaagtagttaaaagaaaatccttatatgagaatgttgggcatgttcactttaccatcactttcaacccaagtaaattttgatagagtaaaaaactaaacactaccttagtaccttaccaatatcatcttagcaaaatttgatggttcccaaactttctaatcataaaaaccctaccaaaattcggtaacctcaaaatttaccaaattgaaattggcaataaagtgaaatgcccgtaaatttaacgactgaaaataaataaacatatcagtcaggagacttgacaaccggtgagcattagtgtaagaagtttattttaaaccccgtaaccatgggtgaaacataacgtggcctctggccacccgggctattgcctaaggccttcgattggaggcccattaggattaagatttttcagtgtatgtaactaccatgcaaggctcagtataaatttgccgtcaaacaataccattttattaagttattaattgcgcagtgttatgaatttgctactcaaatctgccaaacatcttctccaccgctcaaacgtacgtgaatcagaacacatacatatatgtaggcatccttgcgtgatatagctaaatggatcatgcagactgatgactcttctgggaggacaaggcttctatggcagtacccagcggccacgccgactccacgtagcaatccccatacttgacctgtttcacaagcgtcatctccctagttggcttcaaacctgcgaaaccataattccaatttctatgtcaggtgttgttgctgctacttgctagtaacttcagtgtggacgaatttaattcggttgttctttagtacgccaattttgtaaagagtatattaatttttcaaagtgaactaatattgaaatggaaacaagttacttaaagatttgccgcaagttctaataaataattatttatatgatgttttacatgttcaataatgaggcattaggaggcactatacaataatatatatagtttatattgtttgtttatcgagtcctaatatgtcactcctactacacagatgatttattggatgagaaaattataaacagttgattctacttacgattgtaaaacatctctttaattgtttttaactcagattaatatatggtgtgggtgcatagtgcatacattcgtttgtgtaataaaattagattagctctaaatacaactatttttatggttcccgaaaagataccacactgtccgcaaattaaaatattaatttaatctgagttaaaaagatttaaagagatgctttacaatcgtaagtagaatcaactgtttataatttttctatccaataaatcatttctatttatactaccatcctataatctctcaataaaaactgtaaaattatataatatccaactgcttagatagaaataagtttttttacaatataagtattgttccactgattccaacgcacagaacatacattttcacctaatcacggtccttaaggagaatttaaacacttaagatgattgaaaggaaatcttttttccctaacattaatatttgcaaaaaacacttatattctactaccttcgtcccaaaatagccttatttagttcgaggggtaaaaagtgttggcttgccacatcgaatatacagacacacatttaaagtattaaacgtagtctaataacaaaacaaattacgaattccgcctgtaaactgcgagacgaatttatttagcctaattaatccgtcattagcaaatatttactgtagcaccacattgtcaaatcatggcgcaattagtcttaaaagattcgtctcgcaatttacacgcagtctgcgtaattaattttttttctatatttaatactgcatgcatgtgtccaaacattcgt

SEQ ID NO: 61713 - DNA, 2650 bp, Oryza sativa
attcctgcagcccccaaacattcgttgtgacaggatgaaaagtttttgcgtgagaactaaacagggtctaagtgcagttttacattgtttgtgtttaacgtttaaccgttcgtcttatttgaaacatttttatgattagtatttttattgctattaaatgataaaacattaatagtaatttatgtgtgactaattttttttaaaaaaaattataatttttttaaataagacagatgatcaaagttgtacacacatatccacgactgcacttattttattataggatggatgtattatattttggaatggacgaaatatttttgcaattacttaccgaagccctttgtaagcaatgtgtactggtacgtcaggtccatgcatatgaactgcacgtcgaacgcctccgggtacgcggccgcggcctcgccggagctcagcgagcaggccttcgacgccgcctccgcgaacgccgccggggtggtcacggcgctcggcgcgtcgtcgacgacgaacccgccgtgcaccgccctgtcgtagaagtaggacgccacgtagaggtcggccatgccggcgccgccgccgccgttccacacgccgttgaagctgcagttccgggactcgcacggcgcgtccaggcccagcgccgccgccgcctcctcgccgcacttgccgtggtccgccccttccggcgacgccgccgcgtcgtactcctcgccgttgtacttgtatgtaccttcgtcgaggtcatcgaccaagaataaatcgtcaaattattttcgtttgcagtttcgttttgaacatttcttaacgggcgaccgtgcaaaaaagaggaaatttaatttgcccctatttgaataaacgttgctaaattagaaaaaaaatgattttgttttgaaattttctggctaaatagtttcatgcggggttctaaaattcctcaattatttatgtcgaaaatccatgaaaatcattccaccagcctatacatatagacgtattcggtattaatgtgacacatttaaatctagaaattaaagtattttttctgggacataccattgaatccgcgaagcatgcaggagctgaattgcccattcttcgtcttaagaatctcgacgcgagaagcttggagcccataatgcaagtaactgttcattcaagattatgtctgatcatcaccattgcctaaagtatataattactacttatttccttgtgttacacaactaactctgaatgatgtcagaaattaatcaagcccgagttagtctgttttaagctttcttttaattaaccacaggtccacagccttttgttgtcaatacagaccaaaattaagttaacaaaaattgcatggagctgaagaagtaagatataatttggtaagaagttgttgtcgattctacctgtgaacataaaggttataatcttttcccttgagatactcctttgtaacataaggatctttgccgacagggactggaggagcgttttctgcagcatctgaagaaatggcataggccatttgaactgaaccacctccgagatcgatcactcctacggtttttgagtaatcccctcctaacttccccaaaagatagttcagagcaacctgcaccatgtaccatatggaatttttattttctgaaatgatatatttatataaagatgtaaattgtcagaaaatttctgctctgaatgacagtatgtcaaacatttcatacccagaggttggatccttcttgagaacccccaaggacactgatccattctggtttgtactggaaattgctcttgctgtggacaagatctcgaacctgtaagtaatattattgaaaacatgtcatttttgtgatcaatatatagtctacaaacggttaagatctttgcaaaagtagagtacatcatctaatgaaaccagattacggtgagaatattatttaccgcttcaagaatttgctctgacttctcatctccaatcagtcttagaccagcagtggcctgaacaccaatttgattacaccaaacataaaatagttcttaagatcatttcaagaataattaattccagtttcagtaagatcagtaagtaccccaagtttgaggggagttcttttctgaagctgcttgggaacaacacctttagccttctctagcagaggagcaatggagtttgcagcttcctgtggtttgccagcatatgagctcaacccgggcttcacctatatttttttttcgaatgtgagcctatatgaagttacaacttttttcatagaatccacaaactatcctcataactgttccatgcacgtatgctttattgctttacacttcaaaaagatgctgcagaaatcttgaagcatgctatacgcacgcttcacactttaaaaaggagaagcgataatcttgaagcatactccaagtatatggaatacaacgtcgcgttttcttgctggcaagagcatttgaaattcaactattttttgtggtcttccaagtgagaatttgactagaattttatagtaaaaatttatttatgaaatctaataagtttaagtgattataaaattatttttcaagaaaaatattactggtggagaaaccatctttggtcggtcgaccagatttcacaatagtcccggggctgcag

SEQ ID NO: 61714 - DNA, 15462 bp, Oryza sativa
  unsure (1)..(15462): unsure at all n locations
gaaagggaggggagagaaagggaagaggggagagtggagccgccacgtcatcccctcctcattctaccacgtgccgctgccaccgccaccctccttttacgacgcctgtcgccacaaacgttgatctcctccactctaaccaaatctaggagaccgatgggaggggactggagcctctgctatcgcccctccttctccctaccgttgaacgatgcaagacaccaccaatctggggcgctgccaaccacgcctccagccagttgcgaggaaaaggagggatgggaggggatagaacaggaggggacggcagtggagcatccgccaccgcctctcctctctatcgtcaggtgctgcagacctacctccagctagatttggaggggaggagcccccatcaccaccatgctgccctgctgcagtagtggaggagagggaaggggaggggaaccggtggtggaggcatggtgaaggaggagactaccaagacttagtcgctgcgagctccgctggatcgatcgggtcctgattttagtaacgcccccacactataaccccactttctagacagacgactttagaccccgccagcaaaaattaatttttataggcacggtctaaagagtttccacctgcgaaaatatgaggtattttcataggcaaacctcttcaaacctcgcctgtaaaagtcaatttttcataggtggagccaaagatatgaggcctcttggtattttcaaacggtaaaagtgaaaatattttgtctgcttgaaaaaataaaacacagtgttaggaaaatgctttatatattggccgatcggccttatggtctaatatatttattttcattttgttagttacaaaatcaaactaactagcataacatgaacctaattgataggacctatactagagctaaatatatctttcgaggcttcgtgtgtcacaacaaaaacaaatccacatccaaatatgtaaaatgaaaaatacaggcaagacaaattttcataagatggaacatagtggcaaactgtggctagaccttatgccatgggggatggcatcgttgggtgactcagggatcggtgctggttgtcaaggagtgttggtggctaggggtcaattaatgctaaggtggcacatgccaacagggtcatgtgaagactagggctcaggaagcagtgatgtgcagacaatcactagcgacgagtgttagggttacggataaggtataccctctacccttggatgtatgttgtataccgatacggtatacctgcacatatacggatgtttcctgtacatgttaaggaaatccatcatgtaacagaaacggagtccacggatggaaggagtcctactcagatagaactgagtcgttactatatcgtgtggagtccgatatctccgagttctagttggagatcgactgacccgcggtataaaagggaccccccgggaggaccaaagggatcgaatctcaccgccaacacaaccaccacagcctacgaagtcggagcctacaggagctaagtcgccgggtgatctagtcgaaccaactcgactacggtcttgtcggtatcattgagttctactattccctttgtaatctgtggtttccatcatataatcccataccaactggattagggctattacctatcaaggggcctgaaccaatataatccttgtctttgtggtttccatcatataatcccataccaactggattagggctattacctatcaaggggcccgaaccagtataatccttgtcttttatttgcttgatgtcgtattacgtagattctcgtaccaatgtaccccaataccctctatatccggtctacgggtatcccccgtcgatagtggcgcgccaggtagggggctttggtactcaagtgtcatcaagcttcgtcgacaacagcgtcaaccccagcatcaaccaaggagtttctacttcaacaatgctggtatggacttaggtcggcaaactcgtcttcctggtttacaccacggtgtcgatctcgactggtccatcaatgaccggaagcgagaacaccgtggttacaaccctggacggctccatgtcgaagaatcctccctcagaagtggagaacggaacatcgtgtcgtaggctctccggaccttccattataattgagagatgaaatgtataattcaagtcatcaaacaagtataatgaaatatccgacgcctcgagagaggaatattggagacattgccgagcctttagcctgccagtcaacttcagcctgagatgtgcccgtcaaaccactcgaaggcggtgaccagatgtgttacacattcaggagacttgacaacaatggctaaagatctacaacatctcaaatattcttaactcatactcatgtgaatctagttcccaggatgtgcactagattcacactttcatctcaagcatgattatacatagcaaacacaaataacatgaaagcgattataaactacatctactttagttacattggccaactgaccaaataaatatatagaacagcggaagcttgtctactcaatccacaagcacatcgactaggggtttaccccattaagttcaagtcctagaagaagtagtcgattacccgcatcactcaaagactaaatctaaaacctgcaagcaaaaggttaattcaatagcaagagtcagtacattattagaaataatgtactggcaagcaccaagacaagcctaagaccctacttgcaaggcatataatcaaggaaggcataatatggttctttttagcataaagcaagttttatttgcataaaacatttctaaatcacggtttactttcaaataaaatttcagcaagctagtatttacgatattgggcatcaaggtaggcattaatcatgtataaatatgcacctcattgccttccatggcagcaaggagatcattctcaaatctcatcacaatttgaaggtaaatttcagcatttagaagaataaacacaagtctatactcaatacatatccacacgccgctcatgaccgcgagcacggctaatcgattagttttaactctgcagagtttgtacactttacccacatgatacgaaataataatcatgcaagagcatgtcacgcgatacataagtacccgatttattacctgcaacaaagcttttccaaaattcatgatttagccctacaccagcacgatacgtgttactccatcctaagccatacatgttatatgacctagaaccgttaagtggcgggcccacgccttaaacttaacgccgtggtggcggacacaacgggaacccaccacgtggcacaataccgttgtattggacacgcttagtcacctaaactaccacttcggggtaaataggaagctcctctgaattatacgaactcatacacaccggcctaccagaatgtaaggctaaaccataaataatttactaagcttgggctatcccatactagcacatgtggttgcactgtatacgaaatgaactgacattgagtgaagtccttaggtcggtttgggcacactctccccctatcggtacacaactaatcaccatatgtgcaccacttgaggctcaacctaaaatccatgttttccatcattttatttatcaaaatcacaagtattaaagttctgtccagattatttcaaaatcaatttttcatatttgtaatgagcccataatgacaaggaagaccattctaagcatggctaagcattatagtaacctagtgactccaaaattcatatataaagtggtatagtcatattgttcctaaggttaggaatgagggatatggatatatgtggggtcaaggtgaatgcaaacaataggagtttgtctaacaagtttaacaaaattttaatttattagtgtacaatcgacatgcaagatttgcaaacattttcaataacctccaaaacataggttcaaagtgatcaaagagatggaggtgggacttgccttgaatcaggaaaatgtcagcacctaaatcacttcttcaccgtttaagcaatcatctatacaaagtacacgttatgcaattaaacaccgaaatatgcgaaaaatccaaaatactctaaaatggatgatttgtgcacagtgaataggtactggtctaaaattaatttaggtgaaagaatttctattttatctcattttatttgggagttatgaattttagaagtttcgtcggtatagtgtaggatttacttagttactgttgtgaaatgctgttgtaaggtaattcttattaagtttatgtttgctggggtgaagatatgtgttttctaacactaacacatttggtttcataatttttagagttaatatgaattctttttgtattttacaagttataacgtgttataggtgtatagtgttctataggttcatggctttagaggtttaggtctagaacttgcctcatctagctagtgatgtataaaatgaatattttagttaactaatctaaccttagttcataggcttatggtctttattatcatggttcatattttataaactaggggagctctagtccatgttagcaatttattatatcaacctagaaattattatatgagctaagtgccttaagttttggtggatgggaatggaactatgcattcactggtctaacaagttttatttgagtttcattatagctagagtgtatttctatatacatttatatatatacatattgctcaatcgatactatgtgattagcacctatcctataaatttaaagtttagagctataacctgtacagaaggttccatattttattttactatgttgaagcccactgtttgctggttctatagatatttggttcacttcatttagactaaagatgaattttctacaaattttacaatttaaggttgctctatgatggttattacttacataagtatttagaggcttttatcatacagtaagtatataattttattttataatttggaagtatatgttttggtgattctacagaacttgggtttactaaaaaaagatctaagatgaattttatatgaacttctaaaattcagcttatctaaaactagtcatttaaaggtaatagttttagaggcatttgatgtatagtatgtatactatttcattttgctttataggagaacataagttggtggatctgtagaaattgagtttgctccaaaatgagttgaaatgaattttgtatgcattttataaattttgtgcgtgctttatgtgtgatttaacttggataaattttagaggctaaatttgtactgtgagtgcaagtttttattccataacatcaaagttcccaatttggtgagttcgcagaaatttgaatcatcttaaaatgagctatatttaattttatatggatttttacaagttttagttactgttcttttataatttcagattttgtttccaaggggtgcactgtcagtctcaggccaatatgcaaaaaggctcctatagtttcaggaaatcaacccgcagtcctatgactgttctgtgtgtcttgagcttttgcataaagagccctacattaacctaaattcttgtgacgaggtccctggttcgagctgaagcagatcaagccatggctgagctcgatctcaagcttgccagcggcaaacggtggctcgtttgagggtgcgaccaaaagacaaaatgaagatcatgctattgcgattccattcctcttcttttcttggtcagtggacatcggagtaacgccggcggcgagtccgagcggcggctgtgcttaggctgctactgcatgttgagttggtgctcaattctaagtgaatgaaatgcatgaatgcaatcctatgggctcaagggtgctcaccgaaccttgaacgaggcgccggaaagtctggacagcggcagcggagaagaagatggtccggcgacggtgtagagctccgggaagacggcaacggctcgatccactcatcgaattgacatgcatgtgtttcatggggttagtgaggtcccagggatggtgtatacgcgaagaatcggacaatggctcaccggaggaggcggaatcgacaatggcgacggcgaccggaggtggagaagacggtggacgatctccacactcgtagcaccattcttcaagattcttgaggggaaatggagaggaggttgaggtgaagctggtggcgtggtggctcgctccggcttgatctagattgatggcaacggcgacgatgttgctgcggcggtgcgcagagcgcgctccagagctccggtgtgcatggcagcgttcccgccgattggctgcaccagagaggatgaaatcaaaaggagaaattttcgcatcccgaggaaagtatggaacgcaagagaagaggaaacgaccgcggctcatcaacgatggcggccatcgtcttcttcgcagccggcgatggagaaccagtggagaagagcagcgaggatgctctccctcggatggatcggcactggaatggtgggtgaagagtggcgacgcgtctgggagaggcagaaatggagctcggcgtttttagggcgtcgacacgtcgtggccacgcgtcgtgcggcgtccagagccggtcggcgctcgatctctccctctcagtgtttctcggtcggctagggaagttgcacagaggaagggcaagccggagggactgacaaggggggcncaggtcgaagtaaactaggtggaagagagatgtgtaggcagaaacatgggtgagcttggtttttggacgaatttccggaattattttctcctctaattttgtagcttcaatacttaatgtgttgatcagattaactagtgttgattttactggaggtaggtgtatgtacctagtttccattttctttggttgcactcaaaaattatggatagattactcacagaaattagaggaatatgggttctttggaaactagttcgaatttttaggagccctaaacagagaagataaattctgaaaaaattatttttattaatgataaatgacctagtatttgaataaattattttacttatacacttctatgcagttaaatgcacttttagataaagtatggttttagccgattaagaactacagttaatctagtttttattagtttgactgatttatttgaggtacaaatttagttattaaatcataccaaaattacagtgagttgtatgtgttgagtagagcctacatgaattttcccatgattttatcttgcacgaattattttagataattctcaagagttatgtcttatatgtgtttcctttcctaaatgcatgtaaatgtttataaaagttatatttggactctcattaacctgaggtgataatgatatgttagaatttcagtttaccttacacaggtcataagctccttacctattatgcacaagtttactttagtattaaattaagagaatgcttatagagatgattaagatagaatatatcctatatgatataatttatttggtcacttccatgttcatgactagtcttcagatggatgaccaaaatagttttgtggggcttggcattggccttgttgatatattttaaggtgtatggttcctattttaacttcctctagctagcactaggccctaatggtccagttgtttatctagatcttagttaatattcatgagacctattatgatatgcaaatcgaaaatccgaatgcaatccaaatccaattgcatatgaaggactcaagtcaaacatgtctatgagagtatgcatgcttacacataaatttatatttttgtcctaggttagagatgcaaaggtttttaatttgttctaaaattttatcatgcaagagttagatcaacttcacctaggtttaaaatggaaatttttggtttacaaaattgaagaacttccctttcaactagttttgatggaaattccttaatcctagaattcaggtatgttacacatcgacgacatccaagcccgagaaggatcctaatgcggccaaatcttgtccttccgacgagaatcacgagccgacaaggacaatttctgaggcaacaaggtcctggtgtcctatccacaaaaccaggaaacacaccttgcaggcttgctgggtttttctcgacgtacaagctgagatctgtgcctgcaaagagcgtggaattcaatgtacttctccaacccgtgatgtctattgtcatattcacaagacaaagaatcacgacctctcaagctgcaaggttcttctcagtgccatgaggacgtcacctcctaaggtccagcagtcacaaatctctcttagagatgcggacaaggaacaaggagcgacagttatctcagatcgattcgttggggtaatcgacgtcgatccccacgagctgtcggttctacacttgctcgaagaccaggcctcatcatcgacgagtacaccatgtgatgtgttcgttatcgataggaccagcatgtctgcgcgcgctaacgcataagcggaggatcaagtggttacaccggcccagcacatcagggccatcaacgcaatactgagggaaaccccttatgatcccgttctgaacgatgatctcgcacagtggacagaacgactacgggaatcagtggctaacctcagtaacgcgttcgagggggccgccgccggagtaccgacagaacacccgccaattggcggtgccaatggcgaactacctgggcagcgggcatcacctcgtcaagccacccctccacctcgcggcaccagcgatctccgtgaccatttgaatggccgccgagaagcacgacgcgcacgagacaacgaaaaccgttcccgacatctcgtctcttcacgacgtcgggagaacgaagagcgaggaggacacccgagcaagaaccaagaccgtgataaccgccacgaacgcgatgatcgcgaacagcggatgccgggcgagactgatcaaggacgccaccaaaatgatgacgacgacggagatcgccgtcgggacaacaacggggggcgacgacaggattctcgagaacctagacgtcatcctcgtattcgtaccccggaaccaagtgactatcgtcatcctcatcatcctcgtgatcagacagacatccacggaggacatacgatcaccgacaacccaccgcccccggcggcgggtgtagagctttcagtcgtgctctatgtgatgttcgatagcctgagagatttcgaccgagagcaatatagaagtacgatgggagcactgaccctgaggagttccttcaggtctattccatagtattctacgctgccggagcagacgacaacgtgttggtgaattatttgcaagcggcgttgaaaggatctgcacgtttatggctagtccacctcccaccatactagatttcttcatgggcagatctgtggcagcagatcatagccaacttccaaggaacatacaagcgccacgcgatcgaagacgacctacacgcgttgacacaaaatctgggtgaatcattgagggactacgttcggcgctttaatgggtgcagaaatatgatccccgagatcatcgacgcttctgtgatccgcgcttttaagactggtgtcagagatcgctacaccacccaggagttggcgacgagacagatcacaactgctcgaaagctattcgagattgtcgatcgatgcgctcacgcggacgacgcactgagacgcaagaacgataagccgaagaagggaggagagaagaaaccagccaaggacgcacctgagtcaagcaagaagaagagtcgcaagagtgggaaaaggaaagctcaaacagaagtcctcgtagcagaatacgcggaaccacccaagcacccagacccacaaagggacgatacgaagaaaatatggtgccttatacacaaatcggacaagcactccctagaagcttgtttcgttttcaaaaagccactcgcaaaacaattggcattggagaagggtaagcgagtacgtgtagtcgagaaagccactgaagcagctactcaggactcggactcagcatacccagattcccatattcatgtttcgcatatcttcggaggttccacggcatactcctcgaagcaagagtacaaaaaagtggagcgcgaagtttgttcgacatggcagggggctacccccaagatgaagtggtctgagcagaagatcgaattctctgaagcagaccaccccaagactgttgttgacgcccactgatcaacccttccatggaattactcctcagtcatcgtctaagccattgggcaagattacgttgcctgtaactttcggccaagcaaacaacttccgaacagaacagatcactggatttgatacagcatacaatgccatcatcaggagaactgcactcgcgaagttcatggccggttctcactacacgtaccaagtgctcaagatgcccgggccgaagggaacaatcactattcagggtaacgcaaagctcgcggggcagtgcgacaggcggagcctcgacatggtcgagcacacgcccaacccacccgccacagctgagccacccaagaaagtgagtaaaacaaacaagacgccaaagccagacgacgcaatcaagatcgttccactctccagtgccatccccgacaagaccgtcaagatcgaggcgtcactggacgagaaataggaactcgcgctcatcaccttcctctacgacaatgcagacgtgttcgcttggcagccgttcgacatgcccggggtccccagggaggtgattgagcacaaactcatggtgcgacccgatgccaagccaataaaacaaaaatgcggagatttgcaccagaccggaaacaacccatacgagaagagctcgacaagcttctcaaagctggcttcatcagagaggttctccgtccagagtggctagccaatccagtcatggtgcgcaaggccaacgggaagtggaggatgtgtgttgacttcaccgacctcaacaaggcgagcccaaaggatcacttccatcttcctcgaatagatcagcatggcgaaagaggacgaggagaagacaacattcatcacgccgtttggtgtattctgttactttaagatgccgtttggactgataaccgtaggaaatactttccaatgcacggtccagggagcacttaacgatcagcttgggaacaatgtcgagacctacgtcgatgacattgttgtcaagaccaacacaagcgactcattgattgacgatctccgggaaacgttcgacaacttccgacgatatcgcctcatgcttaatccagagaaatgcacgttcggagtaccatcgggcaagctgctcgggttcctcgtctctggaagagggatagaagaaaatcccgagaagatcaaggcaatcgagaacatgaagtcgcccacaaaactcaaggaagtccagaagctaactggatgcatggcggcactaagcacgttcgtgtcacaccctgaaaattcaaaatatataaattgttgtttaaatggaatttttagaaataattttaaaagtcttgaagagaagatctaatttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcccttttggctttgggccaaaagtcggcccaaaacctttctctctctctcctcggcccagtccggcccagtccgccgccgcgcgcgcgcgcgtccgcccgctgacaggtggggcccacctgtcagggtcgtcgtctatcttcggccgccgccgcccgaaaccctagtttcgcgctgccgccgttcctttccaaattcggtcgatcctttccttctccggccgaattgatagaggggaaacaatctccgggatctcctctaccttttctcttttggaatcatcggctaattctttttggaaatcgttggattcgagttcgaatcggattcgtctctttcctccgaaccctaaaccttccttctcgtcgccagcagccgtgggccttcgccgtcgcctccgagcccctttaaaaggttccccggtgtctcctctacccgtcgccacccttgccgtcgtctctcgtcgtcggaaacgccctagcgccgtgtgccctagcgccgccgtcgtcgccgtcgcttcagccgtgcgccgccgccgttccagacgtcgccgtcgctcgggaagaccgtcgtcgtggtcgccaagttgtcgccgtcctcgtccgccccttcgccgtcgctgtagaccgccggagcaccgtcgccgtcgtcaagccgaagaccgccgccgttttaacctcgttgccgtcgccgtccgttggtcttccgccgctcctttggtcaccggtgagttcgccgcgtcgcgctctacccgttggtgccctccgttcgtgccgaagcgccgccgtacgccggcgagcatgcgcgcccgagccgccgagccgccgccgccggtggtgacgtcaccgctgatgtcatcgtcgccctctcccgtgagccggtcgtggaccgatcgatctcggccgtctgttttggatggatcgatctcggccgtccgttcgcgtgaaccgccgccgtgcgcccggtccaccgaaaccctagcccgctgacgcaataaatcctcttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatattaaaaatccacattcatgcttgtttatgtgctgttttggtgattttgctcttttctgcttagattccgtcgtttccggagagtcgttttcgccggaaaagagtttgaagagttccaaggccagcaaggcaagtcacacagattccaaacaaccctttgagcatgttgatcctatttaaagctattgtttcttttcaactattgcatttattttcgaatgtcattgggtggaattaacctattcattgttatagcccatttgttcttgattactttattccttgataccttgggttattataacttgactagttgggctatgtatattggttcaactagatattagatataattgcttagccctgcttagaaacattagctcactattgggataacttatgactcactattatttaatgatggcttaatgatagttcacgatggtcaatcgtgattggttaattaattaatgtgccaactaaaacctggtaatggtgggttgtgagcacatggttttgatggttgtgctcatgacaattaaggaccggttcacgagtttcggttgtgaaacattaaccgtgccaacgacaagccagcgtgggcaacggctttatcttttgtatagcatggttcattgcggggcaccagactgagaagtggcggagataagcccacgggggtcgctggggagtccatgccttgtttataagggggtgattatgatccaggaaggtgcgctgcggtggattgtgttgtgcaaggggtattgtcacaactccttttcgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtcccacacttctcaccatagtaaatgatgctataattggtaataatttgattagctcctggtttggaatggtacattcctggtttggagatagaactgtgcagccgggatggttgtccagaatggttgggcctatacaacagggtatgttgtatagcgttggattaatattgtttaatacttaactgttttattaaattctcaaatgtttgttaaatgctgcttttgcaaatgaaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcaccgtttatcttatttttccactgcttagatctttattgtttgagaggaactatctacctctgtaatgacattttattcgcttattaattagagtaataattgtactctattatcaatttgttattgtgtgcctcggctgattcctggacgagggtttacacacatgtaagcgtttggaattttggatagaaattccgggcgtgacagttcgtcgctaggatgggagagcgtggacaacctttcttcgctctgctgaagaaacaagataaatttgtatggacacaggaagccgaagaggcgttcatcgcactcaagcgctacctgtcaaatccccctatacttgttgctccccaacctaatgaagaattattcctctatatcgctgccacgccatattctgtgagtaccatcattgttgtcgagagagaaggtgcaaaggccagtttattaagtcagcgaagctctccacaatgcaaagacaagatacacacagatccaaaagctgctttacgcagtaatcatgacatcaagaaagctacgccactacttccaagcccacagggtcatagttgttttctccatccctcttagtgaagtcgtgagaaataaagacattgtcggccgcatcgcgaaatgggtagtcgagctaagctagtttgatgtccactttgtaccacgaacaaccatcaagtcccaggtcctcgccaatttcgtagctgactggactatgcctgaaaacaggctggacagtcaaaccgacagcgaaacatggacaatggcgttcgacggtgcactctacagccaaggagcaggggaagggttcatcttgacatcaccttcgggagaccagttcaagcatgcaattcacctcaacttgaaggcgaccaacaacacagccgagtacgaaggactactcgctgggataagagcagcagccgcactaggagtcaagcgactaatcgtgaaaggagattccgaactagtcgtaaaccaggtgcacaaagactacaagtgctctagccccgagttatccaagtaccttgcaggagaaaaggtttgacgggatcgaagttcgacacgtatatcgcaaggacaacatcgaactcgacgacctagcacggcgttgaagcatctaggcccccggtgttaattttggtaattaatgacaagcgctaattgtggactaaccgttgtcttgagctatacattttaagttaggt

SEQ ID NO: 61715 - DNA, 14702 bp, Oryza sativa
ttatttttagtttcgccgtactattaagaggggtaatgacctagcaaagagatgatgttaattgccacattaggtcattatacatttagacttgtgctcacttttcacacacacacacacttcactgggtttggcctgaccaggggcggtcagagcagccacatagtggcggtctgaccggcgccacaatggcggtctgaccggcgcataaggccagtctgaccggcaggacatgcgcggtcagaccggccccctggtggccgggatggtgctgctcaggatggccgatacagagccgagggaaccgtattctgtcagaccgagctgatggcggtctgaccgagccgaggccggtctaacaggccaccccttgtcggtctgaccggccaggccgatggggccctctgacagcactacaacggctagttttctagccgttgctgagtagcacggtctgaccggtcacatacctccggtcagaccggcagagcacagagttgggggatttcgcccaacggctagttttggtgggtgggagtataaatactcccccaccagcagcaagggggctcttttggcacccaattcaattgcatacaccccttgcacctctctcacacaccattgagcttagtgttcatccattgtagtggttgaggttgatttagccaagagtcaagtgcatttgcttccattgtagagctagtgtggcacttgatcatctccacgccgggtcattgcttgttactcttggaggttgccgcctcctagacggcttgtggaggagttgcccggtgacctctccgagaagattgtggaggaggcacggcgccggtttgtgattggtttggagttcaccaccttcggagtgaaggaagaactaccctagtgatcgaggcttgggtagtcctctccgtgggccggctgccgccgtgcccaccccttgacgaagggggcgtgcggtggcttcgtggttgagcggtggagttgggctcacctcaacggggagtaggaaaccggcgagttttcgaacctcggtgaaaaatatcttgtctcatcgtctcatttgattgtcgcatttacatttgtgcaatttacatttctagagacattcttgagatcatatcaccctaggattgctaaacattgacataggagtgtgatttactttcctagagatataattgagccactatcaccctaggtttgcaaaatataacttagttgcttagttagagttgaccctcaccaagcctagcaacttaggttagttttgattaggtgtcatttaattttaaatcgcctattcaccccccactagtcgacatctcgatcctacaagtgttctcagagcttggtctctcttgattgggctttccgcctagagagaagatgtcgaacgaggtgaaccatgtagggaaggctcccatgtttaatggcacaaactactccacttggaaaattaaaatgtctactcacctcaaagctatgagcttccatatttggtaaatgacgaagatagcacagtcgtccccgacatcagctcgggggctacaaaagcagaacgcgccgttgccgacattgagaccacagacgattggcggaccctactcatcaagttcctgagtagtgacgagttgccggaggacgatgcataagccgaaaaaataacccgtcaagccaaaaatctactgtttgattggcgacgatctatacaagaaggcaccaaacggggtatttctcaaatgcatttcatcccacgacgacaaacatctcctcctcgacatacacgaagggatctgtgggtcacacgccgccggtcgcacattggtcagaaaagcttttcaccaagggtttttttggccgaccgccgtcaaagatgcttgcgacatggttcagcggtgtgaagcctgccaattccacagtaaacacacaaggctaccagcacaggcgctccagactatccctcttacttggccgttctcgtgctgggggctcgacatactcggaccattcccacgaggacagggcggatataggttcctattctgcattaaagggatattctgcatcataacagacaacggctcccagttcatcagtgccgacttccaggattactgcattggattaggcgtcaatatctgctttgcctcggtttctcaccctcagagcaacggacaggtcgagagggcaaacggcatagtactacaagggatcaagacccgtgtctacgacagactcatgtcacacgacaagaagtgggtcgaagaactcccctctgtcttatgggtcgtgcgtaccacaccgacaacgtccaacaacgagacacccttcttcctcgtgtatggctcagaagccatgctttccacggagctacgacatcagagcacacgagtacagaagtactccgacgaggatcaagaggggcagtgaagcgacgatgttaatctactcgaagagcatcgagaaagagttgccgtcagagcagccagctaccaacaggccctttgccgataccacgagaagcacatcagagcacgcacgctttcgatcggcgattacgtccactgacgggttcaaagccaagcagggcgtaacaagctctcacccaagtgggaaggaccatacacgatcacgcaagtcttgtggccaggtgcattcaagattgcagacggcgatggtcgcgagttagcaaattcatggaacattgatcaattacgtaaattttatgtgtaaatcaatagtatccatacttgtaagacatcttacgacttcaaataaagttgattttaggtaaagactacaatcaaagtgttccttcccgacgatcccttaccacgacgacacatagcgttgaaacctatcctcatgtccctttacgccgtcttgacaaggcctctgaggaacctaagtgaacttcggctggggacgcccaaagcgggtaaggccttgtcggatcatgtagggacaaacgactatgtaagatctgttcatgtaagagctcttgccgtgcgtattaaccaagccgtgtaatcggaaactgagttttccaacttcacggctaggggctagtgtcggtgacatgggaccgggggtatcgtgactagaggcttgggcagccgcggtcacccacgtggcctgaccccctcggggggcgtcgggcccgagggtgacgtggccacccctccctctgtctccccgaggggtcgggccgctcccgtttcggccccgagggctggggcgccccgaccccccgtggtattggcgccacgtgtgcgggttaggtgagcacagcggcgctcacctaaccgcatttatagcggattgaacgagcgcgtcacgccgcatttaatgcggcgcagcgcacgtttatccggtccgtgaccagtcgcggtgtgtgaccggtcacagaccggtcagatcgcgggttaggtggcaacaggcggcctgtcacacgcctcgccccgtcccgtcggaatgatgggagcttcctggctctcgtccctagccggagccggcgtgctaactcctggagttggtatgtcagtcccggtcagattcattccaggcttcagcgcaagtatggcaaagggggcctgcgcggtctcccggtgaggagccccaagctccgtcagctaggattagtgctttttttcaaccaaggcaagtcaagggtccaagagccttatcctccaagaacgcttctccaaagacaaggctgggggctagggagagtgtatgactcaaaaccctaaacctaaaccctagtcagatagattccttttctatttcacgagtacttcttacaatttataactactccaaaatatattacatgtctccttgaagataatttttacaggatacaaagactaccaggatggctaacgccaatccatggattgaaagactttctcggcaagcggcgccattgacttcgccagattgtctatctctgcgggagtcctccgagaacgtgaaaacccttcttggaggaactcgaggtgcagctgcgggcggtgatctcggacacaggccagcacgtgccctccggcatatcggctcaaccgacgacactcctgtttcagggcctcgtcgatatgcttgccgatgacttcaagctgagtgcaggccccatttaaccatgagatgtatccagccgccgactcctcgggattcccgcgaggtactcggagctccctacagactccagccatcgccatgcagcagctcctgaggtacgagttgaaccacacctcgcgacctcggagggcttccacggcctgctctttcttcacttccaccatagtcctctcgagttcggccaccttgaacttcatcctccaatattggattcgatgatctcggtcggccaacacactctcgaggtctgctcaaacacggaaatgactaagtcgagttgttctcctctttcgagaacacggcaaattaagtcgattggaacaaaagagtaaaggagatgaagaccaaagtaccaacctaaggaagtcatcaccatgtccacctccacggacaggctttgatcgacatcgtcccgcggcacgtacggcttaagcacaagtgccggaacgactaccggcaactcaagctgcccgcgttgctggacaacctcgatatcaacatctctacatttacaacaaagtactcggaatcaacatgctaaagaaaacgaaggaaacaactgcatacacaaaagcagtttgaacctacgaaagttttacaagcataatcgattaaggagtacaggggaaataaaatcctactcttcaaaaacggggagaacagactaccccaagtcaccgaattcgtccatcacgcccttgcgcgtgtcattggcggccccctgatccaagatcctctggaggtcgatattagggtgcgccaacctcatgcacgcgaggacgtggctcgccccggtgtagatcccgttaaacatctcctcgccgatcctggccgcatgcttgcaggggatctcctccatcgccgtggctagttccgtgagtgaggacgtcagcgagaactcgtcagggttcaccgtaatggtgctcgtgacgccgcactccccggcgagctggtgtaggccagtgtaagtcatccgcagcgagccgcggatctccgacaagttgttctcgagctctgacattcggtgctcgagtccttgtcgctgccttttgttgccggtcaccagctccctcatctttaggaggtcctctcaaacctccgccaggtcacgtgctagtttgttggcacgctcgttcgccgacgacgccgctaccctggcctcctcgatttcacgtcctacgccgcgagcacctgccgggagaatacgctccatctcggattagagctccccccaggtgaggacatcagcaggcgcgccccgagcgggtaaaaggccaccggcgaggccgcttggcgtcacctcccgctccctggccacgaccacgacatccgtcgaggccgctgcaggggatgcaatggaggctgcactggacccgtcttgcgcagcctctcgcccgcgccgccctgcgcaaaattcccacgatttcatgaagtcaggcaatcaagactttgcgaataggacgacttctaaagcatctacttacttttcgctgagcgtcaccagcctttgccttcgctggggtggggaagatgcatccgtggcctaaacaagatagcacgatatgaggtcaaaatattctgactacatgaacgaaagacaagagaggcttaccgacggagtaggtgctttccgacggttcccgagtacggaggagaacatcctccccttcttcggaacattgctgccactcgtcgttgcagcagcagcaatgtcggacacctccttggcgacgccctccttcaacgacgccgccgcctggtgatccgcaagcggtccgatgacatccgttagagggagagcctgcgtacatgaagtcactatgcgctcccaataagacagaagtaaaggagtcaacgagtacactcacgttgatcccagcctcgtgttcgaccgtccccttctctcaaagggggacggggatgtcgctcgctgtcgtggggccgctgatcatcacttgaccgacgcggcgctccacggtttcgctattcaaacctgtaagatcgacaaacagaactcgataagtcaggaggaacatgcaaaggccgggtaggctcgggcctggagcggttggatccacctaccgatgaagtcggcagcaacttcataccccgacaaccctcgtactcggaggtcatcaataatgtcgattaaagactgaagggagggagttagggcgggtttggcggtccactctagaatcttgtctggttgctcctcaggaacaacagaggctggatccgagttctctatctgaagatagaaccaccttgcccgtcatttgctacgagaagaggggcactggaaggggatgtatcgcgacttcaggccatcccgaagtcggaaaccgagacatccagataccttttttggttccgtccagcgcaactcgtagtaaaagcgaaagagatcaagaaatgactctaccccaatgtaggcctcacaaaggtaggagaaaatgctaaggaatgcgatagaattggggttcagatgaagcaaggaaaggccgtagaaattcatgacaggaagaagaaactcggagggcggaggaagaaaaccacaaagaatgtaatcctcaaccgcaaccatgcggcccaggacaggttcgggttcagtacctcctagttcgctctccatgatcccgcgaccagggagggcaccgtcgtcctgcagcttcttcagggacgcgttggtggaggtggacttgtcgaaatccatcaccgccgaagatcgccggagaataagaccgagatgagcaaactagggttttttttgcgggagcggagaagacgaggggagcttgaaggctagaaagttttgcggcaaacggacttcaaaatggatccctaaaacccctttaaataagcgcactaccgacggtgcgaattccaaggaaaggagagagatggccgccgaaaatttctgggtccgttacgcgcagcagttttcggactacaatttaaatttactcatgaccgttgaacttcgtacaatgttatcgataactctatgtctctacggttctcataccgagatcgaccagttgagagcgataacgattccgacatccgaagtcgcgatcggtcacatgagttcatttaagcagaattcgggggttactgttagggttacggataaggtatacactctacccttggatgcatgttgtataccgatacggtatacctgcgcatatactgatgtttcctgtacatgttaaggaaatccatcacgtaaaagaaacggagtccacggatggaaggagtcctactcggacagaattgggtcgttactatattgtgtgggtccgatatctccgagttctacttggagatcgactgacccgtggtataaaagggaccccccgggaagaccaaagtgatcgaatctcaccgccaacacaaccgccacagcctatgaagtcggagcctacaggagccaagtcgcccggtgatctagtcgaaccaactcgactacggtcttgtcggtatcatcgagttctactattccctttgtaatctgtggtttccatcatataatcccgtaccaactgtattagggctattacctatcaaggggcctgaaccagtataatcgttgtcttttatttgcttgatgtcgtattacgtagatcctcgtaccagcgtaccccaataccctctatatccggtctacgggtatccccgtcgacaacaagaatagcaagagagagatgaggatacgtacgaggaggataaaaggtgggatgctgacctcgggcggttagtaggagccacaaattggatttgttccccagagaagcctagcctggctgtctagtgagctggaggacatgaacggctaagaccctgtttagatgggactaaaacttttaattccctatcacatcggatgtttggacattaattataaatattaaacgtagactattaataaaacccatccataatcttgggctaattagcgagacgaatctattgagcctaattaatccatgattagcctatgtgatgctacagtaaatattctctaattatagattaattaggcttaaaaaaattgtctcacaaattagttttcatttatgtagttagttttgtaagtagtgtatacttaatactctaaattagtgtctaaacatagagactaaagttaagttcctggatccaaacgccacctaagccatcgtcgtcactattgccgttgttatcgtcgtgttgtcctttaggatagctgcgcattgcagaacccaacgtgacttatgttatgaacatattcttcaagccaagcgttggagccgctgtaggttgtctctgtagagccacctgctgttttccatacctctacttaagtagggggagagtgagaggcaaagaaatagatcgagagagagagaaagaggagaaaagatgaagagatttagagagagaactttcatatatttttcccttgctaggttcggctaggctaggctttgtgtcggtgcatttgaaaaaatagggcgacatagtgttggtttttaacacggaccgtgacctatcacattagtaacagattttttttctataaactggcacttatataatcttattaatgtcatttttttttaccatccaatgcacgctcgtgtcctagggatggacacctcgtgacttttgtccagtcggcattgattattgttgttgcttcattattttccaacatttcgatccaagtggatacaataatcgtgcttgctatatccgaggaccgtacgtgaccaccaatcatccactggggcaaaacgtgcagatttatatagacgacaaatactacgcttcattgtgataagatattattgctcctgcaacaatctaacgtgatccaaagaatcaactaaatcatattatattatacatactaagtacgctacgttgtgataagatatttctctgcaacagaagccatcgaacgtgatccgaagaaacaactagataattaattgtatcaaggatgcactccatccgtagaaaaaatatatatttctcgagtatcgtcaatttatcctaaaatgtagtaactggttctccccctacctccaaatctcaatcagccataaacatctactatttaatttcttcacatagtttatcttctgaaccaatcacaaattttcacgattcaattaaaactgcttatttaattatcctaaaaacctatagaaattcttatattttagggagggcttggacttctgatatttgttctcctaacgttattggcaaggtctccagatttttgatttgcatgttgaagatctgagtagaaatttggtttgcatgttgaagatatgagtagaaaagttcttataattttgttgaaagtacttgattttgaaatcttaattgtaatgtttttacttaaatatttgatgttttgagtactagaaactatacaaaaatttgagttgataggttaaagttacatgtagaatgtattgaaattataagttataaaattttggaaattgaaaatgtcaatattttcaacatagtttttaaaaatttcatatgaaactcagatttttgaagataaatatgtattgttattcaagtaagagtttaaaagatgttgaattaaaagtgtgagtaagcaagctttgaaaatgaatttccttgggaattctaagcgcacagcgagcactcatgaaaaggggaaggcgatcaaatgaaaaaaaaaggatgaggtcattcgcaagcaactactactcatcctaatcatacgcatatcatttcttcatatataattggtgcgcaataaaggtcatttttgtgctataaagctcaaattctgtgaagccaagtcatccacgaaaaattaaccgtcggatcatttgaggaagttattctcaaccattcgattatctccaatatgcttctttttatggtccattcatttgattaggtccattggaaattcttattcttctcagcccatcaaagaccaggcaacgaggtatggagttgttcgatctccccatgtggggctacaagtggtcactagggacgtaccaatactctgttgcttcatctccatattagaggatcggtcgacatctactagggcaatcagcggtaataactatttgtaccctgagaaaaatccctcattcttttcactaagctctttatctgttacactaattctgctaaacaccacgatgctcataagtcataacgtctcgaagggaggtgaagcagcctgcggcggaggcgtacgtagataccgctggctatggcgaaatctcagccgacatgccttgccttcaggaattgacggagctgctgtaacagagagatcgatcaatcttgtttgtttctgacttttgcctaatagattgaaaaaatatggttatataacttacaagagtaaaaattccacaggtgcttttcctatctaatcagataaattgaggtgtacagatcagctaagttcctcctctctctcgctctctcttttccatttttactgattagtttatctttacagtgtcagaggagtaagattattaaggaatgtaagatcaggcaccattgtgcaatcatgcaaatacatgtgtattcggtaaaagaacaatgatcattggcatcattttccattacattacaagacattgtgcttaaggttcagcgctgtacatctaaccaacccctacatgagtctttttttcctttctatttaattagttattaaacttttttactaaattttacaactagagggctgctaccccatgggattccattcaaagtggtagtcacaggataattaaacaactgacagatttaatacacatctccttttccggtccgagccccacgcgattacacgacccccacctggctccgcgtccgcgtagatacatcgcctgcggcaccacctggctcagcatcgcgccagcggcgcggagcaccactacaactagccgaagcagtagtgctctctccctccatgatcctcctaggtatcgcacttcctgcgtcttgaaccaatgcttgtggagacaatgacgttggttgcggcagtagtaagaaacaaggaccgatctgaggggaaggaagaagaggagaagagacgtgtggtgcttgatacttgatacctcacagccatcatgatacctgatacttcgcagccagccatgatacctcgcaggtaccgagtatcaggtttgatacctttagggtatcaaccatgataccataggtaccaagcatggtacctagtatcagccagccatgatacctcgcaggtaccaggtatcaggtttgatatatatgggtatcaaccatgataccacaggtactaagcatggtatctacaagtaccaggtatcaggtttgatatatatgggtaccaaccatgtgttgacagaaaacacgaggcctgggagatctgcttaactccagttcaggtccaaagctcgccttcggatgtatgagcgtgccagttgatttgatcctgcaatcaacaagaaacaaagacaaagaaaccgtagttaaatctataaatgatagccgatcggctatttgccgatgacatatcatttatctctgagccgatatcgtatgtgaatcgatcggcgatcatcaataagtaacaaaacaccaaatctactagatcggctgtagatatcaacaatatataatctttatatcaatatacacttaaatcaagtgattggagtagatcggtcaccataccgagacagtataaatcacttaaatcgaaatatatattaataacgagattatatatatatgtttgtagcatagccgatcaaatagatctagcatgtatcggctaatactccgataccgctttatattaagatattgaagcagataaaatactcaagcagatgcttaatatacttagatgtgacaagatcttaatataaagggcagatttaacatgtcaatgaagcatataaagcaaatatggtcgaatcagattagatcggctaaaactccgagactaccctaatcggcaaccagaaggcaggctagagattgtaattctaagcacgacttaatagatcaaactcaactgatgcagcattaagtatgaaaagaaggacaatatctagacaatcaaaccgctggatgtttcatagggtggtagatatcttatataatctgaatcaacatcgaaatctaacctaatcagctgccttccttgatagatgttagtcgattgtaggttagatgacgatattgccagagatcacgtaagatatacgataactcgacgaatcacataaacaagattagagtatcgtaaagatggaagcactaatcccgagaacgcatgtcatcataacaagttttatctcttgttgaagatcgaaaccgatgcagctcaacccgaaagcaagaactcgtcgaaataaaattaaagcaaaaggtggcgatgtgccgaaattgtattgaacgtgtgtgttaaaaattacataggtctcggggtctatttatacccgagaattacaagatatgcccataccggacacgactgttatctctaacaaactctaagatatcataagtctttgcggaagacttttgcccacctttatctataaggaatttacataaaatatcctaattaatagatacaattgcctttccaggactctatccgtgcgtggcaatcatattgaagtacattaatttgaacccaatgtcgtatacaagtcgtattgtcggaatcggctgaatcacttaacccaatctgactcagacttagccgatcctaaccgtagccgatctagactccagccgatactcattctgtttccacgacaatcctcatcttcgattccgcttcgatcccatcttcctctccgatgctgacactaccaaatttggttgttaacacatgccccccaagtccgggatatttggtaatgttccgaatttgtcatgtaccgtctccgagtaagtttcgcactccgccattattgaccgttattccagcgctttaaatactaaccgttcccctcgagaaatctcacgccgtgacttccgttttcaccgctcaagcaaaacttcttcctctctcttctccggcgattcctccggcgcaaaggcgatttccaggcgacttcctccccgacgagatttccgcccgcagcgatgtcgtcttccgccggcccatctgatgcgccatcagccgagtacgctgaggtaagttctcatcggctaaatcccttttcccaagagtagattgattttctcttgtctcctattgttctcttcttctcggtcgctttggatttgtagcacctctccaacctagttgcgattcccagcttatcgcatgaaaaccactactttctcggcccaatcggcaatcctgatccaaccgagttcattatctgtgaaaccaataggattctgttaagattaaccaatccagatccaggtcactggaaaaacacctttaaatcttggccgtctctagaaaaaacttccctcgagaaaagttggactacatggttcatgcgtatgtcggctagcaaaagagttcactgggacgaaattggaatcggccaagcacttgacctaaccatagcaaactcagccaaggatgaacctctcatggcagctgcctcttatttctggtccaacactatcaatgccttcttattcaaccaagggccgatgaccccaactctcctagatatcatcatgatcacgggtctggatatcacctcatcggctaaccctatgagcttgaacataaagaaccaatatgacttcaagaccaagagcataggcggctggtcaggttatgtagcagtatatatgggccaaggttcggtcaccccccgagaaccttttcaactgttgatcctatttaaagctattgttttgggccgactttcggcccaaagccaaaaaggactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttcaagacttttaaaattatttctaaaaattccatttaaacaacaatttatatattttgaattttcagggtgtgacatagatgtacagtaccgataacactggaataaattttaaatgagaactattaaaagatattatgaagtgcatgtgccattagtttggtttaattaaaagagaaagggaggagaacagttctacttttccaatatttttagagggcttctatgagtaaccatttggcataacctagggtcaaggaggctctgataccaacttgtcacgcccataaccacgggcacggctattcgaatagttttactctgatcagaggtgtaccactgtacccacaagacacaaccccacatcatgtcaccatgtgcctcaataccaccacggtacctcggaaaggagttgtgacaataccccttgcata

SEQ ID NO: 61716 - DNA, 3393 bp, Oryza sativa
taagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttgaagattaaatcggattaaaacacttaaattgattttaattgacttatgacgcaataatgaattatttttgaaaaggaaaagaggatttattgcgtcagcggctagggtttcggtggaccgggcgcacggcggcggttcacgcgaacggacggccgagatcgacttgatccaaaacggacggctgagatcgatcggtccacgaccggctcacggcgaacggccccgatgacgtcagcgatgacgtcaccaccggcggcggcggctcggcggctcgggcttgcatgctcgctggcgaacgacggcacggcggcgcaaacggaaggcaccaacgggtagagcgcgacgcgacgaactcaccggtgaccaaaagagcggcggaagatcaacggacggcgacggcgacgacgaagaaacggtggcggtcttcaggtcaacgacggcgacggtgctccggcggtcaacagcgacggcgaaggagtggacgaggacggcgacgcgatggcgatcttcccgagcgacggcaacgtctggaacggcggcggcgcacggctggagcgacggcggcgatggcggcgctagggcacacggcgttagggcgctacggacgacgagaggcgaaggcgagggtggcggcgggtagagaagagctcgggggtccttttaaaggggctcggaggcgacggcgaaggcccacgacgaccggcgacgagaaggaaaggtcgggctcaaagtgacgtggtgagatgaaagaatacttggagaaggtcttggtttggtccctaatcaacttcttcaatcatccatgcattccttatgctcggtctcttttctttcacccaagcaagtaactctgtaaatgaaaacacacaaaacttattgtgtagcaacgtttgtttaaatatataacaagtaaatctagtataaaacatatgcacatttggttgattaatacataaggtagttatggttatatccgagctagtcatgtcctcgtaatatagtttaacaatgatctatatgccatatttctattggaaatattgggaagataactgcatacactatgttcagtaggttgatttcccagattgaatggcataggatcagcatgcttactgacatgccattacactcattcatgagaaaaaaaagttcaaattatttgggccatatatctcttgaaaacaggaaaataaaaataaatctcttcaaaaccatgcacatgaagaggaaggcagcccaaagccttccagtcgactactgcataaaaaaaagtcagaagatatagggatctagaattagttagtaagcaaagaaagaaataaggacccagtattagcaacaaagaaagaaaatctaagcgcagcaatcgctactcgccttgcatttgctgagccgcatccaagcaatcaacgtggccgagctgcgttgccgccgtcacagggactccggaggcaaccacctccaccaccttaacaatagcgaggcgtagtccttgatatgtcggcgttgggatctgccggcggaggatcagcccgatgcaaggcgatgcggaggggggctgtggccgcgtggatcgggggattgaggggatgccgaggtcggggaacggggggagaggccgccactgccggtggtggatgacgcgacgatggcagatgagccgatggaggaggaggagtcgcggcaggactcacggaagaggcaagacaccgtggcggtggaggtagtcgccgtcggtagtggtgggcagggagctcggcggtagagtggatggtggcggcgaggaagcagacgatgacagctgggtttcagtggatttgggaattggaatcggctagggtttgaggaaccagggtatgaagcaatcacaacgcggctttaccgaaatgaccctagtgcgttgacaatagttattgaattatttggacaaaacagtcaattcaaatttaaaatggcttgaccgcaaagtggcccgaccgcgaagattttgcttttgaaaaattttggctcccaccccacaaaaaaattggcgtctacagctacagtatcattcttttttggaaaaaaaatacaaactatatgcaaaaataatttcaagagcaaataaacagtatattccaacataaatatattttaataaaatgaagacatttggtgaaaataagtgagaatgctaccaattttctgaaatggtgtatccaaaacaaattacaagagcaaaagaacattatattcctacataaatattttttaaataaaataaacacgtgttgtgaaaatgttaccaaaaaattcaattgaaaacatatatatgtggtaaagacgaaaaacaaattatattcatatgtaatattatgccaaagttatatgcaattactcccttcggacaattatactcgatgtcgatcggtctgcataggtcaacggtttgttatacaatcattcaaactgaatctaacttgattcctcatcaaatgttttttaagcatgatataaataattttatatttgcataaaaaattttacattagacgaatggtcagccgtcggtaaaataagtcaatgacgtaaaaaataactaccgttgtttcaaatgcaaaaatcagaaacaacaaaattgtagaactcatcgagatctacaactatcgtattggtattttttacgaataagttcatttgaaaaattaaaaatttgaattttcaaaatctgataatttcgaacgaaaattggggttaataaatgatttcaaatagaaaagtcaccaatacaaagttgtagaactcatcgagatgcaaaatttttattttggtcgtgtctccatctgactctatttgaataatttgaaattcaaagtttgagaacttcaaatagaattttttattagtgaacgacttcagctgaaaaagtcatcaacaacaaagttgtataaaattatttgaatgtcaaattatgacaacttcaaacaacattttcaaatactaaatgatttcaactgaaaaagtcatcaacaacgaaattgtataactcatcaagatatacaacttttgttttggtcgttttgctatatgactttgtttcaataatttgaatttgaatttcaaattatgacgacttcaaacaacattttcaaatactaaatgatttcaactgaaatgtcatcaacaacaaagctgtataactcatcaatatctataacttctattttggtcgtttcttcatccgacaaataacattctc

SEQ ID NO: 61717 - DNA, 992 bp, Oryza sativa
aaaaacacctttaaatcttggccgtctctagaaaaaacttgcctcgagaaaagttggactacatggttcatgcgtatgtcggctagcaaaagagttcactgggacgaaattggaatcagccaagaacttgacctaaccatagcaaactcagccaaggatgaacctctcatggcagctgcctcttatttctggtccaacactatcaatgccttcttattcaaccaagggccgatgaccccaactctcctagatatcgtcatgatcacgggtctggatatcacctcatcggctaaccctatgagcttgaacataaagaaccaatatgacttcaagaccaagagcataggcggctggtcaagttatgtagcagtatatatgggccaaggttcggtcaccccccgagaacatgtggctttcttgttaatgtggctagagaaattcctcttttgtggatcaagctgtggccctacaaccaactggcagtttatagctgaagctctagaaacaaagagacaatttctcttgggtaaaatcctcctcggctatttataccagatgctgaacaatgcatcggctaagatagctgtcggcgcagtagttggagcaggctgaccatggttgctccaaacttggctaaatttgatagtcatgaaagttgtcaatcggccaaccgtgtcagaatccgagttaccaagactgtcacaccttaaaaatcccaaatgtataaattgttgtttaaatggaattattagaaataattttaaaagccttgaagcaaagatctaattttaaataagaaattccaatataaaagtgggctagataaaattttataaaatacttcgattgattctatagttcctagatttttttgggatttatttgagccaaggaagtatttttaataaatggaattgcatttcatgaataatttaaatggaaaaaggttttaaaatacctcttttggctttgggccgaaagtcggcccaaaa

SEQ ID NO: 61718 - DNA, 7827 bp, Oryza sativa
tccaccgaagagcgccggagcaccgccgtggtcgttgacccaaacgtcaccgccgcttcgacctcgccgccgtcgccgtccgttgccgtccgtcgtcgtccaagccctcggtgagttcgccgcgtctccctctacgcatagatgccctccgtttacgccgccgcgccgtcgttcgccggcgagcatgcgaggccaagtcgctgccggtgatgacgacatcgccgacgtcaccgtcgatgtccccatagacccgcggtagaccgattcgatctcggccatccgttttgcattagatccatctcggccattcgtttcgtagaccgttcccgtgcacccggtccaccatgaacccgagccgctgacgcaataaatcattttttcttttcaaaaataattctttattgcgtcatgattcaattaaaatctaaataagtgttttaatccggttcaatctttaaaaattcataactaattcatcttagctcggatttagttggtttaagtctctaattttttctaaaattgagatctacatgttaaaaatatccacatgtactattcatgattttttatgtgctgttttggtgattttgctcttttatgcttagattccgatgttcccggagagtccgattttgcaggagaagactttgaagagttccaaggccagcaaggcaagtcacacagatcccaaataaccctttgagcatgttgatcccgtttaaagctatggtttctattcaactattgcatttatttctgaatgtcattgggtgggaataacctattgccttgttatagcccttttgatattgattatctattctttgtcgtttggttaataattggattagctagaacattatatggttttagcaaaagtcattaggatgcttagccatgcttagagacactagctcacataaatggaataacttatgattcactattatttaatgatggcttaattatagttcacgatggttaatcatgattggttaattaattaatgtgccaactaaaacctaataatggtgggttgtgagcacatggttttgatggtcgtgctcatgacaattaagcaccggttcacgattttcggttgtgaaacattaatcgtgccaaccacaagccagcgtgggcaacgactttactttctatatagtatggttcattgtagagcaccagactgtgaagtggcggagataaacccacgggggtcgctggggagtccatgcctttatttacaagggggtgattatgatccgggaacggtgcactactttgaattgtgttatgcagggggtattgtcacaatctctattcgggtacttgttaagtatcgcgacgcatggttgacatgatgttgaggttgtgtcttgtgggtacagttgtacatctctggccagagtaaaactattcgaatagccgtgcccgcggttatgggcgggtctaacaatgtctttcgtgattagtttcatatctctcaccataataaatgatgatgataataatttgtttagctcctggtttggaatggtatattcctggtttggagatagaactgtgcagccgggattggttgttcagaatggttgggcctatgcaatacgggagtgttgtatagtgtttacttaatattgcttaattacgcaactgttttactattctctcaaatgcttattaaatgttgtttatgcaaataagaccatattatgccatcctttgttatcccctgtatttgcatatttgctgcgtggcttgttgagtatgtcatatactcaccttgcaatcattcatcagaggaggagttctatagtgatgctgaaggtgtggatgattaggcgtagccctggtcaagctgcttgtgggatggagtcgtctgtgccgtttattttattttccgctgcttagaattttattgtttgagaggaactatctatctctgtaatgactttatattcgcttattaattagggtaataattgtactctattatcaatttgttattgtatgccgctgattcctggacgagggtttacacacatgtaagcgtttggaattttggatagaaattccgggcgtgacaagagccgattgtagaagatgatggagaagagcgcactcatcgcagatgtatgtcatacggagaatatgcatccacaccaaccgatgccggagcaaaactatcagctgagctgctcaaggattagttctgcaacttctatgaaggctttcagaaagatgctcgagtatggtttctttatgaagattcggctgaccttgagctcccatcggactttagattcgaagacattaaccatgagatataccaatcgtctagggaaattttctcagctgcaatcagcccatgcatccttcccgtcggtattcatcaaggaagaaacatccaagtttcttatgaattctatcatccaatgagctcagctagacaacttggaatgggtcaactcctaatcggcttattttttgctgacaagatccaatgccgaggagaaatttcatcaaccttgatgatggatcgactgctcaaccttctaggaccccctctgggcagtattgaaaacatagaactggcaatgttcagaagaagaaactttgatagatggtggggtgaatggaagctgcatctattccaccaaccagcttcaatgtatatgacagacctctttccagatgttgtccctcaagtaagtcctaacttcacttgatttcatttaaataattgcttagccgattaatcttaactaatcccccttttgatttgtagacaacagaatcttctcctcctcgtcagagcaacagtggcaaggatatccattatgccccaggcttaattcctaatggaggtgggccatcccctccggttattggctatgatgcccccaagacctcagctcttcttcaagggctcatcaaagaaccagccgatgccggcaaaaagaggaaaaccagatcatcggctgtaaacatcgcagtcccaactaagaagaaaaagacaaggaaaaccaagccagccgatgacctgcctaccctagacccatccattgaacaagctctggatgaagagataattgaagatgaagttgatcaggctgcagccgaagtaagcgatactgaaaaaacaccatcagcttcgcccaagcaaacgcctccaactccctctactccagtcctcttttcaagagtaagcatctttctttaacccttttcacaattattttgtcttatagccgatcactcccaaatttataattgcaaaaaaagaagactgcggtgaaaaagaaatcggttgcaacaacatctaaaccagctccaccagtaagatagttttaattttcattagttaactttcagccgattctgtctaacacttgtttccttttagccacctcctccttccccttctgtacatcaatcatcaagcgatcagacttcatcagctgtagggagtcaccatatagaagaagaaattcaaccaattgttcctgctatcccagtaagtttttctcttgacaacaatcactcagattagctatgcccatttaacctctaactgcttctacatcattactgcaggtcttagccgatcttttctctttcgacatcaaagattatcttgatgaaggagaagaagacaccacaagcaaagctttagcccctttatctgatgatgtaaagaaaactctggaaggttgatgtgactatggctaccacggatgcaaccattgctcacatcatggatgaacaagaagatatcaagatcacatcgtccaagagctggaatccgattcggctacatgctacactgctgacttcaaacggccgccgaatctacatacgacctccgttttcggcccgtgagtacttgatggaaagctctcggagccctctttccaacagatccagcctcatctccgaattccatcttgtgtggccggaatcacaggcacaaggtgctacgtcacctataatgggcctataggcttgtaacttcatttgggaccccggcccaggtggggcccatgtggggtgccccccaaccaggtggagcacgaccctaggcacccctaggtacccttcagggtttcttcggttttgatagattaaagtttagccattgctacttgcttgcagcgcgcgtgtcggctagaccgtccgtctgcttgttcttcggaaccccaacttatcttttgtattaaattcctatttgcaatatcagattgcttttatcttgttcttgcttgtttcttcgatttgctttcaggaatagggttgatctgcaccggcaagatcaacaacccacggagaggtgtatcgatcgctaagccgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagttttcatttacctataactagaaaatagcccgaaaaaaaaattcatacattacctagccacatttgtgccattgcattgttcttttcagtttttgctttgttgaaatttgtgttgcatcgtcacgtcatgttgctggtcatagcgtttagtttgtttagagtttcgagttctggtcacgttttgtaccactgtcatcgttgtcgtcgtgtgctttgttgtcgtcgggacctacgaaaacggaatcgtctttccgccaaggtttcatttttctagttttcagaagtttctattggtcggttttgttgttgctgagttgcatctagttttttgtggtgtgattctgcgctgtcccgaggccgtgttgctgccgtgtgttccatttgccgtgcatgtgtatgcgaggaagaaggaaggaggagagatctgtctagattagattggattggtttctgtttggtggccaacgtagaaaagaaaaaggaagggagggatttgtctctgttttcacatggagcctttccatagatcgggaatcaatctccacccgtgacagagatctccagccaccgtttcctctcggcattggtgagtccgactccctccatcccctctcctcacagtatagacagcttggtgaaaaaatttcgtgtatcggattggagatccgtttgcaaaaacggaacctacgggacgacagcattccatttttgtatagttttaattttgagtttggacatttacagttgagtccctgtatttttttatatttatatttgagtccctgtaaacttgatttatagtccttgaggttgtttttgttaaaaaaaatccaaaaaaaaagaaaaaaaggcagaaaggtgcatacaaaaaagaaaagaaaagaaaaagccgcaccaaaaaaaaagaaaagaaaaggaaagaaagaagaaaaaaaaaggaaaagagaaaaatcagttgtatctttgaatttgctttcatatatcagagttgtgcataagttgttcctagtgctatcttgtggtaccgtttgtgtctaggctcgcgtctctagtacgttctagcctaggaccagcacggtgcttgactttgaacaattattcaactttgcattctctgatttgagcatttgctattcctttactacatatttaagcctacccagagctttacagatttgattgcagccgtacagcaagtgttagccaagacatcgatacatccaacctccattggggtgcttggttgaatcggtgtatgtcaccattccgcttgcattagtaagatcttgtaagagcttggttaaaagcttgagtgtgtgtgatttttgagctgccattacctagtagttaataggaaagcgcatatttttgtgtatgtttcttgttttctacgaacaatggcagggatacgcaagataattggggatagctgtactcaacatcgacatcttcgtcgagacatgaggagtgatcaacatgacctttatgaggtaagtgacgatgttctaggtaagatcaaatctgcactgccttattttgagggaaactatgatcctcatgcttacattaattgggagctagcggttgatagtgaatttcaaaagcatgtcttgtctgagaaacaaaaggttatgtgtgcctctagtgttttagctaaacatgcttctaatgattggaaacatctttgtaggcataacaaaataccacaatcttggtgtcacgtcccaaaacgactctaaaatatatcctttaaatgatgcctagaataattaaaatccatgtgaaagactccaacaattaaaatgtgcaaagttaaaagtcaaataaggcttggaggatttttgtatatttcctaaaagcctaaaatgcgtaaataaattttagtggaattttcagagcacacataataattattaagaaataaacaaaattaaaatgattttataaaaagaaaagctctaaaaagtcccctttccctccctctccctcttgggccggctcggcccatctccctccccctccctctcctctccccgcggcccattcggcctctccccgcgcgcgcgccactgacgggcgggcccgcccgccaccctcgctgacgggtggggcccacctgtcatccccttcctcccgccgctcccgccgcctcgcctgcgccctaacgccgccgccgccgcggattccgccgcatcccgccgtccccgcgtgcaataaagtgggggggaatcattccccgtgattccctctccctttccctctatttttccctctctctctctcgttcaaacgggcggatttgcccccgcaaacctcgccggcgccattgatggagcccgagatcaccgcgccggtttccttcccctccggacactctctcccccttccaaccttatataaaccctccccgcgcctacctcgcccgtttccgcccttgccgcaccgtctcctcgccggaatagagctcgcgccggcgctctctctctccgctgtcgccgtcgagctccggtccgccgccgtcgccgccccgtaccacctcccacctcagcgctgcctgcttcggttcaacgggatcctcggcgacctcgtccacccctccgtttcgctcgtcgaccgccggagcgccgccgtccccgtcgacccgagccgcgccgccgccttcttccgctccggccgccttttcgtcgtcgccgtcgacctagggtgagccgtggaccgccgcctcgtttcccccattccctcccttctctcggccgccgctccgccgtgcctatggccgccgccggtgaccatcggggcgcgggcgcgccgccacccgccggccgcgccgccgtggccgccttcgggcgcaccgagcggctgacgcgtggcgctcacggcgccggccggtgcgagcccaggtgcgcccggtccaccgtggaccgtgaggctgccgcgtgggccccactcccgtggacccggtccgcgcgccccctccccctcggctgacgcaataaactttttttttaaattaaaatttaaatgaagaaattcgtaaatattcacttaaagagcatataaacttcaaatagccataacttggccatttgaactcggaattggaccgttcaagtctctaatttttccttaagaagtcaagaacccatttttgtgctttgttcctgcttgttatatggagtttattagagtaaaagccttttcttttccgttgatcgtgtagacgctgcaccttcggaagatccactcttcgtggaagttgaagccgacggttgggaaagcgagcaaggcaagtcacatcatccttgaacatattgaat

SEQ ID NO: 61719 - DNA, 2126 bp, Oryza sativa
gggttccgaccgtaggtgggattgggtcggtactcttgtctatggctaggatgggttggaaactatgtcacgtcttccttccgtataccgtggtggtatgcggcacgtggctacacgtgaggaagaagtgtcttgtgggtaaagatgtacacctctgatcagagtataatctattcgaatagccgcgccctcggttatgggcaagccgagcaatgtacccaagttagtgtttttaatttttaaaacctgcttaacaactaaaatgtggaatggttggcctgggttggcttgggacgagctgggacccagggtcgggttgccagttcggtctgaatcatcataggccttgggttaaggcaggttcgtgtgggttcacggccttgattaataatattgtatagctttggaatcgtgtttacaaaatagctttgagcaactaagagtcttttaatgctgtttactgcaaaccctaaccctttatattataacccccttgtactcccttgcatttatcctgcacttgtgggtgtgtcttgttgagtacggtggttgtactcagtcttgctcaatttttcccaaacccagaagaggagcccctagaagatgaaggctttggtgtctagctcgtgcctgccgtcaagcgcctgtggtcgtcgccctagtcttccgctgtttctcgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacaagtggtgtaacatcccggcctagggcttaataggattaatagaatactcatatcaacaagttgcaacttcttttccggaagtcaatctccaaagaactccagggttaagcctgcttggcctggagcaatttgggatgggtgaccgaccgggaaattcttcccgggtgcacacgagtgaggacaaaatgtgcagaaaagacatgtgttggtctatgagggcagtctatgacctatgaaagctatcagatgtaagtgggcccggcctgggggaggcgggacattacacttggaaagacctgaaacgatattttagagatgtttatgttcccatgtattatgctgatattctgctcaacaaactgcagtgtttaaaacaagataccaaaagtgttacttcatactatcatgatatgcattcttgtttattacgttgtggcttagatgaatgtgaagaagctacataattgaggtttttacgtggacttaacaaaaaaattcaggacatgcttgcttgtgaaaagtatagatctctttctcatttgttacaacttgcttgcaatgctgaaagtaaaatagagtaggatatgaaaaagaaacacgctatgtctttgcctccaatcactaaccatttgcaggaagtgcgtaatcatgaaaaggaggagagagacatgaaagagccaccaattccattgttcacacttaagttcgagacaccaccatcatctgaagaggacatcaaaggtaaagtaaatggtactgaaattaatcaaggtgcgtgtgttgttaacgaagtaaatttgtccacttttcatgcaaaactagagcaaccgttagtggaaccaaatgttggaattcctttgtcacaagttgatttactcgctgttccttgtgataaagaagagttgtgtgataatgcttcacttatatccatgccacaactagtgaatgaacatgctattcctagtgtttctttgtgtgctgattttaagcatgctgttcacattcctaatgaagttgaggaacgtaaattgctatcttctttaaatactttgggctatgttcagtttgatgatttttgtgcgctcgataatttgaaggagaaattatttgctaagtctgatttgccatatccaaccaatgttatatttcacatttttggcgaatataatgatcttggaatatattttgtgcatagagtttacatctgctcggatttagaacttactgtacatgtggataaaacatacaagctagagagaaatgttattgctaaccaaa

SEQ ID NO: 61720 - DNA, 3444 bp, Oryza sativa
gcgaccataggggcgcgggcgcgccgcctcccgtcggctgtgccggcgtggccgccttcgggcgtgccccgcggctgccgtgtggggcccggctgtcagccgcccgcgcccttaggtgcggctgacgcgtgggacccacggcgccggccggtgcgagcccgggtgcgcctggtccaccgtgggccgtggggctgccgcgtgggccccaccaccgtggacccggtccgcgcgcccctcccctcggctgacgcaataaatccatttttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaatgccttttcttttctgttggtcgtgtagacgctgcagcttcggaagatccgctcttcgtggaggttgaagccggcgtttgggaaagcgagcaaggcaagtcacatcatccttgaacatattgaatcccagtttataaaattatgttgctttaaattattgcattatcgctttatttaaattcccgcgttatcactgttttatctagccatgcctatttagctttgttatgaccttattattgttattgttattatttccttgttcaccctagaataaacaaaaccccaactagtggacactctactcatggtaccactagtatgattttaggtagatgcttcgctatttaattaggtaacattaggtggttttacaactctagactttgggatattctcatcacctggacactatggaattgttggattattgtggaattggattcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggctacacgtgaggaagatgtgtcttgtgggtaaagatgtacacctctgatcagagtataacctattcgaatagccgcgccctcggttatggacaagccgagcaatgtacccaagttagtgttttaattcttaaaacctgcttaacaactaaaatgtggaatggttggcctgggttggcttgggacgagctgggacccagggtcgagttgacggttcggtccgaatcatcgtaggccttgggttaaggcaggttcgtgtgggttcacggccttgataaataatattgtatagttctagaatcgtgtttacaaaatagctttgagcaactaagtgtcttttaatgctgtttactgcaaccctaaccctttatattataactcccttgtactcccttgcatttattatgcacttgtgggtgtgtcttgttgagtacggtggttgtaatctgtcttgctcaatttttcccaaacccagaagaggagtctctggaagatgaaggctttggtgtctagctcgtgcctgccgtcaagcgcctgtggtcgtcgccctagtcttccgctgtttcccgtttgtttttgtgtgtgctggccttcgctgcccatgtaataaattaactatttacgcttccgctggttgaactctgaactgtatcaacttttggtgtaccttgcctcctgggacaaggattaatgcacgcacgtaaggaacgcccgttgggttatttccggtcgtgacaccgatcatgcattaacccaaatacttgggtaatatttcttcaaatatttgccattgagcgctcgcccatagacttcgccatcaagtccttgcaacatatatgcccccttagagacaatcttataaatttggaacggtccttctcaatttggcgaccacttgccgaatttactatcacgagtaccaatcggcaaaatcaatttccatacaagttcttcttctgaaaaatctttaggtaccactttcttattataatggcgagcaacacgttccttatccttggtaacctttgcaagggctcgcaaccgtgattgaaccagatcctccctctcatcggccataaggttgtaatactcatcggctgttaaatcgttttgcaactccgttcgtcgagagccgattctaacctcccacggcaaaacagcctcatgcccataaacaagtttgtaaggagggacttggatcgatccatgacaagccatcctataagaccataacgcttcggccaaccgagtatgccattgccgaggataatcagaaattttccgcttaatcaacttgatcaaacttttattacacgcctcggcttgcccattagcctgtgcatgataaggtgaagaattcaataatttgatacccatgctatcggcaaactgaacaaactcatcggacacgaagattgaaccctgatcggtagtaatagtttgagaaagaccaaatcggtatattatatgttcttgaacgaattgaatggcatccccagaatcaactttcttcgaaggaatcgcttggtaaaataatcggttaccaccaatataaacttatgtccttcacttgacggtgggttaatcatgccgatcatatcaatttcccatcctctgaatggccagggcttaataacaggattcatagccgacgccggcgctcgctatctttctcaataactttcatgtaataggcttgtctcgtgaccctgaccttgcttgtcatcgagatcaactaccgtatccttgggatagacgcttgaaccctccacgacgccctcaaagtaatagcttgggttctccatcttcgagtggctatatatcaaaatcggatacctttagaaaagagtaaagtccatcaccggtccctaaacttgtaccgatgtgtcatcccggtccttaaactcgcaaatcgaccgttcaggtcctcaaacttgttcgactgtgtcatcccggtccctaaacttgcagatcactcgtttaggtcctccaagttgttcagttgtgtcaccccgatccctaaacaggatagtctaaaaactttatatcaaaaaataattcataactttttcatgtgaactctaatgaagacaacctttatatca

SEQ ID NO: 61721 - DNA, 2355 bp, Oryza sativa
gtcccaaaatattgttgcatgtttatagattttgaaattttgattttaaaattacattttgggacaaaaaatgacttaaaataaaaaaaattcaactacaaagttgtaaatcgcgttgagggctacaagtttgatataaagtttatcttcattagagttcacatgaaaaagttatgaattatttttaaatataaagtctttagaccgtcctatttgacccagatgatattcaaatccaaatttagggaccgaggtggcacaactgaacaagttggaggacctaaacgagtgatctataagtttagggatcgggatgacacagtcgaacaagtttgaggacatgaatagtcgatttgcgagtttagggaccaggatgacacagcggtacaagtctagggaccggtgatggactttactctttagaaaatctccatcccaaacctttccagataaacaatcaaggccatccatctcccaaagacctaaatcggcactggcaacattaactgacatgtcgactggtacgatctctattttgtcgccttgccactgaattaagcattggtgcatagtcgaaggaatgcaacaattggtgtgaatccaatcccttccgagcaacaaactgtaagaacccttcccatcgatgacaaaaaacgtagtaggaatagtcttactgccgactgtcagctccacatttagaacacctttggtttccgatggattaccaccaaagtccttgagtgccatatttgtcttgatgaggtcctcagcgtttctacccaacttcctgaacgtagcataaggcatcaaatttaccgcggctccaccatcgaccatcatctttgacatcggcttcccattgacgtagccatttacatacaacggtttaagatgccgattgtctgtcccctcaggtttctcgaacactgcctgttctagtgacagaaccaacttagccgattcctgttccacttcgtcgacatcggcttgatcgattccgaactcagctggcaaggtaaaaaccatgttaattggagctgttacaacactcctcccttttgccaacttcttcgccttatcggctgcgacaccatcagctacaggaacttgattcttaacacgccactcttgccttggctttgctttcctcagccgatggttaatttcctgttcaacctcctggacgcgctccctgctcctcaatctttgaacccttcttttctgattcttcgtgaaaatactagaaggacaccattgattcttccttattacctcatcctcttggccacgatcatgattcgcaggacccaatctttgatgaacagaaactcttgcctgcttcagccgattacccctattatatgatcggcttgaactctcgacgatatcactgcacccagggcaattttcgatagatggcaacctcatcccttcattccaacagaatctgaagaactcacaaccccaatgaggatcaaaaccatcatcgcattcctcataatgcttctcctgctgcttgtcatacttcctttgatatttgttgataaccttagccgaattcacctgaaaaccccttgcatggatcctatcggctgtttggctagctgtatacaccatattaacaggaaaaggattaccatcgactttcatcggctttttggagtcatcgaacttaatgttgcccccctcaatagccacctgaatctgctgtctaaaaaccttacaatcattagtagaatgagacccagaattgtgccatttgcaatacctctttttgcctaattcctcggccgatgggatcgtatgaccagcagaaagttgaatttgcttctctcggagtagcagatcaaagatcttatcagctttcctaacatcgaaatcatacttctcctcctttccagaacttttcacccactgacatagtatgacctttttgctcctaacccactcggctgcagctatttcggaatcatcatcctcatcatccaatccatacatataaggataaacatgattaatcttcctagagttcttcctagcttccgcaaacttttgttcatgcaaagataccttctgtgtaaggtgcgacaagcttcaaagtcttccgatgagaacttctccctgatcggagcaatcattccctgaaaagccaagtcggctaactgggcatcggtcaagctcaagctgtaacacttattcctcatttccctgaacctctgaatatactcgtgcaccggctcatcatgcttatgcttgttcgacgtaagatcggacaacttcatctcatgaaccccactatagaaataactatgaaactgcttttctaaatcggcccaactgttaattgacccatgc

SEQ ID NO: 61722 - DNA, 714 bp, Oryza sativa
tgatttattacagatgtctaatcgtcggaactatgagcaacaaggccatcgttcacaatcacaaggagtcagtaatgttgaagctgatatttcaatcacatggagctagaaattgcggtgtatttgcataaccagcatctacgagataaaatttaccaccaggaacttgaaaaccatgattaagtgcatcatgtaaaactcttgcatctgaagctgatccctcccatccaggatgtatatgcacaaacttcaaatcaaaatcacaagcaaccatacaattttgagagattgattgcttcctatttctatatggctcttgctcatccaatggaagtttcatagggatatgagtaccatctatagcaccaatacaattctacacaagacatgtcaaagttatttttgtccagttcatgaaaaaataggatattcaaaatatgaaatcagaacaacttaacaagtggccatacctgaaaaaaggggtaaaattgtggtttcctcaagattggatgtgggtgtagggatggtgcacgaatgtagacagatgtgagatttgtgattgcttccagcactgctttgaaatatctatgtattgtatctggactatgctgaaaccaatcttgaagtgtttcattggttgcattttttgccactgtatataagaatatagcaatctgctcttctactgaaacatatattgtgtcagttatgtac

SEQ ID NO: 61723 - DNA, 1181 bp, Oryza sativa
gataaaagtctagtggaacaccaccctatggttgatataattcatctcggaaatcaccaattcaatgtagtgttcctatgattaaaattatgtggctagtcacactagtggacagtaatgtgaagaccaggattaaatagaaatttagtggaaggagtagtagattaggtggtggtttggaggttgaaccccaccttcccacaaccagtactttgtgccagataagttaaaactaaaatacaaataattaagtgtgaacacattttcttctttctacttggtggcaaaatgtgccatcgacaatgttagtacccattaatggtttaaaacaaaaatgaacatggataattaatatctcaagcatgatatattaattatggctagctacttgtaattaattcggggattgacaataacaacatgttttcaccaaaaatataaatacacttaaagttaaactttaagttgcttgacatcggcaaaagattaacattcacatcgtttatgcttcaccttataagttgtagctaaaatttaaatttaaaaattaattttacaatcgatatattttaggatttttttattgaagtttatttctcagtacgtgcttttaaattactaagaacacaaaaacgaaagatttattcacagactcataacccgctactgtttataatcagtataagcgaatcgatgattgtgtaaacgaggaagcatgaacttacaaagcgcaaatcaaacgcccatagtaacataatttcagttccaccagcaaattaatttaaggacatgtttcttagctgccatcggttggctggtcatggacaccgaattaaccatacaacttctctcttctcttctctctctctctgagacggctcgcaaattatggtagcggcattacgtccacgccacgaactggtccttaacccgcgccgacctccacgatcatgtggctgtcaactgcaaaagccaaaggtgacaggacacgatgattgattaagataatcacctctacccagatagagagagagagagaaccacgaaatgcttaattaaaacactggtgtgttaggtgactatgcacgtacacgtaccctgttaattatcgagtactttattaaaggttgggctaggctcgaagttgatactatcatctctgcaaaacaactttgaggtta

SEQ ID NO: 61724 - DNA, 1811 bp, Oryza sativa
aacagctaacttcaccccgatttatatttttgtatgcagtcgtttggcttcaaaggtcatgtccgactgtgaaaataatacccctacgttgggaaaaatgctttttctagtagtgataaccaaaaggtatggaaagaagtacatagactcacccagaatatggggagttcaatatcaaatcaaacaaatgctcactcaaaaggaaagaaacagaactaagcgtgaatccttctcttaaaattccagccatatgcagcataaaacttcagcactcttgattcgaggagcttgtaataagccttcaccatcttgccatcaacttcacaacagtgacaagagccttgcccaatgtgctacgctgaaaattacttgcaaaaacgagttaaaattgtaagcaataaaaaccacattattcccactcagccaaaccgtccaacaaattgcagctatacccacaaaaatcaacttttggattcttggattaaacctatttgaccaactaccaaacataagagctatgctgctgggttgacggatgccaaaggtaaagtagaatgaactccagatgtgcctcacaatgcaacaataaaaaaaaagaggtgtttcataatccattatgaaaaaaactaatacatagtttaatgctagttaatgataagagagagttgcggatttgtttcattgatttatgtctttttattttaataacaaacaatggcagaagcaggagacgtaaaattcgattatctattttttattttttaatgacaaatttaacatgaaaatgttaaaaatgaccgaattgtcacaatttaagaataaaactgtcttagcactggcctgttcctacgaatgggaaaaaaaatgaatggttcagcagagacagcgggaatgttattcatttgtgtctaacaaaatgagttacacaaattgttgccatatcctaccctgatcattggacaatttcgactgacagacataaatttctgacggcgccgctctgctgacagatattatttgcccaagcaaatcttgctcggccgaagagaagatcacaccagtcgctactgacatatcgccatctaatcaagccaatctttttaaagcaacgcaaaatggggcaaatctgccatggataacaccgcaatatcttccagaacttccatcattgggccattggaccagcagacctggaacaatcgatggttagcacttcgcaattagcagattggttagtcatcagtgtgggaaggttggggtgttgtgtgtttgtgtgtgcagcgtgcatggttgttcagatccgagtcacctaatggggatttcttttgctgttgccttcggttgggcttgcttgctcagcttaatggggagctcggagctaccatttggaatggacaatttagctgcatgctctggcctttgcaattgtttgctttgggttcatggcaaaggatcaaacaataagatttgagaaattgagaaccttattaactatttgactgcctcaatttatttgagtttgggaaacagtttacttgaacaaaatggtagtctttgtttttttttaaaaaaaaacattttcagatggtcgtttcgcccttgctgattaggaatattcattttcaaaccaacgaaaccggttttattgaaatgaagaaaaagacagtttggtgatttatgaattgattgaaaccaggaaaaaccacatcgacatatgtatggacaaatgtcacagatcaaagtttatagtcactttcagttgatgaaaaccacactttcaaattgaaatcaatcactttctatccagcata

SEQ ID NO: 61725 - DNA, 4788 bp, Oryza sativa
aaactatttatggcagtacaaattacccccctcgattcgaaagctataaattcttcttcatcaacttttcatactaaacgaattacccctcctgccgactctgaaaaggttttcgtcatgcgtggcacacacgtgacactccagtcatcataaaaaaaataaaatatagtgagggcccacttatcagttttgcctcttctctcggtcaccacatgtggaccctactcttttttatattttcttatgctgactggactataacatgtgcgcgatgtaggaccaaaactgcttcaaagactatcacaggataattcgtccggtataaaaagttggtgaaaatgtctggttttgaattttagagggggtgggggaaccacaatagtttagggggtaattcggacttttcccaagatacatatttttagcgaacattaatttaaataataaatgttaataatcaatttaatcttatataatggagccaaataagcccataattttttgaaaatgaagtatacataaatttataattcaaattttctcaggaaaatggcaaatgcggatacaatgtttttatcacggcttgaaaatgtaccggaagcatatcaaatgtcatggttttcggcctatgccggttcaaaatgttagaattatgttaaaataaaaaaaataggactctgcaaaaattagactaaattggataaatcttttttttctatttgctgttttcggtgattcggtcgtttcggccggatcccattacaaacccattcgaatttgccatcccttcctttcagtagaccatcaccacccctacaatataccctataaccagaaaaaagcctccctctaatttcctatttgagaaagatccctcctcttccctccataaaaaaaaaattcaaaaagtttgaaagggtcacaaacccatagaatacacacaaaattacacagcatctgcctttatttttctttttctccacttgtccctcccccctatatttcttctaccctgtctgtctgcctattccccccttccctctctctctatagacagacatccccgcaccgagaagagaggcgcgcgccccactttgttccgcgccgcgacgcgcacttcccgcctttgccgtcctcgcgccggcacgcgcgcgcgcacgaacgcacgaacgctcgcgtcgcgtcgcggagctcgaggcgtgttcccgcggcaatggcgcacgacgggttcctcggtggtggtggcggaagcttccacgcgatggcggcgtggccgctgccgttcgacgccgcggccgcgctgcacgggggagggtgggacagcgacccggcgctcggcgagctcgtgccatcgccggtgggggtgggggtcgggggcggggtgcacaaggccgcgctgatggacgagctggcgagcaggctcggcggcgtgtgcggcggcgggctcgggggcggcggggtgccgtcgccgccgtcgtcgtcgcggtacgcgtcgtgctacagcacgccggtgggctcgccgtgcaagcccgcgccggcgccgcctgtgccttccctgctcgccgcggcggacgccatgatcgccgagcgcgccgcgcggatgtcgtgcctggcggctgccggacacggcggcgggaagctctcacgcgcggcgagcagccagtccctcctcgcggagacggcggcggccggtggcgtccaccagctaccggcgaggacgggtcgagcagcgacgctccttgtcggaagcggaaggcgccgtgcgccaaggctagaggcaaggacgcagcgacgaccattgccaaggtacttcgtctgctctctgctccgcctctgcaatcgcgacgccgaaccagccctgaaacaatggtgaattttccacagtcgccggagccggggacgaaggcgaagaaatgcaagctgtccgcggacgccgccggagacgaggacacgaagccggtcgccggcgacgcgggacacggcggcaatggcaagggaaaggtcctcgacgccgccggcgagccacccaaggactacatccacgtgcgcgctcgccgcggccaggccaccgacagccacagcctcgccgagcgggtaaaagccgccggcatcgatgccgccaatcataatttctttttctcttcaattctcgcgtttgctgacgccattgccgccgtttttcacctccaggtgaggagagaaaagatcagcgagcgcatgaagctgcttcaagacctcgttcctggctgcaacaaggtggcaaaattcagccaaaaaataaatttaaatttcacgctggtaaaacatttttcacagaggaattattaatttttcgagtttgtgaaattcaggtgacaggcaaggcagtgatgcttgacgagatcataaactacgtccagtcgttgcaacggcaagtggaggtgcgttgtcatgatcatcaccgacttaatttacaataatttctgattaattcctttcaaatttgttaatttgagcaagattgtttactgtcccaacagttcctatcaatgaagctttccaccgtcaacccgcagctggatttcgacgtcgacaacttcatcccaaaagatgtaacaatccaacctgaattcgctctgtcatttagttagttgaccttagaccaccatataattctgaaattttacttacaagtctctgaattttcagcaggctagtgatcccatcatgcccgcgccgttgtcgctgccaccgccaccgccaccgctatcctactcaccggagggcgcaagcccggggatctgctacgcgtcgtcgcaagggacagcaatgcagagcgtggtgacaagcaccaaacacttagaaacggcgccaacatttgcaaaccaccatgtcatcccagttccctcacttgatgggtttcacagtgctcattctcaggtaaaattgtactacaactcaagccacagaaatgatcatacagtgaaatcgccgtcatttttctccgacccactgatcgtaaaacgcaagaattgttgtggctgaatttttttcaggcagggagctgcatgtgggaggatgacctgcagagcgtggttcagatggggttcaggggcaatacatgatagattagatagatagataaacagatgagagcccccaatcatggccatggtctctgaattgattcggggacaaatcagtttcaccaatcaaagccaggagacggtcacccggggaggcatgtcgggtgcttggaacacttaacacgagggggttgggtttgagctacctccaacccaatcattggatcatccctccatgattgtacatacaacccccccaccttcaatgtgggggaagaaaatggaagaaggagaagggataaaatgccctacttgcccattgcctcagctcaaagatttgtaccacggcgagtccgaggcggaggcggaggcgaaggcaaaggcgaagacgaaaaaagaaaaagatttagttttcttcatttgctcttaggaattttcatccatctcacaaaggatgcaatatgtaatgttgcagtggaatgtaattgtttctagacttcaacttgggatttgaatataattatgagagaagtttcttgcatttggttgctactgtaggctttgtgccggtaggtggaattgttttgttctctgcgttatcatcgccattatcatcatcacggagtcttttaagccgtgtgagctggagtcaacaactctaggcagaatcttaacctcttttagtgtcttgcttgtttgtatgattgcattcttaatctcatctagtgagccctagacaactaatctttaggatagaattgttgtgtgtgccctttattctgcaaagcaccaaaactgctggcacggcagaaaggtcctttgggcgcatgatttgagccgaactgacatgatttgcgggagtttcatattggcaaatgtcttgggctcctgtcttgtcagcaaaattctttcttaggtttggtctacctaaaaaaaaaccttacaatatagaacaacaaaagaaaatcacatttttgtccaataatttaatgtacatgtgtattgcctctttcagtcaaccaatcaggctgatagaaatgtaatttacaattgtttttatcctttttataaaagataccgtttattattggccttttattccacggactattttctaatgctctaacattggtcaggttcagttaaccaaaggaactgaaaaaaaaaatactaaaccccatataaaaataaggtttgctgtcctgtagacacctctttaaccagacaaggaagagaagagaaaccccaaaaacaaaagggaaggtaggtattgggttacagagtggacaagattccatccagcatagaagcatctgttgcagagtactactgcctcttcttctacctctcctttagtcatatacaaaacctgtgataaacttttggcatctactatggtccttcctggcctcccaccagaaaataaacttaattctggtactttgcacagccaggtgtatatatatacaaaaataaaacaatatcagaggcttttttactttgtctcaaagtggccactctaccgctagatggcatggcaggtatctagtcattgtcaatactgttccattgggaggacaacttacaagattgcaccctccctagtgatggagacacaagtgctacccaattatcatgacgcctacaagggtccattttgatcaaggaaaaaacactgcaatgaaaggccatgcctaaacacacatttagacctcttaattga

SEQ ID NO: 61726 - DNA, 2173 bp, Oryza sativa
ctaatgtgtgacgggggagattgttgggaatagtcccacattgaaagtttaaggggagtggcaccaacttaaaaggggaggggtccctcacctcatgagctagcttttggtataaattccatagaagtattaattactcgacatgccattgtcaggaatttttccagaattctaacagcagattattcgttgattctgaatcggacagacaaaatgtaaagaagttgtattccctgacaatggtaaagcaacacttctattcaagcaaccgaagagggtcatccgaatattattatgattgaagaaaaaagcaaatgttacaagaaagttttacatacaaaacaacactttttctctcgcaagtttgaactgaattgctgcagcaactctgcgtgtcgcgactcagcgtatgcattgcttgattccaaatgatccattcaatgccatgttcatgtcagcatagtgtacagatgctgttaggtcggccatagtactctacgcagtacacataatcatatacataggcttgtcttcttcctcctccgtaatatatacaatacgccgatgaattttgtttcttttgttttcaatgacagcgccatgcatgcagtcggtgtcttcagtgcctcggtatattattttactgacttatctgaattctgcagatatgctatcagcacggattttactacaatttgggtccaggggacgccagattcgccagccaaacgtcgccatcgaaatccaggagcatggtgcattgtactgctcgatgtccaattaagtcgttttcctcctcatctcccttgtcagcatgtattgtgatcttaattttctcctttgctctatctgttgcaagctttccgaatattgactgatctaggcggtgcgtttctgccgcttggatattgcaatatccaattttgcattagttcgtataaagattcagaaattagatattcatcttgcggtacgttttacaataatcgttagatttcattttcctatcttactacctccgtcccataacataaaagtttttttttttttgcccttatagttatataggcaaaatctcttatattatgggacagattacttaataatcgaaaatcataagacataggtaaacacatgttattgccgatcgattccacccatcgaatcccagatccatgagcgtctcccttcagaaaagctgcgtgttttccattcttcactgcaatagccgtttccttgcatcaaatacaaacatcatatgttctttatatcaatcatgagtttttttttattatttgttataggtaggatcaatggtaacataattagaaagaaatagaatctttgcagaataaaaatcagcccaagtaaacaagaccaaaagaaaacagtgcattctatcttaaacatcatttgtctatccgcagagcgtcttacaaaattactctgcccttctagcgtttgtgttcttataacctccaacactacatagtccttcaattaatccatctagaattgtcttacttcctccgtcctaaaatataaccattttttaggtaggtgcagatattaataaagtaggtagagatgattggagaaatattgcgattggtggagaagagaaagtaggtgtagataatggttgtgattggttgagataaaaggataggtagaaaaataacttcattttggaacaaattactgtgctaaaaatagctacattttgagacggaggtagtacacatctattttaactacgttaatcctcaaatttgactataagggattaggatttcctcaaatatttatttctactatttgtccattcttcttaaacatgaactgcatccaaatttaactatttctatttaaaaaatcaacttcatctgcaccaagcaacacctgcacataaacactagcaaaaccatataccaatcataagtttttttcccaacttgactacaattagaacaataacagtacatgcatcttacatacacaactaagttatcataatgcccaccaaacaacatttaacaaaatcattggcaattatgtaaagaaaaataaaagctctcccacttagcgaaaggaataaaaaacctctaagttaaaacaaacactcccatgcttagcgaaagaaaagaatttatccgccccctcacaaaaatca

SEQ ID NO: 61727 - DNA, 12979 bp, Oryza sativa
ctctaaataaaaattcatggttattttattttattttacattgggaagcaaaagatcacaattgttttttttggtatgagtttattttattctgttttgtacctttgtaaaagattcaacaaaagccgtagcgaaaacagttccaaggttgaagaaacagaacatcgaattaacagacaaacaagaaagctggaattgatgtggtagacagtaccaactgccaaccaatatagattgcaatacccgagctgttgtgtctacgacccaattaagcaatgtctattagacggccggggcgccatcaatctgcatcatcacgctgctgtaaacctcgatcccaaaagtgtagacccgaccacgttgggcgccgttggccaagctccatcacccatccactgtgcagaacatggatgatacatttcatgcatatatcatcagcgagacgtacgaaagctcctggcacgtggcgacatgccgtgtaccaaaagagcaggcaatgacctcgactgcacatccggtcaccgaaccatatccatccacgcccatctaacttggggaagaaacgatgtgcatgtatcagcttatccaagtgagagcaagagactgtatcggcttacactactagaaaaatcatacagtaagaaatgattctgaatcttacatttttatatgaatatattataataaaatatccttcttaatgcgaaacggtacgacatccatacagtgcgtacaactactacaagttcaagggtggagaaacagacacgaacaagggagaagctgctagtacatacatattggccggtaattaatactccaatcatttaatatattcctactgtttcactaattacaaaatttaactattttcttgtatgatatgtcgtgaagtgtcacaagcaacctagaggcactgtcctctgcgggtattacgcgtgcgaattcctcacggttaatgggaggtacagggttaacgcagaggatgtaagtctctagactatggactagacagtatcacatatttatgatactaatatattgtttttctctaatgcatgcagttgccaagaatagaatttcgaacaagctttgacgatacaggcatcacaaatgtccagagcgatttgtgtcacttcatccaccgtgagtgctgtcatgtgtgaggagatttattcgtcccagagggtgccctagctacaagtgacgaattcaagcaactttgggagtagagtactgctatgccataatgtaattagatggcgtatttgaagtgacaatgtaaaaaaatattgtaatatatattttgacaacacttttcacttatgcaatatatgtagatttctcagtaccaaatgcttgtttaatctaataatcttcctacatcaatttctattaaataattaaaaattaatttatgggcaaattattattgtatcaaatttcaaaattttgtacccatcttcacaggcggatgtttttttttttgcaggcggccgctttctattttcgcaggcggacctgtctagctaacgtccaactgcgaaaattatcttcctaggaggacggccgtcccgcctgcgatcttcacagtcgttggcttacaggcggagccgccgtccacctgggaagacctgtttccaccgccggcgataatgctttttctagtagtgttatccacgttagtatcttttatttttcgtttttctttgacccctggcaacggtcttctgaccgtgtgtgtcatgtactcaaactctgttcttttcttctagtatattagcgtgtaatccatctgtgtgttcgtgaaaaatattggactgacacagcatgccaaaggacgtaggtatatgtcacaccctgaaaatcgctaaattataaattgttgtgaaaaaaagaatttttagaatttatttaataattaaagcaagtgtgtgaataaaatctatgaaaaatttgaacataaacttgagctagataaaattttattaaatactttgtatgcccaagtattttctggatttttcccagaattatttgagaattggaagtatttttaataaatgaaagatcatttcagcaattatttaaattaaaaagttaattaaaattcctcttctttgtttgggccgaattcagcccactcctctccctctctcttagctgaagtccactttttgtccctctagcaatcgggccaagcaagtaaggaaaaggaagcccatgaaaagtctactttacctcccctcgctacagtaccttcttcctcctccagccgagccgtacagagccgatccgtgtgcgtgcgccgccgcttccttcgcaaaatccgtcgcatcccgtgatccgtttccaaaattggttgcaaaaacggattcccctcgatctcctctaccttatccctaagaaacccctttgaataccgttgtatatcgcgtgaattcgacgcggtttcgagctccgtttttccggcgaactcggataaaccctcgtttttctctcgccaaatcccgttgtttttatccaacctcttcgcacaaatcctataaatagcagcccctcgacctcctcttccgtttccccctctttcccgaattttttccttaaccctagcctcctccccgcgagctccctctctctccacctccggtcgcctctccagccgccgtgcgccgtcgccccgcccgtccccggtcagccccgtcacctccctcggcttcgcaagggcgagagctaccccggccactccttcctttgcgccaaaccccaccggaattcgccgtcaccgtgaagccgatctaatctatctccggccgcgctgttcgtcgtcgtccatcgtcgccttcggtcgccgttgtttccattggattcgtagctgtgaggagaaactcgtccacccctccattgccgccgcccgtcgccggaaagccgtcaccatcgtcaaccctaggtcgccgccctatggagctgtcgccggccatctccctcgccgtctgtcatcgcgtaagtggtggtaagggttgccttgatctcctctctctcccggtgccctccgtttgtgtcattgtattgtggttctctgataaccaccgttcccgtgctcaccggcgttgatcctgtatggcagccatgtcatcgctgacatcagcgccatcttggccatccaaaattaatataaatttgtcatctctttttaataacatattattcttttttaatatatgtcatctaccaaatatgatctaatcttttccggaggatgttttaatcttttgtctcagctataaatcatttgtaaattgtttaattaatttggaatagtctttttttaataggtttaattggaattaaatcttgtaaaattcatatctaattcatacgaactcggaatgaggtcgttcaagtctcataattcatctaaattcaagctctacctatttatgaactttagttgtactgtttatttggtttttattagtgttatttctcattttgtgttctaggtttagttttctgttgtttcagaggatcgttcgttcgttggagaagttcctgaagacgaattgaagacacttgtttgcaaggcaagtcacacagatcccaaataaccctttgagcatgttgaacccgtttaaagctaatgttttatttcaacttatgcattattttcgaatgtcatcgggtggtgagcctttcccaattaattaatagccgaatatgactttatttttctatgggttataatttgattagctagaaccttatatattggattggttcagctaaatgctatatatatataattgcttagccatgcttagaaacattagttcattaatgggatgaatcatactacattattatttatggttatatttaatggtagctcatgatggtcaatcgtgttatgataattaattgatgattaaaatatgattaatggtgggttgtgagcacatagttttgaaggtcgtgctcatgacaattaaggaccggttcgcgagctactgttgtgagacattaaccgtgccaaccacaagccagcatgagcaacggctttaccttttgtatagcatgattcattgcggggtgcaagactgtgaagcggcgagaagtccgtgggggtcgctggggagtccatgcctctggtttttgagggagtgattatgatccagaaatggtgcgctgtggtgagttgtgttgtgcaaagggtactgtcacgatttccccctttgcagtgccgtggtggtacttcaaggcatggcaacatgtgtggaatcgtgtcttgtgggtacagtggtacatctctggccagagtaaaactattcaaatagccgtgcccgcggttatgggcgggtctaacaatatttttcgtgattagtccacactactcattaatgataataatgtgataattaatttgactcctggtttggaatggataattcctggtttggaggtttaatctgtacgaccggggttggttgttcaggtttggttgggcctgtgcagcatggttgtgctgttcagtgttgattaatattgatgattaattactctactgttttacaaattctcaactctttgctaaatgctgctttcgcaaatgaatcctatattatgccatcctttgatatgcttgtgcacttgcatatttgctgtgtagcttgttgagtatgtcatatgctcattcttgcaataatcatcaaacctcagttgaagaaaaaggatccagaaggagaagacctttggcttagatcccagttgagctgcctgtgggagtggagctgaagcttcgctagattttattttccgctgcagttttctttatggtgagaactaagtgcatcttatgtaagtatttatcgttttagttattttgatgaatctgtatattaaattgtcagtttgtgtacctcggctaatttctggacgagggttttaatgcacaaattagttccgaaattacctgtgaatttctaggcgtgacagtatatctcctcgatatatcatgcattgcgattgctcatcagctctcgctacgcactcactgccgttggctgctcgacacgtcggtgcaaagccgggaactttctgccttctgcgtgggcgcagatcatgtttggttgcgatctttcgcttggtggcgcgttcatgtttcagcctttctggtaaagaaatacaaggcttttcagaagtgtcgggttatgtttttcaatcggattactgaacttttttggcttctggctgaaatttccgccattttgagctcacatatataatactatgagcaaggattttaacagaaattaaggttaaggatgcctctggtagtttagtcagccagttcaaataaaactatcactactacgtaatctcaaataggtaccaacttaaaggtgctggtaagaggaaaccgacacctattattaatcgtagataccggttacaactacaaaccgatactaatactttaggtgtcagttattaaaaaaaataaaagttaaaatacatcatttgaggatagaccctatcgtttacctgacaaataaataataacaaaaattaaatgaatactaaatcactaaatcattgtacataacaaaaaatacattaaatgccttccagagcgctcataaaacaccctatatcatgccctaaaattctaagaaaaaccaataaattgacgtatccattatttttaactattaaatctatttttttcaaaaattcttaagtcgccatgtgtcacgtcctataaaaaacggagagaaacttagaaattcatagaaaaatgaaacacactatcatcggctttcacttaaatcatttagacaaattaaaaaaataaaatctcctccgcctcctcctcgccctcacacgcacacaacattgtccatcctctccctatcatttatctattaaacaaaaagagaaacaatcaataaaaagagaaacaatcaataatattggatttttttagaaacaaagtaaaaatgcaggcgctcacaacgcgcgcacgctcatacctatgagggcacacatgcacatccctcatgagtacttctgagagactgggcgcacatattttgagattgacaaagtcaccacgagcgcttcactgtcgacgggtacgtcgtctaccactgaaagaatttatcaatctaggacttgaacccgagtgggcaagttccaccacaagaaacctaaccagttgagctacgttcacttcgtaataatattggatattaaaacaccataatttttaagctatattcctggaatactcctatgttttttaaaccggtggaaccattatttctaagaaaaacaagtgtgtatttatggtacatcacatttttaaaatattattgtgcaattatattttatcattatagtattcaggttaggttgcatagaacctcttacccactctacatgaaatgttcatagatggaccgtctctcaaactacatcaatcatattaggctatataaaatttagtggattcatgtcccacccaattcatcctctaataaaccatgataatatatatacattaataaaacattacttttactttacacttacttttatttccgttgacatgttttctaaagaaaattagtctaccatcttttcaaatgacgaagaagattataaataattgcttatagatatcacttaaatataagcatagagcaattttgacaaattgaaagctgatttcaaacaggagtttgccttgcatatgcatagagcaaaggaagctggcatctcgctttggcaatcatggctagataattttcattagttttcccttgtaattatttgtaatctttgtaaattcacccatttattatattttaatatatattgcaataggagcctctcctgttgtttcatgtcaaaaaaatatcacttaaatatgatataatataaagctaatatgttaaaaaatataaaaacaactaatgccgacgaaaacaacggagaaatcgtggccggttaatattttgctcctataagtacgtgtctcgaacttaacgtacgacgcatgcccgcgcatttgcgcggactaccttcctaattaatataaaaggagctaaagtaacttataataatataaaacagaggtagtatatacttggtacccactagttataaagttgctacgatgattagccacatcaccgcaattacctgggaccattagatcttaaatcaacggaaaaagtacaccgaaggtccctcaacttgtcagcgagatacaaaatcatcctcgaaccacgaaaccagatatgcggggtcccttaactatacaaaaccagtcacccgagatctctcggcggttttaacgccggatttctcctacgtgacgaatgagtcagcgtggaacccacgtagaacccacgccacctcatctctccctctagtttcccctcttctccctttctctccctctcacttttctcagccggcgacagccggcgacaggcggcgctgtgggggaggaggcccccggggggaggggagaggaggaggtccggcagccggcgtcgcgccggcggaggcaacgccgccgtcagcatcctcccttcctcctctctctctgtcttttctcctgttgcaagccggccggcaacgaacatagtggcgcggcggcgccaccggggaggatggtgctgcggggggcacgcggcagaggtgggtggcgccggtgccgaggaggaggaggtcgtggcactgtcgtcgtcgtcgtcctcggcgtcggggaagaaggtgggcgcggcggcggaggctggggggttgccgcggctggtgtcgtacaaggtgctggtgctcgtgctcgtgctgcagtttctgtacagcaggcaggcgtcggtggcggtgcccaagagcgggccgctcccggggtgcggcgccgccgtcgacctcgccctcgacacgctgaaagtttgtgtacgcgtcattctatcttgggaaacatggctgcagtgctgctcggtttgaacttcaggtttatctggtaaagatcaaatggtgaactgaaaacagtaggtgtccatcttgttcaggcatagatgtgtttataaacttcagaatctgtattactcctagtcgaggtagaagttgatacttggaaattggaatgataaacagatgatattctcgttgtttatacacaggacaagctacaggtttcgcagaattaaaatgcatacgaatgcaaagagaatttgtcctctgcttgcaaggggccaatgatatatactgtatgagaagaccaacaaaaagatcccagagattctaggcaaatgttcagagttcagagacttgcaaactctcagatgatggacagtgtcatcgaccataacccggtcagaatgtctctataccaattttagtattctgcacaaatctgacgacgtgatatatatcataatcgagctgaaaagattagcattggctagctacaaacagcaagttgacaggctataataatctcatactatagtcctacttgaaaaggattcaaaagattgcttctttatactgtacagacgatggtagaactgtactacagtatagaattcagtctaggttcttcagacttgccaatggcttgaacaagaataaaaacagagacacctttcgaactgaagaagcaaccatcaaaataaacaggctcgtgaattacagtatcttggagatgaagaagcaatgttcagctttccatccacactagccgcggcaaccccctagcctccgccgccgccggtccaccttcttccccgactccgaggacgacgacgacgacagcgccacgtccaaggccgcctccgggggttccccggccatcccgcctccgacaacggcgccacgctttccgccgccgagggctacgacggcgaggaccgcgtcagcgcgctccccgacgacctcctcgtcgcccgcctcccgtcaaggacgcgactcgcaccgccgcgctcgcctcccgctggcggcgcgtctggagctccacgccgctcgtcctccgcggcaagccccttgtgcgccggcgtggagggccctaggggcggcgaggtccccgtggaggcggtggtggccagcgcgtggaggaagcacggcggcggcggcgctggtcgccgatctcctcctctctgccgccgaggccgtgggcgttgcagccgtcggccgcgccctcgccggtcacccggaccccttccgcgtcgtgcaccggtccgagctcgccgagtcctcaaccatctgctcgcctgcaagcctcgcgctcgcgctcaacaggcagagagagaggaggaaccgaggaccggctaacgtggcatcctgacatgtgggacccacgtctcgctggaatcaatcacacattctgcccctaaagcgccagattcaacgacaacaaggactcctcccgctgcctttggagctcagcatcacctcaatcttctgtttcatataggttcaccgaacttccatacaccgattgattgtacgcttgctgttctcaactgggcctctgaatttcctctggtttcacctttgcgagtgagattgtcatgccgcaaaagcagatatggtccggtattcccttgttccccgtattggttatgttctttattccttgtctagttgaaactaatcgagctccgtaggagagttgtgtagttccactccatctacaaaagagaaagggctcctataacttgatcgacaggacccaaccaactaaactattgattttggcaaagctagaccttttgaggaaaacagatacagataacgaaaggaagctattagtttttcttgtactcgactcggcttttctttactgaccgcttgcgtaaggaaagttgacaataggaaaaccaggtgagaagttttagagctagcgtgccctacttcaataaggtattacctcgccgagggggtaggattggattcattcacttgcattcctgctagcactacaaaaagctccggtcttaacgcccttacggaagcagtgcagcctttcctcgggttcgtagagtcgggtttcccgtttacccacaacggaggagctgcccccaccaaccaaagcaggtaggcggccacggttcataacgcttggtcccacgctgactcagccaccacatagaccaaaacctgggtcaaaaccaccgaagatctcgggtgaccggttctgtatagttaagggaccctatatatctggttttgcggttcgaggacgttttttatctcactgacaagttgagagatattgggtgtactttttcctaaatcaacatttcatgagggaaaaagtacaccgaaggtccctcaacttatcatccagttacaaaatcatcccccaaccgcaaaaccggatataacgcatcttcaaacttacaaaaccagtacaaattaagtccctcagtggttttgaccttggttttgtccgatgtggctgctgattcagcgtgggacccacgtggactccacatgttagtatgccacgtcagcaggtacctgtttcccctcctctcccttcctcctctctctctctcacactcttctctctgggaaggccggccaacggtgcggaggaggtcgccgggcgaggaggtccgacggccggccggcgatgcggcggcggcggcgacgcggcggcggagacacgggagaaggggaggcggcggcggcaggcgtgcgcacctcctcgagctgctcctcctcctccccggctactcccacgacgccgactacctcaccgcccttcccaatccctatctcatcgccgagctatccacctacgggtccgtcgccgatgctgtcctccgggccccgccaccttcctccgccccgcagcctcgccaccctcagtctgcccgacgcggtggaggtggtctgcgtgctgaaacaggtggaggagaggcggctgtcctgcatacttgcattattttttacggtaaatctccctgagctcccatctgaacctgacaccgaaatggcatcaaagctgttggaattgtgaaggtgatcgacaggcccacgcatgtttcttctcgctgtaaacctcatcccaggaggtttgtttgtcaccaatccatcctgtaaaagagatcaccacaaaaacagaggaaagtcagatcctacatccattgttcagttccataatctcacccttatcaagcaaaaatgaaacaatatgattcaagttcagcaagagaaattctgatcccaaacagttcggcacaaaaaaattctgatctcaaacaaaaaatatcacacagcaacacaaaaagaatgacacagtacgattcaagtttagcaagagaaattctgatctcgaacagttcagcatgaaaattgctgatctaaaaaaaaaaaacatgacacagcaacaaaaacttcccaaatgatcaatcacaaaaatgtaagctccctttcccctatatttctttagcaatcttctttgcatgccaaaagccttctttcttatccatcaccaaaacgaaacaaagcaatgcaatgatgatgcactgaaaagaaaaggctctcaacaacccggagcaggtgctgcgcaggatggagcaggagaggcggctcgtgcggaggggcaccgccgggagcgtgtccgtccgcgtcctcactggcggcggtggcggcgaggccgtctccttcctcttcaacggtgcctcgatggcctcctcgggagccgccgtcgccggccgcaccaccctccgggcacgcgcgccgccgtgggggaagacgacgaatgcggcggcggaaggaggatgatgacgggagctatcgtcactccttgctacgatgaggacggcctcgagtccaccgagagcggcggcaaggctcgtgagtccacctctgcgcccggcccgccgccgccgcgtcgccacgccaccctgccgctcgtcgccggccgcccagctcctctgccgccgcccgcgcgctgctcctcccctgtcgcccgccgccgcattcccaccttccgtcgtcatcttcaccaccggcggtggagcaccatcagacgcccccacatctccggcgcccgtcgcctcctccatccctcccaactcacttgagcggacgcgagcagccgcaggagctcctccagctccggccactggcgtggtgctcgtgctccgcttccgcggcactctcgccggaaaaagaaccgaggaagagaagagagagaagaaccgaggaagaggaggagagggaggggagagatgatgtggcatccttatacgtggggcccacatgggtcccatgcttactcagttgccacgtaggataaaaccggggtcaaaaccaccgaaggatctattgtgaccggttttaattagttaagggacgccggatatctggttttgcaattgagggacgattttgtaactcgacgacaagttgagggaccttcggtgtactttttcctttcaggagtgcacaaggccaccatctagaccaatcaggcccaactaaacggcctccgctttcacccatcggcccattattgttaaagtcccgcatgttcaaataatctattgtgcccatgaaagccatctgaagagcagttacgcaaaaaaaaaaaaaaaatcatgcatcatcactaatggtgaagatcagaggccatacttaattctccacccaaacctctttcaattcaccgttattgtcttttggaaaaagtccaaatacccttctaaactttcgatggaagtttgtctagcactctaaacattaaaaccggacatccaacctcttaaactttaccataccatccatatataacccctaagatgttttggatgacggttttgtatattttgaaagcttaaatgggtaattttaaataactaatataacatatttgcatatcatcagttataagtcatcaatttcttcttacacagtgatatcatactattattacgttggtatttgtttgtaaatgaga

SEQ ID NO: 61728 - DNA, 829 bp, Oryza sativa
cggccaggtgcattcaagatggcagacggcgatggtcgcgagttagcaaattcatggaacattgatcaattacgtaaattttatgtgtaaatcaatagtatccatacttgtaagacatcttacgacttcaaaaaaagttgattttaggtaaagactacaatcaatgtgttccttcccgacgatcccttaccacgacgacacatagcgttgaaacctatcctcatgtccctttacgccgtcttgacaaggcctctgaggaacctaagtgaacttcggcttgggacgcccagagcggataaggccttgtcagatcatgtagggacaaacgaccatgtaagatctgttcatgtaagagctctcgccgtgcgtattaaccaagccgtgtaatcggaaactgagttttccaacttcacggctaggggctaggattagtgctttttttcaaccgaggcaagtcaagggtccaagagccttatcctccgagaacgcttctccaacgacaaggctgggggctagggagagtgtatgactcaaaaccctaaaccctaaaccctagtcagatagattccttttctatttcatgagtacttcttacaatttataactactccaaaatatattacatgtctccttgaagataatttttacaggatacaaagactcccaggacggctaacgccaatccatggattgaaagactttctcggcaagcggcgccattgacttcgccagattgtctatctctgcgggagtcctccgagaacgtgaaaacccttcttggaggaactcgaggtgcagctgcgggcggtgatctcggacacaggccagc

SEQ ID NO: 61729 - DNA, 736 bp, Oryza sativa
ttcctgcagccccttcccggtctgctctttcttcacttccaccatagtcctctcgagttcggccaccttgaacttcatcctccaatattggattcgacgatctcggtcggccaacacactctcgaggtctgctcaaacacggaaatgactaagtcgagttgttctcctctttcgagaacacggcaaattaagtcgattggaacaaaagagtaaaggagatgaagaccaaagtaccaacctaaggaagtcatcaccatgtccgcctccacggacaggctttgatcgacatcgtcccgcggcacgtacggcttaagcacaagtgccggaacgactaccggcaactcaagctgcccgcgttgctggacaacctcgatatcaacatctctacatttacaacaaagtactcggaatcaacatgctaaagaaaacgaaggaaacaactgcatacacaaaagcagtttgaacctacgaaagttttacaagcataatcgattaaggagtacaggggaaataaaatcctactcttcaaaaacggggagaacagactaccccaagtcaccgaattcgtccatcacgcccttgcgcgtgtcattggcgcccccctgatccaagatcctctggaggtcgatattagggtgcgccaacctcatgcacgcgaggacgtggctcgccccggtgtagatcccgttaaacatctcctcgccgatcctggccgcatgcttgcaggggatctcct

SEQ ID NO: 61730 - DNA, 9204 bp, Oryza sativa
ggccatgaccgttcaaaagccatttccacataccgtctccaagcatcagtgctgtccatcggcattagttcccaaaaataaccttctgttgcacgactcactacaactgacactgacattgtgtatacttcttggtctattctaaatcctctcaacaaccaactataaattgactgaaatgttctctccgcaggcctatcgatgcccttagatgtcattacaaaatctgacagatcaacaccatctggaccaaatctaatatttccttcatcgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacttgtgatgaattgagcgaaccagcagggcttcgccgctccccttctgctgccctcccctctctctctttcgttttttttggatttttagtgaatataatgaaatttcacagaggagggactgggctttatagagggagaggcaaaaatcgccctcccccagggcggcaagggggccgcctgcaaaattccatgccccccccgccgcccatttgcaggcggccccccgcacagtacaaaatcgccctagcggagagcggcaagggggccgcctgcaaatttcgttgacggccgtcgcccgagagcgaacggccgtctgccacgtcattttcgccgccctctgagagggcgatttttaaaaatcgccctcccagagggcggtaggcgactacttccgtcaattttcaaaatggaaaattatttttgtaaaacttttaataaaaaaaattataaataaaaaaaattcgggcggggggcggggctcggctgggccaatgggccgaagggaagaaaagatgggattttggcccagattgaaataaatgtttttctaatttttggatggaatttgaatggtttggtttggctaggatttaaaggagatttggatagaatttgaatttaaagaagatttggatacctaggttttagggaggatttggagaaatatttgtggctaataggggattaatttggaagagggaaaaatattcttcttagcacaagagcaatcatgataatattattcttgtgccaagaatgtgatcaagtcataggaatcaaattggtggatggatcaaaataggaacctgatcacaggatattttggatcgattaaaaggaaataaaggtttctggggataggtttagatagaggtctgatccaaaataaattacaacaagaagggagttatattggtttaaccccaaggatacaaatggttaatgggatataacaaagagtcgggtcaatcgggaaaatattggcccaagtagactgtggaatcttaaatggataatttggaggaacgggatttcaagggaatatatttgtgggagtatagatctggacttggaagtatatgtagatgggaatttctacacgaacaggattggtggtagattgataaattctaaaggttgggtatgttgactcaaagggggattgaaaaggatattttatgaactctgggaatatttaggtggggatccaaatgaaaggtatcgacatttcatgtactctaggtatggttgaatgggaattgaaagggtatttgttggagatgttcaagaatggaatcaaaggaaatataatctagagccaaagttagagattaaagaaaataaatagagaggttttgtaaaatttaaaagagagcgattaactttgcaaataaagttttaaatccaagttaaaagaaattaacagaaggtaagatcacttcaatagaagaatcgagaagagtgcaattaaaatatttcgcaaaaaaattttccctgaaaatttgagtccattacatatatgagggaaatgttcattcattgaacatgcactaatacaaaataaagggggtaaagatattatatgcagtgagctaacataagaattaatgcaatggcatgaaaaattgcgcatccctaatactgtaggttatcccaattcatagagggttattattctgcgacaatgaagcccaaacaaatatccactagtcgagaaaattactctattttctagcttttttattatttgcccaagacttgatccaattactcatactatactcaattcttgaattaagttggatcaataaacttcatgtttatatttatgcaacatagatatgatcataagatggatgcgttagtattatataacttcacgatgtcttcaagaacataactataacactaaaacattaatctatgaacaagtttaaccatcatggaacttttcaaatcacccaaacattattctacgagaatatttattcttcttgaatatgccaataaattaattgggtgacatatctaacttttattcattacgcctaagtaaatgtggtgtcatttgatcattcagaatcattcgaatccaaaaggtcattatttatttaggatattatttactacaagtaaaccaatagctttcaaatagctatatgcaatttcatacttcctcgatgaatatgcaattttcaatggccaataaataacacacttcgttgtgtgacaataattcataattatcccaaataagattcgctaatagtttgggctatttttgcttctagcatttgacctataacacaccaatttgcctgccacatatccacaatttcttatgcttctttattgcaaatattctgaaattaatttgcaaaatacacatattcctcccccttttcacccaatcataagaaaatttacaaaatagttatcgtgaaacccacatatttgttgtaacttcatggtacaacttttctaaaagaaataatgtggttgcgggtggatatatttaagcttcaatgcttaaacataaatattctaattgttcatgtgcataagtaaactttacatgtatgccaatatggcgtcaatgcacttagaactatcaacctacatggttgattgaggcttagtggataataagaatacattcgccaaaaaaacttcaaataataggcaagacaaatatttacgttcaatgttagacatacaattcacaattttattccacaaaaggttaaagaattactacaagtaaaaaaaaggcaatataggtaaggtgagatgacctatataaaaaaaaattcagtaatctaatgcagaagcttctatgactaaagcaaaagataaagatgctctacatgagcttaaccatgttcttcatattgaacttaatctaaactataatgtaactcgtgtattgtaaaatactatctcaaaagaacgaatgcaagattactgtcattactattcgtctccccctgagttgaacatcaaattcaaatataccaaattcctttccttccacaaattttgagtatgcatgttcttcatgaacatattaatagtataagtcatatatgtgcgtgcaaatgcatatgttgacagtaatacaacttcttgtgtatcaattctaacaactaaacatgttgcatctaggtcaaaattgcttcaaatgcaaatgaccaatttattcaaaataatgtacatacatccataaaaacaatacttcatttgtaaagtcatttatacgtagaagatgcacataacattatcaatcaaattaactatagacactgcataggtacatagtcttttgatagataattttggtgcagggcatattggcatatagacttctcgtctatatatttgcaaattcgatgacattgtatctacttggacacaattaatataaattagttgtagcttatcttctatgatagttatgcactaataaatatctctaagtatactctcttcatgaaaagtgtatatatttattctatacggagaatatataattgtgccttctacaaatgtggcgacaattagacaaagagaagatatatgaataattctattactcatttacgcaataaatgtatttgctacatgcaactacttacatgatgtccttctatgcaactttctaccggtttacttctagtaaataaagtgcacaaaacgagtataaaatagtaaataatggttttctatacacaccttttattacaatcctagcaattaacatgattttctactattcaaaggtatgtgtaatttacagaactactaacccacagaacaatcaattaccccaaacaaacaattgctagtaaataaaccataaaatataatgcttccaaaaggggtgctaaaacaaaggtttcacaagttcatggaagctcttttgcctaaaaacaatgtttctaggattgattatggttattcaagaaactaactaaatagttaaagcaaatacttataaatacgggactaaggtataaatccttaattcttctctatttggcgtaaacctaattcatgaaggttcagagtataaatggcgaatgtatattccccgtaatttctaatgtcccataggacttttccgcataatttccgagttccgcataatgccttggaaaccaaggacttttgaaataaaattcgttttcggacaaaaatcacggttcgtgcccgactccttttaataggccaatttctacttggcccacctccttatactggctagctttaaaacctggccagcccatctcagatgttgcctaatgggctattacgaccttcccccacaagaagtgggtgaggtatgatctaattgtcattcttcaatggagacaacggatggaaccaatggcaaacgtgctagtgagccctcggtagagatggacgactatgggaagttgccatggtcagaggcggagcggcggtgcaacatctagtagcaccgacaccggcattcgttggcatcaggccgtgaccggcgtccgacaatcatagctccatgttacgtgtcgatgaaactcggctcggcatacaggccggcatggcggacggctatcgacggcgggtgctcacggcggcttcgaccctcgtcccggccgcgtgtggtagcacgggaggcatgccgtgcgtaccggtggcgaggggaggcgggcgtaagctcctcggcgtcgctacgggcggcgaccgtcaattgcattgcggatggcctcgaaaggccgtcgagtcgacgtttcagatggcggatcgacgaggaaaagtctctggattgattcggcaaccattgacaaaggggaagacatcatgcggtggcgtccgggtgtcgctacgtacaggcggcggcggcggcgcatgcaggtgccaatgactcggatttgttaccatctacttcatacagataacaatatgacggattattaacatacaagtcacaaccgacacagtgtcccaagcgcgctgatccataagatcggcgatgacaagtgtattatatattcgtagatcaacgactatgttagccagatagacgacaacttctaggtggtgtcgtgtgttaccgagtgtgaggtgtcgtcgtttgggatagcactccgtcgttcaattaaacggattatgtatgtgcaccttcttgtgtacacggtaagcgcgttcgggcgcgtggtgctgaacttcgtggtcggcaatataacaagagaagagtcggcgcaaaggccggacaaatacatctattcatgcgagaaaataaaacgactagaggcatgatctagcatattaatctcgctgctgctaatttttagaattgattaaatcgataacttatctcgtttaaccgacgtaaagttcgccgatccgcggatgccaatgcatagcgtatcgccgcggatcggcgtgatgacgtccggttgttgaagaatacgatggattggtaagatcgattggtacgtcactacgtgcatcttgcatgctgatccgtgcatgcattgaacgtagagtggatcacacacccatacgcatgtgctttcttggttcatcggctggttgcaatctgcactagtgcatgtgcatgcgtcggcggcttgtacgcgaagcttgcgcgcgagcggcccaggcgccacatctccgtgcgtgactgcgtggacacagcaatctccggcacgagtgccggacgtgcaggcgcctgaccgcggtgcctcgcgcggcggcgcaggcggtagatcagcaagccgacggcggacatgcaaaacaatagatcaatctgtggttagatacgagatcatatagttgtaccgatacatatgcatatgcattagtgaattgaatttggataggtccatatgcgtgggcatgcatgttttgtgcttggcatatggctgctgcaactgcgatctgcgcatgtgtcagatggcttgggggctccagtgccgacgaccggcggggctgctgctccgggctgcctcggtgcgcggctacgtacagaggccatcgtctcggccgacggcagacacatgtataaacacaatagatcaatctaattattacgaaaacaaattgatctagtaaaaacgcttatcggatcagcggaacgagtgaactcgtgctgataacgtgttaaataactagtggcatattcgctgatccggagtagaaaacgacgatctcatgcacacaatcatatagtaaataaacaatgaacacagatatagagagaggcatcacagctttattgctttcttatatatagatacatcaaccaacctctcaagccctctctctctctcagtatatatacccataataggaagagtcttattagtatacgtttacatatatttggtatgagtctatatttatctctggcagaagataatagtttcgtaacataaacgaacctacgaaagcaatccgtcttcgatacacacggtgcttaatttggataacaggcaaaaagattcaatgatgaccagataacgtcgccgccgaataaattattcaagcgataaaacgaatgcagcagcaataatcactgaatcgttttcctctttaaagaggaccattaggttacagcagtaccatactcctaagtggccatgcttgaaaaaaccgatccccaaaaccgattgggttggaattaatagatagaccttattctatttaaaaattaattttacagaaaatcgaaaaagcccatctcataggataatatgcagagggagtttagtaacacattgcctattttccctgttcgtccacaatcgctcgcgtgctgcgcgccatacctgatcgtccacaatcgctcgcgtgccctcctcggtacatatttaacatgtttcgcatattcgatctgttcatgctttacagtctaatctatatttatagatcgtatgatatgattattctagtttacatatgcaatatcatgattatttatgaaataaattaaatcattatgtgcttataaattcaacatattgatggaccacgcgcattgatagactggttccttttgctttcttgccaccttgttcagctattatgtgttgaatccaagtaagggagcaggtcttctgacaacttgatatgcaccttgggaacttcagaaatgacgacaactacacgagcaacaaaacagagctatacaactctaagaaagaaacgataacaatacattaaaacaacaaaataaaacaacagaaacggattcttgaagttatgaaaaaaaaattaaacaatctaaaccgatcaattaggagctcgtatggccgagaaacgaacatccgaattttaggtgcaattcagttaaagcggatatttccaagttgtttaattattattattattattattattattattattattataccgttatattatgtgtaatgcattatcgctcaaggagagagagaatcgaacgactgcaggtctgcagcagagacccatggatcaaatagctagattaccatggaccaggttcccagagatgatccacggagagaactgagtgagaccctacgcgtcaaccgtaacaagtgggagacaagcgggcctcacacgaatgccacacgaatgcacgcatgcggaacaatgtggcggccacaagggcacacgaacatagccaccaaacgtgcacgcgaagactgcatgaacgactattgtcgtcagtgcaagagaccagggccgacaatggcacgactagcacgatggcaacaccgagagggcaaggagggcgccttgagaacaatgtccctccaggtttctactactaataaggccttgttcaatttgaaagggattgaagagaattggaggggattgataggggaataattccacaccacaataggtgtggaataaatccactacaatccctccctcatggggattaaccaaacaaggccctccagtcttcttcgatcccctccaaaccgaacaagacctaactgggtagtagtataaatacatctgaatcctttgattaaataagatcaatggttcagattagtttctactaccagtaaggaggactgtagtgaggctcataacgtaggaggaacaacttgcatgagaaaggtcaggagattttggcacgatctaaaattaaaatttattgtgcatacagcagttactccctcagttccattttaagtgcagccatgattttccgtgcccaattttaatcgtccatcttatttaatttttttggaaaaataaaaacataactcacgcataaagtattattcgtgttttatcatctaataataataaaaatactaatcatattttttttaaataagacgaataattaaagttgtgcatgaaatctaatatttgcacttaaaatggaattgagggagtagttagcaaagaatttttggaagaagtaattaagtgatgtgatgtgagatgtgagtggaggtggtgcctccagtggtgtcatccgtgtgtaacagcgaggagaaagaggaagtggtgatgatgacttgggggtcgagatgagcaaaggggctgacggtgggcgctgcgacgtggtcatgggcctctaacatctgaac

SEQ ID NO: 61731 - DNA, 1299 bp, Oryza sativa
tgtggaagccgaggccctgctcctgttcgtcgaggaagaacaggtagcgctccagcgagcccttgggcatgcactcgtacacaagcgccttgaggtcggcgtcgaagcagaagccgtagagcatgacgaggttgacatgcgacgtcctaccgatggtgccgatctccgccatgaactgctcctctgcgcgcctccccatgtcgctaccaaggaccttcacggccactgccagaccgccggggatctgccctttgtacaccaccccgaaacccccggcgccaagcctctccgcgtagtcgccagtcatttcccgcaactgcggcgagctgaacctcacaggccgctccttgatgacgtcaaccgtcgtcgtggtcagcgcggccacagcacggtcgtcgtcgctcctgggcctgggcggctgcgatgccggtaattccggcggcgagaggccgtacttgcgccacatgcgcagcttgcagcacttgtagatgagaatggcaacaacgatgactactatgccgcctgtgatcacggacactgcaaaacgcaaataataatcaaactatctagctagctagctatatgaatcgatcagatcgatcaaaaaggagctagagctagggaatcgatcaaatgatccatggcgcgtaccgatggctacggcgatgttaccaccagatatgacatctgacgacgacgacgacatgtcgatccaactggtcgagttgatggaagcgcccaggtccagccgtggtaaaataaataaatttctggctatgcaattaccacctagtagaaggtagatggtcgcttattgttcatcatatcatctgacttgtagtaattaccaacgagtgattgattagaacaagtcaaaattggctggctggctagctcgacccaccaccgccagaggatatatatatatgatcggtcgtgttcgtctttgaccagccggcctgtaagcaattaattctgattattactagctagtaccaccaattagcaatcaccatctcgtaattaagttaggagtatttggagaagtagtacatcaacaaagactacatgaaattagtattattaattttcagctatagatcattcgattgattaccaagaacgttagggcttattcgttttaaaggattttttcattcataggattaggaaaaatgaaggaatagagatggttgtggagttcaatcctatgggaagctaaacctcaggaattgaaaaaaaacgtgcattcggatacaccacaggagaagtgtaggaaatctgccatttgaaatatat

SEQ ID NO: 61732 - DNA, 909 bp, Oryza sativa
attcctgcagccctaatagcttcaatggtgacgaccacgtaaaatttttttttctcaaattgtgatcctttgctaacatacgagttaatataggttttgatttttttttcttgtttacacatttaattcacgtatgctttgttcacggtgattaatattcgatggaatttgtcaaaactatttgtgctattgttaacacaatttgaataacaatgacgtttaaaacggggatataatgtagttaagtgtatgtttttttccgaatagtattctctcgtatgtttgttttttcattttcttttaatgaattttatctatcatagagacagggtgtacgtatgtgtattcatagtgtgcgtacgcatgcatttataagagctcatgtgagccttttacatcattggtacaaaagaatacttcaaaaaaattgatggcaagagggtgagcaacgggtggcgtgaggcggcgccatggcgtggcttcttttaccacctcgcttggagtggtcgctacgcgtatgctcaatttgggaaaaaccttatagctggtaagaaaaagaaaactaccaaatgggacatatcatatccacactccttttttttctttttatatacgttgcatacgcatgtacataggagttgtgtatgtatgtaagggaagattagacagcctttaggatagaggaactactgtcatagatctaatttatttgttgaaaataatggatcaccgattttgagtgtaaatcgatggatagatgttttgccttttattattttatttcttatattctctcttattagagggtcatgtgacatcttataagcgtttatatgagtgtaggaacactattactcatagccgcaatctatttatagtcaactattatttgcggtggattggttgcgt

SEQ ID NO: 61733 - DNA, 1639 bp, Oryza sativa
aatttttatattcaccgtaggtgtggaattaatggacgcttgtgattgacgaacggtaaactttggcactgtttattataggggtggaaagttttggtgtgtcacatcgcatatacatgaatacacaattaaagtattaaacgtagtctaataacaaaataaattgcagattttatctgtaaactgcgagacgaatttattatgtctaattaatctgtcattagcaaatgattactgtaacaccacattgtcaaatcatgacgcaattaaacttaaaatatttgtctcgcaatttacacacaatttgtgtaattagtttttttctatatttaatacttcatgcatgtgttaaatatttgatgtgatagggtaaaaagtttctgcgttgatactaaacagggcctttgttgttatgcccaaaggcaggggatgtgaaccccagacaaaagagcactacatttagaatagttcgttcataactttatattgatagtgcggcatgatgcaaaatagcgtattactcctatctatcagtgcatctttacataatatattgtcagtgcatgaaaataaaaaaaagtaatgcttttaaaatgtaaacaacaagagacataattattactccttccatttcatattgtaaacaacttatttaagtttaatcaaatttatagaataatatagtgttaattaccttggacaggtaaatatcccttttcacacagccgagggtacgccaggtacaccctgaacctcgccgcgctgctggtcatcagcgccagcgccggcacgccgagctccctcgccgcggcgagcggcgcgaaccagtcgacgtcggcgaccacgcacgcgacgccgccgccgtcctcctcctcctcctcctgccggagcgcgccggcgaggaggtcacggaacggcgccgcgcagttcctgttcagcgcgaacacgaacgacgggatgtcgccggacgcggccagctccggcgggaggccgtccggcacggtcaccagctcgcacccggcggggaggctccggcggtcgggcgcgcgcgtctccgtgtggacgacggtgacggcgaggccgcggtcgtgcagcgcggcggcgaggcggagcatggggttgatgtggccgtggtatggcagcgggagcagcagcacgcggcggcggccttcgtggccattccggtcgcttgcaggcgccatggcatcgagatgtgtgtgactgagacgcatgagtccatttatgacacaaatgcgtgcgtactttcatagggttttttttttcttttcttttcctttttcttgtggaaagcgtatttaatttgatagtttgtgggtgatgagtccgcacggcaacattttggcagtgtccagcattcctgttcccggggccaccacatccacatggccattctgtaaagacaaaaaaagaggaaagattcttttttcttacaattttcgagattttatttgaacgagacgacataagacagcggccatgtcatacgcatgagggtgactattggaacgattttggaatatagtgcaaatttttaatgctaagatccacacaatcttgataagaatgtgagatttaggggctgtttggttgctaccctgagagaaattgcctgacctaa

SEQ ID NO: 61734 - DNA, 1744 bp, Oryza sativa
catgggaagaagaaagtgagagatggagggttcaaatgatccaacgtgcaacaaaagatattatacctagcccaaactgaaaattttcttgtgatggtccaaggtgaaaccttcgtagcataggtagatcaatgtactatttactcttatatttatagtaggcactgaaatatgtctttgtaatccaggtatatcatttcctatgacaagcgtagctagccttaatgaatatatacatgactcatttttataagtttttaatagctatagctctcaaaatctttagcttccgtaaatagtctagatttttaactagattctaccggttagtagttagaaaatccatcaaataaaataaaagtcaaaagctagaaaacttagtactccctctagttttttttgtttgacgttgccgaccggttcgattaaattaaggaagctgtgaattgacttgtttgccttcacccttatccctttgcactgatacgtttcatccatgcaggggggaagaggggaaatttgcgtacgggaggagggcttctgaactgcgagcgtcaaacaaataaacccttttgagtatgaactggaacgtcaaacgaaaaaaatgggagggagtattttcatattcggaccagctaactactcgttagctatctctcaaaatatcaagctacctaaacagagctatagcatgctattcgcttataagattgattttgaaaaggcttatgacaaagttaaatggccttttgtacaacaaacattaagaatgaaaggcttctctcctaaatagtgtgagtagatagcgtcttttattcaaggtggccatgttggtataaaagttaatgatcaaattggtaataattttcaaacttacaaaggtcttaggcaggggatcctttatctcctattctttttattattgtagctgatatgcttgctttattaattaagatggctaaagaggcggaacttttgaatggggtaattcctcaccttgttgatgatgatttgtctatcttgcaatatgctgatgataccattatctttttggagcatgatttgcaacaggtaaagaatctgaaattgattctatctgtatttgaaaagttatctggcttaaaaataaattttccaagagtgaattattttgttttggctaggcgaaggaatgttatgatcaatattctaatatctttggttgtaaattaggttcttttcctgtcaaatatctaggaattccaatgcattttaggaagctttctaataaagatcggaaaggtattgaagaaagaattgagaaaaagcttagtagttggaaaggcaagcatctgtctgttggtggtagattggttttgattaattctgtacttttgagtttacccatgttaatgatattttttttgagataccaaaagaggttcttcgaaaattgattattatagatcgaggttcttttggcaagaggatgatcacaagaaaaagtacaggctcacgagatgggatattgccaacccaaggaccaaggggttcttgggattcataatttggaaattcataataaatgtcttttaagtaaatggttttttaagctaattaatgaggaaggggtttggcaagacttattgaagagaaaatatctttataataagtctataactcaggttgaaaagaaacagggtgactcccatttttggtttggacttatgaatgttaaaagtactttcttaaatatgggttcctg

SEQ ID NO: 61735 - DNA, 1247 bp, Oryza sativa
ttttggttttaaccttccttctagcatatctcatatttttgatgggtggcttttgggtgttgacaagaaaaagagtaaactgatacttgtgaaagcttctgccatttgttgggcaatatgtctaagtaggaatgatatggtatttgataaatcaccgtcaatttcctatatgcaggtcattttcagggcacagttagaaagatgtgatgaagatggagagttactaaaagttacatgttgcaagttggagactacgattatgcaacttttttgccaactatggatggagattcacaaatagactacaataaatatgttctccttatgtcagttttggttttcctttatccttgtttggtgtgttctagttgtttagatctacactcttttctcgagcacttccttataataattgtctgtagctctctttgagcaaaggccgagataatatattccattatctaaaaaaaaattcatcctttcttcattccttctgtgcagccctttcctccagcgggggccaaccggcgagctcaagctcactcaagcatcggtggagtggcaacagaggtggcaggtggtggctggcctagggctcctccctcaaccaaatttagcacctaaagttagagcattgccaaaatttggaaagcgacagatttccttcatggggccggtctgatcaccgcctatgggacagtgtaactagcacatagggttggtctgactggtggcatgtgaccggtcggacttgcagagtctgagtccaagccgattgtcatcatgtctcgggtgtcacgccctgataaatccatcccatattaaaaatcacttcctaaaaggaataatagaaattattaaaagcttaaaagaaaactcaaacactaaaatacatccaagaaaaaaattaatttgagctttggattatttttattaaattctcaatgctctaagaaaaaatcacatgacagacatgtagctaaaacgaaatgagaaaactaaaaataatcctctccctctcttttgaccgaatccggcccaaagagctctcctcctctttcggcccgccgatggagtcctcttctattccctccctcttcctctacctctccctcccgggcctctctctccctcttgggctgcagccagtcagccacctcggcctaattccccttcctctcccacgtactgaagtgcgttttatgtcctcccgatggtcacctcacctctttcctcttgggacgtat

SEQ ID NO: 61736 - DNA, 1789 bp, Oryza sativa
acacaacgtctcgtacggttgtagtcggatcgtcaacgtttctcccaaatcatagttctcacaactcaccgaaagatcgggccaacaacagccttgagtgtcgagaggacctcagggttcatcaaaggtatcgctgatcggctagaggcatcatcactagatagtttggtggttgattgtggctcaattaggactcggctacacaaaattcaggctctgatcccagaggagttagccgatatccttactctagctgtttaccttgagcaacatcaattcaaactagagaaagctaagttaagactggccgaatggcgagagcgcaaggacaatgaagccactatccaagctaatcggcaactggtgcatgaagagaaatccaagcttgatcaacaatctgaaggcccaatcaaatctaacattgatcggctcgaggctcgcaagattgaactcttagcacaacttgaagaatgcaacgctgagctggatatagaacacaaaaaactagccgatctcccaaagtctatcaaagagcagaaagcaagactcaaatcggctatcaagcatgtcgctgatctgaccaagtctctgaagatcatccctagaaccgatgcttaagacgctcaagccattgaagaagtagagcagattaggcaaaaagctgtatcggctatccagcgctatctttctcaataactttcatgtattaggctttaggaaattttgtaaccggcaaagatacttctaagtatatcttgataatcttttgtgccgatacatgtataaaacatcctaatttgcttaaatttatcaaaatttgcaacttatggatatatgtgcccccctaattttacgatgccacaagtagtgataaaattaaattgtgaactaagggcgatacaacaatatcggccattgtacatcggcaaaccacaaccgattacattataaaaaacaactaaaggcgatataacaatatcggccatctcaaggcgatgtaaacacatcggctgtcatacatcgacaatactagccgatgtcgcgtctcaaaacgactttaaaatacatcctcgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattaagaagaaataaacaatgttaaaaaggttttataaaaagaaaagctctaaaaagtcctttttcccccctcaccctcttgggccggctcggcccatctctctccctctctctcctcttccccgcggcccattcggcctcctccccgcgcgcgcgccgctgacgggcgggcccgcccgccaccctcgctgacgggtggggcccacccgtcattcccttcctcccgccgctcccgccgcccgcgccctagcgccgccgccgccgccgcgaatcccgccgcccccgtccgccccgcgtgcaatcaagaggttggaaatattccccgggatcccctccccctttcccctcatttttccctctctctctccctcggattcgtttggaaactttccccctaacctcgccggcgccattaatggcggccaggactcccgcgcctgtttccccctcctccggccaccccctccctctcttaaccctatataaacccctccccgtgcctccctccacccgttccgccactcgccgctctctctgcccgccggaatcgagctcgcg

SEQ ID NO: 61737 - DNA, 3028 bp, Oryza sativa
cccagagctaaaagttgcgcagcaaacgtgggagccgatgctggtgtcgtcggctgcggtggcgacggaatgggaggagctgcctgaatagacggctgagcatcagtgatcaaaggccgataatttgggaagacacctccttgtaaatacactgggcctgcagcctgatgctcagctatgaaccatcggctattgacttcatcatatttgacaaagtgttaaccaacaccccggactgatcgatcaaagcattgtgaacagcatagtcaacccggtcttggaaattgttaaaaaagtcttgtgccacttcactattctgattaagattccctccttgtggcccctgagcaccgtcactctgaactccatgaactccttgagacatgtcaccttgatttcctaaagagccatcggtagcacctttgatactcggctgagctgagccgtctggagcttgttttccttctccatctttagaagaaccggtcccaggatcatcagcaaccactcctatcttgtacttttgaacaagtgtccccttgcgggtctgcataaatgagttcaaaaactgatcccgtgtttgctgcaacgttgcttcaaactctttcttctgttcgggtgtgaacttttctggatcgattggcatgacgttcttttcaatgatgtcatccaatcccgactttgacgccttgtttttagcagaacctgggctagatggtggtggaggttgtttctcggccatgagggagaggttgtctgacttcttgagtgtcctaccgggcgtgccaaaagcgtgttgacagaaaacacgagacctgggagatctgcttaactccagtgcaggtccaaagctcgccttcgaatgtataagcgtgccagttgatttgatcctacaatcaacaagaaacaaagacaaacaaaccgtagttaaatctataaatgatagccgatcggctgtttgccaatgacatatcatttatctctgagccgatgtcgtatgtgaatcgatcggcgatcatcaataagtaacaaaacaccaaatctactagatcggctgtagatatcaataatatataatctttatatcaatatacacttaaatcaagtgattggagtagatcggtcaccataccgagacagtataaatcacttaaatcaaaatatatattaataacgagattatatatatgtttgtagcatggctgatcaaatagatctagcatgtatcggctaatactccgatactgctttatattaagatattgaagcagataaaatactcaagcagatgcttaatatacttagatgtgacaagatcttaatataaagggcagatttaacatgtcaatgaagcatataaagcaaatattgtcaaatcagatcagatcggctgaaactccgatactaccctaatcggcaaccagaaggcaggctagagattgtaattctaagcacgacttaatagatcaaactcaactgatgcagcattaagtatgaaaaggacaatatctagacaatcaaaccgctggatgtttcatagggtggtagatatcttatataatctgaatcaacattgaaatctaacctaatcggttgccttccttgatagatgttagccgattgtaggttagatgacgatattgccagagattacgtaagatatatgataactcgacgaatcacataaacaagattacagtatcgtaaagatggaagtacaaatcccgagaacgcaagttatcataacaagttttacctcttgttgaagatcaaaccgatgcagctcaacccgaaagcaagaactcgtcgaaataaaattaaagcaaaaggtggcgatgcgccaaaattgtattgaacgtgtgtgttaaaaattacataggtctcggggtctatttatacccaagaattacaagatatgcccataccggacacgactgttatctctaacaaactctaagatatcataagtctttgcggaagacttttgcccacatttatctataaggaatttacataaaatatcctaattaatagatacaattgcctttccaggactctatccgtgcgtggcaatcatattgaagtacattaatttgaacccaatgtcgtatacaagtcgtattgtcggaatcggctgaatcacttaacccaatctgactcagacttagccgatcctaaccgtagccgatctagactccagccgatactcattctgtttccacgacaatcctcatcttcgattccacttcgatcccatcttcctctccgatgctgacactaccaaatatggttgttaaccaacaggagggggaggggtttcgccttctttactgccgccatgcttgtatggaggagctctctacagcaaaaaggaggagggcaagggggaaaggaggggcgaaataaaaggcagaggaggaatacgaagaatttttttgagaattaatattatttttatggaaaatcgcaaaagtagtggccaaccggggaaaatcgcgaaagtaggtccatgtcgaacgggtgtagttcgatagggcacctatcgaacgacgggcagtcgacaaagccctttcgaacggctggcgttcgacaagctcacctgtcgaacggagggagttcaacagggcccaccacccggcgccgcgaggcctgtcgaaccgggggcgttcgacaagaccctccaccgaccctgtcgaacaatgggcattcgacaggccggtttaaagccccgtccacccaggccgcgatgcttgttcgatttgtttgaggaccacatcgccagccgccgccgagagtcgccacatcgtcgccgtgagcgccggagggagcgaggggagggatagcaggccggagaggaggccgaggaggcgccggccgggaggaaagggttggcgacaccctcctgcagtgaagttaaggtatacattagtaatccctaagtacaatgcatatgaaagtttaataaaaaattggtttaagagttgttaattgtttcgcattgttcgatgttagtatgggctgcaggaat

SEQ ID NO: 61738 - DNA, 2559 bp, Oryza sativa
tatttggattattaaactagttgttgtgttactaatagttgtaaattagtacacggcaatgtagtataagttgtaatagggtaattatcgaatgattaaatgattaaacgtgaaactatttgttatgttttatcaggatgtcaggtgatatgcccattcgtctgtattatggcgatgctcctatacaaatatgtgatagcggggtggatttgactgtatatgccttccatgatactagtctgaatgcaccggagcatatgcgtttgaacgacgtgttagggtggttgtataatatgtttggggtagatccagtgcacgataaatttgtcataaatgccgtctgaccagtgaggggtcaacatggatggcactggagagtagtggaggttgcgtcaactgggagttggagaaagtttgttagtaaagtaagggagaaaggctatagcctggcaatactggtgcagaagacaacatgtgttgatcgatcgggggagtcaagtcatgccgtggtggaagaaactccattggaaggtggacaagctgaaaatgtttggcggactgagcaaggtcgaggggaagaagtagtagagggtaatacacaaggagaggtcattgttcgtggtactaatcgtgaggccaacgactcggacgatgaagaaccggattcgcctatgcgtgttgatgcagcggaggagaatgaggcggtagtggatcagatggaagtggaaaacgaggaatacattgcgcttgtagtggaaggagaagatacaacactgtgggacaacgaaactaacatacccgatgattggacgaccatatcaatgagtcgtatgaaggtaaacgatggtttagatgcctactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtagcttcgagggttgagcaacatacgtgtttgttggagaatacccatctggtgcacagaaacctgacagcggcatttgtggcacaaatggtatattcaaaggtggttagaaaaacatctttgtcccctttcaccataatgcatgacgttgagaaagagtacggatctgagatatcgtacgacaaggcttggagggcaaaacagaaagcattggagatgtggtttggaacttatgaggattcttatcacaatcttcccccactattagaggtgaagcaggtactccagaaaggggctcgggctttcctacgagctagttattgtgaccacggttcagccgatggtacaagagtgggagcacgcagctgataacttggcacttcagacacctccagacgatgggagttattatggagcttaccttcgttggtaccgcagtgttacacgatggaggtgttttcctccacaaagagatagcaccgtcccccaccaggcagcgattactgacacgtttgcccctcagcctagatcagcttacaactcaatggtacgtgtttatttgtggaatttgagcaactagttcaattttttaaaaaagttagcaagtagttcagtatgtctaataaatgtgcaattggttcaactagttccttttcttacataaatgtggaactagttcagtatttaaaatgatgtgcaactggttcattatttctaacaaatgtgcatcttgttaaatactcttaataaatatgcaaatggttaaataattttaattgccttgattatttgtggaacaggccgaatttgttgagcacgttcacgtggagtccgacaccctgctgcaaagactagaggcgagacctccagtcgtcaggcctgacgacgtggcgagagtccttcgcaacttccgtgcacgtgctgccgcactactacgtcgtgtctcctatcggagcgcggcagatgtggtgcagacgtcgggccgacggccatcaccaccactaccccgacgttccagcgtggatcggagtggtccatcctcttcacgtcgcgggtacgaagcagcccacacatctcacgatcgtccttcctttcagctcaccccagcaccggagtacaccagggggtcagctggatcaggggtacccacgtcgagcacggcaccaccacgtccgcaggtattccaaactccgccttatgttcaacccacgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtgcaaacagacgatgagtacggttcggcgtcgacgcatcacggaatgcctgcttactcccctcgcacag

SEQ ID NO: 61739 - DNA, 1856 bp, Oryza sativa
cgcgattcagtcatgcatgctgctgagaacggtgcacacgtacggcaggaccagaaacagcgttctggtcatccacatgcatgcaatgcatggtttatcactctgttttttaaagtgcaaaatagcatgggagtgtcctactggctacagtgcgcatatattgttggtgtggaaatgcagaaatttgagttgcacgttagtggcttcattccctcgtgcattagttttttcacatggtcttcaatattatatgttgattattaaactttttctttatatattaacaactaattaagaaactaatatcatacgaaaatatttttgcaaatacaattacagtgattatatgcatgacattaaaaatatacttcctatattccaaaatataagtctaaatatttatttaggatgttcaattttgaattttgaccaactactaatccaataatatttactatctatattaaaaaatacatgcaactaaatggaggaaggttgtaatttgttgagaataaaatgtaggtgaagaagtttaaatatttttgataaatatattgtttattttttatggttcgagcgtgaaatagtgtaaaacaaatttgtgccaaagcttttttttgacagtcaacatatacactaatcttgcctagcggtgcggatctagtccgccctgccaccggcacaacatttcttaacctatgcttcttgtcgccccctgtccagctatgaacatggagagggaggattaggggagccggctcggctcggctccgctcgctttagctcgttaggataacgagctggctcagcttggctcgttatcctaacgagctagaagcccagctcggctcagctcgtttgaaagctcgagctagctcgttaggctcgcaagctagagctagtatgcaacagagaagtagagaacgcagcagcaagatgaaatggctccaaaattatctgagaaattatcaaaagatataagaaaaagtctacaatctcccatcaagaaactctaacacaacaacaccgaaatctttcaccgcgaaaagcaaaatcagaaaagcctcctactgtgacagagaagtagagagcagaaagcatcctttcgtttcttcatgcttcatcatccatggtcatgactgacaaggatgcatggccgatggcaacacaggatggagacagggagcagcgctggtgcggcatggagcggcgccggtgcggtagggcgtggcgagggatggacgcaggggagtagcagcgcggaggcgtggaggcgcggaggcgtggaggcgcggagcagccgacggctactcgatctggtgcaggaagcggcgccggtgcggcagggcgtggcgagggatggacgcagggagtagcagcgcggaggcgcgaaggctcagagcggccgacggcgactcgatctggattggagtttggagatagatgagaggaaggggaagcgatacttttctgttcggtagacgcatgcacgggggactaatgtacttggcctgtcatggggatttatatctatgtgtaagctcgttaaggctcgcgagctgctcgcgagccagctcgaactagctcgttatgcctaatgagctgaaactacagctcggctcgtttcaaaaccgtaacgcgccgagtcgattcgagccgagctcgtcacgagccgagcgagctaacgagccacgagcttttcgtccagccctagggaggatctagcccacactcagccatacaacccactgtgccaccagctgttacaaaactctcggtcttgccactagcacgcctacctgctgttgcgctgagtgccattgccataactggttgcgaaagcaggaaaggaggat

SEQ ID NO: 61740 - DNA, 3714 bp, Oryza sativa
tctcatacggactcgaaatcaggcaaataatatatgcacggacatctacagaaaaagttacatccaattctcccccgctttgccgggttcggcgatattaaaaactccaaattccacttgcaagattgtgttttcgaggagagaagtttttcggtggagctttggaaaattccatatgccacatatttcgtccgtttgagtttattttttacatggttggttcctatgagttcctaagtgtgaaaaaaatatcaaaaaaataaaataaaaataaaaaagttgcacatctctctcctctgcactagttcggagagaggagaggagaggaaaaattctacatgtcacatattacgttcatttgagttcaatttttctatggttggttcttgtgtgtccctaagcgtgaaaaaaatatcaaacaaataaaacaaaaataaaaaatttcaggggggggcgccagccactctggcgcactccccctagccacctcagcatcgccccgccacgtcagcagggggacggcgccaaagaggctgacgccgtcctgttgaacgacggcgccagccactctggcgccccaaaaaggaccatttttgggataagtttttctaagggtctacttgcgaaataagtttttcaaaaggaccaaaatgtgaaaaatccaggactttcaacatcagatggactatgcttcaggacatgacactattagctagttcctagcaagcttgctgcttgtatgcaggacttgtgagaagctccgtaggagccacactgttagggaccggcgtcgtccccgccactccggtcagatgggatccagcccaagccactaacctgtactcttttagacctaggttaatgggctttgtgctgtatcttgagacctcgaagaatataggaaaaagtacatcgaaggtccctcaatttatcattgggataaaaaaaacatcctcgaaccgtaaaaccaaatgagaaaaactatataacgggatcccgtcacacgggatcaagtctcaaatcgtgtcgtgacacaaacagctctatggcctttaggcccgcctccgtttccgctctctcgaagtatatgcgtctggtacatatgccgcagtagggtcatgcatagtggggtccatgcacttagtgaatatgtgcatgcatgcacaatggcaggcccaacaaccagtcaagtcctcttgtatgacagcatagaagaactaggcttttcctgggatccgcgtgtgcagctggtaaccggtgaaccagtgcatgcatcatcaaaagtacaagtacatataactagagtatatttatactttagaagtatcaccatcgatagttacatctatcatattttttatttaggccggtatcattataagtgcctaaaagtatcaacacctcaacttaggaggtatcaccattagcaactgcattgctatttgtggtaccatcaaaaaactctaatgatacctggtacctatatgatatcaaataaaacccggtacgatggtacctatgaatcagagttggtatcttattttttatttaggcaggtatcatcataagtgcctacaagtatcaacacctcagcttaggaggtatcaccactagaacctgcattgtcatttgtgataccatcacaaaaattctaatgatacctggtacctatatgatatcagataaaacccggtacaatggtacctatgaatcagagttggtatcatattttttatttaggcaggtatcatcataagtgcctacaagtatcaacacctgtcacgtcccaaaacgactctaaaatacatcctctaaatgatgcctagaataattaaaatccgtatgaaagcctccaaaaattaaaatgtgcaaagttaaaagtcaaataaggcttggaggatttttgaatatttcctaaaagcctaaaatgtgtaaataaattttagtggaattttcagagcacaaataataattaagaagaaataaacaaagttaaaatgattttataaaaagaaaaaccctaaaatccctccttctctctgatgggccgaattcggcccatctccctctctctcctctccccgcggaccattcggcctccctccccgcgggcgcgccgctgacgggcgggcccgcccgccaccctcgctgacgggtggggcccacccgtcatccctgacctcccgccgctcccgccgcctcgcccgtgccctagcgccgccgctgccgcgaatcccgccgcctcccgtcgtccccgcgtgcaataaagtggggggaaatattccccgtgatcccgtcttcctttccccccatttttccctctctctctcgcattcaaacggacggatttgcccccgcaaatctcgccggcgccattgatggcggccggacctcccgcgcctattccttcccctccggccgccctctcccccttccaaccctatataaaccctccccgtgcctcctccgtccgtttccgcctctcgccgcccttcctcctcgccggattcgagctcgcgacgtcgccctctctctccaccgttgccgccgagctccggtccgccgccgtcgccgccccggaccgtctcccgccccggcgtctcctcctccggtttcgccgcaccgccggcgaccccgtccaccccctcgccgagtccgccaaccgccggaacgccgaccctgtcgacccgagccgcgccggcgccttcctccgctccggccgcctttttcgtcgtcgccgtcgacctagggtgagccgtggaccgccgcctcttttcccccttcccttcccctctctcggccgtcgctccgccgtgcctatggccgccgccggcgacaatagaggcgcgggcgccgcctcccgccggccgcgccgagtggccgccctcgggcacgccgagtggccgccgcatggggcccggccgtcagccgctcgcgccctcaggtgcggctgacgcgtggggcccacggcgccggccggtgcgagcccgggtgcgcccggtccaccgtggacggtgaggctgccgcgtgggccccactcccgtggacccggtccgcgcgcccctcccctcggctgacgcaataaatcctttttaaattaaaattttaaatgaagaaattcgcaaatattcatttaaggagcatataaacttcaaatggccataacttggccatttaaactcggaattggaccgttcaagtctctaacttttccttaagaagtcaagaacccatttttgtgctttgttcctgcttgttatatggagtttattagagtaaaagcctttttgtttccgttggtcgtgtagacactgcggcttcggaagatccgctcttcgtggaggttgaagccgacgtttgggaaagcgagcaaggcaagtcacatcatccttgaacatattggatcccattttataaaattattttgatttaaattattgcattattgcattattgctttacttaaattcccgcgttatcactgttttatttagccatgcctatttacctttgttatgaccttattattattgttattgatattattaccttgttcaccctagattaaacaaaaccccaactagtgggcactctacccatggtaccactagtatgaatttaggtagatgcttcgctggttaattaggcaacattaggtggttttacaactctagactttgggaatattcatgtcacctggacactatggaatgg

SEQ ID NO: 61741 - DNA, 2538 bp, Oryza sativa
acacgtgaggaagatgtgtcttgtgggtaaagttgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatcttgtatagctctaggatcgtatttacaaaatagctttgagcaactaagtgtcttttaatgctgtttactgcaaaccctaaccccccataatatgggtgtgtcttgttgagtacggtggttgtactcagtcttgctcaatttttcccaaacccagaagaggagcccctggatgttgaaggctttggtgtctagctcgtgcctgccatcaagcgcctgtggtcgtcgccctagtcttccgctgtttcccgtttgtctttgtgtgtgctgggccttcgccgcccatgtaataaattaattaattacgcttccgcttgttaaactctgaattgtatcaacttttggtgtaccttgcctcctgggacaaggaataatgcacgcacgtaaggaacgcccgttgggttatttccggtcgtgacaacacctcagcttaggaggtataaccactagcaactgcattgttatttgtgataccatcacaaaaactctaataatacctagtacctatatgatatcagataaaacccagtacaatggtacctatgaatcagagttggtatcattttttttatttaggcaggtatcaacataagtgcctacaagtatcaacacctcagcttaggaggtatcaccactagcaactacattgctatttgtgataccatcacaaaaactctaatgatacctatacctatatggtatcagataaaacccggtacgatggtacctatgaattagagttggtatcatatttttttatttaggcaggtctcatcataagtgcctacaagtatcatcacctcagcttaggaggtatcacagctagcaactgcattgctatttgtgataccatcacaaaaactctaatgatacctggtacctatatggtatcagataagactcgatacaatggtacctgacggagcgtggggctcctcaccgggagaccgcgcaggcccccctttgccggttcggccggggaccctgggtgaggttctaagctcttggtttgaggaaggttcgcgagagtggaagaagcacacaagacacgggcgatgtatacaggttcgggccgctgagaagcgtaataccctacaaagtgttttggtggatctgtgtatgaagaagctacaaagtgcgaaccagccccgatcgctctgggatcgttcggtccttttttttttttctctcgtccgatccccctctctaagtgggcaaggtcctccttttatatcccaaggggataccacatgcaccatctctctcttttgtgtggggacttatcctatcttttcataaatggacggagatttgtatggttgccgtctgaatgaccttctgatgggacggcccatacctacctccacttccgccggaaacaggcgcgacgtgggaacatggctgtctgctgacgacatgaccagtgtcagaccggtctcaaatcggtcattcttgtccaccacgcgtcagtttatcaatctgcatgttcgcccttcttcatacaatatcttgcttgtaatggttaggatgaagcctggcatatatctgaccgggacccacgtgccatctccaggaggtaacacgccggctccggctagggacgagtgcttggaagctctcatcttgacgggatggggcgaggcgtgtgtcagaccgcctgtcgccacctaatccacgatctgatcggtctgtgactggtcacagaccggataaacgagcgcgctgcactgcgttacatgcggcgtgacgcgcttgaccaaaccgcaataaatgcggttaggtgagccccgctgcgcttgcctaacccagacacgcggcgcaaaacccccaaggggtcggggcgcctcagccctcggggccgaaacgggagcggtccgacccctcggggagacataaaggggggcggccacatcaccctcgggcccgacccccccgagggggtcaggcctcgtgggtgattgctcctgcccaagcctctagtcatgatactcccggtcccatgtcaccgacagtacctatgaaccagagttggtaccaataggtatcggactcgatagtctaatactgataagtatcagatctaatacacatatctatgagatttggtaccattaaagtatgtgaattagtacccattagtacccatatagttagattagatctgatacatcgatatcatccctggtaccaatggtatcggattggtagttctagtactttagggtaccagttcctagtaccgttagctttgccacctattt

SEQ ID NO: 61742 - DNA, 7135 bp, Oryza sativa
  unsure (1)..(7135): unsure at all n locations
cggtttgccgtcgatggaggtagtgctgcggcttgccggcgatggtggtggcgccgtcgccggcgggctcggcatccatgatggtctcgaaggcgccgaggagcgccttcaccctgctgcactgccgcttctccagcagcttgctccgcgcctcctcgatcacgtcgttgctccaccacgccatctcccaccggcgaggctgctcctcctccaacctcttctccatcgccgtcttcaccctgctccccttgaccttctccgggatgacctccagcagatcttgccttgcaccgccgctgccgccatggacgtcgtcgtcggtggtagtgatcccatccaaggaacgcatgctcaccgactcggagaccttgccgttaaccgaggccgactggccgagttgtcgccgccgacgtcgtccttgctattcctccggcgagatgacttgctgctgccgctgcggcggaacgcgcgctgcatgagcttcctcggcgacagcatcgacgagtagtacgacagcgagggcgacggctgcatggctgcttggctgccgccttgtccttgtgggtggtggccggcggcggcaactcgtcgtcagtcctgaccgtcatgcagctgatgcctcaaaccgggcatgaaccaatacagagaatatatacggctggttaaggatgttgagctaatttcctaatacaaagggatactgacgctaacatgtggggcccgcatgagtcccatactgattcagccgacacataaactaaaaccggcgtcaaaaccaccaaaagacgttgggtgatctgttttgtatagttaagggaccctgtatatctggttttacggttcgaggatgttttttatgccgataacaaactgagggaccttcggtgtacttttcccaagaatatatggtcttttggtaccgatggatttcatcataggctatcattaactgatctaatacaacctggcccaatgggccacatgagatcggggcctgacccgatgaacccgctgggcagaatttgttgaatctgcatacaaacatccatccatccaggcacgcattaggcattaaaatagatgaaatgattaatgtctacaagtatatcattttatggacgtaactacacagctagtagctgatttgtctaaatcagctaccactttatctataagagacaccatctacctatacttcaaatacaattttctcttaaattactcatccgatctacgatccgattacaccgttgtgttcgtaagaattaaatctttacaacaagatctcacatcattatattttgataaaaaatcacaaattacttttatgatatgtctaaattacttttagatttcactaagttacttcttagatataaaagtaaattcagtaaagcctaaaagtaatttacatatattataaaagtaacttagaacaaaacgaaggtaactttagtttagagccgtcagagccgctggttctgttcaccggttttggttgatcatttaggcgatcccgtgtcatgtagaattgactcgttgagtcggtatctcgtgaggctcgcttgccagatcaattcaagccatcaaatcttagtcaactctcggtcgagattaatctcagccgctcaaaatcgatataaatcccctccttttcaatggcatattattcctttttaatatatatcatctaccaaatatgatctaatcttttccggaggttgctttaatcttttatctccgttataaatcatttgtaaatgatttaattaatttggaatagtcttttctttaataggtttaattggaattaaatcttgtaaaatttgtaattaattcataagaaatcggaatgaggtcgttcaagtctctaaattcatctaaatgtactgtttatttagtttttattagtctttttcctcgttttgcatgttagctcgtcgtttccgtcgtttcgaaggttcgcaagtgcgtcggaagtattcaagaagattaattgaaaaccgattattgcaaggcaagtcacacagatcccaaacacaattcctttgagcatgttgatcctatatttaaattctctatttatttcaactgtgcatttattttcgaatgtcaccgggtggtgtgaacctattcctttggtatggccactttgtattgattaccctattcttcgatacctttggttttaattggactagttgtacttatataatggttcaactagatgtattagacataattgcttagccacgcttagaaacattagcacgcaattaggataactaatgtttcactattacttaatgatgggtatttgatgatagctcacgatggttaatcgtgattggttaattaattaatttgccaactaaaacttgataatggtgggttgtgggcacatggttttgatggtcgtgctcatgacaattaaggaccagttcacgagtttcgattgtgaaacattaaacgtgccaaccacaagccagcatgggcaacggctttaccttctgtatagcatggttcattgcggagcaccagactgagaagtggtggagataagcccacgggggtcgctggggagtccatgccttgtttgtaagggggtgattatgatccaggaacggtgcgctgtggtggattgtgttgtgcgaggggtactgtcacagctcctttctgagatacccgtggtggtatcgaggcgcatggtgacatgttgtggagctgtgtcttgtgggtacagtggtacacctctggccagagtaaaactattcgaatagccgtgcccgcggttatgggcgggtctaacaatgtctttcgtgattagtctcacacttcttaccataataaatgatgctataattggtaatactttgattagctcctggtttggaatggtacattcctggtttggagatagatccgtacagccgggtatgattgttcaggatggttggacctgtgcagcatgggtgtgttgttcagtgttgattaatattgatgattaattattctactgttttacaattctcaaatgtttgttaaatgccgttttcgcaaatgaaccctatattatgccattctttggtatccttgtgcacttgtatatttgttgtgtggcttgctgagtatgtcatatgctcaccttgcaataatcaatcaaacctcagtggaagaaaaaggatccagaataagaagacgtttggcttatacctcatttgagctgcctgtgggagtggagccggagcttcgctagaccgtaattctgctgctgtttttcttttcttttgtaagtatgtaacgttattattatgatgaatctgtatattatattgtcagtttgtgtacctcggctgattcctagacgaggatgtaatgcacaaataagttcggaaattactagtgaatttttgggcgtgacaaatatttcccctacttacttaattaatggattagtactacagtaaagtaagattcttcaagctaacacatatctagattctggataggcgtcgcttgttatgactaaatcaagagtggtctcgaattagattttgcgcatttttatctattcacatcatccaacctctccttcagaaaatgtgagagcttcacacacaaatgggagatcaaccgtatgagggtaattcactactctattttataatttccctcacaaaccgactggttcttgcatgcgtggatctacctgaactcttttttttttttttgagaaactacctgaactcttttattgcacctagtctaataatggactttgtattatatcgtgatgggctatcattagcggatcttatactatttggccccatgggtcacggagtttggccccggataccccaaattagtcccataaaataaaataggttataataatctcaaactaacaagtggatgaaataatcaaaattcctttgttaatgaaagaaaaaaagagaactgtttcattcctattaacatacccggatggaacatatatactgaattgctatatggaattcgatagaaatttctggatgaaatcttacagattttatatcgttggatccatgccaagattcgtacatcgcttcttctcctccaactctggcgagctccccttcttctccggcgctggcgacacccccaacaccagcagggagcatacaggtatgggtttggggttgggattagggtaggaggggttaggggaggaggaagtgggggggttggccgtgggcggtggaggactgacagtgggtggtggacccgggcaggtggcgaggcgttggcagcggtgtcgaagacatgaggttggcagcaggtcgagggccagccttggcggcaggggaaaatacccagactggttaggagacggaggctgggtggtggcaaatctggtggctgggagccataggagatagggaggacggcggggcgggggcactcaccttagggaagagaagggcggaggtggagaaagccggtgccgttgacaccttccgaccagccggcgaggctgggcagcggcgcggcgaggcgacagggtggcggcccggcaactgcgtgcaggatgcagaggcggaggagagctcgcacacgctcgtgcaaaatggtggtggcgacggcgggcaaactgagaagagtcggattggaaaaatggttatggctattgacaatcgatcgagacgatcgatggatggtgtagcgggaggactcatcatatccttgcctccacggaaggggtgccatggatgtcctgccgcctgatggcgtttccatgggatcctttgacgacggcatggtacaagacgatgccacacgcctgatggattgcatcgtcgcctccaactcgccttagagccaaatcagctttgttccctccggataaaccgtagatagcgcaggcttatcgatctgggctagcgagaagtatttagaattaaatttaaaaatatattgttcttttaattttttctcatgaatattcgggatgtaaaattttttgtgtaaatataccttcgatctcgcacaaccgttgcgcgaaaccgagattggtgtgacgtcatgggcggtaccgcgcgttgaaagtgcgagaacgcgcggtctagcgcgacgaaggcacgagagcgcgcggtttcgcgcaatgaaagagcgagaccgttcggtctcgcggaatcaaattgcgtaaatgtccacaggctccatttaattagtgcttaattacttaattagcaattaactaataataattagcaactaattatcctaattagcgattaattaataattaattaattgtaattaattaatcgctaatcaagataattagtcgctaattgaatcagcatggcaccggtctcgctcagtgcttgcgcgagaccgttctgtctcgctgcgccattccgcgagacccgttgttccgcgagaccgcgcggtctcgcgccttcgccgtgcgataccgtccacgacgtcattcccacgtcattctcgcgcaacggttgtgcgagattgacggtatatttacgcaaaaaattttacatcccgaatatttataagaaaaaattaaataaacagtatatttttaaatttaattcgaagtatttatacgcgagatcattagtattcctgttttcccattacaatgcgaaactttttctcgttcaaagcggatccgcctagtggatccggtaacaagcttcatcgaggcttgcagcgatggacggtagatggaaccgggagtacgtactcttgagggtacagaatcattttcatatcttaatcttaactaattaaaagattcatatttttccgttcgtcactttcccgtttcatccgtttttcgttcgtcacttcagccgcgatcacccgtcgctcctcctaaactctttttcatcctcagaatcggattaagaaaaccaagtcataacaacagaatcctcgtatgaatccaatcttagacaggcacttttcaaaatcagtgtttcacagcttccatacaaccaaatcagatgcataacgaaaagcaagatcagaagataaacagcaaaatccaaaaatttgttctacctccagccaccgcttgagagacaccatcgtcattgcgtcatcatctacaaaccgctaaagcctggctcccttcctccgttgccattgccactacctctatgtggagatagcgacaagaagcaggttaggggttgccatggatacatcaagaggagggggaggcaacgccaatggtgatctccgaccaccgcacattcacgacctgcccctaccaccgcatggccgcgccagtgtcccggcctccacatcgcaccgagccaccaccgccgcacggcctcatcctcgtcgtctccctgccgtgcctccacctagccgcgcagccgttgcccgttgcctcanngantgacacaaaaggaggaaaagagaaaaaatagcatcagatttgtacgaacaaacaaacaaacatcatatggactaaggggtacggggagcgacggagaggaagccacgctgccgtggggggagccggggagggggagggggaggggcggagatggagggcgtggccggctgagagaaggagaaaaggagggaaaggaaagagggaaacgaaggagagaagggcgagcaagaaagaggcggaggcgaggcggaggaaagagatcgggaaaacaaatgaagagataaggacgggcgaaagaatcgaggtgcgtgggcagttgggcacgccgctctctctccgctcttagagcaagtacaatagtaggctataagctagctataaacatattttaaagagataaaggaagagagagcaagtacaatagtaggctataagctagctataaacatattttaaagagataaaggaagagagagaaaagcagcagactacagatatgtagccagctgcatcacggactccaagacgtaatgtgtgtatgacaggtgggacaggtattaatagtatagtaagcaactattgtatgaattggctattacattggctatagataatttggagctagtagtgggctatactattaaacttgctcttatggccgttaaaaaaaactattataaattatttttttaagaaaacggtgcatatatgtcagtttttatt

SEQ ID NO: 61743 - DNA, 1536 bp, Oryza sativa
cgcgtcgtgtcacgagcatcatccacatcccgtaaaatataaagtagattaattgtccaagaacaaacatgactttttgtcattatacacatcgtcaatgccgatgatcatgctcgggtgcttcgataaataattgagatcaaacttcagccacatctggtgcaacgcacgagcattttgctagtatatgtatatatatgtatatctatatgggtaaattaactggtgctacatggagtatgggctccaagattcaaattgagtatatatccaatttgaatgagtatgaatttttttaaaatgtttaggtatgaacattaacttcttgactaccaagttcaaacaaatttgaactgagtttgaactttttttttgttagattttggttctaggtatataacatccaaacatataattcgctaggtatgtaataatgaattgtgaaataaagttgagtctaatttattttgttgttaggtattggtatgaatcaaattcatatacctgggtttatactcacaatttaaatttttaaaaaaaatttgagagattttgtgtgttttatactttggagcccgggcaccatggagtcccatatgggtatcccatatgtatgtatgtatgtatgtatatgaaggttaaaatataatttatttgaatatcctgatcgaacagagttgtatacgagggtaagtgctaaaaggtcaaatttcagggaaatataactatttgatgtgaaatgtttttagatgaggttccaaatccttgggctgagcttaatacaagtggtgtgtaagacattttcatgtgccaattaccaaatgcgataaattcataagaataattgtcgcagaaaaatgttcactaaaattttaatgctagaaataatttctaggacgacttgataaagtcaaccaagtcctgtagggctaaatcagaagaaccacctttcgtagtgcattttgacacgacatcacccatctctctcatcctatctctaactactccaccctctatcccatccatcaacctctcaatcgctgcctgtattccccctctggtcagcttatcctcgacctcaaccctaacacccaccttccacatgtcacatacatacctcgccgtccctaactggtcaccgccacatggcttgcatatcatcggcacggtcctggatatgctctccagcgtcgagttccacccacagtgtgtcaaaaacgcgcctatagcggggtggctcaggacctcctcttgtggtgcccacctgatgatcctccctctgccacgtgtctcctcgagcagctcgctggggagctcgacggagtcgcgcccacggaccagccttggccggaccacccacaggaacggccggttgctggcagcgaggccccaagccacctccaagagctcgtcggcgtcaatggagacgagggtgccgaagctgacgacagcacgcagcctgggagctgcgtgttcagccattccaggcagctgcggtcctcgaggagcaggctgcttttctgggctgcaggaatt

SEQ ID NO: 61744 - DNA, 1203 bp, Oryza sativa
ctattaccattcattaaagaaacggtgtacattttttttatatattaagtatttgtttcctcaatacattgaacgatataaactttcgcaaagagcctaccttcacccgatgacctcatcctttcacgcgaagcatcttcccccaactttgaatcgtttccatcagctaatctgccatcactttgtgataaaaaagatgctatctggttctgggactgcaactgtgaattaactacttctgcactcactgtcgcaggacctggtacaggagttagctgacctgcacttcctaaagctgcattttgtccaactacaaagctacccatggcaggctgagaaagtgtcacaggatttattgcagttccaaactgacttgaggcgttccaacttccactaagagattgttggactgcatacgctgcttgagagttttgcattccataataaccttgtgtactagattggatagtggctggtccaagatttgccgcatcgtttccctgaccagcccttcctgagaaagactgtgtgctacttagaactgctgattttgaaggttgttctccagctcttgttccttcctcaagaagggaatcattacggggcctaccatcaacatctgaactgcttccaactggcggttcccacggcggtaggtctttctcaaacctcccgagcaaagcatctgtcaataatattgaatcatcttgcttctcagtagacttccatatttttaaattcggagggaagtacccactgccattccatttccgcaactgcactattgagaaaggaccctggattttaccggtaggatccatgtactgccagattttttcagactcattaataactgactgtgatgcatgtgttccccctgaccctatattggctcctaaagtttcagatgaaacaccagatagaccatgtggagcattacctgcagtagctcccactttaactgcgtgtgtaccgatgtttgggctatctgatttacttgtgtaaccagcactttcaccgtgagacgaaaatgcaggtctgcgtccaaggggtgactcgatatgtgtactggattcgccccatgtgtttcgattagactcccagttggtttttaaatctctttgtgcaggactcctaccctctcctttacctggagatacaggattattatctttcttagagaaagatcctcttgacttattg

SEQ ID NO: 61745 - DNA, 17327 bp, Oryza sativa
ctcaagcaagcaaatccagacgagcaattcaacacatcagtaaagacagctggctgaaatagcttggaaaattctagcggactgctttggaacaaaatatgttctagatataataacaggatgcaaacatagaagtggttttcattagttctctcatccttgattagctccctacatacaatgtatccaaagatgttgctatgacagacctcgtgcagttgtttgtgccagaactaaagcaccagccaacaccaacaaaccagtggggatgagcaaaataatgctgggctgatcatgtaatcatctcaataacctaataaaaatagactattgagaaggtaaccttgtccagatgatggttcatgaagctctttcactgcacaatcccccaccaccatcattcagtatgcaaaaaagacctgtgcacttcatcttcttcatgacaccgaaagcttcaacagatcaagctgtgtccagttccatctggcttgacggatgaagaatgacagctgaggctcacaagaacagaaatacatgctctgcatccacctctcaacagtaccgaccttccagcggacccatatttgtgatgcaatgatatgtcatccagttccatccggtttggcgcattatgaatgaccagaataatactgtatcaggttatagcacagttcagcagctagttgcttcacagcaatactgaaataaagggaagaacactaatagacaagcaaggtacagcaggcataaatcaatgtagatgacagatacaacataccgaagaaagatatgtaccatgtttcttgtgcttgcacattagaatatagattattgtgtagaaagaatggatggtcatggagagtaaagaattctctttgcataagggcaaggactgatgaagcacatatcagtttacgcagattgcagcatttcaccaaaagctgatatgaaacagatagcccaaagcattgattcaagtggaaataaaaaattcctgggagtgaacatcaatagtacaggagaaacacaaacagataagtccatatgcctcagtcctggcaaagtgtagggcacttaagaaggatgtctattcaagcacatagtggagctatgagttatcgatctcagaatatctgagaaacaggacaagatccagctgttacattaaagcaactatttgataaacaacatgattttttgattccacgagtatttggcatgatgaatataagacataagcagtatggtatatttactacaatcattggaccaacaaatggcattatggaccttacagattatttgcaggaactactgttttcttgtaggaaatggactcaaaaatctcatcttaaaacaatagtccagtgcaattgcagcaggtagaaatgtcaaaatgttctcaaccacactaactgcaccatcaagggcaagtgatattaaggcatcagtgctcagctcaaagggcctcccagattccaccatagcaaggcctgcaaataatttagttcaaataaacaaaatgacaatgtgcttgaatatgtgctgagaagttttatgaaatagcattatcgagttttacctcttacaaaagcaaatgcagcagcagcccctgtttttagttggacattgtccagatctctcctaatggcataccggaatgttactccaaacaaagcacaacttatgaaaataactgacaactgaacaaataattgtggaaaatcatgggcttcataaaaagatatgggtaaactagctagaacaccaactacagaggaaactgctgcagcttttacagattccagtctttcactatcttcatcaatatctccacttggtacatctccaaagctttgatcctcaagactagaagacaaggaacgttgtgcttcatcaatcatttctcttgcttgtagcaattcacgttgggactctgtgatcttgtttatgtaatgcagcattgtaaacaacattattaagaggaaatagcacataggaaacaccaagctacaaataattcatgtccttcccatgtatattgaaggaaagataatttgatgattacagaaatgaattgtcatacaattgatatcacaactaataatcattctgcctttatcgtcatgggaccacatgaatctgacacatgctactagtactttatgttttctcaaaagacatggaaccatctcctatacagaaatggagaatataaacagttggaaggattcaaagcatctgatatgctaagaaggcaagatattcaattgttaatttgtaaaataaaaaaatcctagagaaaaaatgatggaaactacacagatgatttgctaaggtcagattataatggcatagaattagcaaaactgtggacagatattgcacctttacagactacattagtgtacaaatacagttattttcagcctcaggtactagattgatatattaacgcgaccagcttcaaacataaggatatttcgtatttgtttcagtatccagctaagcgtttgtaggggaaattcatctagttttctaaatctaacaaactgttcagcatagatcaaatgagctgatttctacagtacatctccaactggatatgcataacaagccatgacaaagcaagaatatataaactacaatttatcgactgtagggatattgtgcttggcacttctatccaaaaggcatttcaaagaatcgaatccagcgaaatggcatggaaaagtcggttcaatgtaaggcggtgcaatgcatatcagggtttgctttcagaaatagcattttttgcctgcttgtagaaaacgctcaaggagtaataggttaggcagtatatagataggagaaaataactggagctttttcatattctctgacaatagtcttcaatacgcaattttctgtttccgtgcattacatatttacatttcgtaaatcacatgcacccgtggtgaggtactactgttcggctaattaaagagcattcctcaagctcgtcggtgccacattaactcaaacacaaaggcggcagtcacagaacatctagggccacaccgacacagtagtacagtacaaccacaaccatactagcacgccattgcaccgcaacaccctggtggtgccatattgctggttcatgctacgtctattgccaccagatgcgtgcatcaccgcgtcggggtggggattggaccgcgcgtgtgtacactgtacagcactatagctaggtgaggccacgtcgctctccaccatgaggccatgagagacccactactcgctagggcaggcactctgctcgttgattgaggcgaatgcagagcaggcaaagcatcaaacaggttgaacgcgggcagcagtcaccatacctcgtcgcggcgcctctcgaggcggcggacctcctcgctggcgaggcgggcggcggcctcctggcgctcgatgtcggcgagcgcggcgcgcgcccgctccacccgccgctcggcggcctcgaccccttccaccagcgcgcggttctcctcgcgcagcagcagctcgtccaccttctcccccaccgccgagctcagccacgccgccgcctcccgcttcccctccccctccccctcctcaacctcgccgccgcccgcgcctccccccgtcgcgcatctccagcggacgcctcggcctcggcctcggccccggccgccgcggcatcgcgcagcgaggggactcgcggccggaaggggagagggatggatgagcggacggaggagggcgaggtgttgcattgtgtgcgttcgccgcggcagcgagctctgctgcggaggtttggatgggaagaggacggcgaggagttagcgaaggcccgtttgacccactgcaggtggaccccacaatagaccgcctgtggacctccgtagcagtagggtggtcaatgactgcaaagtgggcccacatgtcagtgactggagaggcacaggacctctcttccaggtgtcaataaataaatagtgctactactactgtttattactgcatttctgaatttttgaagcatcagaattcagacatcaacaaaagagctacacagagaaagaactgcaaggctatcagcaagaactgcaagtggcagaatccagaatggacggttggtattcagcgatccatttgcaagcaagtagcaacatgtcagaagaaagagaacacctgaaagccagtgatgcaacctgaaattgagtacagtatttgcgattacagaacaaattcagtaggcatccaaaatgaataatgtgcgtatgtcatcgacagacttgagatcgcaaatatgcactcgctaagctggcatcctggcacaaattgatgcagcacttgaacattcttgggaacacatgcaaatatcaatacaccaagtaggtagagcaagtgtttgaagggttgaacattctcaaagttagtttcaactttcaagtaataaggaaacatgtataaggaaatatgactgaatctcattgcaaataccatccaaaggtcaaaaaataaacttgaaaacctgcacacaagtcagaggttataagacagtgttcttcagaattgcaggtaaccagacttcatgtttacgagtgctaacaaaatgagatgccaggtaacattgcacagacataagtttgaggtccatatgtcagcgaatcatgctttcaaacttgaaattgttccaatccctctgaagtcaataagaagagtttttcttttttgagataataagaggagttctgaaacacaggaagcacacaaaagcctggcttaactttgtattaagacagagaaacaacaacggaccaagcaaaacggacaaccgcaagagaaccaagttgtgtctcgtgtcagcactcagcaagaacaaggaagggagagacaggagacccgaaaaaagaataaactgaagggtagtccaaaaacacggaactgaagaacactttaaatataaagcctaaactgatggaccagaaaagagcatgcccaaccccttcacatctgcttgctgccaactactgattgggtagaccatttggaggtcatacaccacaggttctatcaggattcaggaatgaaagttacagttataggagtggaaaatcatataaataagtggttctaagacctggcatatgtcatatttttaggagtacaaatcataaacatgatcagctataatttatgatatcatccattggacatgtgtgtcattcctggtcttgtttatcactatcactggactaactgtgacaactccgcaggatttgcagcattgtataaatcacaaagcaaacagggttaagaattctgctactgcctaccctacacaagttacaaccatgcaacttcagggacatagtcaaatataaccaattaacattatggtactagcatattccttgatgtattatgtgctttactcactattactgcagtatcagaggaaaataaacgcaaaagaagcttcataatatctcaacaagttgcatagcacataaagtaatgctgtcagcatttagggaacaaaattattttgctcctgtggtcaaaatcctaaggaaaagtattcactatatcaaccaaaacaacaattgactggtcgaataagatgcaagtactgatcgccgtatgaatatattgtttacataaatgacctagtaagcaagctagtgatcaagcattaccattcttttctctcatgtgagcaactgagcaatagggcttcaacattgatctaggatgaaccctactcaggcttgcatcaacacaagctgggaaagatccaaactgatggtctgatcagtgaactgttgttcaggggtggcgcgcctggatagtcagcattgcagacatcacaggttccatcagccaaggaatactcatgccactcacccaagcgtcgcccagctgcatataagcaatcccctcgaacccctggatgatcttgatcaacgcaagctgcgaatccatccaagccaagaaacagcgaccgcccgcccaagttggtgatcatctcccacttccttttctcagatgcccaacggaacacgcggtacacaaccctctcctcatgctccacgctgatgagcaacacctcgcctccacactccccgagcatgaaccgatccccctccggcctgttcgcgtcatcatgctctcctcccagaaatgacagctccagcgaactctccgacagctggagcgtggcaagacggaggccaaccagcgcgtagagggtgccattgacagagatcaaatcgtcgaacacatggggtgcaggggcggaggcaacgcgccagagcgcgtccccggggcggcagtgctggacggtggcccggccgggcaagaagatgacgacgaggaggtccgcggtgaggatgacgcgggagaagggcgcgaagaccctggggaggcggagctgctcgccggtgaagaggcggaggaggaggagccttggcgggtagttgttggcggcggtggtggaggtgacgaggaagccgtgggcgtagaggagggtgtagcgcgaggggggcaggtggtgcccccatgggaggcggaagcggtggaggcggcggaggcgcgggtggaagagcgcctcggcgaaggaggggtagagggagacgaggaggagcggggactgcgaggcgaggaggcggcgcgacgccgggaggagcgcgcggtaggcgcggcaggaggcgcgcagggagaagaaatcctccagggacgtcaggcggcgggctatgtcggggatgagatccagcgacggggacgacgagtcggcgggcgccgccgaggtaggggtggaggaatcgccgccggcggcgatggaggccggcggtgagtggtggcgccggcgcttcgcctctgcggtggccatttcccctcccaaaaatgaattttccgccactttttttcccttttgtttcttcttgccaattactcctgtccggtggaaaactaaagaagactagtcaacgcccacacctgtccggttgtcaattgtcatgggttgaagccttgaggcccgtgggccgaattggaatgcttaaggacgatattccgttcggatgaaataaggaaaaagtacaccaaaggtccctcaacttgtcatcggaataaaaaacatcctcgaactgcaaaaccacgtagttcccttaactatacatacaaaaccagtcacagtagatccctcggcggttttcatcctgattttgtcctacgtggctgctgagtcagcgtgggcccacgtgggccccacatgtcagcctcctctttctttcccctcttctctcccttcctcttctctctctctctcttctctggctctgggcaggccggcaccggggcgaggcgggagaggaggtccggcggccggcgacgtggcggcggtggcggcggcgaagacgacgcgggagcaggtgaggggcgtcggcggcggcgaggggagcaaggcggagctggtgggaggcatcgaaaccgtggacaccggcggcgacggcgccgtggttacgccggggagctgcggaggcgagggaagcattggattaaaactcacgggaggcggaacggcggatgaaactggcgcttccggcggcggcaaaggcgccgtcgtacgtggcgatggcttcgacggcgacgacaaggtgggcgagtactcgatccaggcattcaccatcctcccactggtgagctcaaccctggcgccatcaagatcggcaacagcggcggacaccataatcccaagatccaatccattcccattcacatccccgaactacacatccatggcaggagagcggcggcggcagcgctgggctcgttggcttcttggcgtggacgtcttcaccgccgccgtcgtgccaagaaaacttgcgttttctccatggattcggcgtgctcgagctcgacgtcggcttccaagcgggaggatgcagcggagttgacagggatgaaagagatggactcgccggggccgacggggaggtttccgacctcgggcgtcggccatgagcttggtgcccttgaggaagaggtggaagtcaagggaaaccagcgcgagagtgaaggaggaacagagcgccgtcctgaggtcgctgatggtggcggaggcggctcctcaccctcgccgccgccgatgccctcccctgctcccgcgttgtcgtcgtcgccgccgccttgctcccctgatcccgcgtcgtctccgctgccgccgccgccacgtcgccggccgccggacctcctctcccgcctcgccccgccggacctcctcccccgcctcgcggcctcgccccggcgccggcttgcccagagccagagaagagagagagaagaggaagggagagaagaagggaaagaaagaggccgacatatggggctcacgctgtctcagcagccacgtaagacaaaaccaggatcaaaaccgctaagaaacctattgtgactggttttgtatagttaagggacctcacatatctagttttgtggtttgaggatgttttttatcccgatgacaagttgagtgaccttcggtgtactttttccatgaaataatatatcataagtcataagtatcgtgtgataccctatttcaaatagggtatcagccgctattaggtattagagacgaaatctttaaggtattatttcatccgaataagataccgttacttagcatctctctctttttatcatatttattgcgagcatttctcttgctcacattagcaagttactccctccgtttcataatgtaagactttctagcattgcttatattcatgtagatataaatgaatatagataattcatatagatgttaatgaatctagacatatatgtgtctatattcattcatatctacataaatataagccatgctagaaagtcttacattataaaacggaggaaatagcattgaacatttacgattacgagtaatttcgtgaaagaagagctagtatagtatagatcactagtacaaatacatccagaatcctgatgcacgaatcacaatgtaaaaattttgccggaagcccagccctgaaaagtgtatcgctatctcatgattcttccagagctgtactggtaaatggcatgccatatgtgcttcagtgcctacagaaatgaaccaatggaaaaggatacaggtgacaacaacggagtggaacaggcacggcacaggtcatgacttggcatccgcaccagtagagtcagagctgagagtgacgcacgggaaccagtatctgcgcttgccatccctgtgcccatcgtcgatcatcgcaagcccttcctgtttatgtaatagagaccagagttggatatagatgccaaaaaatttgacgttcataaaagtgtcaatacagatgcacatacgaaaagtactttatttatatatggattatggatagctcaaaaagaaggtaatcctgcaatggcttaagcgtggattcaacagagagatctaatcaccattcaccaatacataacttgcatcaaaggaagccggttttcttttctttgggcacagaaatgaagcacaaaggttgcttaaagagtggaaatgcaggagcaggatttaccttgagcaaagtttcaaggacgtcaatggcacggccagttgaccacgagaactttctctcgacttgctctacggtgacaaaaccttcagcctgcatgtgaaataatgttataactggacaggtacggttatattgtggcaaggtgacagattgagcaaggcagcaacttgaaagcttcggtttaacttagttttgtactatgtctctatgttgactgaaataagcgtttatgtggaacatagggggctttatgacttccaaccaaaggttatacaccatccacatacttgttcagtgtaagcatgataaggttatgacagcatccacatacttgttaagtgtactgtggtattatacactattaaaagctgattacaaacctgagctagctcaagtatcccattgtgatctttattcagttctgtaggaacagaacgcacaagctttttcttcccaacagaaattacttcaaaaccactaccaaggacctgagagttcacaggcaaaggaccagaagaattaacgatctgtccaagtacatcaaataaaattttattggccatagattcgaatgcaatcttgtaaaacttgcatgaatgcaattacaggattcccaaaaaaatgtagctgtagaattccttaaaatacttgccttcagcttacttatcgcacgcaaacaatcatctgatgttaacgatccaagatcagctttcctcttctgacagaggagtttacggagatctagcaagtcaatcaagccaccgttggtcgctctggttgctatgcatatgtcaacaatctgaactcctggtgcaatagacacagatgccaagcagaacgtaaatggtccaataataacagaaaattccaggatcaaaacatacaaggtagcttaaattaagtataccaacccaattcatagtagaagtcaccaatccctagaagctctgcccaagctcctttattcgaagccagcgggtctactccaacttttgcacacatctcatggaactgttgtctaaatagtggatttttacggatatcattctgcactagcacaccatgtacacaaagttacttaagagttggaatatgctgtgccatttgagctctattgtgatcacctagaacatcagtgttacattgcaaatgtcaacccagttggaactagatgccatgagacaagtgaaatctatcacaagaaacaagatcaattggcaccttggtaactccaacaccttttctttggtacattttccatctttaactaccgttcctcagttttagtatatgttgagcacttgaccatggactagtatgctacttaggttccctatttcccagttcgatagacaactttaatcaagtgaatagcagtaacttcactgttttcatgtttgttagaacattcatttcatttgcgctgggcagttgaaaaaaaatgtaagaattcagtcagtctgcaagaatgactgatatatcctgatccccaagattaagaagattgtgaaagcatgctatgtgtaattcaatttgtgacatacgaatagcgtcggtaatattttctgtaaaactcaactagaatacaggagtaggaatcaccttatgcttgcgtgcaaattcttcgagctgtgtccgaaacgtcgcaagctgctccttcatgacatcggtcctgaccttggccacattttccccaaccagccggaattggtccttaaattttccaagagcacactcatctcagaatccacagaaaaagaaaaaaaaaacattataagctattcaagcaagatgtccacatacacgagtagccgctgcgttctgcaagcccgcgattcccggtcgcctcctcatgcttcctagtctaaattggctgcagttccataaaaaatccgatggaatcaattagcacatctcgtgaacggcgatcgattcgatgtggccagagttctctgcgtgtgttctaacagtggcggacccaggatttgaacccggggtaggcctagcaaaaaaaaatctaaatgcaatacggtatgattcgataagatatctgataaattataaacgataccgtgatacggtatataactctaaatggttcaatacaagtagaaaataacaaacaagtttgaatcttacctaaaggacaatgtaaattgttcaaacataacataacatcttagataaataggatattacaatacaagtcaaaaatttcatttgaggttcattgttgcacataattttgtagtaatctatacaaattactatatccctaattggctaatcacagatacaatcatacaaagaaattgattattgaaggggataatactgtggtctactagaagggggagagggactgaggtagagggagagccggagagggcgagaggcagtgctcaccggagtccaagggggctggggcttgggggagggccggatgccgggcagcgggcgcgccgcgcgcgacggcgctgcacggagcgacgacacggcagcgccgacgcgaagggcgaaggcaacggctgcaccgcggggcgcagcagcggcgcgagtcggggaaggccgaaagcgggcaggcccaggccggggcgcggggcggagcgccgctgcgcagtctgccgtcaggggatggcgctgccgccgtcggccttcgcgtgcgtgcggcgtgggaggttagggcggggatgttacctgggttcgcgacagcctccgctccggcgaggagcggagcggatcgtatccggatcggtcggctgcgggctcaatcggagcgccggagccgagtcaatccccctcgcctccacctccaccaggcagctaggtcgacggcgacggatgggatgcgtactgggcgaccgaggcttgtggagaggaggaacgcggtggaggcagagcagcggtggcgccggtgagaggcggcggaggcggtggccggtgggaccgcgagtggacgacggcctctggatcggcgactagttcagccgcagaggaagagacgagacgacggcgagaggcgatgatgtttgggccacggtctctccactgcggggcccatcatttgctgggctggaatccggataaggcccaccaaatttctgatccacaacgaaatttgaaaggaataagttcaaggtccctcgtctttcgccaagttcgatttttttttcttgaacagcaataccagatatgacatgtgcaaaactggtgtacccaaggtcccaagcagtatggttccccggttttggctcacacggcgagtgggccccatatgtcaggcatatgtcttcttcctccaacctcccctccctctatatctcctatattccccatttcccatctctctcctccatttcccatcatcggctaagggagggacggaggcgacggcagcaccgcacttgcagctgcaaggaacactacttcggtacctcctccccttcgacgaccccatcgtcgccacgcactcctacacatctcttggacccgcaccaccgtcatcttctacgttgacaaccaccatctaagatggctctggttgggccaccgacggttgactacacatacgcgcgcttcactgctatgttctctgacctcatcgtcacctacacccatgccatttgtggccttgagtgtgcggtcactgccctaggcctaatgacatccgaggtctccatgatggtcagccaagcgcggtgccatgtggggttgttggggtggatcgaagaacaaatgtcaaggtcattgccactggctctgctttggtgtatcggagcactgacttcctccactgggagtggaacgttgcgtcgatgcactcgtcagcggtcatccctatcctaggatgactgaacctcttcccgatggtggagcatggatccaacagcctcgacatgtcagcaaatagttttggcatgaagcacatgctcaagcttagtgagtttgacatgcaccaagacttctacatggtggggggtacgatgatgagaaggacaccttctcaccggaggagccttgccgcggggataattgatggagctaatgttgcctcaactatagctaggcgtatgccgcccagtggttgtgcaatcggggttgttggggcagcatccagggcaagtccagtgaagaggaggttggcgatgcagagggcatcgacaatgacggcgatgcggtgcatatagtgttgtctaggacgatggcggcccgccgttggccacatccgccctcccctatcagtgatgtggaacggatgagagagaggaggtttggagaataggagatggaaaaagagaggagattggaggaagaataaataggcctgacgtgaggcccactcgccacgtcagccaaaaacataacccactcgccacgtgagccaaaaacatacagtatacttctttgaatctcattatatctggtattatacggttgtaggacaacaacgaaaatcgaactcggcggtgatttaaagtgaacttattccaatttaaaagttaagttatatacaattcctgggccttacaaagtagacgggccagagcccaccaacgtcagtgggcgaggcccaataaggcccgtggcaaagcgacacgtgaagcagcaacgccacgtcactgcctcacgctgtccccccacactgactgggactcactcgccgcagatccccaaacctctccgccgccgcgccggctcgcctcgcgcgccatggccgcctccgcctccgcctccgccaccgcctccctctcccacctcctcctcgcgcgcaagccagaccccgcgcctctcccctcccgccgcgcccccgccctgctccccttgccgcggcggcgcgggcagcggcccatctccgccgccgccgccgcctccgacctcctctacgccgcaccctccctcaagtcccggctcgccgccggggagaccctgtacgggctcttcctcctctccttctcccccacgctcgccgagctcgccgccctcgccggctacgactacgtcgtcgtcgacatggagcacggccccggcggcgttcccgaggcgctggcctgcctccgcgccctcgacgccgcccgtaccccagccgtcatccgcctccccgaggccggccccatctgggccaagaaggccctcgacctcggccccgcgggcctcatggtccccgccgtcgagtcccccgccgccgcggccgccgccgtgtcgcactgccgctacccgccccgaggcgttcgcggcgccgcccaccccatcgtccgcgcctccgcgtacggcctcgacgactcctacctctcccgctgcgaggacgagacgctaatcatctgccaggtcgagaccgccgctggcattgcggaggtcgacgccattgccgccgtcgacggcgtcgacgtcgtccagatgggaccgctcgacttgtcagccagcatggggtacctgtgggacccagggaacaggaaggtgcgagccaggctgagggaggccgagaagaaggtgttggatgccaggaagaagaatgtgacagcttcagatggcaatgtcgcatatctaggcggattcgccatgccgaacgacccggcagagcagctcaagctgaggggttaccacatggtgtctggtgcagtggacattgggatgttccggaaggcggcgttggaggatgtcaagcggttcaaggaggcagtgatggaaatcggcgaggaggaaggcgaggaggacgatgaaaagaaggacaaggaagacgacgggtactggagtgagtgagcactgagcagagttgagctgaagatgatcaaggaactgtggtgatggtgtcttttgtttgtcttctgaattcagattgagaggtctaagtggttccattttccaggggcctctggtgtactcttgtttagttgtcaggtcgattttgagaacatcatgtttgggcatcttaggattcccatttgtaggtggtaacttctgagtaccaataaaagccagatttttatatcattcagaaaaggttggattttacataaattatgtcgctgtagtatcctctatttttctttatttgcacatcctagtatatttacttttagtcaagcatcataaattatgtcatggaaaaaaagtgcagctcttaagtgttcctgtctagattgttggtgttgtggggtcaggctaagctacaagttcagaatccagattgtctatcacaacactagctcaacctccaccaccagttcagatatgctggcacctcccatccaaaaccattgagttctttggacgtttccccatccagaaaaaaaaatcttctcagttacaggatccatccttaggtgttagaggcaaacccctcttctaattctctcagagtcctccatagttctttctgctccttttttctcatgaccacaatgcttgcagctagctctgtagtgaacagcaaccttccttgctcatcaaggatatcctcctgctcagacttcacatctggctactcctggcgtcctatagaggctgcaaaactctgccggacacgagctgtgcgctcgctgcagataacctgtactgccacaaagcctgcaaagtcaccaggtactgcgaatacgctctccattttcttggtttggagcagctagtaattctctgggcatgatattaatttgctgtatttttttttatttttatatacagctgaagaagaatggaagatcaagaggcaagtgctagtagaaaagcgggtaattcctaatttcctgccatttccaaatgttagctattttgttatcaactccatatatgaagtatcttactgaatacctggttttagttcttcagagagtgtgtattgcacatatatgagtagataagccatagattccatgtcatattgctctgttttggaattatggacttgttttccctgggtttgttgatttcatatgttaattacccgtggggagccttctctgctaagcggcttccatttacattagaattccttctgttgtttggttttgcaggtccgtagtgttgatgtgaaggaagcactgcgtcttcagaaggaaaacaattttgcaattcttgatgtcaggccagtagcggactttaaagaggtaatgttgtaattgttctccacttatcttcggtttttgcaccataatgcagctcttaggtttaacacaataacttgaggttacgctttacattaatatgtaattataatcttttgtggcatttattcccttagaaatatcgtatattgaaccaaaggttctgactttacgcaattttagagtgtctgagaaataggagtaattttgtttggaagagaaaaaaaggtctgcagtcggtgaaaaatggatataattttgttaacaaaattatttccaatgatgtgcaagtgtatctcaaactttgttgctgtcatactatgtggtgtttgatacttagattcattagattttgttgcaaatgccatcatatgggttcattcttatgcaggctcatccacctggtgccgttaatgtgcaaatatatagattgataaaggaatggacagcatgggatattgcaagacgggcagcatttgcattctttggcatattttctggaacagaagagaatcctgagttcatacaaagtatggtagtttattctgttttctgcttcatggttactcatatactacctccgttttttaatagatgacgccgttgactttttctcacatgtttgaccattcgtcttatt

SEQ ID NO: 61746 - DNA, 771 bp, Oryza sativa
tcatctattaaaaaacggagggagtatgagtttacaatcagtgacatatattatctttacgaaagtggtgagagaaacttggtaaagatgcaaagattattgtggcatgttcgacaggaggaacattgaaaccaacacagaactttcctgatgggaagcaatcgaggtatgccatgttaccttagtattctttatcagtaaacttgattcaatttttaccaattaacattcatgttctaactgacacgaaagcgctgatacagtctcttaataccactgtcgcaaatgaggttttttttcttttctgtattccttgaaatcagaaatgggtctatcatattgtggcattgatattcttcctaatatttgcataaggtatttctgtagtgtcatgatcatctcttaattggtggaattttattttgtagtatggatatctttcgtttctttctactggtggttttgtttcacatttcttttgtcaacaatgtttcccagttgaatgatattaccagcttgaaatttctaccatgttgctgagcggtagttcatccgagtgccatatgcaaactagaaggggattatactattcgttcatctgagttccaatttaccccgtttgcccaacatctgtattgtttcatttcatgtaaaactataaacttgttgtctgcccacactcctttcttcaccttagctctgaattttatgttgttttacaaaggtgactatgtttgtgcctctggaacatagctaactcatctcatctgt

SEQ ID NO: 61747 - DNA, 15803 bp, Oryza sativa
cgttgaaacgaaacgaaacgaaacaatttagcgatgaaaattagcaggacagttcagattatccccctcttcgttcctgcaaagagcgcagggctatctccttgtaaattcctcttcgttgatgaacgaatactttgtctgaatttaatactgtaaactcttccaaagaaatacttctcttttcttcagaaggtagcagtttgcatttccaattctgccgaagttggacatggcagagacctgctgcttaaaaaggaaaaatcaatccaaggacagctttgtcccatttgccgagtgcacagtgctagctcgtcatctaaatatccgatacagataacagcagaacagcgagcgactacagaaatccaccgatagcaaaataggagtagaacagcaaagtgcaaatgctatatcaggcttaactctgaatttctgaaacctccttcacactgcacctcttctgaactctgaaatcggccttgctgaaacaaaacaaaacagtggtgtagaaggctagaagcggcaacttgtgatctgatctcctgtctgatctgtgaacaatgtaaaattactaaaaacttattctgctaatcgatcgccctgagtaaatttgcaagggtgaatcacccttcccatgcacgcacaattctttttgctcctctgaagatatctgaacaacgtataacctctttaatttcgactttgatcttgacaatggagaagccattgctcaaacagaacagtttggcgatgaaaattagcaagatgattcagagtatattcccctcttcgtgcaaagagggcacatatgctcctcgattggagtttctccgtctcgatcggtcacccacgacacgacgtgctcggtgcggtgctcgtcggagaaacctaccacggcaccacccctccatattccaaagcgttcgtcagctctgccgctgcctccgccattgccatcctcgtcgagctctgacggccatgacgctgtatcagtgtcagactccggattacacccgcgatcactggacgaacacaaacaaacgaagggagtttggcatttaaggccctgtttgtttcagcttaatattattataatctaaattatagaattagattactataagctgaattataataagtcgacatagaataagctgttagctgtttgtttatctggattattagctgtttgttagttgttagccatccaataatctagaaaaagcacctttatagtggcttaccagattatagtaatttggcttatagattgtaataatctatcataataagctatctatttgtttcagcttactcctaataattcagattacaataattctaagctgaatcaaatagagcctaaatcctattgatcgacatttcgacatcttcgaaatggaaatgacatcgtcagggatcattcactgcgaaagactgaaattctatacgaagatgtgcaagatttctcgtggcatttagggcctgttcactttgataccattttaaaccataccatttttttagcaaatttgctaaaaaaaatgtctaagtttagtttattgccaaatttgataattacataagaaatcatgctaaatttttggtaatattgccatcttatcaaaattttgacatagccaaaatttggttaggtttagggcatgtttactttgatgccattttctactataccattttttttttggtaaagttggcaaaaaaaatgtttacaagcctgttcactttgatgtcattttcaaacttaccaaattttggtaaagttgctaaaaaagtggctatatttagtttcttgccaaaattttagctggtaaggttgaaaataacatcaaagtgaacatgctctacatttagtttgttgccaaatttgattaatatataagaaattctgccaaaatttaggcaatattgccatcttatcaaaattttgatattgttaaaacttgataaaatttattttggctacaatctgaacatgcccttattttgcccattaatctctgtagcctactagccttgccggagtagaagtatctcatttcctttctgagttgtaacgagtccgagcccgagttcgatctggcagcacggagttatcatatattccaacccggtcgcggcggaggtatcgcaaccaaaccttagcagcagcatctctcaccatcgtcatcgtcatgagcagcagcaacatcttcgaggacgacgagatcgaggcggcgttcgcggccggggcgatgccgccggagtggcggcggaggctggtggcgtcggggcagctggacgagcgcggcggcgacaagatcgcggcggacatcgccgccgccgggacgacgtcccgcccgagctcggggttcgcctggtccaagggtgccatggcgttcgcggcgttcgacgtcgtcgtgggcgcgctgctcctgtgcctgggcgtggctggcatcctctccgccggcgaacaccaccacggcgacggcaagaacgcggtggttgggggcctgctcgtgctagcgatgactgcagtggtagccagggtttgtgagtacgagcggaggcggggaaagatgcgcaggttgcaggcgcgaattgtcctcgagcgctctctgcttcctcccgtttaaaggccaaaatttacaatgttttacatgcctaatccttctttataatcgacaagagtgaaagttgatctcagtagcaccccaaggttctgagttcaaatctttataagagcgaatttcagattggattatttgagagctaagtttcatgttcgataggataagttcttaatttaaaaaggttgtatatatccgattggatatagaggctgggcaaaaatacccttctcacaaaaaatataaaaaaaatcgacaagagcgcaagctgcgatgattgtgtaatcgatttgttgaaacaaaaacattacacgaacgaaaattactgaacattcaatctgctggacgtatcaatcgatcgatcacccatcccatgcacgcgtaattattcatttttcttctctgatggagaaggcgattgctgaaacaaaatagtttgtccatgaagtttagcaggagatgattcagagcatattccctcttcctgcaaagagggttcgtacaggctcgtctccttcgcaaactcctcctcgttactgactttgatttactggtcgaacaatttcttctgattttaatcctgttaactcttccaaagattgctgctggtatcatctactgcctactgatctacagctgctagccatgacagacaaccggattctgctgctggcatgacgatgatacagcagcagcaaagggtggtcgaagattagaatttcatcccaaataatactgatcaaggggattcggagaataatgttttgaacaagatgggtttcggtgctgtaaatttaagccattccaggaggaggatttcacctcaaattagttattcttttggatgcatcaaaagaatcaaggtgaagattttggcatgatcgtctcatacaagcacttcacttcagagtgtcttaattgagaattgaacgggaaacctgcatgaccccaaaggtaggaacaaacggacatgcagcagacattagccaaggcccaaggggttcggagattaaaactccgaccctcattgacatcatctgccggaatggtgaaaccatcaaaacccccaaaatttaatactctaacatcaaaatcgggccaatacaaaatgggtcaatacaatttccatgcacagtgcgacggtcagttcagtactcggcttccctctctgtaacgtgtgtttgggcggttgtcacatggttcggggtgtgtgctctggtgcacttcctttatcgacagccagctgccgatgtaaaacttttcaggtaacctttttttcttcaatcttaatcacattgattgacctccttcagtcattctaggaaaaaaaattgccacgcacatcaggaccgatacgtttgggccacagtggaaccccgacctatccatattgggctgtaacgtggttgccaagtacatgcggcccgttacggtttgggacggattgggattccgatgtacatgtggcccatctagcttaaattaggcctacttacgtgtgggcctacttaaattgggccggaacgggatttcagcggtgcggcccattcgactttgcgacgcactcgcagccgttggatccccttcagcaccacgtggtgcggacatgcggtcttgttcacagctaggggtggaaaaaaaaactcaggcttgtgagctcagctcaggcttggctcgagcttggttggctcggctcggctcgtaaaccaaacgagccaagcccaagcctccttttcagctcgttgctgaaatgagccgagccgagctagctcgctagccgcttgttttggctcgcgagcctaggccatcatgtatttatatcgattattttatcttttgtggcgttattatttatcaaattgaaatttatcattaagattttgaagaattgaatatatatatatatataaacttatttaaattttacatgttaatgatttattcttgcattttttaataattataaaatatatatgaagaggtgtttcgacaagaatacttgcaagccagcttgagctggcttgagccaagaaacgacccgagccaagctcaagttttagcttgtttccctaactaagtcgagccgatccaagtctagtttgttgcgagccactgcaaggctcggctcgttttcacccctattcacagcatgccatgatgaattcacctctcaaacatgtaaatttaaattcaacctcttgatattgtaaaaaaaaacaaattaaacgtggagtagtatatgtgcatattcaaaatcatatttgcttttgttctcgacttgtaaaagtcataattaaatttatatatttatggagtgatgtattacgattagtttatgttattaaattcttgcaaaaaaatataattatttaaattatatggaaataataagagaaccttccctccagagaatttaaaaaataaggggacctgtgatgtctctgtcggtgccatcgactatatgatctgtgacagtgtaaaacttttcaacattttaatctgctggacctatcaatcgatcgatcactattccttccaatacatgcactattcctttttttcctctctgaagatatctgaagaacgcataacctcttttcggctttgctcttgatcatcatcattatcgggatcttaagctttggactctcgcacgcaaagagctgccacaagcccacaacttgtcgaagaaagaaaaatccgggccacgcatgatgtctcgcaaaattgtgtgatcttccttgagaaagtgcatcctgcaatctaacgatttacaggtcctcctgactttctgcagtgtgcacaccgaagtgtatctaagctcaactttggatcttatttattgttcaggttaatccgagtgagacattaatcacttcgtatcatcaagttttaatccacaaattttcgccaaattcagatgaagatttacaattattataataggtggatatagcatcttttaaatcaagggtcagattatctataaaactaaaacattttttaaaatcaggagaacttgttgaaacttcaccatctacagctagccacggtcacagatacttagcgacagattatcgtcttgtcacttgccagagacacaactctgaaaaactactacttcatcacttctgcaaaaaggtttagatcagtgtaactgaagaatggaacagggacagtatgcagcagaaagtgcaacggatcgttgcttttgcatgccatctttttctgtggcctcaaatgtataatgaaaaggaggaagattgatttgatccgtccaaggagacctatcatgtgattcctctgctcactgggtagcttacaggaggagcaaaatggaggtttcaagcaggttggacttggagtacgaggtctctgaagtttatactactagtagtagtattgagtagcgggaaaaccactcacaaaaaccggatcaatgcttattattattattattttgtgaaaaccgtttaaaatttgttgactgccgatgaaatatgatcaaattttgtaaaatatttaaaatccagtttgaatatatatttttttgttaaacttgaatggaaaaccaagcggtttaatttgtgttcccgagccaagccagggagatttagtttttagggaaaccgactggtttttattggtttttgtaaaccctgctgagtagtaataatgtacacttcatctaactgatttacgaatgtacgcctaaaattggcaaaacaatgtgggaactttcattttttttttcacaatattggttgaagttccacccctagatgaatcaaccaaaaagacatgcattgcaaatctggctttttgcatcgggaagcgcgcatcttactaccattagctcaggagcaaaggaccaaattcgttaagagtaatatatatggaaataattttgaagttatttagtactacacataattatatttggaacaaaaaattgctgaatgctcccaaaattcagtttgcgtgctgcacaggaagctcacatcacattcctaaatggaacagacaggagtccccatccacagcaattctctcaaatttgttgcttcacatttccattctacaccagcctcaaactctgaaccggaggggactcaccaatccaaaagttgataatcaataacagcttcctttttttccagggaaacacagcaaactgtacgcatcagtatggtcggtgctcaagcttctcacttagagtcactggtctcgatcacatagattcgccacattttggctttttttgacatgtctcaaacaatgagagagaaagagaaatgaagagaacatgctgtctttcaggcagatcacaggagaattttgtgttgtcctcttgctagattggcatgaagagggcgttgttgcagttgagtgtatcggtcgccagatacgtatgtgcactgattttgatccttgaaattgatttagtcttaaataatttatctggaggtatactcatttctccaagtaataactggactaataagtatttgcattttttttatttagtcttaaatttcttgatgtgcacatttaaaaagatgatttccctatacaatactccctcaattccataatataatgcacaactcaattttttttcaagatgttttataatataaggtgtgcatacacaaatgcaattaattagcccatcttctccactaaattattatcttttaaaattctctacttttaagatctctaattatattgggtgcatgtattatactacctccgttttaggttataatactttctagcgttgaccacattcatatagatgttaatgaatctagacatctattgatctatatgaatatgggcaatgctagaaagtctcataacctaaaacagagaaaatatttattagggtgatctaaactagggagattgtctttagcctttgtaaggtgattgtgtcttattttgaaatggacggagtattaaaatctgtcaaaaagggatatccaaccagcaagtatcagcgttaagagcattatctggtttccccaaaaaaagagcactatctggttaccatttcggaataaatactatcaatgctttcctttttctgctcagctttcatcaaccgacgagataattagtaaccgggatcaaccggttcagtttctcttactagtagaaaaatcataatccctatcaataactgggaattcaggacacattcctttttttttttacatattataaatcatcacgggcacatttactgaaactcctaaaccagtactcccttcatactagtaaaggaagttgttttagacagcgatacggtctctaaacacaactttaactccttatttctataaaaatatttattgaaaaatgatatatgtatacttttatgaaagtatttttcaagacaaatctattcatataatttttacatttttaaactcaacaccttaagagttattcatgatttatatttccaatgtttgacttaaacattgtcctaaacgacttcctttatgagtacggagagagtatttcttagataactttataaaattgattgtttaactttctaatatttaattcttttgcatctctgccctcaaataattgcgataaactcagtcatccatgagaactttagaacacagcctactcgtggatcttacatcttgggtcctagtgctacgtatcattctagtggccttgttgtttctctcatgctcttgggtaaccgctgcatgtgaccacaccacaccgagcacagaaggtgtttctgaatgtctgcctgcccgtgtaacccatcaaaacatacctttggcctcacctctgtcttaccaccgctcccgtgacccctacattttgtcccaccataacctctctctaattaccctccaaaattgtactacttcctcctaatgtatgaaaccgttaactttttattaatgcttaaacattcaccttattaaaaaatttatgtaattatcatttattttatcgtgacttgatttatcatatttattctttaagcatgacataaatattttatatttgcacaaaaaatttaaataagacgaatggtcaaacgttgttcgaaaagtcaatggtgtcatacattataatacgaagggagtaataattaggacatatcagcataacttgtacccccatccgaagatacaactacttcttgttccatttttaaaaaaaaacaaagtacaaaacgcatacacttatataagcatgtgcacgctcaccactcatatgagcacacaacacgtacgccctatccctgtgagcgctttcaaatattggtccgataaattttaagattcatgaagtcactactcactacagacgatttgttgtcaatagaaacgtcagttaccatttttctttaaaaaatagctgtaaatgcgagcacctatgtcagatataaaatttgaacagttggatagacagtttccacctctagaaacatagtcagttgagttacactcactttgcctctcattctgtatctggacacatatatttggaaatgtaataatttcttactatgtatttagacatatatatttctaacttttagtcatatatatatctagacatatacatatatttccaatttatattttgagacgaatttagtaaagcatttattatttctctatataaaaatcccgtacataattgcatatcagaatatagtatctgtgttaattacgtatatatctggagccataatccagccgtgagctaagcttgccgtttgctggctagtgaagaatgcgtgctataaatacgaagccccacgagagctatagctatctcagtgtgctcacgtcacgtgcatgctctagtgaggcggcgagtgttcgacgacatggcgctcctctcggctcccgtgcgccgccgccgctcgcgcgtgcgtgtcctgctagtgtgctgctgcttgctactggcgctcgcggcgccgtcggcggcggcggcggcggcggggcatgactacggcgacgcgctggccaagtcgatcctgttcttcgaggggcagcggtcggggcggctgccggcggcggggcagcgcgcggcgtggcgaggggactcggcggtgtcggacggcggcgcggcgggcgtcgacctggagggcgggtactacgacgccggcgacaacgtcaagttcggcttcccgatggcgttcaccgccacgatgctggcgtggggcgtcgtcgagttcggcgacgccatgccgcccgcggagcgcgcccacgccgtcgacgccgtccgctgggccaccgactacctcctcaagaccatctcccaccccggcgtcatcttcattcaggcaagcacacacacaaacacattgcactgcgcaccgtcgtcttcctcgtcgacggcgacgaccatgtgagcgcggcgtcgatggcaatgcaggtgggcgacccaacgaaggaccacgggtgctgggagcggccggaggacatggacacagcgaggacggtgtacaacatcagcgcggcgaggccggggtcggacgtggccggggagacggcggcggcgctggccgcggcgtcgatggtgttccgcgacgacgacccggcgtacgccgcgcggctgctcgccggcgccaggagcgcgttcgagttcgcggacgaacacaagggcgcgtacagcgacgacccggagctcagggccggcggctgcccgttctactgcgacttcgatggatatcaggtcagggtaattcttgtcttgttcttaaatttcttcagtttttttgtgttttgctgctttaatttgtcactagaaacaaaaagctttgcatgctgttgctgcaatgctagctgctgctctggcaattcagtagttggcatcaaaactgaaacgctgcttagatatctctcgcatataaaaataaacgataaataaactgttcagaagaaacaaagcagctttggtgccttgcttcatggagtaccagctgacattgcacgtctttataagtttagcatgagaattccagtaggtaaggtcaaggaaaaaaaaaagaaagaagggcatattcaatggtagagacgagtatagtttcttaaacaatataagattatttagagaccgtatctttacaacagttgaaacgataaaaactctaatcattaactcaaaaaatatttattttattaatattctttctatttttttaccctcatgcaaccatatttccatattgtagtgattaagagtcgttgttaagccgttgttatgcatgacaacaatgttttgtctctcctctttcttccacgtcaacaagtattcctaattagcaacgctaagagaccactattgataaccattgtacatgtaaatgctattttacagggatattaaactaggaatacacgataatttctttccaaaatgaaggggtaaacaattatctagtccgggaacattaaagtttctatttctgaaactccacaaattcaggttgttcacagggctaatctatttatgagctttggggcaaaagcaactgttgcgacatggtttcatggaataggcatatgtgaaactgaagccgtcatttcacctgaaaaacaagttggccggagaacagtgtgacatgatgctcgagttgcgaaagggcatgtagcctagtggttgtattgatctgagtagcaccccaaggtcttgagttcaaatctccatatgaacgaatttcagattgagttatttaagggctaagtttcttatttgataggctaagttcctaatataaaatgagtgcatatatccgattggatgtagaggccgagtaaaaacccttctctaaaaaaatgatactcgagttctagtaaatagttacaatgctgatgtcatcataatcggttgcatatatccgattggatgtaaaggccgggtaaaaacccttctctaaaaaaaatgatactcgagttctagtatatagttacaatgctgatgtcatcataatctattacgttccatatctggtacacaaatacatgatacacagaggtatcaaacctgataccttatccatcaaacataaactaaaccgttacaacggtaatagcgttttctagtatttctggaaaaaaaaaactgaacccgtcaaatgctgttgttacgaactccagaattagaacttcacaaccatcagaagctcataattgatcacatagttttttttttttttgttttgggggggggggggtgaataaaaatctcaaagttcacacgactgaaaattcttggcaggatgagctgctgtggggagcagcatggctacggagagcctccaaggaaggcacctacctcgactacattcagaacaacggcaagacccttggagcagaggatagcaccaacgaattcggctgggacaacaagcatgccggcatcaatgtccttgtctccaaggtttgcctccatcaatctcctccagtttctgaacacaccttctgcagctgcaacaaattcagagaaacatcagtagctgacacaaagagaaaatgggttccaaatttggttacaggagttcatagatggcgaggtgctatctctgcaatcctacaaggagtttgcagatggattcatctgcacactgattccggagtcgtcgtctccgcacatcacgtacacgcccgggggcatgatctacaagcctggaggcagcaacatgcagcatgttacatccatttcgttcctgctcctgacttatgccaagtacctctccaattcctcgcgcactgtcaactgtggaaatgtttcggttggtcctgccactcttcagcagctagccagaaagcaggtagtacctccatcccaaaatataactaacttttgaaataatgctaagtcaagcatgttaaactttaattattaataaaaaagattataaactgattatgtaagaatgatgttactagacttatcattaaacaaactgtcataatatgcaactctttttatttaaaataactttttgtcaaagtagcatcacaaagattatgtcaagatccaaaagtaattatattggagggagcgactactgaattgtcctacataacatccaaatatgaaatgcaggaacattgactaactaaactctgaacattatattgtacttatttacttatttgcaggctgattatatattaggagataacccgatgaaaatgtcatacatggtcgggtacggcgatcggtatcctcaacggatacaccatcgaggatcatcgttgccttcgatcaagagccatccccagcgcattgcgtgcaacgacggcacgccttactacaattcatctagcccgaacccaaacccgttaattggcgcagttgttggggggcctggggaggatgatgtttatgaggatgaccgtgccgatttcaggaaatctgaaccaactacctacatcaatgctccattggtaggagttcttgcttaccttgttggcaatcctgatccaggccaaggccatgtcaggcattgagattgaataatttggcatctagatatagatgagggacagaagttataaataggggaaaatgtaagaagtaggtttgtgttaagatggcactgcctattcataggattggattgaaaagcatgggggtctatacaataatgagagcttcttcccatgttctcttcttttctcttctgtttttgggtttgcactgaattttgtgtggatgtgtcaaagtgcaattttactgcactaatacaggtggtattgaagaaacctgtactttgtgttttatatgaaaggttctcttacctgaaaaattataagaaaggtgtttgactgtaaacagtacagagtattttggaacttcacagcacaaaatgctggtgcttgataacgcaaatatttgacatgtatttctgaatgtaattctagatcaacctgacacaactcacaaacatacgtgcactatagccagaaagcagccatccaactggagatgatttatgatgatcttcagaaaatatccccaactacatggcaaaagagttcatcaaacatgtggttctataaaaatccaatttggagaaaaaaaaaacatctatcatagaatattccagactcgcaatcgatctgatagccaccaccagccaccgtgttgattggttacaaggacatggaatgcattgtgctctgattgatttataagcaccaagctattcagagtaaaaatccaaacctttgtggcaaaatccaccaagatgtcatcgtacgtcgtcgtcgccgcagcgttgctcgtgttcgtcgtcgtcgtcgtcgccgcgatcaagaatcttggaaaggggaagcttccgccgtcgccgccgtcgcttccgttcgtcggccacctccacctcgtcggggagctcccgcaccgctcgttggacgccctgcaccgccgctacggcagcgacgggggcctcatgttcctccgcctgggccgtgcgggggcgctggtcgtgtccacggcggccgccgccgccgacctgtacaggggccacgacctcgccttcgcctcccggccgccgtcgcacagcgccgagaggctcttctacggcgggcgcaacatgtccttcgcgccgctcggcgacgcgtggcgccgcaccaagaagctggccgtggcgcacctcctctcccctcgccgcgcccgcccgcgccgccgaggccgccgcgctcgtcgcccgcgctcgccgcgccgcggaggcggcgcgggccgtccagctcagggagctcctgtacgcctacacgaacggggtcatcacccgcgtggcggccggcggcagcggcgcgacggcggagaggttcaggaagatgatggcggacacgtcggagctgctcgccgggttccagtgggtggaccggctgccggaggcggcggggtgggcggcgaggaagctgacgggcctgaacaagaagctagacgacatggccgacgagtcggacaggttcctgggcgagatcctggcggcgcacgacgacgagaaggcggagggcgaggaggaggacttcgtcgacgtgctcctgcgactgaggagacaaggcgccgccgccgccggcggcctcgagctcgcggaggataacgtcaaggctattatcaaggtaacgaaaaaaatccaccattttttgaagatatatccattgtccagcatcgaatgtccgagttttgttttacaaaaacccagggttttgaatgccatatgtagggatgagagaaagaccgaacaaattttactaaaatttaaaatttttaaaagtcaatatagtgagttgtttctttccgctactggcgataaacccacgtggcaggtaaaggattatgggggaaatatacagtgcaaaactgaaaactatcgtaaaatttgaaagcataagattatctacgtcacgcacgagtaataaaactgtaagtaaaaattttattttcaaatttaaccgtaagtagattctttattactaggagtaagaactttatcataataacatggcaaatcttagactttcatttagtttacaaatttttggtgtagatgttgatacttacgggcacaataaaaaagtcatatttttccccgattggtaaggaaaacaaatgtttgggaaccgacgttttggtgcagctgttgataccttaggattgagatcctttgacgtaacttcccactgatttggtggctaacatgtggtagtcacagtgaatagtaacgtgagagaatctacttctgataccttataggtaaaaaagggtcttttttttctaaattcaaactgaatacaaaattctttttaatctttttgcaggacattatgggtgcagctaccgatacctcgttcgtgaccctagaatggatcatgacggagctgattcgaaacacgcaggtgatgtccaagctacaaaacgagatcatacaagtcactggctccaaaccaaccgtcacagaagaggacctaaccaaattggactacctaaaagcagtcatcaaggaggtactccggctacacccaccagcgccgcttctcatcccacaccactcaacgatgccgaccaccatccaaggctaccacattccggccaagaccatcgccttcatcaacgtgtgggcgatcgggagggaccctgcggcgtgggacacaccggatg

SEQ ID NO: 61748 - DNA, 16445 bp, Oryza sativa
  unsure (1)..(16445): unsure at all n locations
cctggtgtgattagtgactgatgtttgctgactttgaacagaatgtagcatatggctgtcgaaagtgtgcttatctaccttggtgaaagaatttacttcagtgagtcaggccaagccagttgcaaccaaaagtccattcttctgtctcctggaccattcaatcatgagactagtgtctttttataaaaccatgccatgcatttgaggatctgagctactgtctggctttctcttctggtttcatattggttctagagagatggctctaaaggtacacagttagttcatgctgatacaccatttgtccgtgtatagtgtatgctgtaaagtacaggtctttgcagtttctgtctctcttaaacaagtgcgttggattcaactcactgttcttatatctaatgagattactggtgatttatgtttttatggcactaccaggtgttcaattggctgaatcggaagaagcattctaatgtcgagtattgcaccatcaatgagaacaagggtaaggataccaggatatctctcttttatgtaccacatgttttgttgttctcatgttgtcaactcttgtttcttctcttctattttttttcctgatggagtagccatggaagagaaggaagactctctgcgtgcaagtgtgactgagcaagacactgaggccctgctgctccgtgatgtgcttattaatggtatacttgcaattggcacgctgggccacaatgtaaactcactctgtcctgagtcctgtattgaacaagatgagcccatcatcatgtgtgatgagaaagtggaacaagagaagtgcgaagaagaaaaggctgaggctaaacaggacacaccagttacagcaccaagtgaaccggcatctgctcttgagcctgccaagatgcactcatcatcgatgaaagaagacaacttcatgtgctttgtgaaggaggaaatcctaatgcatggcatggaagtggaagatgttcctaacatccaagaacgaccacttctgatgttagagaaggtggagaaagtgagaactacacttgccgatctatttgctgcagaagcattctcatcaagtgatgcagaggataagtgttacccgaaaatcgtcattgttgctggggcatccacttcaaagcctacgtcgtgcatggagaagatgcatcacaagaagccaacaaaaccaacgtcaaagcccgctgaaggctacaagaaaattaagtcgagtatggttttcttcgtctctgctttatttgttaagccttgttacattatattttactagtctggaatttattacactttgttccatggtcagtgcgccacatcttacacatatgttttaccatatagctacaactggagtaagcattatgcatctagccagtctttagtggtaaatgatcactgacctggaatgcacctttttggtttttgtcatctgtaaaataagtaggtcatgaggaagatgttggggaagaagatccacccagagcagctcaatggacgtagcaatgcagagggccctgtcactgcataatgctaggtttgtggacaaaagtttcctttctctatctggcaatttattacctagagtttttttaaagctgtctgttgaactatacagggctcaaggcccttgtgttttgcatacgattttgtacctttccaaattttcttgatttttacttggattccattgtttgtaataaaattaggttaatatctgaggtagtatttgcatagaatggataccttctaccaaagttatatttgtttgtgggtcctagagctagcatgacccacgaatcacattcaagaatatagtaattcgtttaggctacatttcactaggaatagaacatatgaatattctcaggtttaataaggcagatgcaaaaaagaactgaatagcacaggaaagtaatttttccatttcaagcttctcacagtcaaaaacaagtaatggttcaaaaattgaatattctatcacctgttgcctccatttatgtggaactcacaagagggtctaagtgctgcttgacactctgacctgtatttaaataaaatgttatcacctattgcctctgcttattattgggatctcaaaacacaatctattactgtgtatgccttggcattttttaaaatctgagctgcccccttattcttcacattttctcagaaaaccatataaacttttagataaatgaagcttttattgatctcagacaattacatcaagttgatagaaccaaactaagaacacttctggcctctgataatggaactgctgtttgtttaagtagaaagaatggtgtgtgtattttaacggttggtgattgggaattgggatgcagtgaccatggagactgtgttcttcagaatatttttaagaaatagtgttttcggtggatcctatcatggaactgcctatggtggaaagagcaatacgagttgaaacatatagggattaggaagcatgggttcggactaaaatgcattcgttcctgccatgatgcaaagcttcattcgaagcaaaatgagcacatgccatggtacagtggcgtgcaacgagcactgcaattgcacacgacgtgcatgttctgaaaaaggccagtggacactagacatgcagctaatcctcttttgatgaattctatcatgaaaccaatggattcgttgaaaatctgaacaaattgatggatttggtcccagctgtagaaaggttggcaaactcttctcgctcctgtattattgtaggctggagctatgatggaccaaatcatcagaagcaaatttcaccatatataagcatctacttttatctttttctctattttaaaatgtgatcatagtgaagttatatacattctatctgcttaacgctccacattatccaaaaaaatgcatcacactccatattgngaacacgttggtggttctgaaccaaagtcgatctcttgatgccaattttttttttgagctggttgagtagtcgaactgggaacaattactgcttgaggctacaaaatttctggccgacaatacgtcttgatcaggaactgactaaagaaattccctttcaccttttgcgggatttgttggatccatcctcacgcttcggattccttgctcaagagaaacatccatgcatatcgtcgacagcgttcgttcagtcctcttccttttgttgttggtgctgttgttattattgttattgttattgctgcctattcgctcgccagtgatgaagaatagtcctgcctatatttgcctgtagtacattgtaaagctacagttgacgtgtcttgtaagacccttattattattgtccataccacgacgtctcatcatcgtgttcctgtcgagattaataaacctctatcctatccgttctgctacctctcctaccctttaactgtgtactcgtttactaatccactcaatccctgtctcgtccatggtccatggctggattggctgcagcagctgcaactgctgtgaataaataaataaactagacgagtggttgcagtggtgctctgcaccaaagcagttcagtgtttatacaacaaaacaaggcgaaactgccaaagcagcagcttagctagcggaatggcagctgatgattgtaagcgtaaaggtaagcatcggcgcgtgaagctcataccctcatgcttgcttgctgctgctgcacgttgctgttcccgtctcgccatcggttcgatctagacgggtcgacggcgagacgggaggcgatcgattatcgataccaccagcagcaatactggtgctctccatcggtgggcgccgtgtcggacttcggttggtcgccctcatcatgccggatctgaaacctgacgcccacgccttcttcttcctcgtctcctcttcttcttctagcggggccttcttatgtcggcctagtctgacagagatggagaatttcagttgagatgcgcttgatattacagtgataactgacaagagtatgtgatttcaaccttaagatcatgtttaattcttaagacgctcacagtttcttcttatttatttgacaactaagtttcacgcgaagtagtttaatttttgttgtctaacaaaggcggataatttcatataacacgttcttgtagtgatcaaaagttacctcctcttgaagctgcaaaggggtgcagccgatggcaatggaggctggtaaggagtgagaggcgcggctaacggcgggaggccggactgcacgatagacgtgtccggtggtggagaaggccgacgtggcgcgatgaggcgtagccagcggtaaaggtggcgaccacgatgtgaggaggagctgtcggtgagtgtggcgctgtcttcgacgcacgaaggctagccggcggggggcgttcccacatgtcggcagaggatgagtggtggtggagcatcggtgcgacagccgtggactcgcaggtgatgagcagcgggtgaaaacccagcccggccttggccggaccgacaacgatgattctttcccccctcctaagggcgttgtcgtgccgtctcgtccttcaagggtggttgctgggtaaaagcccagtcgtggctcctttaagttcctgacggacggcgcggcggttttccgtcgcttctatccttggagacgtcgtttaggcatccccttgctgaaaccactcgaacgattggtgcaagcacgctctagatagagttgggctttgtgttggttgtaagggcgttttttggcattctcggctgtgttcctttattggcctagcggcaattggtccgttgctagctttctcctggacctgtgtgttgacgttgtctgtgtatgtggtggtttatttttgtccttttttctggttacgaccttccaggattgtaatcttgtaatttttttcgctttatcaatagaactttgcaccgtctcgtgcaagtcgttaaaaaaaaagttacctcctcatatttcacgtgaaacaattcaattctcgtagcgatcgaaagttacttccgttgcaaacggagatttgtgagttgtatgttgagtgccgcactgatcgacagtcactgccactaaactgattgatgatggggtgtcttctcaaattctgggcgttgtgctcatagcctttgcgacgcactgatgatggattctgtttctatggtaacagaggggtgacgatgatgcagcactgctttgtgcgcttcccaaaagcaaagatacactctgtcacgaaacagattaaaatctcttcatgtgttatctctcttatgtgcgaaatctctccatgtttatctaatttatgtgccagtagtgcctgaacgttcatagttttcgagcaaacggttcagaacttcatatcgacttctcctaagaaattgttcaaaactgtactacgttcttcgcatacagtagagttgagctaagtgttagttgggctgcatataagcccaattacatcaaacaaattgctggctgggccaatcttaaattggagcagaagaacatgaacctaaggttgaatgcacggattatggggatttttcgtctctctctctcctcatttgtcttttgatttatcgactacagttaaatttaaattttaaaacttaattttagagctgattttgaggggttttttaaatatatttttcttgcctttggcttttagaccacgaatgatatagatataaagttctggctataaattagttttcgtgttgcttgacttgcttgctttgttcatatttctacactttatcagtcgtaactcagatgatcagagccatactaaccccttcaaacatatatcttgagtgaattttatattataaagtacctgaattttcctcttccattagtacacatgttgagccgcccatatagagtaaaaaaaatcatgagcatataagggatgaggaaagactcaaaaaatatcgaaggttcgtcaagtcaaggactggggtccaaaccgtttaatcctctttttttttttgggagactgctatacagcagaatcccgtttaggtgagacaataccggttaggtatcatgttctggtattagtaccagattctagatgttaatacttgttgatatcacctgatacttgttgatatcatagcgatacctaccagatataaggagtcaagcaccgaagcgtcatcgccggtggccgtatcttctgcgttgaccagatccttcactgtcacgccttacgccggagctcgtcaccggcggccctactattcacaccccacgtcggagctcattgccagcggccgcgtcctcctttcactgagcaggtcctcttccccgacacacgacggaggtcctcacaagcggccacctcctcctcgctgctcagcttgtcgggacaaggggatcccgtctcgccgaagctcgtcgccgatggccatgtcctcctcccgctgagcaagccctcttccttggcccgcgttgaaagtcttcgcaggcggccaccttctcctcgctgctcagctcgtcgggacaaggggatctcgtcccgataggatcccggcatgtagcatttccaagtgctaattttttcccttatatttacctgaattaaattgattcttataaaaaaaatctacaagattatataaaatcaatgtatttcaaacgatggttgaaattgaaagcctttttaagaaattcaaggatcaaaattgccgtcccgcgaaaattgtaaatgcaattacttagttgaaaaatccacaacaatgttgtgctaaatattcatttcattcttgaacaagaagcctattatattattcttggaagctttggcatatttacactttctcgagatccccgcatccaagccgtccatctcgatctggacggtacagaaacgtgtcacgcctctccatccacctgtcgcatctaccattagcccccacctcctccccccctcttataacgcgtcgccttcccttcgccatgtccgtctccgccgccgtcgccgccgcctccacctcccgtaccctcgtcctcgcccgccaccgctcgccgccggcgtctagggtcgcggcgacaagccgcgggcgtccgttctcctccggcccccatcccctcgccgtctctcccgccacccgcgcccccgccatggccaccgacggcgccgccgccgccgccgcggcagggtcgaagaagaagaaggaggtgctcatcttcgacgccgaggaggacctcgcggtgtccctggcgaagtacacggcggagctgtccgcgaagctcgccgccgagaggggcgccttcaccgtcgtgctctccggcggatccctcatcaagaacatcaggtgattttgattgcttggaccccagagatcgcgcgtttcttgggttgcttcctcttcctccgggtgttctcggatcgcgtaaggaatctctcgccgttttggttggtggtggcgcaggaagctcgcggagccaccgtacctggattcggtggattggagcaagtggcatgtgttctgggtggacgagagggtggtgcccaaggaccatgaggatagcaactacaagctcgccttggatgggtttctctccaaggtattccctcgcgagctctggatttcttctttccgaaactgcttgtcctagtcgtcgtttcggcctggatgcatgatctgctcggggcatgatcaggctatttagggatcataatatttttgtggtttagagtgatggaaattcattcaggaatagaattctggtaatgcttgggttaactgaagatgaaaacaaagaaccgtgatgaagaacagattcaggttttcagacttagagcatctccaatagcctctttattccactctccaagccaaatgttagcaactttggacaaaaaatacactccaacttagggcctgcttggcaacttcgaaaaattttgcaccggtaaagatattacacttgtatttttcggggtcccgaaaattcccttttggttacggaggaaaagtttttccaggcaaatgatgtttgggcaaagagcaatgggtatatcacaatatttccattactgcagcaataggtacccattctgaaacatctttttctataaactgaaatcaaatagaaaaccaactgattataaagaattttcattacaaatcaggaagaactgcaatcgatacttgcaatttataaaagaaataagaggcaacaaatttgaatgagaaaacaatgatcttgaggaatttcaatcttgcctgctaagatctgaaataacaaagaaactcaaaagctgacaaaccagaactcaatctttcatcttgtgaaaataacaccaagcttctccttccaatccctcggtgtggcaccgggcgtagcgctgtgaaacgagcttgaggctgaccttgcccatcaccggataggagagaagcagggggaactgttgcgccagcctccgaagagggctaggtgagggtgcagagtgctgctagagctagaggaaagcctgctggccactggtaagaagctgatcgagctagaggcggcggccatgggatagaggggagaggagcgcagcacgagcacaaggagaggcgaagcggcgagcctgacttctgtcattttatttgtgtggcctgaggaggtgttactgttcttccgggtgtaatgggcattttccggcggattttaatccgataacagcccatccaagcagtcctttccagcccgtccagtaaaaactcatggaccggtattttacaccggttttgaaccaaaaaccgggcttccaagcaggcccttgtgggaagcggttgattgatatgttttctgcagtgtactagatctgtaacaaaaacacttgtgcttctcatccagtttacagaacctctactgctctctgtgagttatcggcataagcattttgattgaccaatgatgaaacgctttattcgactgtgggcagtgggattttataatctgcttgcctgtatccatgctcaattgtttgaaattgtgccaaccatttgaaatataccgtgaaatgaactatagtggttttttgtggataatggataatgaatcattagtatccgcaactgtgaatatttaggaaataagttgttgaagtggtgatccgagatgcattcttgtgtctacttattgcattttcatcagttttctggtgtgcgtgtaaatttctttgctgtgtattcagaagtactccttaactaggttcttcctttcgaatttctaggtcccaattcctactggccaagtttatgctataaatgatgccttgtcagctgagggagcagcggatgactatgaaacttgcttgaagcaacttgtcaagaatggtgtgattgcaatgtcgcaatcgactgggtttcctaggtttgatgtcatgctcctgggaatgggccctgatggccatattgcatctcttttcccaggccaccctcttgttaatgaaaacaagaagtgggtcacctacatcaaggattctccaaagccaccacctgagagaattacgtttacatttcctgtgatcaactcatctgcgtatgtcgcaatggtggtcactggagctgggaaagctggtgcagtgcagaaagcactttcagataagcagacttcgtctgatttgctgcctgtagaaatggctgtacttcaagatggggaattcacttggttcactgacaagccagcagtgtcaatgttacagaacaaatgaggtccatgcctggatattgtttaagctttcatcttaaataaagatccaggggctaatcccagcctggatactgcttaagctttcaatccaaagctgggttgtaatgatcttctgtctaaaaaaggatccaggtgactgcatagttgcattcctcttttatgcatcacttgtaaggaaaacatgagcatgtatgttgtatgttgttcagagtgatgtatctgagacactcctggtttcgacttagtaaataacctttcctggcccttgctcaagtgtctatgtttgttaaatttgcgcggttaataaaccggcgatcaacttatctacatattttgcaaattcagatagagaactcattttgtgcatgttattcaaatggtttcaattcaagacacaattctttttgtttactgattgaagtgatgccaatgctgcttgacaaagtgaggtaaactgtgatacaagcttggagacctgcatgattctgcattattcactattaagaggagtcttattcagagtgtattgcgagtaccttcagtttccagtttagtaaatcacctcttttgggcgttgcattggaaatatttagatgttcagctgccacttgtcaatacctgtaattgttagtttattgtgtatactgttccatccacagacaatccatatctttttactgcatttgcacttcagaacggcaccaatttcgctcgctttcagctgcctgtacatcgcaaggggctagtgattattcaatttttagagccatgcataggtagtgtacaggttgatctgtaagatttatattttcaggcagtactgcacgaggatgaatttacttaggcagcagcctaaatggctgtacgttcaaggcagggaactcagaactgattagcaacatggcctttctacccaacataaatcgcgcattaattgtgctgtctgacactgacctcggtacatttctggcatctaaattttcatagacattcacattttgggcaataatagcatgttgacccgttgacaaattatttcacatatttaaccgtaaggaattttggaggaatttcataagaatcgaactactcgttaataatatttgacgttaggagtactagtactcttagcatattttgaagttgggagcactaattgtaatactggaagtagtgaattttatgaaaagttctataaattccatactcctatgttccaaagaagccttaatcatatgataattgaacttattcctaaggccgagtttagttccaaagtttttcttcaaactttcaatttttccatcacatcaaaactgtcctacacacacaaactttcaatttttgcgtgaactgaacacgccctaaaagaaattataaattccatccatttcaaagaagccttaattggataattgaacaccacgttttcgacatgatttggcaggccaaccgtggtggacacatccagagtgaatgcagggagacgagacgatggaccatggctgcattcccctcgtgctgccacgggctctcggccggccaagccaagccgccgcaccgcccatttcggccatttgcaccggcatttgcagccatggtcctccatccatctgcaacgcactccaaaaatcccaacaaacaagcagcagcaacacatgattccatgagctgctccagtgaaagcttctgctgccactcgatctccagtttgcagcaagatattactaatccagtacctaacctctcacccaggttcatgtgaggtgtgaccctatctcctctcaagactcacatgagctttggagcaaaagaacatggcctagaatctagggcactcttaaaaatctaacctattagtttcaaaagaaaaaaaaatctaaccttggccatgttagaggctcatcatggtgtggcatggaattctttttttgttcggataaataaaactgaaagattcagaagcctgatcttggggacacgttgctcgtcactacatgaggagagctccatcgttgctgctgttggtttccccacaaaactactccgcatgttcaactgtctcatgtaagatcatattaaaattcttggtgttgcaacttgcaaattgtgactttgtgactgaactcatctgtccaaattttgtgtgtgatcgaattaagaaggatactggatatatagagaattgttaattaacatgtggtagcagaatagatgataggatctttcattttttttgccgcagcaattgataaagagaagagaaaggtaaaggtgttcgtcaaaggtgcgaccagtgcagaaaaaaatttggggtggttatgattgccggacagacctgaccgatcgatttgcttttgtcttaaggttttgtgcttttttttgggcctgctttattctaaccatgcgtattgaattaaatcaaaatttagctggagtacgtaataacttgaatacgaaatacatacgaatttctgaagaaatttgcagccattacatgagaaaacacgcgcgttattgtcatgtatgattgcgtatggttgttaatttggcttggctgcatccacaaaagattttgatgactcgttcaatgagtcggtccacgcgaaatattctccaattttttcttcgttttttttcgagcatatttgatccgttgacaaggtgaggatttccatgagctaaacgtgtcaggtcacaagtcaatcagtgttgatcacgcccatgccattttatagttcacacgtacattgacctacctgaaattagtgcaggattaggttagaaaaaaaagttaattagtggttgggattttcatgggcttcttctcctggataaaaccgtgtggatttggtccactctgaatggttcattcaaaatttagcattgcaagtacacaccttttagacaaacatttagacctattataagcctaccaaatctcgcatgaattgagttaaaatacactcaagtagatgcatataaaaaaatcagaaaaacaaacacgctattaaagtatgaacaaattttcaggtcaaccaacccagtctccttttgtccttacaacctaagcttagttattcagacaaacataaaattgccaaagaaagagttcaagaatgtatccccactttgaatatttttttaaaaaattaaaaaaaaaatcaaagaactaaccgaattcaaaccaaaggtacatcggttctattcgtaccaaaaattcctttgaaactactagtatatgattctcatcctctacttgttttgtttataagctgcaactaatatcgaaacgtaaccttagagttgatttaagatttttttcttttattctactaaagctattatccagtcttaataacctctataatataatttttactatacagacataaaaagttttacctaaactaataacctaataacatgttctttttccaatggtttatcaaccgacaagagcccaagatttaccaaaccgtttggattgggactactatcaccttatgatataacgattatcacgaaaaccacgtggttaccacgaagtatatcgtggttaaaaaactgaaaatgttatttcacacgataactgcacggttttatagacatttcgggagcccaaaagtttcagaacagatccacaaatgtggtgggcccacaccgccagcctctcccactgacacctaggccccacaagaaggacagggccggtgggtcccacgtggcaggccggaacaaagacccgtttaaacgcgcacggcacccacccactcctctctccctcttcttgtgtgtgtgtgggtgtggctttattggcgtcacatgcgccctcttttcctctctctgtttttcttctttttctctctctatctcttcgcttacgagcttaaagagacaacgagttaaagccgaggaagaaaaaaaaaaccaaccgatttttttttaattaaccggcgcctcctccttgcgcggcgtgcgttcgccggcggcgagatcctgcggcggcggaggaggaggaggaggaggaggaggagggggatggagtggtgggggccgggggagtggtggcgctggtagtggcggggacggggagtggttggttgggtttggggagtttggtgggtgagagagggggagagggaaaggggacatgaaggcgctgcggcgatccagcacctcgtcctccccgtcgtcgtcgtcctcgtcgccgacggccgcgtcgtccccgccgtcctcgtcgtggatccacctccggtcgctgctcgtcgccgcggcgtcgtcgtcttcgtcggcgtcgtcgtcggcggcggcgggaagctccgtggccatggtgtccgcttcggcgcccgccgcgtcgtcgtcgccgtcgccgtcgccagcgcccgcccccgcgccgtcctcgccgcactcggatcggtgggttttctccctctccttcggattggtgaaaaggaggagtaaaaatgactccttttttagtcctttccttttgggggcgtcttgatctgcttcccgtggagtctagcctcacatgttctgatctaattggtggtctggaggctgcttaggtgctcatgttatggtttttttgtgcgcctcaatccaaccaagtctttggatttcagcttaagagtgcagtaaaacgttagagtgacagcctggcttaattgtgtgcctagcaattcctgcctcgtgcaggaaggttgcggggcctgcaatccaaactgaggacaccggatttttaagagcgaatcgattatgtgttcaatctgttgacatgatagtgggggagattcggtttgttgattcagagagatcatggattctgttgcagagtggtttgcttactctaaaggtgccttccgtctaagttctagtgtgataagattttgtcatagtttagtggcagcgttagtgctgaatgcagcttgcacaattgcctcaagatatgttgatgatgtgatgctgttggtggtttgaacaagggacagcttgctgctatcttgaattatgtgctttaggttgttggatggcatggtatttaagaccttggaggtgatcctgtcccctaaggtagcaaatttagtttctaagaataatagggggggtgcttgatgtttccttttggtttgggagtgaagctgtggcactgtaaatgctacctaaaagtttggatcttccatgagttgaacaattttgctgacctgaataggtatcaccgtaaatcacaagagtttttagatgatacacctccagttttcctgtgatctgctcttgttccgtagttatctcttgtcaagtttgctttcaacttatttgttcactgatctaggtattatattgaactgcatgttgactataacgattcctttttgtagcccaggtcctcagataactcataactatgaatcattgcctagaaaatcgttttatgtggtcatcttttcttaatccaattaccaagttcaataccatcaatttttttcactagcgtatggtgttagggaccctgtttcatccacagattccatagtattgtctgatttatgcctcttgatcgatgtatgtattattcagctatgtagttttgtttagataatggataaaattgtatggttagttcaaaatatggtagaccatactgcttgattaagaatcagttcatgctgcgcataacgaatgtatccttgacgctgcacaattatgttcttaacagcactttgaaacaataactaggaggaagtttttcagtatcacgtttgtttcgtaaactaattaataccttaatatctgtctattttatgaatttgttttatatccaaccttttcgtgtgcatacaaattatatgtgaagttggatttatgaggactcaaagcattccctcttcggatgctgtagcttagagagtgtgttaaagatggtactattagttagtctgtcagttggtatggcagtgttatcttttattgatccatatcttccttgttgctccactttctaaaactattctttaatcttctttcaggggtggaataaagtctccatggtctcgaaggaaaagaaaacgagtactttctcgtcaacaatgggaaggtctgttttctgctaatgggaaacttcgtgatcgaggaaagaagtttctgaagaaagttcgcagcggggtaagtttgattatctatttgtttagatgtcctgcatatgtttacaagaatacttgcctattgttttgtttgttcaaagatttagacatatatagtagtgatattgaaagcatgttctgcatcttactccgtacagtctaattaatatactggccttttttttctgttgtgtcagggcattgaaccaggaatcagggctgaagtttggcccttcctgctaggagtgtgagttttttaatctcttctatgcatctagtaattcataagctttcgtttctttgaccaagtttgaggtcgcaactacatacacgtagacttcctatagcacctaattggttatgtgaccacatggagtgtgcatgttttgtgtagctctacgggacggctccgattcatggactagggtccttccttactgtttcccataatgaaaaggtttaggattatcagttagagaagatagttcttcatggcaatataatacaccattcttagtatttgaatccaggataattaataccttcatactacctctgtcccaaaaagacttcatttctcagtt

SEQ ID NO: 61749 - DNA, 3122 bp, Oryza sativa
ttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctaatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtgggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgagggaccggacatgcatgttggtacaattatggagtctcgtgatgctaccttctttgagagcttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggatttcattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagttcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcttttgctgtgagcaagttgagccgatttacctctaatccgggagatgatcactggcgtggcgctgaggaagtaatgcgctatctgaaagggactgtggaaatggggccttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaataattctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacaatacattggaaaaggcaaatctcagtgggattttgagatttggtgggggattg

SEQ ID NO: 61750 - DNA, 16101 bp, Oryza sativa
agtactactattatgcccagttcgccacccaaaatatctggtcttttcatctgccgaatcgccgttgaaatgaaaacagctagtagtactactactcgtagaagtgcgttaaactgtataccgtcgctcgcgtcgcgcgccgttgacgactttcccgcgcctataaaagccggcgcctcgtccgtcattccgcctgtgtcaagccgaagcgttgagctaacgaacgagagtcgtacgtctctagacagtcgagtcaacaatagtcatggcgactccggaggacactggcagctggctgctctacctctccttggcggctaaatgctccggcgatggcgacggccagcctcaccggcttcttgggttcgtcgtggtttgcgccgtcgctggtctggttacatgtctgctgcactggtccttccccggagggccggcgtgggggaggtggtggtggacgcggcggcggcgtcgggggtcgccgtgcggtgtggcggctgttcctgggctgagggggctgccggtgatcggcagcatgtggctcatgaccgggctggcgcaccggaagctcgccgcggcggcggaggcggcgggggcggggcggctgatggcgctgtcgctcggggagacgcgggtggtcgtggcggcgcacccggacgtggcgagggagatcctgcacggcgcggcgttcgccgaccgccccgtgaaggagtccgcgtacgggctgctgttccaccgcgccatcgggttcgcgccccacggcgcgtactggcgcgcgctgcggcgggtggcgtccacgcacctcttctccccgtggcaggtcgcggcgtccgcgccccagcgcgcggtcatcgcgcgccagatggtccgcgccatcaagctgcagcagcggagccggagcggcgattccgccgccggcgccgccgtcgaggtccgccgcgtcctgcgccgcgcgtcgctccacaacgtgatgtggtcggtgttcggccggcggtacgagctgcagctggaccccggcaaggagagcgacgaggtccgggagctgagggccctcgtcgacgaaggctacgacctgctcggccagctcaactggtccgaccacctcccatggctcgcccgcttcgacctgcagagcacccgcgcccgctgctcccgcctcgtcccccgcgtcaaccgcttcgtcacccgcatcatcgacgagcatcgctcatctgctcccgtcgcagccgccatcgacttcaccgacgtcttgctctccctgcagggcagcgacaagctcgccgactccgacatggtcgccgttctctgggtgcgtcacgtcaccgaagaacccaaccttcgtcgccggcgactacctctgcatgttttctcatcggttttctgatacgtgtgcaggagatggtgtttcgcgggacggacacggtggccgtgctgatcgagtgggtcttagcccggctcgtgctgcagcaggacgtgcaggctcgggtgcacgacgagctgggccgggtggttgggctggaccgggacgtgaccgagtccgacacggcctcactcgtctacctccacgccgtcatcaaggagacgctgaggctgcacccaccgggcccactcctctcatgggcccgcctggccacgtcggacgtacacgtggacgggtacctgatccccgctggcaccaccgcgatggtgaacatgtgggccatagcacacgaccccgacgtgtgggccgagccgatggagtttcggcccgagcggttcatcgggaaggcggcggagttcagtgtaatgggttcggatctcaggctcgcgccgttcggatcgggtcggcggagctgccccgggaagagcctcgccatggccacggtggcattctggcttgccacgctgttgcacgagttcgccctcctcccctcgcccgacccggcacacggcgtcgacttgtcggaggtgctaaggctgtcgtgcgagatggccaccccgctggcggtgacagcgtggcctcggcgtgtggtgtgatgacgtgtccaagctacgtcatcagagatgctccttacaaagactacttgatggtgccttgtactccctccgtcctaaaaaaaactcaacataggaggggatgtgaccccttctaagacaacgaatctggactgactaacgacgcttagtccagattcgttatgttaggaggggtcatattcccttctaggctgagttttttttggacggagggagtagttgtagcatatgctttagatgctcctgccactacatatataggatgtgaagtgctgatgctttttggacgcctggtcagcctgcaccggcacaaaggccacaagggtgtgtatgctggcgaaatgaggtgactgagtgtgatatttttgttttgtactgttctcttgctaaatattaccctcggcttgctctgtaaattagtctcaatggtatggaattgtacatctattttactgccaagactcgaaatctccatttccttgcaatgctaagctgaactgtaactgatttggctcacaaaggaaggaccaagaacaatccctgacaaaacatctcaaccataaaattcaggagttaacaaaagcatccgacaatctgaagcatgactagatccaagcatatcctgaagacctgaacactagattttattccttcagagttcagactgtaaactagctaaccagccacttattacaactggtctgaactctgaattattcccagcttctttctctgaagatggcaaccgtttggggctcttggcagatagcttcttgtaaccgcgctacctgccatgaaatctgaggacaacaacttggcatccattcctacccaagcgcgtgcctctcttatctcccaatttcactgccgaaagttgccaagttcactagcgggtcgcttttctctcgaggcacaagttgaggcgctaagctacaaaactgaaactggcatcttgggtagaaaccgatctgtgaatccgacgcatgatgttttctagtaggaggttcagtttaagtcgatcggcagaatgtatcactgtctttgcttcatttttggtttctttcatgataaaatccagccgatcgaattgccgcgcaatcgcagtctatccataatccttaatatagcagtcagtgtttatttgtcactgaaatgtggggttgaaatggccaaatgttacacaggaacagataaggatcatgtcaagcatatgatatgtagtttttgctatgcagcagtagttaaaattgttgcaaccaattactcaagtcagtttacttttcactcatgcatcatgcatgctactacatcaccaagacaggaagcactattaattggtaggaaaatcacatgataagtacagcatattattgatgagagagcacctagtgcatgctcaggattctttaacaactctgattagaagggttttaggctttcagcaagtgtataatgtatacgcagaggttctgatcgactgagtcacagacccataaatccataattaattctggaaagggattgctcaagcttttagaacagagattaaactcaccaaatcaatcatagtgcagcaattttgctgttgtcagacgatctgtgtccacttgctgtatctcagtccaagtttgtggtcagattagacagttaagcagccggactgattgattgtgtagcttagaacgactcagattgatttatgcaggcccccagctaagctacacaatttacatatatatcatcattagtatgcagctgtttcgattttgcccaaaagatgcatcatgatcacgcaggaacaacatggcttcacaacaaaggatagagcaccttacgatggtctgtactcctccctccgtcccataatataaggattttgaatttttacttgcactgtttgaccactcatcttattcaaaaaatttatgcaaatataaaaaataaaaagttgtgcttaaagtactttggataataaagtaagtcaaaaaaaataattctaaaattttttgaataaaataagtggtcaaacggtgtaagcaaaaactcaaaatcacttatattatgggacagagggagtattatttcactgcagtattatcaccagcagaagtgatctcaatcattcaattgtgagttttattactagtaaagaaacatatattttattataagtagttgagatggtagtacagatagaaataaatgcgatatatggattaggaaagatgaagtcgaaattaattctaatactactataaaccatctccaaagggttattattatcgttagaccttttatgaataagaaaatctacaggacggtgtttgtgcaagataaattaatgaaatactaaccctttcctcttccctcgctccatcataatccgccccctcctgtattttcccctcctcctcctatgctcctccttctagccgtagacaattacttcgtagaaatgcttagcgatggtggagcaggccaatgaagccagattataggctagacctttcccacctactggatccggccgagtgcacgtcaataacaagggcggttgccagcatcattctcgtggcctcctccagttcatactttgaggcataacggcatccatctaatctggcttccatggcgaaagggggcgaccaggaagaaggaatgacatcgagaaagatgccaatcagcgcattgtcgatggtgatgcaagggagaggccaataaagttgttggacttggagtttcgattcacaacaacatggtggtgagcccatcgtgctccttgccggtattttgtgcagttgcggtgcattatccttatctggtacctatggtatcacagctgatacctacggggtatcaagtctatcagactgtcactagcacctcctctcctcttctcccttccccttggctcaacccttgctccctgttattgttgtcgtgacgagcgtcattgccaatagggatgcaagtgggtagttccgctacccgcataaaaacccgcttgctagtttatttctcacacgatattacaaaatttagaagaaaaaatgaactaaaagtaagataagcgggctaaaaaacccacttgcccgccccacttgcatccctaattgccaacgtagccgctgttggctcaaggtgcggggcgtgagtgcgtggagtgagggtaggattatgctagactacgagtaggagcggatacatggaactacgtcaaccttcataaagtatcctgttcggacgatatcccatgctctagcagctctctttatgaacagaaccatttgttaaacatacggtttggtctatctgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcgcttgaagcatgtgtggtggagagaagaggggaaacacacgcgcgcgctcgctcgcctcgcctggcagggcagggcaggcggcgcgcgtgcacgacgtacgcgtcgaatggtccgaaaaattggctcctcacccttgcgcagatgcagcctccttttgcagttttgttttgttgcaaattcggattcgtttttgttttggaaacgttccgaaagatccggtgcgtgcaaacggcgtggagtccggataagttacgcgcgacttatccggttcggttacgcgcaatagagatcgtgcgggcgccctgatcaagcgacccttctctatataaaccgacctgccgtcttcacgcaacatacaaaaaaatcaatctagggtttgcttcctactctgtactgcgccgtcgctcgtagactactccatcccgctcgccggcgtgcaccggcgatcgggagagcaggtctccggaacctctgccttcgacgttctgcaccgggagaaggcggtaataaggtttttgggaagcgcttcgcgcgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctattcatgttatactgtgtagtttacatgtgtagatctaatgatgcgttcatactagttttcatctgtaatgtcatgatttatttatggaatagattaaatcattatatgtctataatctcaacactatcaactacgagaaaaaaaagacctgcataaaaagcaagttgtgtaatcatattctaatagtcactaaaaaagggcagatataaacacaacactcagaaacagcaaacgcgagacagcacacttttctctgaaagtaaagaaaagctaggaaaactcttgaagctgttgctatcgttattaggtctcgacgtccatgtcgagccatcgagtgtcacacacacacgctttcctgtactatgttcagtgcatgcagtacacacttgccactgaaaatgcagcactaaaaacaaacagttacagtgtatttttaaactgaaatttcactggcgtaaattggtcacttatcgagttcaaaatttcagaagttttccaatttatccaaagtataaattttgaattgtatggtgtaagattagcggtagaagttctcacatttaggccaattttgaattggagcaaaagcaaagaaaaccaaggatttgctttcctatgtatttaaccactgtaacatcgtttggatcaacgtaattaatggcacaaaggaaaatcgaaggaaagcataaagaaagtttccttccctgtctattccagaggaaaagaagaattcactcagagctcttgattttcttttcatcccttaacttttcgcataatgtttgaccattaattttattgaaaaagttagtacaacgttcgcacaacattagcagcataaaatcctctaaaattcttaatttttcatatgttccattcaaatacatatttatatagaattattgtgtttttcaatattctgttttacacgggcgttcctatcggtttcatttctttttcttttctatcatgtatctaatcctccgatcatttcagtggaaagcatcgtcgacaagcctatccgtttggtgtttggagctcggacactagtattctgcagtcacaagtgcaaccttatgacagtgcaatgtaatcgagtgaggtcagctacactgtgaggagtatgtttggagcaaacaatttttcttttttgtagaaattaatttcacagtaagattctgtcgaaagcgcaggagaggtcccataagaatttgacagaaactaatttaatttagtgccaaatatatacacaaaggcggttacaaagtacacaaccatccaaaaatatagctactttagtgtttaaatgtccctagtatactccctccatgccatattaatcatcacataaaaaaaattcagaaatttcaaactgatcgtcacataacactgacatcttcatttgacgtgcagtattattgtctatacatgcaaattaagtttgcatgaaatgggggtaattaattagaacggtcccaaccctccacatgagctaatttctatagcattaaagagtaaattgcacccatagtacaacaatttagcgggtggctgtgatatagtacaagaacttaagaattaaacattcgagtgcaacaacttgacaagtgggtgtgttctagtaaaagaacttgacaatttagtattttggtgcatcaacttagctaagcatatgctaggtgagtttttttttcacgatgtcaatatgctgttacatagcaatcctacagatattatcttacaatattaaatttaatctttaagaattatactgcacatccaattaccttcaagaatttttgttttcttcaccttcccaaatctcaaccgaaatataataatttctacatccagtttaattgactttcagttattagttattagaataaaaatataaatatacttatatacaaacccacgctagtatattatcaaaataagtacttaaaaatctaatatgtgtaaaaatgtgctccaaataattaagttgttgaataacttcttaacttattgtatcaaaatcatacatatcttgtaagttgttgtatttatacgatcacttatgaagttcttatactaaattgtacttatctgccaagttgttgcactagaacgctcatttctcaagttcttgcaccaaattgcacccacctgctaagttgatgcatcatgggtgcaatttactcatcattaaatatattgtcacataagaaaaaaataaggtggcaaaagagttaatgagtagagagggaaaaaagatgaagaaaccatttttatgcaacaaactagttctacataaaaaaaagaacaaggggataggaggatgaggagagagaataaaggtgattggacaagaatattgtcagggttatggataagtcataccctctatccttagggtcatgagacatacggatacggtatatccataagtacacgaaaaggatctgtataaatcaaggaaatagtatttgtgaaatggaaagtaacagagtcctactcggagaggattaggatatagtttggtcgtacggggtccgttgtctccgacttctacttggagactaaggtgatctacggtataaatacaaaccccctaagggatacagggtatcaaatcttagtgcaagacacctgccaccatagacgcaatccggaggacttgaagcctactcgccgatagatctcgttgaacccctctcgacaaggatctcgtcagtaatctcagagttcagtcgttctcttctgtactctctgtggtttcttccataatcttatataaagtggattagcgctattaccttacgaggggtctgaactagtataatcattttcttcttgtatgcttgatgtcgtatcgtttagatcctcgtaccaacgtaccccaataccctccaaatacgatccgcgggtatcccccgtcgacaaatatattttgaagaaactacttattgggtacatagtttctatatatagtgtctatatgataaggtaagtatggaaatcactatatgatttctaggttgggattgcccttaagcactctttccttgtgcatatgaggaagtttaagtctatatgtttcttgattattctctaccactttttgtacaacaggtaagtctttcgttacccagcttggaaaccaagcccaagagacaacataagtgcatacatgaaaagcagacaagagaaccttgctgcactaaaagtgaaaaaaggcccaaaagggcagaaccatagtaaacaactacactggggctatgtcacaccccaaagttctttcccaagcctaaattgaagttataaatggtctcaaaaaaatacttgtgtaaatcaagagaaaaccttaataaattaatgcaaataataatcagaattggcatgtggaatttttcttgagttctacatgtcgaaatacgctaacaagatttttagtggaattttcagagccctagaaataattttaactaattaaaattgagcaagcaatattttaattccagggaaaatccttttcttcctttttctttttctttttcccccttttcttttcgagtgggccgccggcccattccccttcctcctctcccctccgctgggccagccgaaggccaaggcccagctaggccggccgcctccctcctcccacccaggacgccgacaggtgggccccacctgtcgggcccgtctcctacctcgcgcccgcgccgccgcgcccgcaaccgtcgccacgcccacgcctccgcctcctccgggccacgtcggtcacgcccgcgcatgcgccgcacctcccgcgcccactcccctctctctcccgcccgcgcccgcgcccgagatggctgggattcgattttcgaatcccgcctctctctctcctctcccactcccccacgttggccggcggaatctcgcccctaccggccacgtccgggactcccctcccctatttaagctccgccgtcgccccctctctctttttccccatttcgtcgaactccctcttgctccccatcgctcccgcgccgtgcacccacccgctgccgcctttcccgccgctccggccgccgctagccgccgctaggctcgccgccgcaccgcgccgtcgtcgccgttgggttcgcaaggacgaactccaccccgtccgcccttccttcgtcgggattcgtcgccggaattcgcatcccctcgcgctccggtaagttctacctctaccgccgccttcggccatggatgccggccgccgtggttcatctccctctctctaatctctctctcctccttccttagggcaccccgaagcccgtccgccggttgccgtcgtcctcccgtggcttgccgtcgccgttcgccgtcatcttcctccgcgccggccaccctcggtgaggcgtcctctcccctttactcccctccctctccctcctagtgccgcgccgccgcttcaagtcatgcgccgttgccttcggccgccaccgccgcctcccgtgccgccggtcgccgtcgccgtcggccgcgtgtcatcgccgctagccctggccggccggccggctttgatgctgagccgagcccggcggccacctctatcgccaccgcccgatcggctcggggccgatctgggccgtcggtcccgtggaccggcggtggatcaccctgtggtcccggtccacggtggaccgcccccccttgagccgctgccgagtggggcccacgtgccgccgccccttcccctctctcccgagccactgaccagtgggacccacccgtcggcgccgcccccttgatgatgtcagccctgggaattattgcgcaataaatgatttaaggactttttgttatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgtttgccttgtatgtcgctagattccggttcttccgacgctccggtgtacttcgaaatagtcgccgaggtttctccagcagcagagcaaggcaagtcatgcttgtcacttgatcatgttgatactatattgcaaatgttctaatgttttctttcaaatactacatttgttttgcaatatcactatgggatgtttacctattgttacagccatgctattttggtaccctgctccttttttagcttgggttataacatgaatagacgttggactaggagttgcttagccatgcttagttcaactagtacacagtggggaaaatcctattaatgtttagactgtaggttcatatgataatgttggtttagtaccaccgctttggtgttggttaattaaaatgaatcacacggtgggctgtgggtgcatgattttgctagtcgcacccatggcagttaaggaccggttcgcgggatgccctggaagaacttatcgtacttaccacaagccagtgtgggcaacggctgggcttgtagtgtagctttcctctagctgacgcatccaggcaagggtgggcgtgatggagcggggcgggccctgcgacggcctctgtcgcttctggattcacctaggtacgagaggggactgcccgctgccttgcgaggagtgggggtgaaacctgaggtgtggtgtgcttggttagagggggttatgcaaagggtcctgtcacggcatctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtctaatgaaattggatagtataggtggatggttgggcctgttgcaacgtgggatggcgttggacagccgatgatcaatattaattaattattgcaactgtttaattctttcaacttctgtttataaatgctcgctttatgcaaatgaaccactttagctctcttttgataattccctacatcatacccctattccggtatgacttgctgagtacagtgggtagtactcagtcttgctctattttccccaaccccagagtacgagtatgtgtcagatggaggtttctccgaggagtaggcttcgtccgtgccatcgaggatgcctgtggagtggtgttcccgctgcagttctagtcaaggcttagctcctgttgtctttcgtttttccactgtatttatgtaagacttttatgatgtttgtaagatatggatctgaatgtcaacattgtcgtttgtgtaccccggccggtcctggacggggattttaatacacattctgcttggaattctattcgggaatttctgggcgtgaccacactggggctaccagctatccaggacaacatagaaacacaagaaaacatactcatattaaatgaaatgcatggaagttaagccatcctcatctttgatgaaaaaaacttctatgaagatcaaataggagcggagggagtagctacctagaattgtaaaaggtgattttttttttcacttactttttcaccctacccctagcaatctatatcaaaccaactacctagccttagaatataataaatttttaccttgcaccataatccttaatctctccaaaaacaagctagatacttatattttgagacaaaggaagtaggatttagagttataacatatgcaagataaaaaaatatagtctgactcttatcctaaactctcccttaatagagatacaaacacaatataactgcatggggacagtaacatatgcaagggaacaatggcaagtggttcaagcagattgagatttgttgataccttgatacactgtaattatgtcagattgggaaagagtgcttgcaattagtgtctcagggatgtatgttttacccagtattcacctagacgctaaacgctagacggacggtgacccatggtatagagtctagctagtctagacgatatgccgtacactatattatcgtcattttttttatacacttaacatgttccataaatattgaagaactagcagctttatataggtacaaccactcgagtaaagccatgggccggacaaatatgcagcaaggtccacaatgacgaatagcagagaagagacgacgtaagttaattgcagtgactggcttagagtagaggagaaaggtttggaatgaggtcaaaaccttaaaccatatgcactttggattgggctcgaagttttaactcctgccacacaaaaaatgcattggcccattgcctaggccatagtctaaaacgacaggtttacaatttacacttgtctatatattgtctaattatgtggtctagatagtgttcgaattggttttgactgactggacagtcgaacagtctaattccaagttaacccaacatttagggtctagaccgtctaaactatatggtctaggcgaacactaattttacgttaacctcagtaacaaatattatatgttagtatcttcatagagtcccactccggtgctttctactcggagtataaattaatctaaaccgttgatcgttttatatctaatgggtcagatctatttatactcctatcttaaatagcggtagtagaaacgttagagggtataatcgtccaaaaaatatggacgggatggttgaattcgtaattttgcatatcagttagaaacacttgagcatcgttgggccgtgctaggtttagggtgagtgtggcggagcagatgcgatgagcagatcggcggcgtgcttccatgagatcgttgcgggattacggcgggggatcagcctcgggaggctactccttgcccagcggctcaaatgctagagatcagtatgcgttccacgccaggcccgagaaggagacatataactagcgagcctgaagccctgaaccacgacaagaagtcagatcaattcaacgatttcaacgccatcgaagccaatcaatattacggtgttttgagcatcgctttgaactgagcaaatgaccactctgaacttaaatacttcggtaccatcttggacaaatttagcgatgttaatggcttaattctttaagaactgaaaacacaacatgtggagaaactaataaataggttttaaagataatcatggtgagtttataacagcacatttgctcttgctcctcgatttgactatatagctttgttcagtagttctttgtagtattatctgttcaacggaggagctcgcacatgccggagtgggcactgccgccggagtcgggcgcacgcgagaacgaaagaagcggtgacacagacgaactgatcctactattaagaaaaaaaagtaaaagttaaaaattacccttaaccataaattagtaaaatactaatttgcccttataaattaatggctcagattgcttctacttgtagtagaatactacaagtagagagcaccatagcagtgctcatcttcataacgattagatttccatggtatttttttcgcgtgcggctattgaggtctatatcggtgctggtttttatagaaaatgggaaaatgcgttgcaatccaaacaagagaagacatttttctggtgactcgtcagctcagcgcatgggcaaagccccctatctcgttacaatccaggagtactagtgtttccactcggaacatatgttgctgccgcacgatgcaaggtggaaacagacagagaataatcgaaacccaagctaatgcttggtcaccacctgcaaatattactttctccactctactaaagcctcagctaagctttgttcctactgcacttttgcagtgctgtatatagctgtgcactggcatatcactaccagggggtgatgcacaaaaaggtttctggctcaaatgatcagagaattgaagcgcacacacacgagaagagactccagtggtgagacacttctgatctctctgtcccccattgcaagtttgcaacctcaaatgcagttcaatccccacacgtgcaaatgcagattgatcgaccaggccagtgggtatgtaggtgtgtagccactgtgtagtgccagttgaagcaatgatatagctcatcagcattcagcaagatgaatgtttcttttcgaaatgtttatcagattgatgaaacgaatgatttgtttcatgctttaaaagatatatttttttataaaaaaaatttatcgtattgtttggatcatgtacttattttaagttatttattaagtttatttgttaaaatattcaatttgtccttataattaagtagatcagccgcagcaacaattcactcagggctcattcggttcacaggattttcaaaacgtaggaataggaaaaacgtaggaatactataggaatacatgtgcaaacctatggattgagaaacacaggaatttttcctatgttgttgagcaatccaaccaaaggaatgcaaacattaggttggagtggattattttttcctatgcttttcctttataaatggaggaatggaaaactttcctatagtttttctatggtgcattcctataaaacgaatggtagtttaaaacccattcctattcctatgcttttcctttgcaattcctttgaaacgaataagcccaatctttcaaatttaaagtattagtagacattagctcaccatgcatgccaatccacttatcagagaagcagataggtgatactgccgtatcttctgaaccgaacctctgatttgaagttgaacgaaccatcgatccaacccacctgctggtgccgattgcgcaagtgatcgaatcactcatcatctccaccatgcttgtgtctgtctagacagttaattactcccacattttaaattacttatcgctttagga

SEQ ID NO: 61751 - DNA, 952 bp, Oryza sativa
tttatctttatctcatactatatttggaggttttgaaatatatggtatgttcagattgtactcaaaataaactttatcaaaatttgacaataccaaaattttgacaatttagcaatattgccaggttttggcaggacttcttatatatttatcagagtttgataaaaaagaaactaaatagatgcacatattgaacaacttaaaaaaatggtatgatttgaaataatatcgatatgtacaacctcataatttgtaatggatatctaggctcaggaatatatagggtaatagggctacacagtagcaacggcatctagtgtttgaggggagagtcgatgaggcttccctgtcatacagttcacctgcagggagcccggacgcacggtggcttgccggctgtcgatctcgccgtcgccgtcgtgctcgcatgtcagccatgggagctgtagctagaggtagacgacgtacgaggtggcgaccgatagctaaagctatagctgtagctagctgcagatctcgatcagttgacgcatgagatgagatcgagagatcttcagtagcgcgcaggcttaggtgcagggtgactcgactgtgtcgcgatatgatcgctttggtcgtttgagctttgatgaagaagccgagacttgcaaagcggtgggcagtcgagaggtctcactatcgacggtgtgcgctccgtccttcgtacgtatgccatttgcagagggttcacgataaatccgaaatttcagaaattttggaatgtatatttcggtctgatataatttcaattttgagatatttaactatttgccatacaagtgataattaaggatttaccattagatccacatgtcataatctgaataaaattagctaaattcacggatatattagaatttcggatgctatagtttcgttcctgggggccgaaatgttgaaacaaaatttcgaa

SEQ ID NO: 61752 - DNA, 1256 bp, Oryza sativa
taccacattccggccaagaccatcgccttcatcaacgtgtgggcgatcgggagggaccctgcggcgtgggacacaccggatgagtttagaccagagcggtttatgggcagtgcagtggatttcaggggcaacgactataagttcataccatttggggctggccggaggttgtgccctggcatcatcttagcattgccaggattggagatggtgatcgctagcttgttgtaccacttcgattgggagctccctgatggcatggacgtgcaagatctagatatggccgaggcaccggggcttactactcctccgatgaacccggtttggctcatccctagatgcagaacaatttgattggttgatcaggttgcaatgggtagcttctcatttcacgtgtattaagcataacaaaacaacaagttgtagattattgcacacctaatgtagggcgacaaggaggatccagatcaagcttcggcccctccccccctccccaccgacctccctcactccttcttcgacgatctagatccatatctagctcagctctcactggtcatggatttttttttcgtgctcctctatgtgatctccctctttgtgatgaaattgtgatttattaatgaattgagagtttaatttgtgaatgggttatgagttttgcgaatgaatatgttggatggattatatgatgtttgtgatgaatttggcaagggatttttgttttgggggcgaacaattttggatctactgaattttttttgtgccaaaagtatttttttttcatggcgggtagattaaatgtcctgcctaggaaggatgatttttactggttgtgctctttaggtatctgacagtggatatatattttcgcacgcgattaattcatgcttgtgaaaatactctatctatttttattggcatttggttgttggcggttggtccggctgtcagcgaaaatatgatatggccgccaatgaaaagctttttttatagtaaccctgaacatagcgagatttcatcaacatcataggttcttgtagatgttgcacatgccccagtggtgatatgtccgatattcagacaggcacttaagtttctgcacagcctgactcggtggctatcttgcatcgtctcgtcctggttctcgggctggcgcaggccggcaaccaaacgggcttctgcatggcctcatacgaaccagacctgatgtagacaaatccaacataaccataataggcaccgagctgcaagta

SEQ ID NO: 61753 - DNA, 8987 bp, Oryza sativa
agttggagagacgttatacccgattttacgattgagggatatggttcgatcaaaggcaaaagatgagggaggtaaaatagactaactcagctcaagtaggactttccccaaactgggccgctaccatcagtcgtgtcgtttaccgtgcagaacttcagtcaagcaaatcatctgtgagaatatgactgtcaaagctgtgtagtaccacatcagaagaggaaaaaaaaatgctcctactcaattttgcgggcatgcacctcgcactttgacacgctaaaactttatatcctgttatatctcgaatatttaaacacatgtataaatattaaatatagtctaaaaaataattaattatatagattatgactaatttgcgagacaaatcttttaagcctaattactccaagatttgataatgtgttgttacagtaaacatgtactaatgacggattgattaagcttaataaattcgtctcgtggtttaccgacggattctataattagtttttttatgagtacatgaatattttatacactaacctctataatatccgatgtgatacgctaaaacttttcacctctaattctaaatatctcctccgttgctgactaccgtgcacattattgcccatagctagtggagtggagtactctaccactgtaccagccaagaagaggagatttcagagccgaattcacagctagtaccgacaacttgccaagatatttcgctctgtagaaaaatcgctgtcaggccatctccctagccgacttctttgatcctagttctttgtcagttcattatattttctctcatataatagcatatatgttttctcattatattattaaaatatattacaatgacaacataattttaaattttgcaataactttacgaaactactaatgtgtaataaccactctagtctcctcttctaatattacttatttttttaattccaaatttccactgtttctaaattgtatttctatatagactctgccttttctttttctccgattaatgtgagaatttctaggctatgagagtgaatgtggaggctcctttttattctaaattttagttagttttaaattccaatatggactctatactctatttctaatattccttattttttaattccaaatttctatttttttttcttaattatatttctatatgtactctatactttacttctaatatttcttatttttaattccgaatttctattatttcctaattgtatttctatatggactctatactctacttctaatattccttattttttaattctgaatttcaactatttctaaattgtatttctatatggactttagtctcctcttctaatattccttattttttaattccgaatttcagctatttctaaattgtattttgatgtggactctgctttttctttttctccgattaatgtgagaatttctaggctatgagagcaaacgtggaggctcctttttctattcctttaataatataatagattgtgttcaacatttaaccgttatcttatttaaaatttttatttaaaaattttatgagaaaattttaaaaacaaatagtcacgtataaactactatttatattttatcatctaataacaacaaaaaaactaatcataaaaaaattaaataagacgaacggttaaacattggatatgaaccgtgtaaaattatacttattttggaacggagagagtataactcaatctaaaaaagacagattcttgctacgaatctagacacgtatgtgatcagattcatattaaggattatgtctttttctttttggaaaggagaggtagactaccttaattagatgaaatttagtactattaattatactccatatttatacaacaaccagtgactcatcaattatcgcggtggagaaaattcctatcttttttcttggagtaggattaggatgtaccactacgtcttcctcgccgccgttgcgctcctcgccgtcgtcggctacggggtcaagaaccgacgccgtcgaagcgccaagctcccgccatcgccgccgtcggtcccgtttctcggccacctgcatctcttgggcccgctcctgcaccgctcgttgcacgagctgcacctccggtacggcaccgacggcggcctgctcctcctgcagctcgggcggcgccggacgctggtcgtgtccacggcggccgccgcggcggacctgtacaggaaccacgacctcgccttcgcctcccgcccgctcgtcgcggcggcgcacaagctgtcgtacggctccaagaacatcaccttcgcgccgttcggggagcagtggcgccgggcgaagaagacggccgtcgtccacgccctctcgccgcggcgcgtcgaggcgttcgcgcccgtgcgggccgccgaggcggcggcgctcgtcgccgcgacccgccgcgccgccgatgccgcggcggacgggggcgccgtggagctgagggacctcctgtacagctataccaacgcggtggtgacgcgcgcggcgaccggcgccgcgggcacgacggcggagaagctgaagcagctgctcgggaacgccacgtcgctggtggccggggtccaggccgacgacctgctgccgggcatggcggcgaaggcggtgaggtgggctacggggctcgagaagcagtatgacgcctcgatggaggagtgggacaagttcctctcgccgataatggcggagcacgcggagaagaagaagaagaagcgagaggacatcggagcaggggaggaggatttcatagacgtcttgctgcgtctgaaagaagaagacaccgagctcacggacactcacgtcaagagccgcgtcgtggtgatgatctaagctatcaaatcattctcatccaaactactctctcaacaaattttcatcaaattaatctctcgattcttgcgtttaaaattctgcaggatttgatcgccgccgcaaccgagacgacgtcggtgacgctggaatggaccatggcggagctcgcggcgaacccgcgggtgatggcgaagctgcaggaagagatcgctcgagcgaccggcgggaagccggccatcacggaggcggaggtgggcggcatggagtacatgaaggcggtggtgaaggaggtgctccggctgcacccgccggccccgatcctcgtcccgcacgagtcgacggcggcggcggccgtgcaggggtacgagatcccggcgaggacgtcgctgttcgtcaacgcgtgggcgatcgggagggaccccgcggcgtggggctcgccggaggagttccggccggagcggttcttggccggcggaccggcggtggacttccgggggaacgactaccagctcgtcccgttcggcgccggccggcggatctgccccggcatcagcttcgccgtgccggtgctggagatggcgctggtcgccctcctgcaccacttcgactgggagctccccgccggcatgcgcgcggcggagctggacatgagcgaggcgcccgggctgaccacgccgctgcgcgtcccgctccgccttgtccccaagcgcaaggcgccgcttgcctagacatatttacaaacgaaatgtaattggtgaataaaacttgggtatagctatatttattacgctatatttttcatcaaaaaatagtcggcatgtatttacattgtaagtccctaaattacatatgtaattttagtgtatttataatgtaagtctcaaaattacatatgtaagcactaaaattacatatgtaaattcgaaaattacatatgtaagtggggtgtaaatgaggtgtaactactgtgtaagtggctgaaaaaaatcgactgtagcatatggcgccatatttctagcaactccgataaaacttttatatacgtgttcttaacaattaaaagaaaggtaaattggaaccatgtcattataattttgtgaagtttgaaatatgccatcggtatctcaatgacatgtaggacccacatgagtcaataacatgtgggtcaagatggtatatcttaatttttacaatattataatggcatggttccaatttttctaaaaataaaggcggaaaaataagcttcgatgaaaaatctttaaaatcggtttcaaatttaaagttaaaaattaaaaatttgactgataaatgtaagcctacgcgaaaagatagtttgttgtcgtgggctcgtcgtccgtgctgctagtcgtagatgcattgtatctggtcagtgacacggggatcagtcgtagtagtatgctgctacgagtgtttctcatctgctctgatcagagtggtgcaatgtactcctactccattgttgtatctgacctcattgtcagcaaatttgtcgatggatggaacacgaacaaatgaccacaaaattgttggaattgttgtcgttgaagcaccgttgttacaaatccgccgccgcggccgccgtggacacgaccagcgtccgccgccgcccgagctgcaggcggagcaggaggaggagcaggccgccgtcggtgccgtaccggaggtgcagctcgtgcaacgagcggtgccggagcgggcccaagagatgcaggtggccgagaaacggaaccgacggcgactgttcttgaccccgtagccgacgacggcgaagagcgcaacggcggcgaggaagacgtagtgatacatactacttcaagcaaaaggatttggatttttctccacctcgagaattgatgattcagataattgtgagctgcaacgatatcgtgtagatatgctttctccgtcagaaaatgttgcaatttatttcctccgttttacaatgtaaatctttctagcattaactacattaatatagatgctaatgaatctagatacatatgaatatggataatattagaaagtcttacaatataaaacggaggaagaattttacatattctaaaaaaatctggacagaatttgtttaggatagatctaaatctcatcctaaatacaacattttgagacagaagaagtagtgtgctcctgtgttggtaacttggtatcggtagctgcgaattgggatcagagaagacaagtcggctcatgagcctgcttgacagcgatttttcagacaaggaaatatcaggtccggtagatcaacgtctggtcgatccgagctctgatgtccccgtcttccttgctcctgctggtagccttgggcaataatgtgcacgtagtctttgtttgagagctgcataatgtggcgccaaatttagttttctctctctcaaaatttagtacagaaacacacacttatatacacgtacacacactcatatgtaaagacacatatgcatattatttttttgaacatctccaaaaaaatattttaacatatattgagattgaaatcattgtaggtgtttcaatgtcgactcataacactccgttcgttgagttctttttttttatgtggtatggagtagctttgacagtcagtcagtcacggcgctttgcttgtctgaaactctcaactccactaccgggggatgtcgattcgaaggcacattgggcctatataagttaatgggccagaactgatattcaaaggaacattgggccagtttatcgtggtccatctttcttcttcggtgatgacatggaatgaggcctggcccaactaaacatcgggcccaacttttcttcgtcggtggtgggctagagatggtgtcagggcccggcccaactagaccacatcatcctacccctacctcaacccgtcggtcctcaattccccatagcgcggctcgtcgcgacctagccctagccgccgcccgttcgcgacctcgccggcgccgccatcccgccgccggcgaacctccccccctagcggcaggtcgccgtcacgccgcgccgccccgcgccgccgtactaggcgccagcccgcgaggtccgctcggctccaggattcgcgctgccgcacactccgctccgctcggcgtccccgccgactcgagggcacccctcctcgtcgggcctctccgtcgccgacgagctttttggggggttgagccgaacccccatgccctacgtttggtctgtcccttggtcgtgaggatatggaccatatagctgaagaagagactgtgggagttgcggaagaccctggtttggctgatgttggcaaggctgatgagaccaaggaagaaggtggtggtgctggagtgcacttggatgaaactagggttgcagtggatgatcccacggaggtgcgtgcttcgcagattgacgatggtacggctatggtgtccgtattaggtggcgatggcgatagctttgttgagcaagatggtcaggatactagcggcggcggtgcttgcaatgaaggtaatgagcctgaggaagatgctcgtgttcaggtgcgtttggatgatactagtgccgctgtggatgaggggggtgcttccttgattgatgatgttatgaatacgctccccgttggaggtgtggctagctttgatgatggtcctcagacggacaagaatgcgcaggatgagggggcgcttatagatgtagtttcctcaactgtgctgaatgatgcgagcatagatcttgtcaaagctagtgatagtgtctcggaggaaggcacagggatggatatacttgtccaaccgggagaggacattaaggaaatggttacaatagcctgtgatgcggccacagatgacgagggcaggaaggtggatgcagtttccagctccagtgatcgcaacgaggaagtggttggtgcagctggtcttgatgagacagatgaagacatgcgattgggtacagttggcctgtctggtgatgacaatgtggcaaatgaggctgctgccgcagctgctggtggtgcagatgatgaggacttgaagatggatggggtcattaccgccggagataaggatgtggaaaatggcaaggctgacaatgctgatggtgttccggaagtgaatgtagttgccattagtagagataatagtgcggaaaatgaggctgctgcagctggtgatgatggcgcagatgaagagggcattcagatgaatgtgctaaacacaactagaggtgagggtgaagaagatgatgaggctgctcaaaatgttgttgaatatgctgttgatggtacagaagaactggaaactataggcctgactggagatgataaggcggaaaaagaagctgccccagctggtaacaatagtgcagatgaggagggcatgcagatggatgcggttaccacaactggagctgaagatgaagatggcaaggctgatgaaaatgttgttgaagatgatgatggtgtttcagaagaagctgtggctgacacagttggtgaggatatccctgaagaagatgcagtgcagatagatgaggacgaggatgatgatgacgtgcctccaccattgacaaggaaaggcggggggcgccggaagcgaggtcgtgcatcttccaaggctcaggttgtggtgaaaccacctgttaggaagaaggatgatgaggaagtttgcttcatttgctttgatggtggtgaccttgttgtgtgtgatcgtaggttcgttaatgacatggaatttcattctttccatatcccaaagtatattgctatgttacaattattaatggttatttctatgtcctcatactcaggggttgtcctaaggcttaccacccttcttgtgttaatcgggatgacgagttcttcaaatcgaagggtcgttggaattgtggtatgtgggacttagtctgaacaactcgcagtgcccttgcttagttacttagatggtttactttggaatgtggatatgagtattcatacttcatttcatcaaaatccatgatttttatgggtcatatttgcattgaacctactctttttacatgcagatagtgggatgccggtaaaatataaatataatagctgatttaaatttttttccattttgtcctgttatatcatatttatttgtttattgttctttactttgaaaactgaagcttgtgaaatctgtgtaatactgagtaaaaattgctggagataaatgatgctggactgtttctctgataatgatgagatttgtgcttagtccacagataatatcttccttttttttttgattttgttcaatctgcatcattttcccagggtggcatatttgtagcaactgccagaaacctgccttccatatgtgttacacatgtacctattccttatgcaaaaaatgcataaaagagacaaaattcgtctctgttaggggaaacaaaggcttctgtgagacatgcatgaatactgtgatgttgatagagaacaaggaggaggctactgagcaaatggtaatatttcctctgtttcttggcttaccttaatctatctattgtatttctatagtatcatccagtatctttgatcttttcatcattttttagtttctgtatatcatttgtgacaccattttatccttttgtcattctctctcatctaagaaacttaggtggtgtttgaaactcatgaagatgaagataaagttggtgcacgtaaaacgagataactattagcacatgattaattaagttttaattattacaaacttgacaaatggatatatgtgatattttaaagcaacttccatatagaaagttttcgcatggaacataccgttcagtagtttgaaaagcgtgctaacggaaatcgaggtaatatcttaattcataagaaaagaacagggcaaggcgtaacaagttttcgagatattcatgctcaataatcattttgttaagatgtaggccctatgtatcttggaactgttaatttgcacttgatttgtctatttgattagtaaactcaaatgagctaaccaacctgctgcctgcaggattcaaaaggtgtaacaagaactattttctgaatgatgttgtccaagcattgcagcttgctaaattgttttcacgaaatggcatttccataact

SEQ ID NO: 61754 - DNA, 14318 bp, Oryza sativa
  unsure (1)..(14318): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccagctcctcaagaagatgcttccgcaggctctgaaacaaacaagttgcaaggaaaataattcaatttgtattactaagtaagttcaaatgaaagacgatgtcaatttttcatctgaatacaggaaataattaaatagtaatgtaaaaggttgtaaaagatgaatgcctgtaaccaaacaccatataagaaaatagcagatgtttaacttggagaaatcaatcatggatcaaattatagtttaaaatacaaactaacaatgttgatactccctactacattgattcttatatggcatattttaatttcaaaaaggccaaactttgtagattttgatcaatgattagacaaattaaaggaaccatttagttagtgtataaaaagtatatcaatagctttgtactttaaagtgatctcacatactattggatttattactattatgagtataatttataagaaatcaatagacgaagttaatgttgaagacttcttcaaattaaaatacagcatataaaaatcaatggaggtagtttataaaacgtatccatgacacagactaatgcagatcacaactatatgcacctcataaaaaaaatatcaaaaggctaaaaaaaatctgggcctaacagttatacatctatcaataaatgctatagaagtattggatgagaatttccatctatttgtttcaatgaggaccatcaacttatacagctagatgtaccagtgataggaatctgtctagctagtacaacaaactttgtccccacaattcgcctaaaattaattagagcatattgttggaagtcaatgagagcaatacaataagcaaaatgtgtacttaataactgactagctagacagaagatactagaccataaccaatttcactgggttaaaagggattagtatatgctcctggatacggtttggatgagaatgtttgaaatgagataagcaaggctcttgctgattcttttcattcaagtgtcattgattcccttgaaactacatttaaaccttcttatctaaaaatcaacataagactaataacacgaacaataacaccccttagggcggggggagcggcaattgcagtttggatcaagagtttccctttgaacagatctaaatctctacttagcaactgccagggaatacctaaatctctacttagcacctagaatcaaaatagcacatgctatgtcagcattaaccaattgtaacataccttgaaagcatcggtcttgcccttagtgacctggttctttgcgatgcagctgttgagcacgtctcgggtgaactcgtcaggattcttcccgtcatcgatcaaactagcaaaacaggcaccaatccaatccaatccaatccaagtcatacacccagaaccagggggcgaaaggggtactgagatggaaatcgaaccaactcacttgacgacctccatggggacctggatgttgcatccctcggcgtgcttctgcatcgtgtcgagctccgccaccagcgagttcctgcggcaaacgagacaatcaccaaccaaaccctaagatttctccacccactcacacccgcacaggaagggggagagggggatttgctgggagaatctcacaggcgctggaggaggggtagctgggaggcggagctgaaggaggagacgttgaggttgagctggtggaggagccccagcgtcctctggatcgaggccatcatcagcgccaggttctgcttcgacgcgtcctccgccctctcgcccccgccccccgcntgcacgccgttccccgccgccgctgccgccgcggcgactccagatgcgttcgtggccgcgccgccgtccattccgccgcgatcggagaagacgagagagagagagagagagagagagagaagagagaccgagacttgacgtgtcggcccaatatatcagcggcctattgctgggctgacgtggacgtaacaccatcacgggctcttcccgaagcgcatgggccgcaactccctaattcgggcccagtttaactgggccgtgctgtcctaggccgagaagcatcggaagtttttctttttctttttctttttcttttcttgctatatgctacttcctccgttccataatgaactttctagcattgcacatattcatataaacttacattatgagaaaagtactaaaatttagggatgcaagtgggtagtcccgctatccgtataaaaacccgcttgctagttcatttcccatatagtagtataaaatttagaagaaaaaaataaactagaagaagcgggctaaaaaaacctatttgcccgtcccgcttgtatccctattacatacaaaagttggaaatattattagccatgcaaaggtaaaaatggagattgattggttggtgcgtgtcccaccatcatcaaatcataggttgataaccagtccatgtacagtgcacatacgcttcctcgtcggtattcatacgtgttacatatgacaaacaaacgagataacgagataagcgtcgtcactcggtcgctagctagctagatagcttaacttgctttgtttggaggcccgtctccatcatatccatccaatctgatctcatggccgctagctgcagggtgagtccgcagtgtgagtgatcagctgactcgatcgatgtgcatgcatggtgcatgcgaccggtgcaacgtaccgtacgttgcgtaccctgccctcccctgccggtatacgtgttgtgccactgccacgtcagtgacaacagtctcatcgtttggtcaacagctgatgactcataggaaaataaacaaaacaatagaataaataaagctttatttgtgttcttgatgagttaaaagtggatggtgaaaaataaaccatcgttaagaaaagaaattcaaaaaaccagctcaattaagttttagaacacacataaaactaatttgattgtggcttataagctaacaatcaaacaattgggctgcgagttttgggacgacgccgtacgtcgtgtaccatacaggtcatgtcatcagcaagagctggccaaagttgaggacgccgactcgcaaaccgatcgtccaagctaattattaagctagctaatcgatcgatcagtcgaccgatcgagagatcgccgtgtgattgcttacgtgcatggtccctgcagctagctaactagctagcaaaaacgtacaaaaagatcccatgaaaactaccatgtaccgacgacacgtacgttaacgttacgccgtggcatgggcatcagggcatgcaactaggtactagctcgatatctcagctgttggcgagctagttgtgcatttacacttaggacttatttaagagcttctaactactaaacaaaaaattggaaaacctagtttttttttaaaaaaaattagaaactaactatcaacgccgccagttactcctcagaatcttgagctctcgaaataagcccttaaacagctagctagctgagcacaagaacgacaaggccggccagccggctccctgtcgccgctttgtccgagtggccggccggcgagcgaaaggggcttgcgcgcattggattaactacgattatattccgacgattttagcaaggaaaagaacatcagcaaggtaacaaatttgcaaagatattcgcttctcgatcgagatctgtccggcaatcagctggctggccgatcgagacgatagctagctatagcgcagatcgccgtcagtccaaaccaccggccgtcacccgcacccacccgcggcgccacctttataccgcgattcgatgcgatgcgatgagatgagagatgcttcgatctctctctcccctcgccggcgcacccagcgttccgggcactgacccgccgcccaatcggctgcgatattcgccgtgcacctccgctcacggttgctagctagctttgtaccacccttacccgtgccgcccattgcatcatcgatcagtacgtacacaaaaaaccggaataagttcgtaccgcgtacgggcccggcgatcggtacatgcatatgcgcgctgctagtggatcgccgtcgtcgtcggcggcgtccgcctcgtacgtccacttggccaccgtgctggtgatcgatcgatcgccggatcggaggcaggggtatatgcgtagaggtaggcatctcgtcagacacaagtagcttgacccgtgtggcgttcatggcggggccccggggttggatctgataagatccaccgtgccacagccggcgaatcagccagctatagctaccctcgccggcctctgcatcgcattcgctcgtggctacacgtgcggctgcggcctgcgctgcggcacaatatctggaacaaaccggccactcgcgtgctccgccgggcgccaataataatgcaaaatcacctcgatctttacttgcacccggagccccgcactagtggagaaaccatctttggtcgctagaccaaattccacaataatactggttccattaaaaaccgggactaaagatgatttttagtccggttcatcccctgtcagatgtatgtcaggggccgaggatctttagtagattaccactttagtccgggactaaagattgatctttagttccggttggagttatcaaccgggagtaaatatttctctcccacatctgatcggttaagtcccagacagatatttagataagattggatcatcccatctcttcctcttctcgatccaatccccttcctcctcccctcccccctcttcctccccccttcctcttctcctcctcccctctcctccctcccataagccggcccttcctcctcctcccctctactccctcttccatcagccggccggcggcgggcggtggcagcgcggccgcgcggggtaggatggcggcaggctgcgagcggtggccggctcgtttgtttttttatatataatttgtgtttcactatatgtatatttttttagattttgtgattcattgcatcgcatggatctgacatgtataatctgtgatgtatttaatttatgtgtagttttttaggatttatgatgtatttgatatgtgtgtaggatttgtgatgtatttgatctgtgtgtatgagtaacttaatatttaggatgttgatttgggatatgcatcccactcgatttgggaaaaatatagggattaactctagccattagcaaatcaacaatgaaaaaaaaagacctcaagggattgccgctacccctcttcagggactaaagattacccctctttactccaaccgggactacctggattcgtagtcccggttgaaaaaccgagggttctaaaccgggagtaaaaaatatttctccaccagtgccggacggcggatcacagtgatcggcatcaagaattaccatatccacgtattaattccagcgtccaaaattaccaaagccactcaaaagaattagttataattactatacctccatattaaaacataaagatttttggaagtagttatataatattcgatagttttttgaatgaaaaactttcaactgcaactactatataattacaattacaatgtagttgtaggagtaccatgtaactacaatataagctatctgtgactcaaatgtaacttggaagaatttgatggagcgattggttatttcaatgagcatgtagtctgtaggtctcgggttcaattcttgtagtgagcgtgtggttttttttttccattttttccaccacagcacaaagctcaaagcatatcggacggtttaaagtttgctgcaggtctcgggttcaattcttgccgtgagcgtgtggttttttttttcattttttcctccacagcacaaagctcaaagctaagcatatcggacggtttaaaatttgacagttttcacccctgaaaactgtggtgaaaactgtcgacagtaggatagcaaatccgtttttagattgtacaaagatatttttaaaatatgtataattaggggcagactcacacctcagatcactcgggccatggcccgaagactgcccattaattatgatggatatattttcaccatgtaatcattatgcataggctaattaattatgtggatatattttcaccatgtaatcattatgcataggctaatgtgccttaccaattttttggcaacttaaatagtacatgtgtttggattgagcacaaccaattggtagtgcccatgttttatttggccaaattatagaagtttttcactacgataccaaaatttggcttcatattgatcccaatcgaaacaagaaccatataactttaccttaacgaaatattagtagtgctaaaatttgcctagattttggcactagtaataaattgttagggtaggatccaaacatgcccttaactcttttataggctagccctgaccatggaccaatcctagatcacttcctaggtggaactaaatgaaaaagttatgatttgttaagaacataagtagatagagaagttatattttggtataaattttaggaactgcctatatgacttttgacatgaaaaaccccctcaaatgttgtaaattttgaactattggatcactttaagatttgtgcaacatagccaaaaccttttctttctccttcccttcctcagtcccgcttgcacatgcgcatgcacactcctcctgcgccggctgcagcccggtctcatcggatggtcggaattggttaacaataccaagtcctctctctccggccggcctccccccttctctttcgcaaagctatggtgcccccacccaaggtcttacccgtctctagccgccggatccttcatcaccagtcgttgcctcctctacagtctcgttgtttgcccccgtcttcaacgccggcccactgcccactgccaacccccatggctccaacgtcgttggcccgtgtccaccacccatcataggtcctctgctgtctatggcgatccctctgaaccccaaggaaatccttcctcttccccatctcccaacgctcctacccaacctaatcttaaacccaaaccctaatcttgtctcctctgtcagagttgggaaatatcgtcggggccggaaagagggggagctcactaaagtcggaggataaaaagcttagccacaaaaatttagtgcggatcggatggtccaaaatctataagattttatttctaaatttttatcgaatgatatgtagcaaatatgtaaattttaaatgctggaggtccggatggagcgagtacgagcttgattagtaggggtggtcccactgcacagttgatgagcctaacccaatgactaggatggtatctatagtattaaataagttgccatctaaaatgaaaaatgatatggcaagtgaataaatgaggaaagagaaggaaaccatgtcttgcatgagacatggtttctacacaacatctaagacatcatgtggaataagtagcattaaattaaagtatggaatagttgtgtttgcattggaagagtagtgtctagcactagtttcttgatgatgtggagtttatggaaactatgtctagtgtcatgtgttgggaatgacctaccattctcaatccaatgactaggatggtgtccatatcattaaataaactgtcacctagaatgaaaaatgatatggcaagtgaataaataaggaaagagaaataaaccatgtcttgcatgagacatgatttctacacaacatccaagacatcatgtgagataagtagcattaaatttaagtatggaatagtgatgcttgcattgaaatagtagtgtctagtagtactagtttcatgatgatgtgaaatttatgaaaattatgtgtagtgttatttaatgaggagttacaaaatcttttcttgtaatagatcttaacctctggtagataacctagaaatggttatattatttgtggatggaaggagtacaatacaaggttagcatcaggatttgccaggtatgtgaaaagagagagctgatgatccaaatcaaaaaacttaattaacttactccccggaattaatcagctgatggatcatcatcactcatgctccttttagtttcttttgaggaaggcatcactcatgctgtcatccaatattggttgctgtttcttgctaatatgaacaaaacagtcgctatattatatatgctcgtaaaatattgatgcgttgtgagtagaacgcaaagaaaaaacaataggaatcgataaggactcaaacacttatctaattgtaagcgtcttaaaaaaccgcactgttcttttcgtccctcgtatgcactagtaggattcagaacttcagatatatttaatcatgctctcatccctcgagctagaataatatacaatgatgaaaactaacttgtgcttgacatagacagagaatgcagaattttcagatcaaacttactgtaccatacaagattagccactcacagctcatcgatgcaataattgattctagtttatagcttaacacctgatttgtttatggtaaacatggatgttttcctgcaatggaagcaatcagtgtcgatcaagcaagattgccacaacaagatggcaggaacggaaagagcatatctaaggaagaatcttgatttagtcactcctcttcagattaaaatagagttggtccatccatatccacaagccttggaggtgttgttcacccgttctgcattttttttttcgcgaaacctgttctgtattttgcatgtccctctcttgaccacatataactgaagaacgttgcttaattatttcagttaaacatgtagtcaggcaagagcacattatgttattgagtaagtgagtcacctagttgacttgccacgagtcattttcatgtgtttttaagaaatggacataatggtacaattaggggtgcatagggaaattaactaatcagctatacatactaattagtatagtaacaaagcaagcctttggcgtccacaggagactaacagaatctagctagcaacagatcagatattatctatattggttgaagcagctcttgtctgagagcatgtcactgcgtcacatactcgcatgtattgtcgatcgatcgattgcaagaagccaagaactggtaaaaacggagtagaaatgaatgcctgactacagcctgagtaaccccctatttgtcccagctgtttggtgtgtgatactatatgtgtacttgaaagttctatctttccaagaattaatgaagctgcgaataccactgaccacataacgatctgataattaccttgctgggcactttgcctgttctgttcatgctgcaccataactgaaaagatatcacacaaaagcagcagaagaatgttatgacagtgctgagtgcttgcctcacaaactcgtcacccttacgatcgaaatcatgagctaattaaaacaagtccagcgacaaagcatgttgatctctactattattcttaatttggtactagtacaaaatgtgacgtataattttcctgaaccatatatgtatgcaacaataatctaattaacacgcgactgcaattccccctccccgggttcgtatcctctgcatttgggaccaaaggcaaagtttgccgttggttccatccaggacatccatacgtcaatcaacggttccatagtttagcagttagcacccttttagtgactaattagcagctaattaactaatagagttgttctctcttaaaaaaaaatcaaggaaatgatctccagcggtaaatcaaatacaactaatacctgccttgccttttggaaccaactcaaaaaataagataaaatcaagaagcaaacaatctcaggacaagaaaaatcctttatttatacagtagtaaaataattatgccacgtccgtatgaaacatctagcaattctaatgctaaaatcctcccaaaaaataaacatttattttgaaaaaactaatctgtctttattgtacaagagtattttatcataagaaaattaatagacagaaccgatcttgttaattaattggactaatatatagaaattattatattatattaattaattagctgttaatcatctttgaggtgctaaaccatgctaccgttcattgaagtacggatggtctggatggaacaacggcgaaccttgcctttcatcccaaaggcaagacgatactgaccccccagtattctttttagttcaaattttgtagaataatataaatattcgtagggaactgatcctaatgaacagaaattcatccatttaggcaatcatatcctcgagggggtaatctaaacaaatttaaaattggactactagtgtgtgttaatcttagtatttactactccctccatcccataatataagagattttaaatttttcttacaatgtttgatcactcgtcttattcaagaaatttgtgcaaatataaaaaacgaaaagttatgcttaaagtattttagataataaagtaaatcaaaaaaaataaataataattcctaaattttttgaataagacgaatggtcaaacagtgcaaacagaaacgcaaaataccttatattatgggacggagggagtaaataacttgcatatgttcgtatccatgggacggacatgcatgataggtgcacacttaagtacctgacttggatcgagttgttttatgcatcaaccttgcattatttgaggaaacttttttcataccttaatgcaatatcctcttatttttacatgcatttaatattttttagaaacatagtataaacacaaatacttacaatgcgcgcacattcaccctatgaacctatgagggccttcattgataaagtcgacacggacgcctcactatcgatgggtacgttgcctaccacggaaagaataattagctatcaacgcgagcagccatgtcaaatctataatttaaaccagatgagctagttccacaacaagaaacctacccagttgagttacactcacttcgctatatgcacctaaattgttattaattttttttaaaaaaaatgacatgatatattaatataagatatttcatgtcacaaacgtaccaatttaaaatcaatatatacaaatagaaataaaaaaacaataaatttgaatgtgaacagtgcgtaccattcgcaacgatatttattatttttttataattgtctaagttaaatttaaatttacatatttgtgaagtctatcttgttaatattttaatttttatcacttttaaagtgataagtacaaaacaagggaatatcctcatggaatggatatatgtctcccatcactgtagtgatatttggcatggtgagttggtgacatttctagccattcgatatttatttagtaggagtaatcacaaagtttgtttaatggtgtcgctaaatgcgtgacgcggtactaatatatagaatgacattatgttgcatcagctgggactccctgcccctgccctgataacctgatccgtatatctgatcattatctgaagatgtctagctgcagctatgcacacggaagaacttgcgtagactttcacaatcttcagctcctcagacaacctggattttcctatggatttcgaaaatcaatagctatagtatttaaaaattgaactaaaaactagaaacggaaaaacttctcacccgctaactactcatctcttaacaatgaatcctctaattcctgtttggcacaattccagctccagctccacctccatcctctactagaaaaaaaacacttttaccgacgttaggtatttattttcgcaggcggacatgaccctcggagccaaatagccgcctacagaaatacaaaccggggtgaagctcgttgtccgcctgcgaaaatagacttggaatataaatagagccaacctatagggcctattttttttcaaagtcctcattctccctcattcctctcccgcgttgtaatatcccggcctagggcttaatagaattaatagaatattcatatcaacaagttacaacttcttttccggaagccgatctcgaaagaactttgaacttgtgttggtttgtgagggtagtttatgacctatgaaagctgatagatgtaagcggacccgacctggaagaggcgggacgttacaagtggtatcagagccgactctcgcggttacacaggcgcgtgtgtcgcagttgcacaggcatggggctcatggctggtgtggactcggagtggtcatacagcatggcacatgcgctggcactggatgcacggacgtacgttacaagtggtatcagagccgactctcatggttacacgggcgcgtgtgtcgcagttgcgcaggcatagggcgcatggctggtgtggactcggagtggtcacacagtatggcacatgcgctggcactggatgcactgacgtagtcaagaggggacgttcctagcctggggttgaccgacgaggacgtcggtgtcttaagagggtgaggatgtaacatcccgccctagggcttgatagtattaatagaatactcatatcaacaagttgcaacttctttttcggaagcccatctcgaaagaactctaaggttaagcgtgtttggcttggagcaatttcaggatgggtgaccgatcgggaaattcttcctgagagtgcgcagaaaagacttgtgttggtttgtgagggtagtctatgacctatgaaggctgccagatgtaagcggccccagcctgggagaggcgggacattacacgcaccctccccttccccctcccctccacgacgttgggcggcggcggcgcggctcccctcccctcccggatccggccaggggagggcggcggtggcggcattgtttgtccagaggattttcgcaggcgggtgactaggccacctgcgaaaatttatatatgggtgacgggagcctgcgaaaatgatttttggttgcctgaaaaaaatgatttttctagtagtgatctctcctgaagctggagttcaatcaaacagttttagctccacctaaaatgggagcggaactgggtggagttctctcacaaaatgaactagagaggtggagctaggtttagacagctcaacaacttcactcgagacccaactcctgtagttatttagaagttggagctctacaaggccctagggtatgtttggcacggctccaactcgagttttagagctcagccaaacagttctagctccacctaaaataggagtgaagctgggtgaagcgttctcacaaaataaagtagaaatgtggagttgtgtttagggtgttctccaactccactccaaatccaatttgtgagctaaatttaggagttggagctgtaccaagggcatgtttgatacagctccaactactaaatataactccaggagttgagtctggaatggagttatggagctgcataaacccagctccacaactccagtatattttgtgagagctccacccaattccactcctagttttggtgaagctgaaactgtttagctgagctccagctccggaaggggtggagctggagctagagctatgccaaacagaccccaaatactactactagctgcttttaaaaatctcaaaactcttcaaacagcgccgttgcggcatttgccagaggacttcatgaagcacacgatcgaacgagcgacaaattaaacaagggatacggaggaagaggtcgatccgccgatgccgttgcattggttggtgagcagcatcatgcgcgcgcccacgcccgcacgcgcacgagccccgcgtgagcgacgcagcgacggcgcgtgccgggctagctgtgggcgagcgcgcgccgagccgaccagccgcgccccgcggcgcgagcaccatgctccgcgcctacctagtattccgatcgtagacaattacacaggccgacgcgacgctagcctctgcacatgcatgggcgcgcacgcctagctgccaaccggcgcatccgtgcatggtaataacgtgcacccaacgccgcctcgcccccgtgcccctctccggcacccctaccaccaccgatcgtgtacgtgtcaccgccgcttccctctatcccaagtccttacgcgtgcccccccactatcgcgcgcgccgtttcaccccctcaaa

SEQ ID NO: 61755 - DNA, 1331 bp, Oryza sativa
catattgaggagagggggagcagctgcttctcctattcttggtagatgcggcgtggagtggcgggggccatggatgacgtcggcaatgacggtggcggtcggtttggcatggagcgggggcaaggcggcagcgcgtggcgtcagcggcgcaagggctgatggcggcggcgaccgggtggcgagcgcgcgcgcgggaagggcgaccggcgaattcaaacggcggcggcgggaatcggcgccggggagaggagttcgacgagagagagagagagagaggaaggagacaagagaggcgctgcttctctcgctcggcgcgtgcagcgcacgtgcggggaggaggaggagcggccgagaggagaagatgggctggaaaagggaaaaacggcccaacgaccaagagggaggtgaaacggctgagggagggaggtgggctaagggggaaaacggcccacaatacccgagggaggtaaaatagacttttgtagagaagactgatttggagtggattcgaattggggttttggatttgaattcaaatttgacattcgaactcgatggtttagggaggaatcaagggagactcgaggagaagtcaagaaagagattcaaaacggaaacttggatatttttttttgtagtcggagcgaatgttcggcaaggattcaaaggaagggattgactttcggaatttgatttcggagacttgaattttggataggaaatcttgaggtggaggatttttgatttcgatgagagggaacaacgggattgaattgagatccatggcacgacttaaactcgcacacaaagaacaaaattttcgcaattaggattttaccgaattagtttttaacgtctcacgagaagcggagcgttacacgaggtggggtggcggtcactccttccccaaagactagtcggagaaggctgccccccgatgccacgtggccctcccccgaggggagtcaggcccgaggtggggtggcggaaactccttccccaaagactagtcggaggaggctgtcctcccgatgccacgtggccctcccccgaggggggtcgggcccgaggtggggcggcggccactccttcccagagactggatggaggaggctgccccccgataccacgtggccctcccccgaggggggtcgggctcaaggtagggcggcggccactccttcccaaagactagtcggaggaggctgccccccgatgccacgtggccctcccccgaggggagtcaggcccgagttaggacggcggccactccttcccaaagactagtcggaggaggctgcccccgatgccacgtgggcctccctcaaggg

SEQ ID NO: 61756 - DNA, 744 bp, Oryza sativa
tctcttgaagtttttagttggtcttgatatacacttcacttctgcattagtccatatggacagttcatttttctttccttaggaatatttgctaattgcaaacactccagttttcaggttaacttgagtgttgcaattataccaatgtcacaccagtatggttggaactcatcgactgctggattagtccaatcgtcattcttttggggttatgctttgagtcaactgccaggtggatggctagcaaaattgtttggcggaaggtttgtttgcggtaacaaaaccccccttgtgcatagacaaatacaaaagctacctatgattctccatctgcatgggtgttttaatatcttagcaatgcttttttttggtggttgctgttgcttccgggataagcatgtttccaataataaatgcaaatgatgataatggctatttctttctgcaacccatcttgttaggaattaggatatcttacggatttttttgtgtacctttatgggaaagaatgatccgttaagttggtagtaagcaaaattgcaaatagcagtacgaggtcataattttttttggatggtacatatcttcatttattttacccttttccttactcccaattgtttattttaactataaatttgagtaaattcctagttacaatgatttaatagcagcagtaatcaattcaaataaactagaagaaccatatagcaattttaaacttcaggagaaatcattctgcct

SEQ ID NO: 61757 - DNA, 7399 bp, Oryza sativa
tgttactcgcagccaacactgtcgccagcccactgctggcagggaatccggcagtgataggccccacgaaccgatagtgttagccggttttggggctattggtgttggtgttaccgaatggaatggtggcttatatagtcctaatttccaatatacatgagatttataacatagtcagatttagtccctatatttgtaggggtattccctcaaaaaaaaatatttgtatgggtagcactagatgctgcattttgttcatctgaatacgtgaatggaagtcaattattaaggccgtgatgtaccaatgagccttgctagaattgcattgggtgggttaaggtatgtgctgacaaagtaaaagttctaatgattttttatggcgtttttcaggtgttggtgaaatatttggacaggagtgtaagaaacgtggcatgatggttaaggttcttggaaacttgatagcgatgtccccaccactgataataacccgtgaagaaattgataaagtaattaagaacaaatcacagcataacctttctccctcttttctggttgtagatgaaagcaacgctgttatgtcatgactcatagtactctattgcttttcagctggtgagcatatatggagaagctctgaaggcaacagaggaaagagtggcagagctaaaatccaagaagaattagtcaacatatgtcatctatggcaatggcggcaaaggttgaaggcaatgatgtggtccctgcaccgaataaattccactggtgcttgttgttcgataatttgttgaaatattactgatgttgtgttaaaagacaattattagctttccactaaatctcggagtacttgttctttctgatagtacgaaatcgtactgccacaccttaagtacattatgtgtaacccgcagcggcacccggagacgcgccgatgcaggggaggcacatccccccctcccggcgcgcgcgcggaacaatcacccgggagatagcctggtatcataaacggcactgttcttgcttcatgttgatgtagattagcgacgctccaatacataaacgagtggcgttaatctcgacaaagagacaagagagagggcaccacggatgaacgacatattgtcatcttggcacggcggagaggaaacatcacggatggacagcatcacatcaccgttggtgtagcggggagaaggcatcacagacggatagcatctcatcatgttggtgtagcgaaaatgggtgtcacagacggacggcatctatctcagcgtgacagagaggagacgtcacggatggacggcaccaatcttggcatgacgaagagagagtgcaccatggactgatggtatggctactccggggtgacgaagagaaggcctcactggcggctggaatcgatctcgacaaagacttgcgagtggtgccaacagattggttggcacggcgactccggcatgatggagagagtgcacctgttgataaaaaaacacacactgatctgagagatttactttactctagtgcaggttcaaagattaatttgctttcgggttcagggtgtgccagttgatttgatcttacaaccaacaaaaaaacaaagaaaacaaagttaaatctataaacgatagccgatcggacggattgccaatgacgtatcgtttaatattaagacgatgtatcatgcatcagatcggcagtgaagtatataacaaagaaataattagatctacttgatcggctaaagatatcaataatatacaatctatgcttcgaaatatgtttaaaccaagtgattgggatagatcggacagtacgccgagacagtataaatcacttatgattaaaagtactttagaacaaagattatatatattcatagcatagccgatattccttattttttaattcaaatttcagctatttctaaattgtacttttatatggactatgtttttctttttctccgattaatatgaaaatttttatatgccgagagcgaatgtggagactcatttttctattactctaataagttaatagatagatttgacggtctcacttacacggtacactgcatgcatgcagtacgtactgatctcccagttcctccttggtttgccctcatacatgcatacgcatatatatattaaccaaacatgcatgtgtatatagctgggcacacacatatttgcatgcctcatgcatcacacgtaagccaacaaactagctagtttcacatattaatacatgtggctgtcattttgcttgttttggccaacatccatattctctatttgaacaagatagcaaaatgccctcaaacaacgagtgctccggcgagatcaatgatgggcctgtttgcatcataatttggcgggaaaaagtacaccgaagttccctcaacttgtcatcgagttacaaaatcatcccccaaccgtaaaaccaagtatctagcatccctcaactatcaaaacaggccacaataggttcttcggtggttttgaccccggttttatcctacgtgggccccacatgtcaggctgccacatcagcttctctctccctctctttccccctcttctctcccttcctcatctctctctctcccttctctgactcagccagcgggaggaggagggcgtcagcggccggtgaggggcgacgcggcggcggtgatggcggcggcgggcgacgcagcggtggtggggggagaagctgcgggtgggcggcgaggagcagcgcgcgggcggcggggggaggagtggcgcgcgggctcccccgtctgcccctgcccacgaggctcacgtcgtacaagtccttcccgtcggcactgcccagcgtgaactcggcgagggtgacgggcggcgcgccaccgagggagcagctcacaacgccgccgaagtcccccgtggcacaggcgagggacgcggtgccggagggtgcacagtccgtgcgcgcccacaagcggccggaccaaccatccggggctgggaacgagacattggcaccgagcgacagctcgaagccgccacccccgatggccaccgcggtgtttccggacaaggtggtcggccagacggtgtaggtgcagttgttgcgcagcgtgaagaccgtcgtgccagctgactcagcgccgaactgcagctgtgaccataggaaccctacattgagacacaacattgttgaagaatgagtcgggtgcaagtggctgggcgttcgacagcagcggctgtggtggtggtgaccacgactgcggtcaccggaggcatgacggcctcggacggctagccgagggcgtgggaaacagctgcttctggccggcacggcatcgttcgatgaaggggtcggagactggcttggcacagagaggcgtagccgatggcagcggaggccggctcggcgcgagaggcgcgggcggcggagatggaggccggcttggcgcgagaggcgtggccggcagtggaggaggcgacctaggtgagaggaggagctgccggtggatatggcgtggtcttcggcgcacgaaggctggccggcgggggacgtcggtgcaggggtcccacatgtcggcagagcttgtgtggtggtggcgcatcggtgcgtcagccgtggattcgcagccggtgagcggcgggtgaaaacccagtgcggccttggccgaaccgacaacgatcctcctgagggtgttgttgtgctgtctcacccctcaagggtgatagccgggcgaaagcccagtcttggctcttttgagtcccgacggacgggcggtggtttttccgtcgcttctcttcttgaagacgttgttttggcatcccctagggggcgatctcgtctgtgtccctttgttggtctaggtgacggtcggtgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatgattaagtatactctctgaaattttctcgaatttttcgaagctcaattcctaaatgatacaaagaacagttcagtaattatttgatcattaatgatctaattataattgttaagagcttttcttgtttaaaaatccttaaattataaattgttgtttaaaaggaattattagaaatgatcttaaaagcctaaaagagaagattttttttaatttgctaaatctcaatataaaattgggcgagataaaattttgttaaatacttctcttgaatctttagttcctagatttttctggatttatttgagccaagaaagtatttttaataaatggaattgcatttcatgaataatttaaattgaaaaaggtttttaaaaagtctcttttggctttgggccgaaagccggcccaaaacctctctctttctctctccctccccggcccagtcggcccagcccgtcgtcgcttccttctctctcggtgccgctgacaggtggggcctacctgttagggctgtcttcctcctccagccgtcgcctggccgaaccctagccgagctgcgccgccgccgcttcccttccaaattccgccgcccctctctatttccggtcaaattgattgagggcaaatgatccttgagatctcctcttcctttcctcttttggaatcatcgcctaattcggtttggaaacttgtggattcgatctcgaatcggattcatctctctcccctaaccctagactttccttctcgtcgccggtcgccgtgggccttcgccgccgccttccaacccctatataaggatccccaagctctcctctacccgccgccaccctcgccttcgtctctcgccgtcggtagcgccctagcgccgtgtaacctcgagccgccgtcgttgccgccgctccagccgtgcttcgccatcgtttcagtcgtcgccgtcgctcgggaaggtcgccatcgtggtcgccgtcgcgtcgccgtcctcgtccgccccttcgccgtcgctgtagaccgccggagcatcgccgtcgtcgtcaagccgaaggactccgccgccttttcctcgacgccgccgccgtccgttcatcttccgccgcttctttggtcatcggtgagttcgccgcgtcgctctctacgtgctggtgccctccgttcgtgccgtagtgccgtcgttcgccggcgagcaagtgcgcccgagccgccgccggaggtgacatcaccgctgacgtcgtcgtcatcgactctcgtggcccggtcgtggaccgttcgatctcggccgtccgttttggataggatcgatctcggccgttcgttcccgtgagccgccgccgtgcacccggttcaccgcaaaccctagccgatgacgcaataattccctttttcttttcaaaaataattcattattgcgtcataattcaattaaaatccatataagtgttttaacccgatttaatctttaaaaattcataactaattcattgtaactcagtttaatgtagttcaagttacaaaagttgtgtaaaataaagatctacatattaaaattatccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttatatgtattgtttatttggtttttattagtctttttcttcgttttgcgtgttagcttgtcgtttccgtcgttgcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttactttcgaatgtcactgggtggtgtgaatctattcctttgttatggcctgtttgcattgattactttattacttgataccttgggttattataacttgactagttgagctttatatattggtttagctagatattagatatgattgcttagccatgcttagaaatattagcacactattgggataacttatgactcactattatttaatgatggcttaatgatagttcacgatggtcaatcgtgattggttaattaattacttgccaactcaaacttgataatggtgggttgtgagcacatggttttgagaatcgtgctcatggcaattaaggaccggttcgcgagctactgttgtgaaatattaaccgtgccaaccacaagccagcgtgggcaacggctttaccttttgtataacatgattcattgcggagcaccagactgagaagtggcggagataagcccacggaggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcagaatggttgggcctgagcagcatgggcgtgttgttcagtgttgattaaaattaatgattaaagtactctactgttttattactcttaaatgtttgctaaatgctgcttttgcaaatgagcctatattatgccatcctttggtatccttgtgcacttgcatatttgctgtgtggcttgttgagtatgtcatatgctcattcttgcaataattaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatgcacaaataagttcggaaattactagtgaattttcgggcgtgacagtcggtcacgcttagcggcggtcggtcacacttagcggcggccgctccggtgctagccttctcttggacgcttgtgttggcgatgtcggtgtgtgagtggtggtattcttttttttccctggttacgatcctccagggttgtaatctttat

SEQ ID NO: 61758 - DNA, 3718 bp, Oryza sativa
gtcgttgccgcctcctcctctgcctcgtgggcctcgtgggctcgtcgccgcccgcgcgccgcccctccccgccgcccactcgcagcttctcccccaccgccgccgcgtcgcctctcgccgacaccctcctcctcccgccagctaagtcagagaagggagagagataaagaagggagataagaggggaaaagagagagaagaggtgggttatatgacagcatgacatgtgggtcccactctgacttagccgtcacgtaagacaaaaccaggatcaaaactacctaaggatctattgtgaccggttttgatagttgagggatgctggatacctgattttacggttgggggacgattttgtaactcgatgacaagttgagggaccttcggtgcactttttcctaatttggcgtcaacagggccctgcaccgcggcctacgggactgtctatccatttgtcgggtgatttctaaccaaaaattacccagattttttttactcttagatttacatctaacggactacaaaagaatatacaaatacatatttacttacacattatttttatcaaaattacagtgcacttatatgccatatcaactgaatttacaaatgtaattttaggtatataggacagtaattttatattttaaagaaaataacaaatatatatttacttacatattatttttattaaaattacagtgcacttacatgccatatcaactgaatttacaaatgtaattttagttatgtatgactgtaactttatatttcacgacgacgacgagagtggccgtactgccggcggccagctcaatcagaggccaccttggcaccgtgcttctccatcatcacgcgcgcgggggtagctaggtaacacaggccgacgtgccagccggccggcgagctgcatggaacatcgatcttgcaaattgccgctcgcatcgcaagctgcatggaggccaaaacaaagtgtcaaatgccagaaaaaaatcacacggagatggatagcaaaatcgttttcatataaaaatgagattgcgactctttgagtctcctcctgctaccgaggatgtaacactcactctccttatgcaatattaattcaagtgttatataaaaagcttggagaatccatccccgtgtccctggaaaagccaacaccaacctttcaacgggcccaaatgttgctcctgcactaattaatcactttaattacagctacgcagagcattttggctaacttgaactcgtttaagaataaatctaaagcaaaaaaaagtcacctgtcactcttgatgtgtcattgtacagctggaagtcagacactgcgagctctcttcagaaaatgtatttgcacggtcaactctttgatgcacattatatggactctgctgaaagcttgaaattgcaacaaattactgctttgattgataaggcctggtttatggctagcttctcagattgggacaatgcttacatggatccttgtgtgtgctgatccaattaggcaaatactgagccaaagtactagcatcttctttaattttaagttaagtcaaacttcattatggcatctggggcaatagcaacatgccaacttgttaatttccataccaaaccatgcatgatggaaggaaagcatcagtgccaagtaaccatgcaattcacacttctgaatccatcatacattcattgtattgacacttttaaaaaaagagagatttgctctggtacgacaaaaagtaactcgaggtaccgatacctcatgatgctaaatcgttttcgatcgttggatctaacaatgcacatcatgtccagctagattcaacgataagaaacgatttggtaccgtgaggtaccggtacctcgagatactttttgttgaattggagcaaatttctttaaaaaatacctgcaggtgctctagttcaactgaagggccagatttagcaatatctgagtccttcaaataaattcatcaactaacaaacttcaaccgaagctatatataaacaaaatcaaaaaccgtgatagaataacggtatatatttgaccagaacatcgaaaacgaaacagggaaatgtacaaaattggaaagaaaaagggtgaaataacttatggaacataccaaaggttgggggtgttgacatatccacacaaattaaactataatctgaagacctccaactccaagttgtcaagacaaataaccgagcacgcgagcgcggttcatatgatgtgtatgggaattgggatgctgaaaacaaatgcaactggacacatatctgcaacttgtaaataacttttatttcttttaatggaaaaaatgtgcctctcgcgtattccggaaaagaacattctgtcctatacatgacatcctgatatgttgtaaacatgataaataactggtaagttgcctgaaatctctatcaaggttaaagtcggccgaagaattgcagggagacagatgaactgatgagtaagagacagcaaagacctgatgaacacaagagggtcatatgtccccttgctgtcagtgtcagggttggcatatttgcaagccggtgtgcaaagtcagattgataacgcatgcaatggccgttggatcgctgcaaaagatgtaggttagatagaaccgaagccgtgaacatgatactagtagctaacaacaacttttgttgttgatcctgacacgccgttgctttgcttcaggccgtcatgaaaaaaaaccagtgcatatctcatggcaagaagaagtgcaggttgtgaactgaaactgcaaacatgaagagaaaatacagaagtttatgaagaagctcccatcaatccaagcaaagttttttttttcttgttatttaatagaacaaagttacaatgccagagtaaacagtgctgagccacaattcttggaatctcattttactctgaacactgaaggattctgtggacagatacagaacataacataacagaacagaacagaaaaggaagagaaattaattaatcggcaagcaacagatcgattctgcgcacgcatctgatgggatattctgatccttggtggatcccatgggataaagggcagtcttctccggagatgcggcgccgaggttatctcctttatcaattcatttcagcttaatttaaacggttctttgctttcctgtaatatacatgcaatgtagtttcagagatcagagtcgagactgtcaacgctagctagctgcctctaattttgttgttttaaattcagaccaataatgcacccattgttaattcagaaagaaatcggtaagcccagagagttcagacttcagagagctgacagcgtgttcaggccgttcgattttggtgaggccattgcaccagcacgaatcacgaggcagatattacaacttgagctctctataaatagccccagcgatgcgcgatccaaagcaagcaacagcagcagaagtgcacttttgcattctatttccaatcaatccaagaggctagagctagcggccaagatcatcgtcaccggcggcatggactcgtcgacggtgggcgctccggggagctcgctgcacggcgtgacggggcgcgagccggcgttcgcgttctcgacggaggtgggcggcgaggacgcggcggcggcgagcaagttcgacttgccggtggactcggagcacaaggcgaagacgatcaggttgctgtcgttcgcgaacccgca

SEQ ID NO: 61759 - DNA, 5190 bp, Oryza sativa
tgcgcgcaggccgcctacggcgccatcttcggcgtcatccccttcgtctcccgccgctcgctcggcatcatctccggcatgaccggcgccggcggcaacttcggcgccgggctcacgcagctgctcttcttcacgtcgtcgaggtactccacgggcacggggctggagtacatgggcatcatgatcatggcgtgcacgctgccggtggtgctcgtccatttcccgcagtggggctccatgttcctcccgcccaacgccggcgccgaggaggagcactactacggctccgagtggagcgaacaggagaagagcaagggcctccacggtgcaagtctcaagttcgccgagaactcccgctccgagcgtggccgccgcaacgtcatcaacgccgccgccgccgccgccacgccgcccaacaactcgccggagcacgcctaattaagaggccaagttaattaattatgcatgcatgtataaactgttgaacgttttgttaccgttttctttatactatctagagtatgtcgtcatggagaaaggcctttgtattacttgcttcgaaaagcgtttaaatgaaaagaaaaaagttaagaaatttttgtgataaaccaacaaaactacccccaaagtttgcaccattgcgttgattttttttcttaaaaaaaaatggaggcaaaagctttgctttgactataccattgcgttcagttattacagatcttatttgaaagtagaattgcatacgagggagactacgtaacaatataccattgcaacagaataattaccgtcaatatggtaccatatgtaccatttatggtatcttcggtatcagatatgacaccccgtatgtatcagatccggtacataggtactatgtacatgacataaaagcaagcgtggtgcatcttttagctctgtgttttataaataaaaccacatttgtacacatcttcagtggttaattaatctctacccatttataatctggatccaccattgaccattgtaacataaatcggcaacaaccaaagccaagagaaagaaccatgatggcctcatggccagatcactgttggggggtgactataccgaatggttatttaggaggtgtctaggattattagctgttcagccagggttatcttttcagtaagagcatctccaacagatgtacaaaattcgaaccccaaaaatcctctattggggatagccaaaaaagaatttggcctaaaatacaccccccttcaagaggtgtcccaaaatgttaaaatttgccacataatcatttgtgggtccttctcaactaattttacagcaaccagtgattgatcgagtcgtctccgtagtgttgctgcatgcgtgcaacaaagacagaagattactgcagcaggatgagggaattacccaagtactgaatagacacaattctgaatataaatagtttgtattgcacagacgtagtaaaccacctaatctagacacaacagacacaattctgaatataaatagtttgcattgcacagacttaataaacctaggtaaatttctaacgaatcttcactaatctgaactccaagtacgattgccaccaaatattgccatctccttccctcccactctctgatctggtggtttccctgttgatagtaatgagatggagttaaaatgaatcagaatacatgtacagattatacagctgccaatttttccaatatattgtaattaataatgtgaacaattctggacatctatgaacatttctgatataatctaaacaaatatttctgaacatttctgaattgccagctagcacaacattctgaaggtttctaaaataaatctgaacaaatacagtagtctttgatgctagaaatctacatccagatcaactcaatcgaaggtaatacagctgaaaatgcaatgcagtatgttaaatcttttggcctcaaagaccaaaattcagaccaagatttggcagtgcatcatgcagcatatttaaaaatatatgcagccccatgtatcagtggatcgaatcagatggtgtagtgcagctgtgcaaaggcagcatttcaacaagatggagacaagaacaagtatatgcatggacaggggcactcaactgaatgtaaactgttatgagacacaaacctatcaaccggaactgttcatgcgacgagcgatgatctcattttgtaaactcttgtagaactgctgctgttagagaggcttggaagaaatgtccagttgaaaaatctaacatagtagagatttggactgaggaagtgtacctggacgtagaagaggaggcaccttggaaggggaagacggtggccggcgctgccctcaatggaggaccagcgacgccctagatgcagggtcgccacgcaccagaagaggggctgccggcgcgctggatgaagggccgccgcccaccggtacgagggccgccggcgctgtggatggaggattggaggcggcctgtggaaacctcggaggtgaactgcggcggcgtgcgcctagctcgagaaagaaacggcgcgagagaagggtagaaaagaaccgggcacctggcggaagaaaaaaaagacgcgggtgtgaaaaaagtggcgcgagatgttgattgggagggcgtatatgttcccaaaatctaggggtttggcactggttttaggcgtgggtaaattttgggatcttgattaggaatctgttggagggctgttttttatgaaaatcctaaaatttaatttttaggaacctttttagccctctcttggagatgccctaatgaaagtggaactatcaaaaggtgtcaactgtcaaccagaagaagcaatattatttgaaaggaaaaaaaaaacagctaaatacttggcaacttagcaacaatttgtgcatgtccaaagttcatggaagtgcattagacaaacatgaaggacagctcaggtacttgttggaccttattaatgtccacaacaaatggcttatctcaccatcttcaaatttataatcgagtaagattatgacatgaaatgtgcacatctttggaaatggtctactgatccaatgtcaacttagaaaacaatatattagatgcacctgtatagttgtgtgtgtgaacttaattggtattgtgattttttgaggtttgctcaaagaaggaagcaaagggtgtccttcctctcaaaaaagaaagaaagaaaaaggtggcaagagtcagattaggcaaactcccaagtgccaagtgtgaactgacagaaaaggggagaaatttggacttttagcaaaatttataaattcaaaattcggttggaactttcaaacaaaatatttgatcaaattttaaatttgaaaaaaataatgtgcaaatctaacctaaattttaagagatgagctttaaccaattatggaatatgacgtgtccagcaaccctccgccatctctcatgcttgtttgcaaatcgagatgccatcgcccccttgcaccatgagatgttagagcaggtacaacagcagactataagccatctataaacacatatcgagaagataaaatatgagagagaagagcagtggggtacagatttgtagccagctgtagcacggactccacgacacaatgtgtgtatgatagatgggaccatgtaagtatatgtttataggtaactattatatgaattggctattaagttgactatagatgatttggagctactagttggttatactattaaacttgctcttaaggagccatcgtatcattttcaacctaacagaatactccctccatcccaaaatataacaacttttagcccttaggatttgtcccaaaatataacttctctaccaacattctctttccaaccaatcacaaccctctactattcacttttcccacctacctccactactcgtccaatcacaatcttccaacattcacttgtacctactttcttaataaccatatccaacttgtcggagaatgaactcctccaccagggaaccgtgaggcccccctttgtgagttcggccgggggcagcgggtgagattcgagggcttggtgagcgaagctgtgtaatcttgaggaggttcaatcccccaaagacgatgaaacaaaaggggtttatacatgttcgggccgctaagaagcgtaataccctactcttgtgcttgattgattgagtagagaacaccagtgtttggggttgcgagacccaagagccagttcgctcggaagtcccccccctctccaccactaggcctggacctccttttatacctcaagaggttaccacatgggcccaacaacctaacctagctccggtggagaagtattataatctttgcattaaatgcatgtcttgtctcttgacttgggaagccaagcgcatgtcatcttgatgatggggcctgtcaaatcttgccgcctgacatggggggtgcccctgttagtcaccatttaatgggtgaagacttctgggctcctattacaccgggaaacgggagccttgctttgaccagagcgagaggaccgactccggctgggataagaggatgataacctgtcaccatcattatttgatgggatatgtcgggttgcacgtcgcctgacacacgcgatggtgcgcctgacatcctgggtcccatcagtcattcgaccggtcacagaccggttgagtgcactgcacaccacattaaatgcggcgtggcgcgaccgctcgggtcgctataaatgcgggtaggtgggcacctggaggtggatacctaacccaccgtacgtggtgacctagagagggggttgggggagcccgacccctagttacgggaggggacggccgccgcccgacctcgggcccgatcccccctcggggggagccacgtggcgcctggggcggccttctccctctagtctcggccagggagtggccgccgccctttctcgggcccgacccccctcgggggagggccacgtggcattggagggcagcctcctccatccagtctctgggaaggagtggccgccaccccacctcgggcctaactccccttgagggagggccacgtggcatcgggggcagcctcctccgactagtctttgggaaggagtggccgccgtcctaactcgggcctgactcccctcgggggagggccacgtggcatcggggggcagctcctccgactagtctttgg

SEQ ID NO: 61760 - DNA, 10817 bp, Oryza sativa
caccgccggcgtcaccacctctgcgccgcttgaccgctcgcgccatccgcctcatctccttgaccgccccaaggtcagttctcccaaaccgacatcgccacctataaaacccacaccccccctcccatacctctcacttcctctcctccatcacaccactgccgcctcgccgttcgtcgtcgttctcgccctcctctgccgttgtgcgtgtcggggagctagcgagcacgaggagtcgacgaggagctccgcgccgcccccatcctcgcgcctctccatctcttcttccccggccgcgccgccccgccgtcgcgtccgcctcgccacgactccatccgcgccgccgacaccgtttctctcgtcggtgagctccccactgaaccccttttcccctgtcgcacgctgcgccgcgcccgccgccattcgtcacatctcgccgcgcgcccttgctctgtcccgggcgtcgctcgccgtcgccggcctctctcggcgtcgcccgtgccctctcgaccgatggaatgagctcgcgacctcgcgtagatgctccagctccaacgaatcgaacccccgttgccctggtgaagttttccccctttgctcgccgccgacgatcgccgtcaaaatccgccgccgtcggctcccctcttgtcaatccctctcgccaccacgctcccggggatccccttgatctcccccttgttgccccatggccgccggcctcccctctcgctctcgcgccgtgccgccccttccgccaccgcttagcgccgccgcctgtgcgtcgccggtgaccttcgggtcccgcgtcaccgtgtgcgcgtcgcaaccccctttccgcgacagctgagcccgagaccgcgcgcccttcgctctttccacgcgcggccacatcagcgtgtcggcgagattggccaccgccgtcggccgccgtcgttcttcccccggctaatccgctccgttgaatcgattccccttggcctcctctctcttccggtgctaaccccccaatccacctcgccgccgttcgccggtttgcgtcgctcgtcgccggccatcggatcagcctgcccggcctcctctacctccccatccgacgtggcttccacgtggacgccacctcagccctgggcccgcttgaccgagtcaagccggcgcccagtcagcccccctcctccctctccccgctcgtgggcttggcccatcaaccatccccccttctcggcctaggggaaaatgaaaagtctacttttactccctctgtccaagcccagtgcccacacacatgaacaaaagtccacttaatcccccccatgtacagtacacccttggccccgcacgtcagtgactgtcaataatattcttgagaatattatttctataaattccataaaccatttctcgtcttccagaaattctaattgaacttccaaaattcatatcttcccaaccgctcttctgattgactccgttcaacttccagtaattccgtaaaattgagatctatttaatggcactattatttagtctaaatagggtttttttcttggtcttttgtttaggtttttgtttgtttgcgtatagttgtggttaccggattttcgccgatcgcgggttttctcgaagattcgtgaagctccgtgaagaccttgagcaaggcaagtcaccctttgatcaattgcccctataattggaaaatcattattattttgtttgcaacttgcattattagaatcacacataacttgcttggcctcgatttgcgtgccaaaccgacggacctacccagtagtcgcactaattcctgtaggctgtactatcatgattccttgtcgctccacccttgtggtacttcggtattcgtgctctctgagcgcgtataccaaatatctcacatacatcgttgattgtcgaaaacttgggaaatgggtttgagaagccttgaaaacccgacatgtggtgtcggtgtgtttaaaaataaaatgaattgtgaaaactcgcgatgcgggggttgtgcctgcgtggcactgtcccgtgttcgcatataaggaccgattcctgtgggaaactcatcgagcataatcaaagtgcaaccacaaggtggaatgggacaccctggctaagtaattagtcggttcagggaaacctcgcatgccaatagttggggaacgctggggcggggtcggttggagccaaaccgggttcctggtaagcaaggaataggagcttgctgaattaccgatcgaggtggttggagtttgatttgtgaaaactaaaatggcatatatttatgtgaggatttgatccttctatgtggcatgaggtaaccctgggccggcttaggaaaggccttgttgcgaacctccgacaccgacgggtgttcggaataagttcgtatcttgtgggtaaagtgtacccctctgcagaggttaactaactgtttgaacagccgtgcccacggtcatgggcggatgtgaggtggttcccgttgcgtagatttgtttgcctgtgctttgtgaaaagttgttgtgggatgggaatcgtaaccagaatcagcctatgtggcagatggatgacctgagtggtcagaaacgaatctgtgtgattcgggatgtctacgggcatcatagactaggcttcccgagtggaagcggaatgttgtgctgctgggcagctggactctgggagtccgagaaaatgagaaaggctctgggagccgattaatcaagtgaaatagctctgggagccgagaggtaatgatctgacccgggaggtcgatacattaccaattgagttgttgaaaaatatctcttaagtcgatttgagacgcaagtctcttttcggcccaaacttaacaagaagtaaatcacttagtgatttcaaacaaaggatttgcaaaacaaccttgcccctcttccaagcttgcattaaacacctaaattccagtgacttgctgagtacgaaagtactcacccttgctctatataaatatatatagttcctccgtcctgaagttgaagatgaagtaaagtgaagattaagggttttgtcctggttcccagccgtcgcctgtggtattgggtgttagaccgttggttccgctgctgctgctgttgttggtgtttgcctcgtccgtgtcgtcggttgcattcttaggctgtctgagctgcaacctaagttaaggtaaataagtcctctatttattttaaggattgcaatgattcatatttgtcaccgtgggtaccagcgctatgtcctgggactggtactgagatcgcggtttcgtagggagcggtttgcaccgtttttcctacgacacgctcctatcaggtgccgttgtacgacggtgccagattggggtgtgacacctcgggcttgactcccctcgggggaggaccacgtggcatcggggggcagcctcctccgactagtctttgggaaggagtggccgccgccctacctcgggcccgacccccctcaggggagggccacgtggcatcggggggcagcctcctccatccagtctctgggaaggagtggccgccgtcccacctcgagcctgactcccctcgggggaggggcacgtggcatcggggggtagcctcctctgactagtctttggggaaagagtggccgccaccccacctcgggcctgactccccttgggggagggccacgcggcatcggggggcagcctcctccctctaaacctgatacatacccccgggcctatatcaccgacataactctaaaacttcttatattatgggatagaaggaatagaaaggagagcagtgccaatgtcgcacactttatgccgtcagtactcctttcaaacgcatgaattttattggattttaatacgaagaaagcatagaaaggagcttaggacaggttaatttttttttaccaaagttactggcctggtgactaactggacccacctagcggctcaaattttaaccccggccctgatcataagatgtaactaacgaatttctcaactatgtattgctcgccgcttttttgaaatttgtatgcaaaataattgcgtagttcaaccacaggacagtactcctattattttcagctggagtgtcaatatgacaacatcaatatggaatacactgtaaattcaaaaaagtgtaacatgtacataggtataaatgcctctcccttattatacctccgtttgtatcggagaaattccaaaggaattaatttcaaaggattcaattcctaaggaaatatttcactcttaatttcatcaccgtttgcaacaaggacgtgctccggcgtgttatcatcgagtcgaactccagcgtattgctggtctcggtcgcagaattgtttacgccttaggcgtgctccggcgagttgttgggcggcgtggcggcggcggcggcggcgttgatgacgttgcggcggccacgctcggagcgggagttctcggcgaacttgagacttgcaccgtggaggcccttgctcttctcctgttcgctccactcggagccgtagtagtgctcctcctcggcgccggcgttgggcgggaggaacatggagccccactgcgggaaatggacgagcaccaccggcagcgtgcacgccatgatcatgatgcccatgtactccagccccgtgcccgtggagtacctcgacgacgtgaagaagagcagctgcgtgagcccggcgccgaagttgccgccggcgccggtcatgccggagatgatgccgagcgagcggcgggagacgaaggggatgacgccgaagatggcgccgcaggcggcctgcgcgcagaaggagaagaggaccatgcagacgacggaggtggggagggtggatgcgcggccgagcaggaggcagaacgcgccgccggcggtctggaggatccaaatgttccagaggcgggcgcgcatgccgaagtagcgcgcgccgaggtccgagaggaggccgccggtggggcgcgcgacgatgttggccatgccgaaggatgcggcgatgatgccggcgacgcggaggtcgaggtcgaagcgatcgtagaagtactcggcgatgacgttgtcggtggtgagctcgacgcccatggagtagccgtagaggaggacgaagatccaggtgcggtagttggtgacggcgtaccagagcaccctggagaagctgtccctgttgacgtcacccttcttctgcaggctgcgcaggttgccgtcggggaggtcctgccccagcgtcagcaccagcacgcccatcaccacgtgcagcgtccccggcacgaagtaggccagcctccacgccgtgaacggcgtcgcgccgcacttgcggatcacgtcgtagacgagcggcatgatgagctgcgtcgcgccgccgcccatgtttccccacccggcggcgaggccgttgacgaggccgatgatcttgctgttgaacatggtgctcatccagtactggcatgacacgaaggtggcgagggagaagccgatgaggaagcgcacggcgatgtaccccgcggcggagtcgatgagcgacatgcagaagacggtgggcgcggcgagcatgatgaggaaggcgcagccgtagcgcgggccgagcatgtcgcagatggcgcccatggcgagcctggagaagatggagccggagacggaggcgacgccggcgttgccgatgtcggccttggtgaggttgaggttgtcgcggatgatggggacgagaggggcggcggcgaaggtggagacgaagcaggagaagaaggagatccatgataggtggaacgtcctcatatgcgggttcgcgaacgacagcaacctgatcgtcttcgccttgtgctccgagtccaccggcaagtcgaacttgctcgccgccgccgcgtcctcgccgcccacctccgtcgagaacgcgaacgccggctcgcgccccgtcacgccgtgcagcgagctccccggagcgcccaccgtcgacgagtccatggcaactactagctgctgctagccgctgcttcttggagatggaatcgatcgaatcgctggttgcaagagagaagctaggtgagctcggatgcaattgctggctttgctggtggcttgggagttgggatcacgcatcgcccagctatttatagagcttcaggtgcgcgggaattggcacgctctcgttggcgccatccttatggcatttgccttaagattcgtgctggtgcaaaatggcctcatcgtctccgttctctcacctgataatatcgacagacctggacacgttctctgaactctgaagtttattgctgaattaacaagagtggatttttaattatgtgattatacgattattacgttacgagcgataagggggcagcaagcgttgacaatatcagctgtgaactctgaaaatatagtactactagtagcatgatataagaggaagtcatgtgagattaattaaggagataacctcggcgccgcatctccggagcagagtggcctttatcccatggaatcctccaaggatcagaatatgcaacgccaatatgggacccacctgatgcatgcgcagaatcgatctgttcatctgttgttcctcagctggttgccacttcacaatttcacacagaaaaaaataacagatatagctgtaaatgcaagtatgcatagacgtagccagaggtgagtaaaaaaaaaattttgaacgaatcggtaagctgccaatttcattgaatagagaaagagtaaactttacaagtaagaaaaaccaggcccaggaccttcggtcctactgagctaaaaataagaagcaagccagctaccaagatgcctcgcccccgcccgagaccatgttttggcctcctttttaattttggccaacagacttccggtagataactctttgtgctgaaaaattctacgatttctctcattccagatttcccagttgaccagaagtgttaacgtgtgaagtgctttctttggggcttccttcaagttggcggtggcctcccaccactctaacaccgattgagctagttgccattgaccgggatttagttgaccacacccagtccaatcagataacgccgcccagattttcttggtgtatctgcattctgcaagaaggtggagagcagtttcttgggtgtgtctacataaggggcagaaataatcgttctgccaacctctggttgccagtctgtcggaggtccaaactctattttggataatcaactaggcaaaggtcttgcacttgcgtggtgcccacggcttccatattatgatgttgaagttggtggctgtagtacctaagagctgcgctttgtaggccgacgtcaccgtatattcaccatggccagtgagcttccacactatcttgtcctcctcattttctgtgaaatgtacgttgtgtaccgcactccagacattgattagctggctgaccagctccgttgtccagcctaaggctggaggaaggtccagatcgagcagccactggtctatagttgaggcctattgtagttctttttcttggagggaggtgagtaaaattattttgtgttaatgtgcactttgcagttctttttcatatgattcgaaagaaataaaaattagcctttggattcggtttaggcgcccagctagtagcattttcaacttcagctaatttttctacctgaaattttgatatctttgtgaatatatgcttttcctagaaatgccaatagaaaatcatttacagcatatctgttacatgcaccaatttgactttcaaatcatttcctgatcgatacaaatttcgatgccgactttaatttcaaatcatcaaaaccccgagtcggccagctgaagtagatcgagcagtaaacatcagtagtgacagacaacagcgacgtcgagtagtaaccatgaacacggcttcgtcctagtagtaaatcgcatcttttgcagcaatcgaacggccatcgcattgcatcatttgctctgactatgcaaatcatgtaattttgtcaaccgctgacactgacagcaagggacaaatgacctctagtgttcttccttcaggtctttgctgccttttacacttgtaccaaaggcatattttttttccaccaaatttaattctgcaaatacgactttggacttggatattattgctgcgactctgcaaatcggttgttacaacttacaattaacacttgcctaactaattcgatatttcgattgctgaattcttgcttgctccaacactgtgacgacaggggacagaaaggcagtctagaatcaatgctacaactgatcgaaggggacaagtgaaatgagctattgacgtctcggcgggacaaatagcatccagttcattgttctacaccgtcatccatatattctcatttctcaatttagggcaatttctcggttacggtgacatggtctcctgccttgtagaatctaactattgggaaatcaatcatgaaagctgccatgtggccggttctagtacaaataatgtgtacctgtgtactccacttacacttgcgtcctactacgttgtatgttacttgagatcgaccgctcgatatttttcatccataaatatgtgcatttaatgtaatgaagaagaatacatttaatgtgtaaaattagggaatctccacccgtttctgtaaggctttcttttccttttcaatgtgttgtttgattaccttcatcagtttttctcaattgaaaaaagctcaaagagacgtgcacatgaaatctggccttttggacttatcagggctgcgcgccgtgctatatgcatgataagttatgatcaagccagttaagtgacatcaagtgatgcatcattgagtcttgagggaaaaaaaaagaattgcttgtaaatttcagaggcatttgactttgtaggagctggtacagcagccgtacaagggcccacgatctatacagactcttcttaattaaccccccccccaaaaggttatcttttataatcatgctgaattgatctattttcctcgtaatctttaatcatcagatcaatcaataccgattgttcatcatgccatgaatctccaaacgcttcattttttgttgggccgaaagctttcgacctggctgacacgtgctgaactctatcatgggcctggagacatacggcccacgcattcaatcctctctcctgggccttggcccactaggcagtcctgaactgaactctgatgatatcttgttcttatctgaaaagatcgccacatcgatcacatggccaactcatcgagcggcgcgatgctaatcaatctaatactgatacactacactaatcatgtgttgcattggcgtttgttaatcaccatcttggtcgtcgtcgtcgtcaatcgtcatcgctgagcatctttgtattgtacattactaatacgagcagcgatcgtgatcagtaaaaacaacaacgtggtcagtccagcccccttggattagttacactaattaattaattaattaattaattaattaatactcctctcttccaggtgtatacccagtaaacgacacaagctgcaattagccgaaatcctccgtatatttcaccaagccctaacacggacaaaaccatccagatgtgcctgcaattttctttcttaactgcgtgacgtgttcgattcctcgccctcgaatggacactgccacgtaccaaacttaagattcatctgagcttgcagatcgaacatggtcgatctgtgaatctataattattcctcctcctccttcacatgcgtatgtatgtataccagtatgtggatcaactggcgtaattaaaatgagtaaattaacaacaattagtatgcagctgatggattccatcttagctagctagattctccgatccctgaaacaaatcggcagcactggacagatcatgcattgcatgtatatatatgaccaaccatttcagctaacgagtagctatccagcatatgtttgctagtttcagttcagtgatcgagtgagcgagctatagtaattaaggccttaagtgaggagtgattaattgcagttgatatggggcacagtggtggcgttgaggctgcgtgcagagtgctacccatcatcgacgaggagtcggagtcggaaatggacgaggggtcgccggagaggaaggtcgtcgacgaccgccggaaggccatcgtgtccaggatgagggagctgctccggcgagcggccgctcagtcgtcggcgcagtccaagctccggtccaccgtgcttgtcagtgccaagaaatggaaggtaagccaaaatccattcgatctctgactaatttatgcatatgaattcagttgcatttctgtgttgaacctctgaaatttaacttgtttttgtgctaattgatgttgtcagagggtggtggtgagcctgcagaacagcaggaggaagcaggagcagcagcagcagcaactgacgacgacgagccggcagagcgacggcggcatgagctcgtcgccggtctccagcaagagcgacagcttcagctgggacatcgccacagcagagagctgctcgtcctcgccagcgcagtcgccgctgtggccggcggcgctgcgtcagttctcaccgtcgccggcgacgaagcacggcatgaggctccggcgagacagctcggggtcagcagctgacgatgacaggatgagcagcatgtcgtgcagtggcagcccggatgacgacgactatggcggcagcagcaggctgtgtcagtggatcaccacggattctgactgtaagtgattgctcatcatctcgatctcgcgttcacgcataagacaattaattcaggttgctgatgaacggatcatt

SEQ ID NO: 61761 - DNA, 4004 bp, Oryza sativa
cggtactaccatttgcattttgcagtgtcctacactacaaccaaatattcgctaacattattttccactcaagttctattggcacctataacaaacacgttagttggtgctacatccaaatatatcttgtactaggtcatttgcacttcagctctggtaacaaccatctatggcttcaaaatacaacttttcatactgaattacgcccttgagaagaaaaattgaagcttccttgtccaaatccctattgtaatcactgcatgcaaatgattggatgcaatttggacacccatcagagttggtgcagctgcatgatgaaacaagctctaaagcagcaaccagaagctcaccaaagagcagcttggcctgtgatgctaagccgatgccaccgggatgtttgtcgtacaacagaattctgtctgcagtttcagaattttcttgaggctctgcacattgtgttcctagatcagaaccactgcacatcatgtgcagaggtattatacttagaagcgcatgagaagcagcgtgtacaccaccacagagctgatattccatctgctccatagtcgtccttactgacacaggaatctgtacccaaacggcttgagtttcaaaggagtatggaggtagatgatcaaggttaatgctgtcggatttctggttgtttgacttcaatatccgatcaaagccaacccatttggttgtcaccctgcagtcatttgcttgagctgttgtcctcctgatgtcaggtttacactcactcgcaggatgttcatcaacatcacctccaatgaaactgatttcagtgtagtcctgaactttggtgtagtagttcagatcaaacaccttgcagtaagctatccttgatgtcagatcaagcttatcaaccaagtagctgacaccttggtgcatgtagacagcaccatcatacacctgaaagaaagccttgctttcctcaatctcttcaagaactcgattgcttctcctgtcgatcaccttgtacctgtgatgctcaattgcccgtatgcttacactatgagaaggttttttatcaggtccaatatacttccacacgcctgaatctcctccagatggattgttcatgagacagcccttatctttcagtgtcatcaaaacactgttcatgctaaaaccaaagtagctctcgtcatgttcctgacgcagtggatattcagaagcggcgcaagcgagatgctgttcaagaaccttgcggttttgtgaatcaacctggcagtgctcaatgggcttgccaaacagcttgtgtggtgatctcatgaagtactggtcaagagcaccctcaaaggctacataaacagctatggactgctttgctcttctccctgatctccctgcctgctgccagaagctagccatgcttccaggaaatcccaggtgcagcgtcgcatcgatgtgcccgacatcgatccccagctcaagagcattggtagccgcgacgccgcgaagaattccaccgaagagatcagcctcgatcttcctcctgtcactcgcaacatagccaccacggtagacacagatagaattcaccaattctgcagctgtctccttaagaatctgacgcgtctgcattagcacctgctcacacatcttcctcgtcttgcagaaggcgatggcacgaagcccatgctgaaccatctcggcgaacagataggaaacctctagtactgggtttggtcttctgtcttctgctttcgccaattgcaatggcggattccacaggaggaagttctttgagccgcaaggactcgtgtcattatcaaccagcacgactcgatcaagatttgccagctccatgacatgctccctcggattggccaatgtcgcggtgcagaatatgaatgttggattgcttccataaacatatgaacagatgcgctttaatcttctcagaatcaacgcagcgtggcagccaaatgcgcccttgtaggaatgcgcctcgtcgatgacaatgtacttgaggttgaagaggaccctcttgaactgagcatggcatggcaagatcgacatgtggagcatgtcagggttggtgatcagcagcctcgcggtgttcctgatccttgtccggtctttcatggcggtgtcgccgtcgtagatgctgacgtcgaagtctgagcggaacgccggcttcatctcgagcagtgtcttgagctggtcttgggccagagccttggtggggaagatgtagagcgcgcatggcgcggagctctgggagatggactcgaggacggggatgttgtagcacagcgacttgccgctcgacgtcgaggtggacaccacgacgtgctcgccggagacggcggattgcacggcctgcgcctggtgggcgtacagcttggtgacgccgatgcttctcagcgcgtccctcatggaggacgagaggtggccggggagttcggcgaacgtcgcctcccttcccgggatctcctcgacatgggtgatctgtccggccttcccgagcccttgcctgagatgctccaccatttgggtagggtcgagaggttgggtgccatggcaggagagcggcctcggcggcgctgggttcgtcggcttcttggcgtagatgtcttcgccgccgccgtcgtgccaagaaaacttgcgtttcctccatggattcggcgcgctcgacgacggagggtgcggcggcgctgacttggcgttgaccgggatgaaagagatggactcgccggggccgacggggaggttgccgaccttggcgtcggcgatgagcttggtgcccttgaggaagaggtggaagtcgggggaaaccagcgcgggagcgaaggaggaacggagcgccgtcctgaggtcgctgacggtggcggaggcggcgatcgtgacggtggtggagcgcccgtcgtgggcgcgcacccggatgactctcggctgcgccattgccgtcgccgttgcggaggaaggaaatccgcggcggatttatagccaaattacgcgcaatgccgcatcggaatcggatctgctgcgatactccacatagaaaccaactccgatgctgtgaagtttgaacgtggccgacatcgccggtggcgtgctgccgccgtttagccggcgccgcgcactcatcactcctccatggggcttgggctgactttaccacgccggctgcgtcgatgagattgagaatttgaggcccattccaatttattcccgcacggtaaccctggtaaattttggcccgttttcatgctcgagagaaaggcccatacgcataaataggccgcacgtataatttggcccaatttgtgtgggctgcacaaaagtcagaatctcgtcccggcctaacatgggctgcgaacgtaaaaacccaatcccgttattgggccattacggtaagtgtcggcccatatgtggtccaaactgagaaggaaacggccatgtgagctctacggcccagaacgggttgtcgtctccccgtccggcgggggcgcggggcgccgccagtctcaggagcccgccggccgccgcaggagagggagagcacccaccgagaccgagtcgacgctagtgcctactgccgccattctcaggaacccgccgcctgcgcctggttccctgcaaccgcatcttccgcccgccaccaccaccaacaacgaacgacggctgcactcaaggtgttcgatcgtgggtttgccccggagtggccagaagcggcggcatcatcttgatgcacactgatatctattctcgtctccggaggagctcgcctcgccggcaatccacgacgtggcggttccaatccgggaagcgtctacgatgacaacggtcgtacgttaccttgtcttgccaacgacgctgcctgtggctacgaggacgtcgatgtacatgtacgtgagttcagcacgcccccactgcaatttctttcttcactacgattaatatctggtctctacacacacctgtgaatattggtttagttccaacggattgtgcgctttactctgacagaaaat

SEQ ID NO: 61762 - DNA, 958 bp, Oryza sativa
tagagcgtccttttttaaggaaaatcaaattcaataacttttgactaataatcatactaaccatatatatgctaaatattatgcaagttatatcaataaattcatattttaaagtactttcatataatggtaattttatatttgttgggattgtaacatgaaattaattaatgatcaaactatgtttttgaagaccgtataaaaaatataaatcttataatttactcccttcgtttcataaaaaaccaaactagtaccagatgtgacacgtcctagtactaagaatctggacatacatctgttcagattcatcgtactagaatatgtcacatccgaatccgattctagatttgttttttacgggatggatggagcaggacttatggagcagctagcatcaacgtgcacggcaggttggcaccccgacctctgcaggtatcgcacgtacgtgccgtcgaatctctgcaggtatcgatcgtactcctgtatatcaacgtgcacggcatcccgacctcttcttatcgttgaccaacttgtagctagcagcgttacgtgcagccaccgcccgccgccgatcttatcttgttgttccaatccacatcgtccagctcggccgtcgccggtacatccggcttgtcaagtgcaccgcttcttcatttttcttattattatctacaccttcaccagctagccgtcgtctttaattattcatcaatttacatatctgatatcgtattaaagtttaaacctgtactacaactgaagctaagggtatgttatgtttagttcacattaaaattaaaaagtttggttaaaattaaaacgatgtaacgaaaaagttaaaagtttataagtgtagaaaagttttgatataatagaaaagttaaaaacttaaagaaaaagtttaaaactaaactcggtctaaacagatctcccaaacctttttttttcgcgtcaa

SEQ ID NO: 61763 - DNA, 4274 bp, Oryza sativa
  unsure (1)..(4274): unsure at all n locations
atcggctatatttgagaatactttgcattgactagatttagattgaatataataaaaaagaaattctttaatagaatcaatcctgatagatcgaacctaatcgatacagtataagattattgacaatactaaagttaattatcatatgattataagatctaaataactagccggtgtacaaatatgtgagcagggcttaaaataactgtgatcggctcagaggtgatgcgacatgcaattaatgacctaatctttcgctttaatataagcaactataatacttcctccgtttcacaatatcaatatatgaatgtgagaaatactagaatgacttatattgtgatatctagattcattaacatcgatatgaatatgaaaaatgctagaatggcttacattatgaaacggaggaagtagatcagaacctaccgaggcattattaattgttggtaacaaagatcatatagattaataattatatgagttcagacaatagccgatgaggttacttaagctacatatggataatgtatcggctagaactctgatacaatcttatatgaaaatgtcatatttagttaaatatattaaacaagtcacgttcttagcagatcgaacctaacggtgaggtcaaagataacatgcaatcttaaacaaaagagttacatatcaggcaagcacactgaaaccctgataaaatcccaatcggcaattatagagcatgatatttcttatagctttaattacaacttagtagattcaaacctaaatgatgcaacaccaagttataattgaaattgatggatctaaacaagtccgcttacgcaagatacacagattaatctataacaacaaaacagtttacacgataacggcttaagcaagatgaatcagctgatagcagtaaacaataatattgtctaagattaaataatatatatgataaatgacgcttatatcgactggatcatagtgtcggttccaaccgatggaaaccctagccctgtcgatacatgcgtgttgacggaactcatcttgtcatcgaaaaccaaaaccgatgcagcccaactcaagaaaaaaaaagaactcgtcgaaaagaaaagctagggtggcgatgcaccgaaagttatattattgatgaattgtcctttacaatgatcccgggtgtacatatttatacacatgggttgatactacataattcttgttggatatggcacaaacttttctaaaaataaagtaaaaatatactacaagttctgatcgggctccaaacaatcttttctaaaaataaaatgaaaactaacttactttgtctaattaatagataaattatcatgccacttacttcttgaactcgatcggcctcttctagataaacttcctttaattgattaacttacttaaccaaatccactgatattaatccgactgctggcaactgataattcccatcaatcaattctaggactttgaaaccatactgactttaggccgatgaagattccaaatactttagaccgatgacgattccggagcttgtcaaattttaccgttacaagtaaatcagaggatactcttccgagcatcagcatagccacggcgttaaagcccggacctgttgtcgcgtacccacgacctgctgagtcccacagcgcccgcgccgccgatcgacgtgcgttcgctgcgctgaaccatatcgcgagcccaggggagaggagaactaacgctagctgcacacacacatggcacacggcagtacggcacaccgcacaagggcacctatagctagctgtgcttcttgggcacccgtccgaacattcagccaaccaaaacatactgcgccccggcggtatatttgtaaacaaaaaataatttatgaataaaaactgaaaaataaacttcgatagaaaaacttcaaaatcaactttaaatttaaggctaaaaatttaaattttagctgataaatataaacataagtaaaaaagatgaggctgctactccctccatttcatattaccggtctttctagaatttaaaattttgtatcaaaatatttgctctcacattccgaaacactttcttnnnctgtgtactcttctaatgcagtcatacattaaagtactgtgataacttctattatatatattatatacttagaaaaataattgagatattttcttttaagatagaatggatataaacccggctgaagctacagtgatttttacgaggaaagataaggttacatgtattaattacaatcttcttctacaagtagctccaaaaaatgtatcaccgcagcaaacggtggatgaaatctccttcaatgtgagagccaatatatcttgaccggttttcagtagtgaatacaaattgtgaatacaataccggttttcagtataattcacggctgaacaaattgtgaatacaatccgtttccaaaaatattgatgaagccaacaccggcatttttacccatattttctcgcgcgcaagtggagatgttggcctagtttagctttttatgagattggattagcgcgataggagatgggaggacgattgtgtctttaaaggactccctccatttcaaaatataaagaaaaacctaaaactagattcagatatataatattaggtgatgtcatatcttangttggtacactactacacaaagagttataggtgccggttcgtaaagggccatagatgcggattttcatccggcgccaattggtcggtaccaatacaaacaattgacacctatgaggaaaatagaactagcacctttagttttgctcgagccaaaaaaacagagagcccgctcgaatcgagccgaaatcaccaagcgtcgttacctcgccatgcgcccatgcgagttactccaaaatcaaattgaaatcccaaaatccccaaatcatccacaaatcatcaccaaaatcgattgacatcacataatgaacatactcaacaacaaaatcatccacaaattcacaaaaacatttacaaagaatccacaattgagactggggagaggaggagaggggatgacaaggggctggccaccgggcttcttcatgctccaccttctacttcgtcgccggtggggagaggagggcgttgccgtcgcctgccgcctgtcgtccgccacctcctctcttgcgccaccgcatgccgcctcccctcctgccagatccggcaaaggggaaggcgcagacgccgccgctgccgtcgccgaggtgcgccgcctcccctcctgctagatatggcagaggagagggtgctggcgccgccgcccccatcaccggaggccgctgcggcctcccatcccgccgcctcccctctcgctagatctggcggaggggaggtcgcagccgccgctgcgcgtgacaaagagaagtgagagaggcaagagagatagcgataatgccgatgctcactcattcgtatggataaggtcgacgacagatctgctcaacaaatctataattatttgtagatgtcgattttaattaactaacatttataatatattattataaagatgtcgggttttctaaaaaaaatcaatatctatagtataggtgacggtttttctttagaattaacccctaaagttaattaaaggtaccggttttatgtattttcaatccacggaagagagggaaaaatattataggtgatggttttagctgtttcgataactatagtcacaatcgctaacatgatgtcctcgtggttgtgccaagcatgtccttttcgtaccttgcgtggacgagttgaattcctctataaatgtgaccaaataaacctgaaccgagaccgttaatttgcttccttggtctttcgttgactctagtatagcttatcatcccagaagttttcctttgatcgaaagtggccgcccaggcatctggggagtcaaaataccacatgtgatcagtaaatgcacacgtacgtacgtggacaaatttctaatatggtaccgtaggctggtagcatcgtccatggtttaaacatgtactcccccgacctaaaatatacttcctcttttctaaaatgttgctagctaagttgttgtccagattcgttgtcataggataagtcaaatatcccattctagctagatagcaatattttagagcggagaaagtaagaaattaatttgtgtggatgtgacatatcctatgactatgaatctagatatgtcacgtccacctaaaatctcttatattttgagacggagagagtacaatattattgattactcc

SEQ ID NO: 61764 - DNA, 2300 bp, Oryza sativa
tttcaatttttttccatgtacgagaatagtcgttggagatgttatagtaattaattaagattagttgttattgattagtaactattaggagataactacacgttgggtacttgatccggagtgggaaaattgggcccccacgtcatgctgatgtcatcatgcaaaaactactttaaattattttttctcttaaattatttatccaaatcatgattcgattgtaacattaaattcgttgcaattaaatctttgaaacaagaccacatatagatatattctgacgaaattttttttttgcttattattgaattatttttaaatgttgcacgttgttctaccaagtatatcggaattgtttcactaagtggatcgaaaatgtttcaatcgtttaaatcggacgctgtttcaccttatataaaaacaatgtttcagcaaatagcgaaagaatatttcagttcactacaacatttgatccatatgtagtgaaacattataagtacactaggtgaaacatttttggtgaaacaaaaaaatgaaacgaattcctttaatagagggtttccaaaatatatgggtgatttgttgcaacggagtatgtgtgtggagacacgtggcaggtgggcagggagacgtggtggggccagggggcacgtgcgtctcgtgaggggagcacccgattttactcccccgccggtcgccagcccataaagaatttcgtactctctctgtttcatattgtaaaactgtctagtattgctcatatttatttagaagttatgcctaaatttttattaacatctatataaatataggtaatgctaaaaagtcttacattgtgaaacagagaaagtaattattaggtactccagttccgtataagacttacctggccttcttgaaaggcagcattataagtaactgtagccgcagaaatttcgtacttgaccgaacgaaagccgtagaatttaatcccaagtataataacaaatccgagcgctggcgcctataaaaggtggctcgctcattataccatccacggtcagtctcgcccatcttaattagcttgttgcataggccggcctgcttcaatcaaggtagaaacaagtgtaactctctctctcccccccccccccccttctctctcctctctctctcacattttatacctgacacacattctagttcggtaatactactacgggaagtgtatgctaaccatcaagccatgtacgtaggctgttaatattttgattttaggcaggaacgtttttattgacaggactgaaaatatatacagaatcagatcggagaatgatgcatgattctatcaaatttaaaataatgcatagtctctttgattattgaaatactctcgccattccaaaatgtataacgctgttgacttttcacataacatttgacaattcgcattattcaaaaaaattatataaatatcatttattttattatgacttgttttatcatcaaagaaattataatcttaacttatacttttagatgtttatattaaattctttaaataaaacgaagggtcaaatattatgagaaaagtcaaccgcgtcatatatatatatatatatatatatatatatagggatggaactgcagtatgttcttataaatggaaatctatatatattattgatttttaaaactctatgtaaagttaataaattttagtaataaattccatcatttaaaagggcacattcatgaataattgaattatgacattcatttgtatataacgtggataataaagtaattaatcatagatattaacatactcatctgaaatgttaataaagaagtccttaagaaaatacctgaaggtaccaagattttacactaaaaattttggtacctcaaggtatataacaaatacttgaaggtaccaaattttataaaatgtgatacttccggtactttttcaataatggcccgttaatataggtgttgtcagatcataatccattgagaatccatgcctttgtacttgaccctacattattaagaacacacaattctatgacattttggtcagcacgatccatgtcatgctagctccctgtaacaataagatcctaacatacgtcttggaatatcctatcaacctttcttgcataggctagcagtacatttctttcaactacttaaccatcacttgtttccatttagaaatagataataacctataggcaaacatgaatttagctccattgtattttcttgactctttctaacaaaggaatatagatcataaagataatgcaagtatg

SEQ ID NO: 61765 - DNA, 10504 bp, Oryza sativa
attctggagcccattggcctggttttgacacccatttcttcgtcgccattcctgccatccttcaaagaagttatcacgaccgtctgggactgacttgtgttgtcatggacattgtgggaaatgtgggtaggagtaatcgttcttgtatgttggtattttctgtaaagggcaaacacatttaatcttgttctctgttgactgttaagtagcgctccatccaactggagatgtgatggcgatctcatgtcatgatgatgtagtttagtagccatggaatgaaatgaaatgaagctgagccggttataatagttgtatatctccatctctttcttgacttgcatcatgctgtctgctatgttacagatggctctgtctgctacattacaaaacgagactacgtttgcttgcattgtgtgaccaaaattattattcttgtacttatcatctaataataacgagctggcccttaacggcagaggcatttgtatgcatacatatacatggactaatatagacatgctgcttccttcgtcttaccaaggaagtaggaaacataaaaggaagaaatgactcaggtggtatttggttggggggactaaagtggggctaaactttagtccctctcacaaaaacataagtccctaccatagggatttgtacttttgtgagaggcactaaatttagttcctagtttccaaacactcccttaggattgatatgtaaaaaccaaatccattacagaaagtagcaggtcttgaacataacatattagccattaggcaggtaaatcatccagcagaatatcactgataaaaaaaaattaagcggctcgtgaatcgcccaatctctgcagcttgtttcatctctttccccctggcagcctacgtgatttcttcttcttttttcttttcttattagactccatggcgccagttcttaccagagttcctgtctcacctacatcaaacacacaacagaaagggttacaccttttcttgctccctaataactagggcaacatagggggtgtttagatccataggtgtaaagttttagcgtgacatatcgaatatacggatacatatttaaagtattaaaagtagatgaatttattaagcctaatcaatctgccattagcaaatgtttactgtagcaccacattgttaaatcatgaagcaattaggtttaaaatattcgtctcacgatttacacacaatctgtgtaattagtaattttatgtgtctaaacattcgatatgacaaggtgaaaaattttacgaggggatctaaacaagcccatacagtaccggatcattaaacagaaactagtacattctgacagtaatagaattatctttttacctagaaaaaaaataccgttcgtatgcttttcaaatactgtttcacttcaggttacttttggtcagcatctactaattacataaagcctagaggaaactgttaatcctaggggtgctccctgaaaaacagtcatggatgaactctctcccctccccccacccccaaaaaaaaaaaaaacaagagtcatgaatcaaagtttgtaacatgtcaacttctaacagtagtcaaaatgaacccttctccaaatgaacaagtcatgaactattgaacttaactcgagtataataaatacagcaataccccatcaacacaggtcaactagaaattacctgtagcgttgatgagatatttggagatctcactggtaatgtagtagcgcatgaagctggaattcttcctgtgatcaagctcagtcacaccttgcagtgtcttatccctcagatcaacagaaataacccatctcttatcatcactgtagccgatcttggacaggaaagagatgacattgccatccatgcccaatgtggggtgacctgtgagcaacctcctcaatgtttcctctggatcattgcagatctttggcagcagctcactgtacctgacattgtcgacgacggcgatgtcggttacatccaccgtgcactccctgtgccaatccttccatgaaccagccggtatcggcctgctccatatgttggccttccagtagtaagcaacatcctcgtctgagccgtcagaagaatccgagtcatcagaattatgttcaatcaaccgtcgtcgccgccgaggtggtggatcaccggggcgtgtcaccatctcgacgtacttgatgcaggagggagcagagtcctgcacgacgacggtgatgtcacggtaaccatgtgggtagcctctgcagaaggatttccggttcctcctcgccggcttgggcagcggcaggtcgcggagcacggggtgttcgtcgagcacgtcgtcgcagagcaggattcccctccagagatccacccagccgacggccatggcgtggtcaccgccggcgagcgtgatgaccttggtggtgtagtggaagagcacctcggtggcagtgtccgggatggggagcaccctgtccctctcggccggctcgtcgacggacaccgccgtggaggtccagcggccgacgtcggagtcgaagcgctgaagcttgaactccatggggcacctgatggtgggcatgaggccggcgatgacgtagcgtgcgccgcccgagcagcggacgatggcgaccgcgtcgctgctgaagggggaggcgtgcgggttgggcagcagccggagcgacgggcgggggctggccgtgtagacgaagtagtcgtaggatctgatgccgcggtagagctcgtcgttggggtgcgggacgaggaggagggctacgtcggcgtgcgtgctgatgactcggggatcgacggtgaaccggtaggcctcgccgtggccggcgccggggcgggggcagtggacgcagaggtaggagaggcgcggcgggcgggcgaggcagaaggagacgtggatgcgtacgccggtggtggtggtggagacggcggtggtggcgttggagacggcgtcgggggagacgtaggcactcgcgtcgaggtacacccagcttggggttgggctcacgccgccgccatcatcgtcgtcggccgggagcggaggcgaaaacagcaatggcaggaggagatcgtcatccaaggggatgggctcatcatcatccatggcgaatcacggagacgatccgatcggagatcgacgaacgcctctttggattggattgcgcccaccccacacgcattccgagctcccgcctatctcgctcgctaattgcgatcagggtgaaatttcggaccgaatttcttacgatattacttcgaccgaattttttcatgaattttggtagtatttgttcaaattcaactaaattttgttcaaaatttcggaccgaaatttcggtgaggcccaatcaaatccaacgccggcacgcgggtgcctccctccctacagcagccggagctccgccgccgttcctcgccagccgacggatagtcctccagccagggttttcccttcgggaaacaagaaaatttcggtgggcaccgaaattccgaaatttcggacaaattctgatatttcgaacgaaattttttgaagaaaaaaaattctgatttcgaatgaaatcttgcttttgaagaaaacccaaaagcaagagagttcattacaaaacgaaaggtaaaacacgaactctaacgatggggtcgccagcttgacattttattacagtataataaccgaagaaaattcctgagcatccatttcaggccaatcatcaggggaagatagcagtttaacttgggataaacagacgaaaaccaaatccattacagaaagtagcatgtcttgcacagaacaactctgataatagctcattacagaaagtagctcatgaatcgcccagtctctgcagctcgtttcatttcttcaacccaggtagcctacgtgattcattaattaattcctacttcttcttttttgagactctactattaaccccagtttttacaagagttcctgcctcacctgcatcaaacacacaacatacacagagagggtttaagtggcacttcaaaaacaaatcctaggagtgcactctgaaaaacacactcatgaatcaagtttctaacctgacaacttgtaaacagtagtcaaaatgaagaaggttatgaactatccattagattatttgactattatggtgcaacagttataaaacaaacctgtagccttgataagatatttggagatctcactggtgttgtagtagcgcttgaagaggaaattcttcctctcatcaagctcagccacgccttgcagcgtcttactcctcagatcaacagagataacccatcccttatcatccaagcgattgatcttggacaggaaagaaatgacatccccatccatacccaatgtggggaaacctgtgaccagcctcctcaatgtctcctctggatcattgccaatctttggcagcagctcactgaacctgacattgtcgacggcgatgtcagtgacatccaccgtgcactccatctgccaatcctcccatgaaccaactggtatcggcatgctccatatgttagccttccagtagtaagcaacgtcctcttcctcatcagagtcagagtcatcagaatgttgcggcggctgtcgttgtcgaggaggtggccgatcaccggggcgggtcaccatctcaacgtacttgatgcaggtgggaacagagtcctgcacgacaacggtgatgtcccggtaatgatgcggcggccctctgcagaaggatttgcggttgcttctcgctggcttgggcagtggcacgtcgcggagcaccaggtgttggtcaagcacgtcgtcacacagcaggatccctctccagagatccacccagccgatggtgccgccgagcgtgatgaccttggtggtgcagtggaagaccatctggctggccgtgtcagggatggggagcaccctgtccctctcgaccggctcactgatggacacagctgtggatttccagcggccgacgtcggagtcgaagcgcataaccttgaactccatggggcgcctgatggttggcatgaggcaggcgatgacgtagcgggcgccgccggagcagcggacgatggcgacctcctcgttgcggaagggggagacccgcgggttcggcagcagccggagcaaggaggcgcccgggcctgggcgggccgtgtagacgaagtagtcgtaggatttgattccgcggtggagcccgtcgttggggtgcgggacgcggaggagggctacatcggtgtgcgtgccgaggactcggggatcgacagtgaaccggtaggcgccctcgccgtcgccggggcgggggcagtggacgcagaggtaggagaggcgcggcgggcgggcgaggcagaaggagacatggatgcttacgccggtggtggtggtggagaaggcggtggtggagttggagacggcatcgggggagacgtaagctctgtcttcgaggtacacccagcttgggctcacgccggcggtggcgtcgtcgtcggccggcagcggcggcggaaacagcaagggtagtagcacaccctcatccatgacgtaggggacgggctcatcaccatcatccatggcgaaggcggcgagggatccggtcgaatcgaatcctaatcagcgatgaggaggaggaggagctaaccctaaatcggagttgtgccccaagacgaggaagaatggggaatttgaggtttccttttttttttttttctctctttcccccctcacccgcctcgggaaagacgggagttggattttcacctaatctgaaccgttgtgtctttttctacgcataggattaagccacgtctctcttcttgttccttgatctgtctccagggagaaaatggatatttagccattctcaaaacactggaatgctattctgaaaccgcgattgttaaaatgccaatatggaccgcacaaccatagccacttttccattttctttattttcgatttcattttcgttggggcagagcttgatgagacgattttgcccctctccccactctcttctcctctgctcgaatcggagggaagagaagaggtcgccgcgcagcgatgccgttctgcagcttctacgcctccacctccctccagcttcgacgaggaggaagaaacggtagggccccacatgttcggctggtgcccggtgaggtcacgacctcgccaccgcctgcgcgaggcgctggaccttcgcggcgatccctggcggctgcggccgctcacggccaccgcatggttcccaacgatcctgccggcacttgtgctccgccgtggtggcaccgtcgtttcctcctcgcaaatcagtccccatctccctttgctcttccttatttttttttcaatatccacatcacctcgcatggttattgctctcttgtttgattggtgtttcttttgtctcattcaaagaagcattcatgttggggatcgatatgaacggttgtgcttgctttctctgtccctgagatggatacacgcttgtactagtttgcaaatcttgatggtgccggaggagtatgtcggtgtcttgcaggtgtttggggtgaatcctgtcaggatgcatgcggtagtgtgcagtaggtccttgtggaggagccggcgacccgacgaggcatgggacagcgaggcggtgggacgtggtcgtcggcgagcagaccagcgggtaggcgtcactgtaacgccctgaaaatcgccctaaatttaaatcgtgctttaatgcatttctagaaattttaaaagcctaaaagagcctccaacaattaaaattcaccaagatttatgtcaaattggcttgtgggtatttttaataaattccccatgcttaaaaatgtttaaccaatttttacttgaattttcagagcatcctaaataattttaaggcaacaaaaacaattaaagaattttacaaaaaggaaaagctaaaagaaatcatcttcctcctgttgggctgtttgcagcccatctctctccccctcctctcagcccagcccagccgccccctcaccctccctctctccccttccactgcctctccttgggctggctcaactgctccctatattcctggacaaaagtctgcttcacctcccctgcgcgcccagcctgacaggcgtgctcctactcgatgacaggtgggtcccactcgtcatccctaacctccagccatcctctctctctccggccgaattccaagcgacggcaacctccgattcgcctcctccactcgccgtttcatcaaattaattgaggggaattaattcccacctcatcctctccaattcccccataatttcccactcaatcccacattattcgtggtggattttgatgatgctcatcaatggtgagctccaccatgccccgcgtcgatctccctccccggcgcctctctccctcccctccggcctataaaagggacccccgactccctcctctctcccctcacaccgctgccctctccctcctctctccgcggccgccgcgccgctctcttcttgtgccgccgccgtcgcaactccggccgcccctcgccggtggtcgggacctcgtcggagcccggcgtcgccaccatccgcttcgtcgcttcctcctcttccccgtccacccctccgtcgagtacaaggaccgcgggaacgacgccgacgccgacgacccgaagcttctcgtcgtttcttcctcaccgccggcaacaccgtcgacctctcgccgccgtgtctgctcggtgagaaccgtcgtctcctcccctttccgtttttcccctttccgctctccgtcgcactgccgccgcgccgttggccgtcgccggcgagccgcctggccgggtgctgctcctgcccggccgtgtctgtgcctcggtgcaccgtgagccacctcggtgctctcggctcacagtggaccgagcggctgccaagtgggacccgcccgtggacccctctctctcttctctgtgcaataaatcaatttcctttagaaaaataattcacaaaattgcaaatttccatttaaacaacacctaaacttcaaatggccatatcttgaccgtttgaactcggaatcgacccgttcaaatctctaatttctcctaaaaatgagtagaatccatttatgtgctttattgcttctgttcatatggtttttattagtccttttgtatttcttcgcgttggtcgtgtagatcctgccgttccggaagatcagctcttcatcgccgttgacgccgaagactttgtgagcgatcaaggcaagtcatatctaccttgaacatgttgaatcccatattgtgaaaattatgttgttttacttatattgcattgctttataaattataccgttcattattaatattgttttattagttattcctatgctcttggttatggccatgatgttgatttgatatccatgatctttgtgaaccctagtaaaattataacttgactagtctagtaccctacatgatggactgactagttgctttaggtaaatgcttagtcatgcttagttccaacctagaacttttggttaaactagactttggtggttaacaactaaaattggattagttatggactattgactggtttgtcaatagatgggtgataaaatgatttgtgcaactaaaatatattttttttgggctgggcttggggtgcaagctagttactttggtagtcgcaccccggctaatataaggaccggtcttcgggcctctgttgcaaggcatcttcgtgcaaccacaagtctagtgggtaaggcctgactggaaatttagatcttctcaaaacagagaccattggttggaagggtgtggggccaggattaaggccgtttttcacccggcgcaagggggggcctgactcgtcccgggggatccgacaacctttaccttgtcggggaccggcgggcggcgaaacctcagcgggttctcctgttttgggtagacctagatggatagtcttgtcacgacctctatccgagtaccgtggtggtacccggcgcgtggcaacgcgtgttgaggttgtgtcttgtgggtaaagttgtacacctctgatcagagttaaaaactattcgaatagccgcgccctcggttatgggcaagctgagcaatgtacccaaagttagttttgttttataaaacattggagggtgaaatcatgatggtgtagtcatgtggagattagcctgggttaaggcaggttcgcaggctcatgcgaccttgatgatattaaaatattggcttagaacaggatcgtgttttaaaatgagctttaacttgattaaaatgtttaaattatggctttatgcaaaataaaccctattaggccatttccttgttttccctacgcattattgttgcatttccggtgtgacttgctgagtacggtggtggtactcactcttgctcacaaaaataatccagaggatggacctgaggaaggtgaaggcttggatctctagttcgctccgccgtcgagtgcctgtggctgctgctgttccgtagtcttccgctgttttatttgtttatctttgagtgtgagggcctaagtcgcccatgtaatcaagtactcctttacgtttccgcaagtgtggcatgtaataatcaacaatgtctatgtgtacctcgcctcctgggacgaggattaatgcactgagcgtttggaaatggtgtatatttccgggcgtgacagtcacgaaacatgcgtgccgctgctcaccggctcgctgcctccatcccgcgccccaagtgagtccgagcaggcgagcaccggtccgtttttaggaacagcgcacgtcggcgtcggctgggggtgcctcctcgccgtcgaacagtcgaggatggggtcctgaagacagagagcacggccgtcgtgaaagcctaggcggcagaggtagaggagcgccgagcggagctggtcgcggacgctgcaggcgagggtctgggggcatttgacgacgacgcggcgttaggtggtgtccgggacggcgaggtcgtcggtgaggaaggcgaagaccgggcggaggtcggcgcggacgctggcggtaaagaaccgccaggagctccgtcgggatgtctctgtcgctgtggtgacgaagcagcagcaactgggtgagcaggggtaatttggtctcatcaagccacattgcagcaaatatggaattgaaaatggcaaaatggctgtgatcacgcgcttcatattggcattttaacgaaacacgcttttgagatgtcattcctctcctcttgaagccaactcccacaagcacatgatctgagtgagtcttgtgcatacgaaaaaaaaaaaactttttccacctgcaccaagcaccatatcgattgaaccacgggtaaaaatgctccctgctcctatattccatatatttaaatcctaatttcagctatttttaaattgtatttatatatagactatgtatttttaaatctgaatttcagctacggggaagaagaaatgccttccacacgatgtggcgatgaacggactggc

SEQ ID NO: 61766 - DNA, 1213 bp, Oryza sativa
aatgagagtccaagtaggaatccaaattaaaaatagctgaaattcggaattaaaaatacaaatattaaaagaagagtccatgtaagaacccaatacaagattaattaaaattcagaataaaaataaaaataaatctgaaattagaaaaagaaaataaaagaagagttcaagtaggaatacaataaagagtaggccgcggacgggctatagagaggcataatggcatcgtttaatgggacttctaaaaattataaaaaatgaaactacaagtctaatttttaaaggtttggaacttctaaaaagtaaaaaaaaaagcaatgataatcatgttcgatattaaaatctcaatgacaataaagaagggaggcagcgggcgagctatagaggagtacaatggcaaagccgctaacggtttggcaggacttctagagagtaaaaatgaacccagacaataattatgttcgatttttaaaatctcaatgacaataaagagaaagacagtggatggaccatagaggagtataatggcaacgtttgacgggaaatctagaaattataaaaacgaaacccaacgtgacaataaactctacaaactataaaaatccaattttaaaagatttcaagaagaataagtagaaatagtggtagatcgagcaagcaaatgaagaaggagatgacataaaggatagcaactggtgtgacttaaaactatataattaaaaacacgaggatgataaggtttggtctttcaaagtcttaagacaatgagatagctatttaataaattttaagtaaaattatacttaaaaaatatgattttgtttgacacaaaataaaataaaatccgaaattagaaaagaaaaggagagtccaagtaggattacaatttaaaaattactgaaattcggaattaaaaataaggaatattgagagaagagtccatataagaacccgatacgagattaattaatattcggaataaaaataaaaataaaatccgaaactagcaaaaagataagaagagttcaagtaggaatacaatttaaaattaactgaaattcggaattaaaaaaataaaaaaatatccaaaattagaaaaatcaaagagagtttaagtagagatgtaattttgaaacaactgaaattcaaaaataaaaaataaatttaaaagaacactatactgtattaattaaaatttgaaaaaaataaattc

SEQ ID NO: 61767 - DNA, 2252 bp, Oryza sativa
acacagttagtctttactcaaaagacaaggcgcataagacttccttttctcttttctatctcatgtagagagcaaaccttccagctgggggcagggcatcaatatgaatctttggggggtcatttgatatttctctccattgatcatcaagttcatattcggtgatgaatcttcctatagcacttcgcaagaagcccacgaccctgttcagaatgaacgcacagttacaacatttgcaaaagataaagatctgtctatacaacatacgccataaatttgaggtataaacttaactacacaatccaaaataatctgataaattccaaccacagtatttggcagaatacatgttactgagattagtaagaacattttgaccacaattggatttcctaagaagcataggaaattattcatacactttcagttgacattaaaagaaagttacactctctagtcattcatatattctcctgtcttcagtctgctctctattaactacttttgcttctgacttccacatgcatgctctctctatataattgtgtcaccataaattaacaaattcgaaaggtaatggcaggaatttgtaaagcgattcatcaatattttcagctgatataacatttggaaaaaggcaatgtaaataagtagcaagtcgcacctcgcatatgagttggatatttttgtacccaggtttgcatattgtccttggaagtgcccatagtagacacaaaaagttttgctgttctgatagaccatactctttagttccccagcatagaaaggcccttctctgtgctctactgtgaagctgcatgagactataatgtcaaaaaacaaatttatacatccttcaaaaaaattataatatgactagaaaaagtgcccgtgcagaccccacatgatcatgaaaaactatcacgaagatcatgaagttgaaaaatatcatcgtatatgtcattaacatgtgggtccagaccccacatgatcattctcgtatacgatagtatttcacaactcacttatatttatgatggcattttatgaattttctattgtatgaaatcattgggatttaatttagacatatttgcattattgcagggagcaatcctgacatgtactcataaacatgtccatatttgtatcagagagcttaattggatgtgcatgtgtaggatgctctcctacggtagtttccctaaaagaaatggatttacatgcatatgcatatggagccatggagacgagcagactacataaatagccaattagcagaagagcattgaggcgatgatacacccagcatacatcttcttttctcaatggaaggcccaaaaaatatctcaaaccagtctttaaaaaagagagcccgattcagttctctgctttaagcccatcccaaaactcctattatgattactggattttacgtaggatcttcacttatgtgcacacatgtgtcggaagaagaaacatagtaggacagctatgtcgttcgtaataagaacttgatctgatgaaacacatcttcaatttttataaatcacattgggctagtcttatgctctctaggatacatcaatccaagaaatagttgataccttcgaaggaactgaaggaagttgtagccaactgtttcatcttctcttttgttcaccactgcagctgcataacttcgagggcttggtgtctgttgggactgggaggcctgctgctgccgctggccgtgttgggctgcctcgacgacgtcagtgggcgaggccaacgttcccgagcgctgcggctcgaccgcggtccccacctccgcctccgcctccacctccgcctcctcctcgacgcggacggcgggcgagctgtcgcccgacccgacattggcctctccgcggtcgtcggtcttcttccgaggcttccccttcccacccttgttcttcttcttcctaccaccatgatgaggcatctttagtagcctagcggggatgcttcgctctgcgatccgcggtggggcaagccgaggcagcggcgggaggtgcgcccgcgacgtgctcgacggaatgcgcacaagagggtgggagggcaggagggggagcaggtgggagggcaatgggtaaagtaaaaaacccctcggcctcatccgcactgaggccggcgtgggttcttatatacttcggatagacgtgttgaaccacaagctactagtagtactaaagttgaaccacaagctaggagtaccgtgtatataggagtat

SEQ ID NO: 61768 - DNA, 9946 bp, Oryza sativa
ttgccgtttcacggagtgcctgaagcttcatgtttccttttttaccctctttctttttcccaatgtatcaactgaatgcataattctgaaaataacgttggaaccgcgatgtaactaaagttccactcatgtacactgcaaatgaaaaatcaaatacatggaggggaaatgtttcaaaggcctgtctgctgttaatcatcccatgcatgcaattttcttatattaaaagagaataatgtgacattttctgggacttacacgcacaaatagctgttcaatccgcacgcttcttgactagcgtcacatgcacaaaaagcaaatcactttttccccccaaaaaaaaagtgctgatcaatgttgagatgcataattttcatcatcagaaattaaaaggagtggtccttagatttgccctgccgtttgcaaacacggtgtccttctcctactcgcaagttcagatatattttaaagggatatgttacagatcttcaggaactacagatcacattcaccagccaacaacaagcaatgcaagactaacctaattgagtcatcacatgaatgaaaagattgggtttttttttcctgaagcttttgaggtgtcacagcatgttttccctgcataaaggtgtccctaagtgtgtaatttagggatgtgaggagttgtgtgtttgaccacaaggttaaataaatgcatatcctgcatctccagctaggtagttacagatgcaagacagaaaaggttgccaaatgttatgccaagagagacaaaatatgaaagctagatcaattgttgcgtatgtacctatactgtagtttaaactttcctagatctatgaagctaagggtgcaagcaaccagcttggtacaactgaaacatgaatccaattaattacaccaagaaagcacacataatttgattgacataaaggtatatgtagctaaagtgacctacatggcataaccaccttgacaggctaaccatttcagacagaacatagaatgaccagattagcatcagcatgacagatgagatggtggctgtcagggtcatgcattgcaatggcagggcacaagaaacatcagtgtgaaggcaaaggcagcagacagacatgctatgcgtgtataacagtatatgtaaccaccaaggattgagatactttactggtcagaattcagtaatggatggtgagtgaggaagctgtttatgcagtggattgctgtcctgtctccatggaagcctgcagggtgtccccatggaccatggtgcacatgtggaatgagcacaaaatgttgaaggatagtactcaatctgggttactactgatattctgtgtttgcatatgtttgtgcttgatctctgatttgtttgtttgtttcagtttccataatatgcagagcatgtcattgcatttaaatatagaaacatagattgagtaaatttatatttaccttcaaatgcaattttacaatggatttacctcaagctagtactatatacaagatggcagaggtaattaggaggataatcctgcaaaaatccatgtaggtgcaggtcttaaaaaagagagatgctgtacctgtgatgtctgtccttgaggaagatgagttgacaccatgtttgatgctctgtactccttggcagtgttctcttctcactgtgtttgtccccatggttcattcaaccactcttatgatgaacaggggcaactaaagctcaccttgatcagtacccttaaaagcatcctgtttggtgagatttcagtcatgattcatgaacatggactctacttgaacctgaaagatcggagtatcagtttctgtatgtggagatggcacaaaattgcaggcagtttactgagctgagatgacttagcctagcttagcagattcagagagttcagtctcttagctctattctgataaagcgtaaaaatatgaacgaagcaacggaaaaataatttatggataaaacttttatatccggattatttatgattttaaaagccaatgttaaaagtagaccactaaaaaggacccccaaaattaactatacaattattaagtttcgaaattcaagaggtttttcagacttttgagctgtggtagacggtagacagcaaagctgggtcaggtacagtattgtactgtactgatgatcaggttgtgatctccaactccagcagctagagagacaagaagacgacagaaaagtacacgagctcaactccatttgcagcagcagcagcagcagaagcacagctcaccacctgtctttttccgatccaatcgccgctataaattcagcagccaatgctgcccgccatgtgcagcagaactcactcacagtctcagtctcagtctcactgcttcagctcagctctcctctcgtagctcgacgagctagctagcccagctacgacaatcatgggggacgcggcggcgggcgggaggaaggcggcggcgtccggcggcggcgcgcggctgcacgtggcgatgctggcgctgcagctcgggtacgccgggttccacgtggtgtcgcggctggcgctggacatgggcgtcagcaagctcgtcttccccgtctaccgcaacctcatcgccctcttcctcctcgcccccttcgcctacttcctcgagaagtaattaatcgatgcctaatgccgctaatcctgaattcctgatacgaatgatgaactagttaatcaatcaatcaatcatggatgcttgcaggaaggagaggccggccatgacggcgagcttggcggtgcagttcttcttcctggcgctgtgcgggatcaccgccaaccagggcttctacctgctggggctcgagaacacctcgccgacgttcgcctccgccatccagaactccgtcccggccatcaccttcgccatggccgccgcgctccgcatcgagcgcgtccgcctctcctcccgcgacggcctcgccaaggtcgccggcacgctgctctgcgtcgccggcgcctccgtcatcacgctcttcaagggccccgccatcttcaacacccaccacaaccaccagccgcaaccgcaacagctcgccgtcgccgtcgccgccggcaacaagagctggacgctggggtgcgtgttcctgctggggcactgcgtgtcgtggtcggggtggctggtgctgcaggcgccggtgctgaagcgctacccggcgaggctgtcggtgacgtcatacacctgcttcttcggcctcatccagttcctcgccatcgccgcgttcctggagcgcgacgccgccgcctgggccgtccgctccggctccgagctcttcaccatcctctacgccggattcgtcgcctcgggcgtcgccttcgccgtgcagacgtggtgcatccaccgcggcggccccgtgttcgtggccgtctaccagcccgtgcaaaccctcctcgtcgccgtcatggcttccctcctcctcggcgagcaattccacctcggagggtataccgattaatctctcttgattaagattttttttatttttttagactttttatttttttaattttattaatagacctttctaaaaaaattccaaatctaaacttttcgactacgccgcccaaataaatttgtcacgccaagtacagctagcgtggcagcgttgtcctgccatgtcagtttggcgtggcaaaataacgctgccacgcctggttaagaggtttagttttcggaatttttttaaaaaagatctattaatagaatttaaaaaaattaaaaagtctaaaaaataaataaaaaaatccaggatccaagaactagtaaatgattagtgctaattggatggttaatctgttcatgcaggatcattggggcggtgctgatagtggcagggctgtacctggtgctgtgggggaagagccaggagagagccattgctgctgcaaaagaagcttctgctgctgccgccattgctgaccaccagcagcaaccagcttctgctgctgctgctgattcttgcctgaagcaaccactcctgccggcgtcgacggtggcctcagagaatgtgtgaccgaccaaccatttttttttttttgttgatgcagatgcatgctggcactacatgtggttaggctaattatgtatgattcattaatcaattaaatcaacttaatttccctgttcaagtacttgcaagttgcaacaacctgcagtatgttaaaagaatcaaagtcgttgtgctattactgtgctatacaacagtttgtccagaggatttttacagtccaacgggtaaaccttgcggtatcgaatcttgactgttggatccggacaaatctccaatggccacatggccacagagattggtatcgcggggtaccagttttgtccctgatgtggtaccgtgtgatgattgtaggtggaagggcagtaatgtaattttgcgtgccaatgcaagactgaacataaaccctagaatgagctttgcctctcccaccgccgctgtcctctaccgcggcgccgctggaattgttcctctcccgcgtcactgtcgttcccttgttcctctcccacgccgccagacgcggtggagaagtaggccaggggcggtaaggcatcggctccgacgatgtgcggtgaggcggacgagggagctgtgtatgagcacgaaagggaattgcgtgccctcccgcgcctcggcacacaagctctacacattctttttccctatactaccccttcggaaatggacggctagatctgttttggtacctacaggtacaacttgttggactataacaacgttatctcccccttcgaatacaaaagaactccccctttaaactttctatttccagttgtgaaagatgcattctaagttcgactactaaatctctcaccttctgcttggattgaatgaagagttggaaatatttggcttttctatcttaattacaacacattgatggctagcttcttatagccatcctaacttttttgtacggtacccttaacataggcatcattgggacttaagaatttttggaaaacttttatgcatgggaatttaactaatttctatgaaaataacataagatatatacgttccaaaagagcccagcttagagcaatattgatgcaacagagcaccgactgacagatgtagctcaactgttcctccaaatcgaatgtccaagcatatctcttccactctttttttttaattaccatatatccggaaagttctctgtggagtgtgtatgtataatatatcttggaacttgcaactaggcaattcttgacacacttactttcaaaattaattcagatacacctgaactacaggaagagaaatagtactaacacatatagcaaccatgtctgacgaaactgaataatacataatcaggttggagcaacaaaagataaaccccatgcatccacacaaatcagagaatatatatatttttgaagtgtatcagagaatatattaaacaaaagcagaaaaggcacaaggtacttatattcatatatctttttttttcaaaaaaggagaagcactagctaaccaatggtgttccactaaaaataaagcacgatcgagagagaggagcaggagagcatggggggaaaagcaaatcatttttctgatgttaataaaaaaaggagtcgagtggagtgaactgtgaagcatttgtggtgaggatatccatggaagatgccagtggcagctatagctgctgcctcgccaccgtttcattcctcgagtttatccccctgggtcgagccgcctcgccacaatcctttctttctctataaattcatcatgccatggctgctaatgctgcagaatggagctgagaagtaaattcagatcagattcagagagagcatgcagctgattgcaatgtagcttcttccatcagggggtgtgtactgctgattcctcatgcgtcgtcggagatcgagaggtgatgcatgctgcgaacggcgagcggcggcggcggcgacaggaggtcggcggcgagctccggcgtgctggctggcatccggcgatcgacgacggcgaccgagggagggaggaagctatagctaggatggtcatcatgtgattaattcagtgatgtgtcctaattaagtagcttcttgcttgctagcagggcaatttcaatcctttggcatctgtaacctttttctttctttctgaagtaaaccttaataacccagctatgttctcttatgatgttctgagcaaatacaacaaattaggcatacagattcagatacaatagcacttgagtttgtatctagtcgtttgtcaagagccaagacacatttcttgagctatttgttctccagctatcatgcaataaaaaggtactatgatcctatcattttcaaacttatgcttacacttataagtaaaaatttgtattttaaaattaatttcggggtttggttttatgttttttttctcatagttcattttatactagtatttgcttttaaattgctaaggacacgtatgtaaaaaaatacctacaaattactttttaattactaataagacgtacgaataagcataaccataaacaaaacgctgagtccagtagtatttcaaacatgacacaactgagaaatttggaggttttgtttgaggtggtttttcagattaagtccatcaaatcagatcgagttttcagtcaggtttgaagtagccgatcccaaagttcgttctttttcatccggtcacagaaaaacatcaagggaacgaacttgtttctgcactgactttcaggcaatatgtcattaatcacaaaaaaggaatactgacaaaataggagtactccagtaactgcatttctgatcccgaggatgaagagacagctactacagctgacaaaaataactgcacgcattcatcactctgctgcttgctgttgttttctgtggcagctaaacgctactgtagatttccgtgattctctccttgcagaaaatacaagtgcgaaattaggaatcggattataccggtcattgggggtcaagatactccatttcagaatttcagacagagacaagtgtgacaggtacttaacctccaacttccaaatgcgacaatttccgttaatcaccggatcaaagttccaaatgcgacaaacactggatcaagttccagctacatccaaatttttttgaaacgaccgagtgatctagagtagagatagagagatcagtttcagtatgggcatgtttgtgctccttaattgcttgctctatgtgagtcttcgccagtatcagtcctggtagttgtagcatcatcaacagcaatgagaaattgatgctagtatgacatatccacagttaaccatgtgtgtgacaaattgccatattccttgccaatctacagtctgttcttctattttctaaatttgtttcatgaccacgtcctatttttgctaatcaaatacggttgatattactcaattgttctagaatttttttcttcaaagcccatggttagatattccaatatatcacgatgcagaggtcggaagtgtgcttttgttatctagagaaaatgttccgatctgttcaatatgttcttgcttcctaccaaaccatatcttcgatcgaaagttaataatggaaaatggttaaattccagcttgaaatggagatttgggaatcacaattttacagccttgatttaattttaaccaaacaggatatattccaatttggggattacaattctatagccttgatttaattttaaccaaacatggatatattcctttcctgttgatacacaaacccgagttagtacactcatatcatgcaaatatcattaatataaggggcctaaacgaaaaaaatatccctacccgtttttagcttaaaagcccacctcctctttcaaatttaccattcttcctcacactccaacctcctcctgtctccttctctctctcttaaaaaaaaacgcgacgaatccgacggaaaaatcggagaggaaaatccgcgccgcgaaaccaaccgaggtggtggtggttagggtttgacactctcaccgcccccgcctcaaccgcgagcgtctccggcggcgatcccacgggccgccgcgcgtcggtggggggcacccgatcgacctagatctcgcatgagggagccccgaatcggccagatctagggagctcttcgcggacatgcagcccggcgaggcacccccctcctccgggggctcgccggcgacgtcgccgcggccgccgccggcggtggcgcaggggcagcagcagctagggtttaggaatcaggtgagtctgggctctctctggtctgccccaccatggcgttgggattcgaattttttttgtgtggtttgggggtttgaggttttctctactgcggcctgcgcgcgacgtgattggtggggaaccgtgggttgtggccgttgggatttgggaaaaaatcctgacgcgtgtggcgaaaaggcggcgcttttttacgcgcccttccctaaacagtaaaccgcgagcttcgtcctctcccactcactggactgcgaggtggtggctttgccttgcctcatgtgatttttgcctgccctgtttctgatgcttgtccggatggttctaatttccgtgtaattttgggtttggaaccgtctgtgtgtctgatttgggttgaggttttggggggcattttggtttcgttctgtctctctgtttgtatgggtttggtttggtgtgttgatggaatgctccaattgcgtggttggtctaaacgggttggcttgtgttgttgcaggcaatgatgcatcaccatgatcagcagcagcagcagcagcaagggtacccatcgggcgcgccgcatggtatgatgggaggtggtggcagcagtagtttccctccgtcctcaggcccaatgcccccgttccagggccagaggaacatgccgctacccggtggaccgcagggtctggctggaggccagcagcataacccgacggcgatgcagcaagcatacctgcagtacatgatgcagcagcagcagcagaaggcccatgggatgctcctccagcagcaacagcaggccaagatgaatatggcagggccatctacaagggaccaggatgtggctgccaacactgcaaaaatgcaggagcttatgtcccttcaggctcaggcccaggcccagatgttcaagagacaacaatctgagcatcttcaacaggcagagaagcaggcggagcaagggcagccgagcaatagcgagcaaaggagtggtgatatgaggccaccttcgatgccaccacaaggggtccctgggcagcagttgtcatcggcgggtatggtgaggccgatgcagccaatgcaagggcaagctggcatgagcaatgctggagctaacccgatggcaatggcccaacttcaagctatccaggcctgggccaaagagcacaatgttgacctgtccaatcctgcaaatgtgactctcatttctcaaatcctaccaatgttgcagtcaaacagaatggctgccatgcagaagcagaatgaggtaggcatggcgtcacagcagcagtctgtaccctcacagatgaacaatgatgcaccaggacatagtaattttcctagtcagggtgccccatcgaagccccgacagcctcttccaccaagcacctctgtttctggtggggcagagcctaagatgatgaatatgagcaacatgcagatgcaacaacagttagcagctcataacagagatagctcgaatgacagggctgcgaggccagccatgtcaatgggcaatggtggacaaatgatgcatatgccccaaagttctggacatgcaaacaagattcctgagcagcccaatccaaaaaatgcaaattccgaagcaatgcagatgcaatatgcaagacagttgcagcaggctaaccgagctactgccccttcagcaaattctggtg

SEQ ID NO: 61769 - DNA, 1117 bp, Oryza sativa
aactattcctgctagtggtcccatgcaagtgatgaaagcttcacccaaggaacctcttagaattggaccagtttcaatgcctgaacaaaccaacaccaccctgattaaatctgagcaggatccagaaaggggtatccagagaacacctgggagaagtgattacaatggtgaaagggggaaatctttgccagcagaaagtggttcagcagacgctgagcaggcaaaaagagctgcctcatcaagtagcgtgcctactcccaacagagatgtttcaagaaaataccatgggccactatttgactttccatcctttaccaggaaacatgattccatggtgtctgcaaattacaacagtaatctagcactcggttatgacgtgaaggatttgttagctcaggaaggcatgatagttcttggcaagaaacgggaggataatttaaaaaagatcagtggcttgcttgcaattaatctagagaggaaaaggatccaaccagatcttgttttaaggctgcagattgaagaaaagaagctgaaactccttgaatttcaggctcgtatgagggatgaagttgaacaggagcaacaagaaataatggcaatgcctgatagggtgtacagaaagtttgtcagacaatgtgaacgccagcgtgttgagcttacaaggcaagttcagcagatgcagaaagcctcaagagaaaagcagctcaaatccattttccagtggcgcaagaagcttttggaggcacactgggccattcgtgatgcacggattactcgtaaccgaggggtagccaagtaccatgaaaggatgctgagggaattctcaaagaaaaaggatgatgatcgaaacaaaagaatggaggcactgaaaaacaatgacgtggaaagatatcgtcaaatattattggaacaacaaaccagtgttcctggcgatgcagctcaaagatacaatgttctatcttctttcttgacccagactgaggagtatctctataaacttggagggaaaataactgctgccaagaatcatcagcaagttgaagaggcggcaaatgctgctgctgctgctgcccgagcacaggtatgagtatgacattctttgctctggaaaatgata

SEQ ID NO: 61770 - DNA, 2375 bp, Oryza sativa
ttattgtgttcgtaacaattaaatctttacaacatgatctcacttgattatatttgttgatgaaaaattacaaattacttttttaatatatctaaataatttttagatttcatcaaattacttcttagacatataaaagtgaattcaataaagcttaaaagtaatttacatatattatagaagtaacttaaaataaaagaaagtaacttgtcatgacattaaaagtaaatctattgtgggggtaaaaacataagtctatctagaaattaaatttaatcaatatattatagaactaaccaataaataattgttcactgaatgtctaaaaactaatttaatcatatctaaaagtagtttatatatatatatatgataaaattaacttacatatataatttacaacctaattattttttatcataatataattatgtaagattgctagaaagatttaattgtaacgaacacaatggtgtaaatagatcatatgtgtaatcagatcatagatcagataaataatttaagagaaaattttatttaaaatttcaaattttccctagaaagtatgtggggtctgtaaagtaacagatgaaattgaaaaagtgagaggtctcgatttaagactaacacgctactgcactctacctagacgcgtcctggttgggcccactgcatattaatgttcattttaaaatttgtgcaagcacatatcccacattttaactactaattcacatatatttaacaacctacataatttctaccatatatacttgacactaatatggattatatttttcacaaaaattcgaatttgaaccgcaaaagtatcagactttaacccttgcattctgatctttcttttaactgatataatttttcacggtgcaaactgcaggaaatggctggtactttaacaataatattacctgagagtcatttgcttctgaaccactgttcgtaaagaacactttgcccatttccctggcagtaaacatgctaataagttctttcgcaagatcctgcaagtagcagcaaacctccaatcatcagtatttacaagttttttttttgtttgcagaatgactaagtcagtcactataacattttctcatgtagtattaatatctgaaaaaaaagaaacaatacaaataaaacaacgattgatgaattaaagatgcagaatacatatgtaccaaagaaggcctggttgtatggttccaaaaggagtggtagaagggtaacttgtttaattgctccgtagcagctttgactaaacgaggctcactaccacctgaaaatagcatgcatgagtggttaatgcatcagcgtttataatcagttattgatcacttcactgctccctctacccttgatcaataattagttcaatatcattttttaacaatggaattagttcaatatcaatacgtcgattacaagataaaatggtactacattggattcatatttaaaacttcggctggatttactacctggaacaattcaatttatccacttagcaagcctcctgacaaaacttcgtctgaatttactccactaaaacatttcaaccggtttaatctactgtaacgccccgcttttcgcgagacgttaaaagctaatttactgaaaatcctaattgcgaaaatttcgttctttgagtgttgaagtctaagttgtgccaaagatctcaatttacatccctcctttggtccatctttgtgctatcaaagatcgtctcctcaaagtttccatcccaatatagtcccgaagctcgattccttctattcggaatcccctcatggaaccccatccgtgaactttgtcaaatgcccgaaccctaactccgtccaaggattcaccttcgcgtcataaactctctccttggttccttcaaaccgattctcaaattcgaattcaacctctcaggttttgtttcatctatatttctctctgtattggttcgtcaatctacccttgttttctttctcgaacttctgacccaagtctgaatatgcaaatcgagatcacttccacccttgaactctaaaccccaagattcaatccctttcgccttgagttctccccaaaatgatttccgttccgaaataatctcgaagtccgaacccttctatttagacttccctccaaaatccttacccacatatctcgttgagtagtcaaactcaaactcccaagttacactctctttctctaaattatccatctcactttgactcgtctctgaatattgttcccttccttgactccttcctattctcccgagaccgagtatcaacctcgaaactcgaatccagaccccaaccctaaaacctcccaattaaatctctctatgaaagtctatttaacct

SEQ ID NO: 61771 - DNA, 2921 bp, Oryza sativa
gccgcatcccttcccatcgcgcatccacgtcggcatcccggcgagcttcgccgccgccgccggccgtcgtcgcgcgttgtcttcccaatccgagccgtggaatcggttcgccttgacctcctctagccaccggtgttcgtcgctcgcttcggctcgccgccgttcgccggattccaccgcgcaccgtgagccgtccgatgccattcccgcccccccccccccattttctctccccatccgacgtggctgcccacgtggcgttgaccgggcctgcccctgcccagtcagccggtcagccgtccccctccccctttctcccctggctcgtgggcttggcccattggccagccttcctcctcggcctaacaaaacaaaggaagtttacttttactccttcttccgagtccggtgcccacacaccgaagagctaaaagtccgcaattgctccctccaattgctcctctctctctcaccttcttattggccccactcgtcaatgagtcaaagataatcttgagaatgtcttttccaatattccacaaatatttctctcttctataaattcagtaaatcattttatcttatttcgtgagttaataaatcttttttcccttgatcccataaatcaattctctattccaaaatttcatgaatcatttccttataaatcatttcctttggtcccgcacgtcagagacggtcaataatattcttgagaatattatttctataaatttcatgaatcaatctccccttgttccacaaatatcttccttcgccagaaattccaattaaacttccaaaattcgtatctctcgatccaatcgtccgattgaccccgttccacttccagtatttccgtaaaatcgagatctatttaatggcactattatttagtctaaatagggtctttttcttggtctcttgtttaggtttttgtttgtttgcgcatagttgcggttaccggattttcgtcgatcgtggatttctcgaagattcgtgaagctcagtgaagaccttgagcaaggcaagccacctttgaacatattgagcctatatttgaacttaattatattgctcgcaaaatattatgcattgataggattgcacttaatctgtttgcaccgtctgcaaggcagaccggtgggcctacccaacttgttgcatctgatccttacattgttaattgttatatcatgttcccttgtaaccatctagctgcgcctcgatattcgtgcactctgtgcgagtatcgacggtcgccttcaaacttaaaatatgagtaacttcttgggtaaaacttggtttacaaaagcttcggaaaacccgacgcctgggtcggtgccttgtgaaagaaaatgagttttaaaaataaaactcgcgacacaaggccattcctaggcggaatacttgtgcggtcgcatctaaggaccgattcctttggaattacattcgagcatacaatagtgcgaccacacgggtggaatgggacgcccctagctgagtaaattgctaattgggggagccttgatgccgagagacatgtgaattcaacggggtggtgtcggggagaacccccgggcttcctagcacagtatggtctgggacctaacctgttgttggtctgggacccctctcgtcggcatatggcaaccctgtgtctgctctcgaaatgccttgtaatgaaagcccttaggtcaccagacgtggccgttctatacgggctgggtgattcgggttagtaatgtcgtgtgggtaaagtgtaccccctctgcagaggttaacaaactgttcgaacagccgtgcccacggtcatgggcggatgtgaggtgattccttagcgtagtttttgttttaccctgttttatgaaaagggtgttaaggtttgggaaacctaatgcttgggaagcaattagctgtccgggggacagcgggaccgggtgtccctggaagtaattggtcgtttggggaccactattatcgggaagtttggaaaattggtttggtttgggaaaaaccagatttgaagccaactctgggagttgtgcaaatcttgataaataaatttgttacttctcacctcccgaccgagctgagacttgtctcgctctggttgtggaaagcacacacttagattgttgaaaacttgaaaacaaaactgtttgcaaaataacagccttcccttgaagcctgcattaaccacctaagttcccctggcttgctgagtacgtaagtactcacccttgctctctatataaatatagttctgccagctccgaagatgaagttgaagtgaagtgaagattagggtttcgtcctagttccctgtcgttgcctgtggcgttgggtgttagtccgttggttggttccgctgccgctgctgttgttggtgtttgcctcgtctgtgtcgccggttgcattctggggctgtctaagctgcaacctaagttaaggtaaataagtcctctattaattataaggatttgtaatgattcatgtttgtcaccgtgggtaccagcgctatgtcctgggactggtactgagatcgcagtttcgtaggacgcggttcaagccgtttttctacgacacgctcctgtcaggtgccgttgtacggcggtaccagattggggtgtgacatctaccctgatgagatttgccttttttcccctccccgtacaaggtgaatttgaagttcagaattttcatggtagcaaagaacagcatatatatatataggccgtgtgaagttccaaaataattcttcaaactaccaacttttccatcacatcgaaactttcctacacacataaacttccaacttttccgtcacatcgttccaacttcaaccaaacttctaattttagtgaactaaacacaaccatagcatatgtttgaaaattgtattgaaggtttttttttca

SEQ ID NO: 61772 - DNA, 6383 bp, Oryza sativa
ggccgtggcgcgcgccgtgctgccgcgccactacgccgccggggtgcgcgccgacacgtgggcggtgttccacggctgcgccgagcgccgcgtcgtggtcaccgcgtcgccggccgtcatggtgggggagttcgtgcgcgagttcctcggcgccgaggtggccggcaccgagctcgagacgttcgcctccggcaagcggttcaccggccgcatcaaggccgtcctcgtcggcgagaagaagcgcgaggtcgtcgagaggctcttcgccggcggcgacatgcccgacgtcggcctcggcgaccgcgagagcgaccacgacttcatggccatctgcaaggtacacttcatggcctacgatccaaagctcgaaattttcatcatttcttgaattgaatcaatcacacatgaacaaaattgaagttttgcatcatgtggccactaataatttaacaattcatttagaacgccaaaaataaaaaaagaaaatattgtgaaattaattgtggtaggaattgcacgctcgattgttcttcgagtgttcatggcttcgatccgattggctcatttgtggtagcacgagtagcaagaatatgtacgcttcttagctttttgccttttttttttgttgaattgcctttttttcccctcttttcataggaaagatcaagaaggctctagaatttacattatggttatgcaaaacttgtggccaaaactcaatactgttggtaccatcacctcctttagtaggcagttagcagttgcttcctatttatttcgtcctttttaaaaccaaaaccccaaattagtatgtactcctatattcaaatattgtttgctcatgctgacttgttatagtaatatcattatcattgatcactttactcatatagtattgttttctttgcatcaattaatgtggatttagtactctctccatttgcatttactctgaatattgactctactgtttcaactttgaccactagcaatttttaattggttagactatcataaactaaaatttcatgcttacattcagaatgcaacctagcccatcatcaatatttgtttttatttaacgaaaaaaaaagaagacaagtgttcaaaatgtacatatgaatatactccaaagccagatatttgtaaaaattaggccttgtttagatttaacttttttctttaaacttttaacttttctgtcacatcgaatttttctacatacacaaacttccaacttttctgttacaccgttccaatttctccgaactttcaattttgatgtgaaactaaacacagccttagtgtgctaactctgttttggcgccaaattgccaatgcgcaggaagcctacatggtgcccaagaacaagcgcgcgccgcgcgccgccgccgacgagctgctgtcgcgcgccatcttccacgacggccgcctcgtccgccgcccggagccagcgagcgcgctgttcgcgctggcctacctccccgtgggcttcgccgtggcgctcctccgcgtgttcctcaacctccccgtcccggcgcgcctcgtccgccacacctaccgcctcaccggcatccgcctcgccgtgcgcggggcgccgccgccgccgccgcgcccggggacgccgggctccctcctggtgtgcaaccaccgcaccgcgctggaccccatcatcgtgtccatcgcgctgggccgccccgtgacgtgcgtgacgtacagcgttagccggctgtcgacggcgatctcgccgatccgcgcggcggcgctgacgcgggaccgcgcggcggacgcggcgcgcatcgcggcgctgctggaggagggggacgtggtggtgtgcccggaggggacgacgtgccgggagccgtacctgctgcggttctcggcgctgttcgcggagctgacggcgaggatcgtgccggtggcggtggaggcgaggcaggggacgtactatgggtcgacggcgagggggtggaagttcctggacccttacttcttctacatgaacccgcggccggggtacgaggtgacgttcctgccggcgctgaggccggaggagacgtgcgtcgccggcgggaggagcgcggtggaggtggcgaaccacgtgcagagggtgatcgccaaggagctagggttccaatgcaccacgctcaccaggaaggacaagtacatgaagctcgccggcaacgacggccgggtcgccgccgccgccgacaagcccaaggccaattgattagtccatccatctttctaaagatggcaggccacctaccagctgattaggccacttggcgcccctaagttggtatataaatctaatgtcatttgagaaaaagaaaagagaaaaaaaagcggctgtcatacaacggaatcccgttttcgaatgggatgataccggttagttatcaggttttgatacttaacctgtattatgcgtttctaccacgtatcaggtaatacttgcgaggtattagatgatatctatcaggtatcatacgattcttatcacgtagagggtgatacttgtgagatatcaggttctgatacctaaccagtatcaggagatacctatcaggtatcatgcgattctaccacgtatcaggtgatacttgtgaagtatcagatggtatctataaggtatgatgcgattcttaccacttagaggatgatacttttaaggtatcaggtcctgatacctaaccggtatcgggtgatacctatcaggtatcatgcgattcttaccacgtaaaaggtgatacttgtgaggtatcagacgttacctactagatatcaggagccgagcatcaaagcgtcgtcgccggtggtcccaccgtccacgtcccacgccggagctcgtcgccggcggccacatccttcatcgtccgcgccacgtcggaactcatcgccggcggccgcgtcctccatctccacgccccacgccggagcttgtcgctgacgaccgcatcctccaccgtccacgccacattggagctcgtcgccggcggccgcgtccttcgtcatccacgtcccacgacggagctcgtcggcgatggctgtatcctccatcgtccatgccacgtcggagcttgtcgctggtggccgcgtcctctgcctagccaagtatgtgctcgtcgtgctccgcaccgacggcggcagcgagggcagcaccttcgcgatctacttcctcatccaccggcgaggagctcgcggtcgcggggcagtgtgtcgacagggcgggcgtgggcgccgcaacactactgcccatgtcaaccatgcgtgcgcactggagcggctcctgtagaggctgctgctgctcaggacgtgcatggtcaggtatcgctcctctttgaataagcaaggagacaaaaaggatcccgtccggacggaattccggtatctagcattccaaaaaaaaggggccatgacaacagtaacatctggaggattccaagtaacaaacactctcatttctttgcactgcttcaacaacaacatattctaattaagttctcagctgaagcagataatcgatatatgagaaaaaaaaaactggcagcccaaaggccaccaaaactcagcatgcaagggaaaagggaaaacaaaatatttagcttgtgcaatggatctcccattagaggacaagcaaatcagaaaaataattaaaaaaaggtcaatttgatggtttttgaaaaatgatattttgctattacaattttcataatagtttgatacatgccactagtttatatttttacccgtaccccaaaaaatgtattttatgcagacctattgaaaactctcatattactatgagaactgatatggatcccattatattttctttttgtgactgtaattacaagtaagtgccacgccaaacgaaaactaggtcaacgtgccatgtagatgccacataggatgaaatcaccgttcaaacagccgagaaacttgatttgtactggttttgatagttgagggattttacctggttttatggttgagcggtgtaaatgtaactcaccataattgagagacctaaagtagactttttccttggaaaatatggcctggaaaaggattgcggcgtctgtgcgtccatattagatgggcctgattggtcgctgcggatgatatttggacagacagaattcttcagtactcacaagctaacgccggtattgcaaccccacaaataaacatccaaaaatttcataacacaatatcctctcaaagaaaatgaaatctttaacacaattggtgattacgtgacgcaagtacgcaacgagcaatcacgaactggcgttgacgagtcgtaggctggaatgctgctgatctcaaattaagcaggcagaggcagcttgctgatctacattttttcggcgatacctaacaccttaatcttcaggccatatctccagctaactgtctattaatttgttcgttaattagtactcctgctgtagtatgctagtagcaaaagcgaagcaacgacgagctgcaaagcaacctgcaacttgcaagcctctctgcaattcttgcgacccaaaccaatactgacactactactaatactgatcgatgatgcgtcaaggctcgtgaggctgctgcgtgcaaggaactcgtcgtcgatataattattgctgcaatgatccctgagcaatgtgctcccaaaatcttaggactgattctgacagattcagtcgtaatcagcaatgcgtgttgcaatcttactcctgtgtagtaacaattagtgcagatactgcatgcgtgttactgtcgattacattagcagataaacagcctctccatcatgtcaactgcatgccttctgaaacaattgatgtgatgtactttttacatgaacgaattcctgaattcctgatactgtcaactgtcaagcattgtggcctgatgctaatgctgcgaaaagttttatgatactactagggttgtgtttagatccaaactttcaactttttccatcacatcaacctgtcatacacacataacttttcagtcacatcgtactaatttcaacccaaatttctaactttagaaggaactaaacacagcctagcttctctagcacagcagcatgttcacttcttaattagtggcatctgaaccatgtgatttttgaaagtgaaactattattaactgatcgagttgccgagataaggacagctccatgttaaggtggggcatcacattctccagcctttcaagcaaccccaaaccatgccgaaaacacacatcttctacaatttgtgagattaaatgtcagggaaccgaaattcagtcatgcagatgtggattcagccacattttacggatctgaaactactgcgactgatatgtcagcactctttgttttcgtactagcctgcacaaacctctttttaagttaattcagtcggtaccagatgtcagaaaagttcctttgaattaaatctcaagatgtcaccagccaacagaccaaactgatcttctttgtatttttcgacttgggcaaatgtttgcccatgcaatgccatcaaaactgagccgcaaattcagttggtcaagctgaattctgttactaattctgttccgatttccactcgagcagagaaatagaaccgtaagtagtagtacaatacgaatttaagcggaatcagctcagattccacacgaggacaaattcgtattcgagctcgaaaaggcaaaaagaaaccaaaaacagaaaaaaaaagaaaaggaatccggctgtgcttggattgcattggaagcaaagttcgtttaaaaaaaaaaactaaaactaataaaccagtccgtttcaaacaccaaaaccgcgaacgctataaattcggagggaaaacctctccgaatctccaaactcctccaatggcgaccgcgcgcgtctccctcatcctcctcgtcgtcgtcctcgccgcctccgcctgcgcggaggggctccggctgccccgcgacgccaagttccccgcggcgcaggccgagcggctcatccgctcgctcaacctgctgcccaaggaggccgggccaaccggcgccggggatgtccccagcgtggcgcccggcgagctgcttgagcggcgggtcacgctgcccgggctcccccagggggtcggcgacctcggccaccacgccggctactaccgcctccccaacacgcacgacgcgaggtagatttcgaatttcgaaccccaaattagttgtaaagtagtacaaagttcttgctctctcttttttttttcttttggaaattttgggttgagtgtttgtttgttggatggattggggcgttgcttgcaggatgttctacttcttgttcgaatcgagggggaagaaggaggatcccgtcgtgatctggctcaccggaggcccc

SEQ ID NO: 61773 - DNA, 1392 bp, Oryza sativa
tgtgttcctcactttgccttttagtgtcttattagttgaagaaaaccatctggggctagaacttcattgttgctatctgttaggttgttaccaacttaccatatgtgttccatttgactatcatctcttatgccaccacaatagtctttgttaagttttattgctttttacatgaactgatgcacgacagcagaagtttacgagtttattgaggacaatgtttccctacatagtattgttcgttattggtgaacattaattcctactatgattttttagacctttccaactagtttcatgatgagtttaacaatggcagtggtcattgctgcagtcagttcacatcttacaatgatcaagcctacacaccttttggttcctttgtatccaccccttctgataaaactttcttcatgcagatttcaaatataatttttgttgatcaacccactggaactggatttagctatagctctgatgatcgtgatactcgtcatgatgagacaggcgtcagcaatgacctatatagctttcttcaggtactactctcaacccttgtaactgacgtgcttgcctttttctctttgtttcatcaattccatgtgatatctgattacactatataggcttgttcaatccattcctttacaatactaaatactaataaagaaacataaatgatctccaatgtaaagtaatcatagcaatatgtttgttttaaaactgcaggctctgctcttaataatagttccatttcacaaaataattatttgcatactctacttgactaagtaactaacagtcaacagtctggtgtgcctaattattgctttcatcctcaatttgtggagtggttctcttacctgatatgatgctcctgtaaaattaattgctacaataccataggaaatttccaggttggaatttggcattgcttacatgaaaggatgtacctaacatatttgactggatagcttcattaaattagcggtagtagataacttccgaagatttagcaccaaaccagataatatgcacggatctctctaaagagttgtgtattgatctgagagttgattattttgtgttgttgacttcagcaaaaatgtagagtaatatgtagtatttgcttgattcccatgtcaggtgttctttaagaagcatccagagtttgcaaagaatgacttctttataaccggagaatcttatgctgggcactacattccagcattcgcaagccgggttcaccaaggaaacaaagcaaacgagggcattcacataaacttgaaggtatgatccttacccaagtttgccatatcttttaacttaattgcttctttgctattttacacagttttacctatttttcttgtagggttttgcgatcggtaa

SEQ ID NO: 61774 - DNA, 6729 bp, Oryza sativa
cttgatcacaattcttaggccagttgaaattccagccaaggaagaattctcacccttttttttccaaaataataacaaaagcattacagtacatagagtctagctctctaaagttcatcagttgttcacttgttcttaaataaaaatgaaatctttgtctcattcactgctattatttctgacccttttttctctcctttttatttccaaaaggtttgcagagaaatggcaagagctgccggctgcgttggatcaactaccttcggccaggattgaagcgtggaatgttctctcaggaggaggaggacattgtcatcaatcttcaggccaagctgggcaacaagtaatcctcacacctgacaatctctatgaacaggatgatacaaaaccaagctagttctaacttgtagctgaactttaccttgaaattcagacaaaacaacgtcttttaagttaaaaaaaacaaagctcaagctgtcacagaataacaaaattgagcattttcaattgttccatttcatctacatgatgctgattgttttgagaaatttatgatcaggtggtcacagattgcgatgcatctgcctgggaggacggacaacgaggtgaagaactactggaattcctacctcaagaagagggtgatgcaggcacagggctccatccctaacaatctagcagcagcagcagctgaggtcacctccatgagcaccaccgagccaccatcattgcatcaccatcatcatcaccctcaccatcatcagatcaagaacagcagcggcagcacgaccacctcccatgaccaagacgccaacctgagcagcggcggcagccatggcggcatctctgctcctgcacctgtcgctgagccatttgatcagcagcccaagagcttcgtcttcaccggcgactggatgccgatgtctgcggcggcggcggggcaggagagctactccatctcggcgcagcactggccggcgtccacggcgagctccggcaacgtgacgccgtcgcacggcggcgcgttcggggaccagatgagcggcagctacggcgcattgcagcagcagcatcagagctcagctgctgctgctccaatggcaggaggcggcggctactttgacctgctaaacatgggagacatctatggcggatttgctgccactagtgacgatctgctcttctgatgacgattgtgtgtgatatgatcgatcgagttcgtgtgttttgtgtgcattgagcgtaaaagcatcgaaagaaattgcggtatactgcttcattaatttgattcttctcttttgtaagaaaaaatgtgatgtagtagaagttaagcacaccctaggctggacatattctttggttgtttctgcaataaaaaaagtgtaaccatttgtctgtgtaaatgtgagcctgtaattctcaagtagtagtagcacaatacccaactgaaagaaaaagttttattgttggatcgagtaagtttgatgaattctccagttgctcatttgaataattttgaggaatagagtgattacttgtcactaataattgatgttcgaaaaaacgttaaacctctggatgtattcgcaattcatgcactcaaaatactccagctgtaattgatatgaaaatggtactatggaactgagccttacatagatgttctgcaaaattgtatagcttacatgcttcatcagagttcagtctacaggatgacttttttctccacaatcaccatcaaggtgatacactctacttctctcgtcaaacaatgcagtacaaaaccatgatagtaaaagagcaacaaatggggaacagaaattcaatgcttcttgcgagaaaagtggttgtcattcggattccgtttcccactgaacattgcaagggccttcctcactggaggtttcagtggtactttcttttcaccgctgtgcgaaaatatgtcctcgacacccaagaaatcatcgtcctatagagaatattattaatggttaaataaatagttgcttaactattgcgatacaaaaacaggaaaaaaaagcatatgcacccacagaatggagaatatctgtttagcagagcacatagttggtgtaaaagaacgttttggagatgttgaattgaagtgccgaaaagcaggcatgcttataaaaggaggcttttcagtaaatctaacaatagcaagggctagttacctgcttgtttgacttcttcgatttagggtgcagaaccttctggggaagctggtcttcacgcaaaatgggattcttagttatggcatctcttccaccttggggcattgggagggaaaactgaaagaaaataggcatacaattaaaaagaaaatcttttgtcatcacagtaggaatcaacttggaaaggccaggtgggcacatggaaaaatatccaaccaaaagcattcagactaagaaatgaatacgaaaactgatgtagaaggccatagtatggcaggatatgtattgcgattcaccaaagagagtctagaaggacttgattagtaaggaatgcatacgggactggccaaagctcatggattttctacaccactacactgaagactatgttcgacacttttgaacctctgaccatcatacatattacaagcatggaaataaactatctggacatttggcatgagtctaaaatgtgcttttctatttctcagataacagtaaagcaaggcagcaaacaaaccaatattgccacaataatcaggcaagtgacaaaacataaaagtatctaggccacatggaagaaaaacagcattaagtttgaaactacactcacttttgtgcctcgaagtgtcacacgcggacgtcgtgaggccatagtgatcccattttcaccaactgttaccgaaaccttccgtaaggtgccaccgttgccacattttgggcaaaatattttcccaatctcttgggtcaccttatagcaagcatgacacctcagaacccacctgccaaattagcatcccaaagcattagcgttacaaagaaactactataaatagaacaagaactagtgcgtgaaagagctctgaagatgctaaaagctcatacctgtgcaactgacgtatttgcatgccacctggtgccaagagacggagaccaatctgcaggatgacattttgcatggcatagtcactggttatgcatgctacagtagattcagataaggacctcaacgcccaactctgctcactgctcccatcatctgcaagagatgaatcgacaccttcctcagagtcgcttttgatatccaaattatccaactcttcaatgcatgcgtccgtaccgccggtctcctcaacatcaccaacattgcctaccccattgtccttattatcagattgcgaatgatctgcaacaatttcaggttcattcacttcttggtgctccataacatcagtatcagcggaagggccatccactggattcaaaccattttcagataaaattttatcgtcatcaattgatggggcagcagaacttgtctcaatactttgttcagattccttgagggcatcacgtctcgccttccttcgtagatatcttctgtgtgtactgcgactaacagcaggcaaccaaccttcattattctcatcatcttcccaagcaatacctacatctttctttgcaggctgatgctcttcatcaccttgcttgtcagaaatactgttggtctcactattcggtatttcgtggttctcaagatccttcagtggaagtatgcgtgacttgagatccccacctgcttcagacatctggtccaattcttcccattctgctaggttctgcacattagagccccaacctggcagtggagcctctttcaggtttctcacattcaccacacgcagaggaggtggctgctcccgcaaatggttagtcccatggatctcagcttccagcatgtaagctagagcaataatcttgatatcaacatctgaaagcgtctggaggtctcctgtttcccgggcaaatttgacaactgccagaaacaaagattgagaaattagcctttctcatcattacgtcattcaaagatgaggaaaatttccatagtagaagactagaaggctaattctattctatagaaaaccatactgttgtgacatctaattgcttttgcacatgcaagccttgccatttccctcatgcttacattaagttttaagacaacaacattaaacaaactaccagctcatgttacacaaaggcaatgttttaaccacaaaacttattaaaccatggtcttggctacacctacaccgttatccagttcttagtacactcgtaccataaaatctattttaaggaaaatgtgaaattcactgatctgtagatagttttattgctaatactcaacaaggttcagtcagaattgctgaaggtagtacctacctttcttgacgaattcaggggcagggtcgagggtctcgacaggggccatgaggagcgcgaggcggcggcgcgcggacgcgtcgcgcacctcctccagcacctcgggcaccgtgacgaggcgggcggcggacgaggagagcgcggctccgcccgatatgacggcgttggcgtccaccacggccaccgccacgccgctcgtgttggcgcagctcgccaccagccggctcaccgcatgcgccgacgactcctcggccacctccttccgctgcgccaccgccgccgcgccccatgctcctccacctcctcctcctccgggaggagccgcagcttccggggcgggggcgagaggcggccacgcttcttccatggcggcggcggcggcgctagggtttttgggttcactttgaggctgtttggttggttggcccgcaccagtccatgcaaatttgtttgcgaccaagggacgaaaatcagactgacctacaaatagagggacccaaaatgaacttattctttggttgcctgctcgggccgggcctcccagcctgtccacgaggatgcaaaaaatagcccctcagccaggcccaaggcccgacggaaacggacttcgctgctcggcctggctcgactcgagtgatgcacccgctcacggaggatatatggggtcaccgctacttctccctctcgcgaaaaaactagggtttaccctagcggctctggcggcggcgaggcccctcccctctcctccgactccggctctcctcggtcgtcctccctctcttttgccggtcgtgccccctgctccaccgtcactctccgtcgagctgagcacaatggatagttgtccgtcgcccattgcaaggttgggcatcctcttccctgtcccagttttttctcctctatttggttgatttgctgtgatttgagtggatgagattctcacatggggccttcataaatctgctacattttcctagttgattttggtagatttaaatgttgaaaccatctactgttgctatccttctccttttccctcttatagttgcggaaaaaacggcgcgtattttagaaaaaatagaggggtcttattgcataatggccatcatatcatctcgccgcgataaaatggcggcgtcaccatccgcatttccccttctccgcatctcgcctttttcctcctccgggctgcggcaatggccgaaaccctagtcccgccgccgccgccaccctctgatccccaccagatctaggatttgtttgttgtttcacggtgctccatgcccttctccttcctttccaccacaactccgcccaccgctctcaaatccaccgcgtccacccccgcccgcctctgctcctcgtcagatccgacgcttaagcacctttccgaggtgtgatttttccccccgatggtattgtatcgttctcattctcttatcatcttgttgttaaggttgctcttgtgtggtagtgtatgttcaggtggtaggatttgtttgagttgatatcgctgagctagctgagctagatgattagattaaattggaatgaggcgtgcaagttaatctgcctgctgaactgattgtatctcaattaaattgctgtgatgacatctataggacggtatctgagcgacggatctatcctcgcgtgattatacctaaactgagactaaaaatgtctgagcaaaactctgcatttcttttttaccatctggaagttggaatatttgcttctcgctgttcagaactaagcagcaaccagcatatgctattcgtgttctgtgtcgtctttgttactgccttgaaatgagaatgatgatttgcactggatttagaatgattgttttgcactggatttagaatgattgtttgccttgatgattcctacaaggacggtatctgagtaaggttcttgaaagagtactccttatgtgattacatccaaaactgatcagagattctgagcaaacatgtgtctgaacagaagaaattgtctatcctgttgtacatttgactgtttctcaacctgagaaacatgttaaggtactacgtattataaggtagtacattttgattgagttgatgtcgctgagttacatggttagattggaatgaggtggtttttaagtttgtgggcctgctcaacttaatgactgtatctcataattgctgtgatgacatctacaaggacggtatctgagcgatggatctatcctcacgtgattatacctaaactgagactaaaaatgtctgagcaaaactctgcagatttttcactaaaatgaaagaaggaatattgg

SEQ ID NO: 61775 - DNA, 2377 bp, Oryza sativa
cctgcagcccgcatgcttaacgactaacgtggtatgatcagctagcaataattaatactcctagaacagtaagcttttgctacatgtacggaaaaggatatactatagtattagagcaagtttaatagtatagcaaattgctaccttcaaattatttatagtcaacttaatagctaatttatacaatagttactataaacatatactacataattaatatttagtcccacctgtcatacactacacatgtattttaaagtccgtactgtagctggctacaaatctgtagcccgccgctattctctcacatcttctatcttctcaaaatgagtctatggctaacttatagcctgctattgtacctactctattgtacctgttcttagggcatgtgcaatggtagtctcttaacgttactaattagaaatgtttgctaaatgatagagagagagagaaacaaggagaggcaaacattatttttactatggttaacaactttttagcgacgactttgaacatctataaaatgaaaactttgctgcataaagatgtgaacaaggaaataatagtaataaaaaataattttgtagattaatggtttagagtgtttgctgtgttcaccgttgtaaggacatggtatctaagtaaacatatgttactaaacccttaaatactacctcccgtcccaaaatgtaagtatttttagctagtgcccagattcatagctaaaaatgcttatattttaggacgaaggtagtatttaagcgtttatatatatatgggctctgatttgaacatgcctaacaacggcttttagccttcatacaatgaaaacatagttgtatgagggtgaaaaaaaaaggaaacaatggaaataaaagaatcttatttttaattaatggttatattagagcttttatcatctcactgttgtaaagacatggtttctaaataatcttatattgcctaagcgaccatactcgtctttactattgaacgtgcctttactctctctctctctcgcaatatattcttaactaaagcaagtttaatatatataagagagctagcggttgtctccaaagttgttcacatcaaaggtaggaattgctaatatatacaataactagctattggattactatacaaaaatttccaaaaaatctatcatccaacttttaaatataatcaaatttaggcccccaccactttagggcttattcgattttgaggaatttgaatccataggaatagaaaaggtgcaagaataggaatgtttgcatacatcaatccataggaatttttccaacatgtttgagtggatggaaaaattcctatgttttctctatacaacttgtaggaaaggaaactttcctttgattttcctatacctcaatccaacaaatggaatgacgctcataaaaattaatcttatgaatccaaatgctttgtttttctctaaaacggacaagcccttaatctgccttttctctcacccaccaaactaatttttcttccaacctatggaaggccatgcagtcccacaaataatgcatggtattggcagcaccagccgcatgcaggcgctaagtactttctctttatcttgtgctatcgcctggcgactgcatgattaggagtagatcaaacggtcggaaactaattgatcctctctaaaacgttatcatgacagacaccactgtgatttagtaaagtgcagtttttagttaagcccttaactagtctgtgaatgcagtcaaaatatctaataaacactttatttttgaaataattactctcctgatggagtaataattactctctctgtttttattttttacgcgtttaacttttggacgtacgttttgatcatttgttttattaaaattatgtaattattatttatcttattgttatttgtttaatgcctaaagaacttttagcagaattacatttttaatatttgcataatattttgataagacgaatggtcaaattatatccagcagtaaacggcatcaaacattaaaaattgaatggatcataagtggcgcttctagaaataaaacagtactagcagaatgatgttttttacaataaccctgggtgacgtaccgtcaagacccagctgatgcagttaaaccaaatcggctgcggctttatgataaacaagtgacaaactctaaataatccctctgtttcaggttataagacgttttgactttggtcaaagtcaaactactttaagtttgactaagtttataaacaaatatagtaattttataatatcaaattagtttcattaaattaataattgaatatattttcataataaatttgtcttgtgttgaaaatgttattattttttctacaaact

SEQ ID NO: 61776 - DNA, 1293 bp, Oryza sativa
taatatttatagtcaaaattagttttattaaattaataattgaatatattttaataataaatttgtcttgggttgagtacaaatttggtcaaacttgaaacagtttgactttgatcaaagtcaaaacattttataacctgaaatggagggagtatctcttttgtttttatcaatcgcttctatacaatattatagaaatagccgataattcagtatttagagcaataatagatactgtattggctattactccaatacagacttatataaacaacttaatcgatataaatacatcaaataacagtcgttcgatcagggcggaataaggcggcgatccgatcggagatcagctacgagggggcttgattggattgaatttcgtcgttcgatccgaactccggcctatctcgctcgctaattgtaattgccatgacgtcgcgtgaagccattatgctatttccacggatcgcggggcctcctcgccgacgccggcccgcgggcgcctccctccctacagcagccggagctccgccgccgttcctcgccggccgacggatggtcctccagccagggttttcccttcggagaagcaagaaaatttcggtgggcaccgaaattccgaaatttcagacaaattctgatatttcgaacgaaattttttgaagaaatttttttgctgatttcgaacgaaatctggcttttgaagaaagccggaaagcaagagagttcattacaaaacgaaaggtaaaacacgaactctaacgatggggtcgccagcttgacattttattatagtataataactgaacaaaattcctgagtatccatttccggccaatcatcaggggaagatacagtttaactcaggatagataggcgaaaaccaaatccattacagaaagtagcatgtcttgaacagaacaactctgataaagtagctcattaatcgcccagtctctgcagctcgtttcatttcttcaacccagatagcctacgtgattcattaattaattcctacttcttctttcttgagactctattaaccccagtttttacaagagttcctgcctcacctgcatcaaacacacaacatacagagagagggtttaagtggcacttcaaaaacaaatcctaggagtgcaccctgaaaattaaacacactcatatgaatcaagtttctaaccagacaacttgtaaacagtagtcaaagtgaaggttatgaactatccattagattatcggagtattatggtgcaacagttataaagcaaacctgtagccttgataagatat

SEQ ID NO: 61777 - DNA, 2719 bp, Oryza sativa
tgtgcgtgccgaggacttggggatcgacagtgaaccggtaggcgccctcgccgtcgccggggcgggggcagtggacgcagaggtaggacaggcgcggcgggcgggcgaggcagaaggagacatggatgtttacgccggtggtggtggtgcagaaggcggtggtgagagttggagactgcatcgggggagtacgtaagctctgtcttcgaggtacacccagcttgggctcacgccgccggtggcgtcgtcgtcggccggcagcggcggcggaaacagcaagggtagtagcacaccctcatccatgacataggggacgggctcatcaccatcatccatggcgaatcaagcggcgatccgatcggagatcggcgacgagggggcttgtttggattggattgcgtcgttcgatcgatccgaattttttggaatccccgcctatgtcgctcgctaattgcgatgatgatgtcgcgcgaagccatgacgatgctatttccgcggatcgcgcgggcgcctcgccgacgccggcggatggcacctcccctccagcagcccgagctccgccgccgttactcgccggccggccgatggtccttctccagccgccggagctccaacacgagtactgcgtatgatgatgtgttccttccatggattgctctccctctctagctttttcggttttcaatatgaaagtctattgaatgggtcaattttccttacaatcatcacattgcaggttttgaaatatgaaaacactgcaaaattagtttgtttctggcgtacagctacaacttactgctaactccgtcctaaaataagtaccgttttacattgtttatatccaacgtttgaccgttagtcttatttaaattttatttatttattattattacatgataaaatataaataatactttatgtatgactaattttttatttataaattatttaaataagacggatgatcaaacattaaacacgaatacccatgactttttagaacgaaggtagtagaacacaaatcaacccatcaattttatgattggcctgtcaaaatggtgcacagaaactacatgcccgtcacaacagtcgaaatcaagccccgagggacagagagatagactagagtgtaattacgctggcggatttgctataaaatttctgtaagtactcttttcatgtatttttgataggcatatttttaaatctgaaaaatttacttgatagttatatttcaatccaaccatctattctcttaatgactttctcggatttaatgcgtgactctctatttttcaacataagattggctacatgggcatcgagaaatgtaaatattaatgaatcgcttgtttacgaggaataactagtagaattataccaagatgaaatatgactatcaaaagtaaatagattgagtattttttttaccccttttatatttgtgatcatcggatcgcctcaagatttgtttataaagagaaataatattataaagaaaatttcacacatgtcacgcgtaagatcctggtgctaacaaaccaaaccatagttgaatacaagttttatataagttatatcatagttacagtgcagttacaaagtgtaacatcccgattttcgcctccatttaaaacctattttaaatacaaaatttattttcaaaatttggtacttatttgaattttggtttgtaccgttagagatttctactccatcatccaaagttcacaaatataatcctaggattattagagtccaatgtcccatttatagtacagtccatttacaattttcgaaattcaaatttcaatccaattcaaatccccttcaaattccaaatcccaaattcccaggaaaatacaacgtgatcctattcgtttggggtgaaaattttctcctttcccctctctccgtcagcccagcaaccaggccggcccatctccctcccccaatccccgatggcccaaccagcccagctgccatcttctcctctaggcagccacttgtgcgcgccacctgctcgacgaaatgtcgagccaccccgcaccgctcgcacaacgccgtgcgccgccccgagtcgtgcacgcgccgctccgcgacgaatcccggacgcgctgcctcctttttcgccggcaaaacccgccggccatgtgggcccccgccgacgactttctccgcctccctgtacccgtacccggcacagcgccgtgctgtggcctcccgcggtcccacgccgacgccgtccagcccgtctctccgctcgacacatcagtacatcacccctgccttgccctctttttgctgacgtccgcgactcgccaacacccgctaccctcggtgcaccgcctcgcctactcgtgcttcatcgcctgcggtcgagagtccacgccgaaagccacactgccaccgtcctcgctcccctgtgccaccatcaccatgccccttacctttgcctctgcgccatcgcttcccgggtgctctcgccgccagcacctcccctgccgccaacccggggcgccgccgcgtgagcgccgcatccacgaccgcctgctgccggtctcccgccagtccgccgtttacgccatcccttccccctgccgtctccacctccgcctggccggaataaaatcaaatatttattgatattttataatggttaaagttgttttctaaagaatgtgtcattgtccaaaacgacacatattatcgacctaga

SEQ ID NO: 61778 - DNA, 2015 bp, Oryza sativa
gtaggagaacttgccaccaactttgtcctcctctctaccaggaccaaatctacttgggtcatatacattagggtccttatagatgtagggcagtctgttgccgacagtcgtacaggtggccaatgtatgtcccttggggatttgatacctgtggccttgtcttgtttgtacgctgaagctcttgcttgcgtggcgtatcagcaggtttgctggagggtgcaaccgtagggcctctttgatgcagtgagtcagtgtggtcatctgtagcaagatgccccagtttatgcgatccccatgttgctggatgattcttttctgctcttggatggcggctgccaagtagcttcggtggccatggctgagcaggcaagctcctgtccatgtgctggtgctggagctcgtgtgctgcgcagcaaacatcatgcaaatgagtagcccggcgatctcattctcggtcatgcagcggccgttgatgtatttggagtctaggaatttctgtagcacatcatcctcagctacgcctgaattcctgcgtgatctcactgcctcgtggatcatctccccgagcatagcacgggctttgtcgcgccgacggtgctgtggggtagggagatatgggaagaagaggctgatcaagtggaaaccgttgtcgaagagctcatggaggagtgtggatacttgttccaacttactctccccgaactgttttccaagcaagcatcggtttgcaatcagcaggatcaggttccccatctcatactttatgtccactacgccatcttccccccactgtgcaaagtagccctacaaattgcagtggccaatcaatctagctaggatcaaaattgagacatatataatacgcatgggactagctctggcatctatactaagtcataacgcaaaataaaacatatgaaaactctctctctctctctctctctctctctctatatatatatatatatatatatatatatatatatatatatatatatatatatatattactaaccagcaaattgcaaaatcgcatataaatatataggaaaaatcaaaccaaaagtcaaaagtatgcatgataccacataatcaaagaggcagatctcctgccctgaattattcagtgagatcatcaaatggtaaaagttcacgctagcaaattaacctgctaacaaagaatgttgttcaatcaataatataattaatgttcatcatcatctcctgttggacatcactacaccaggcatgcctgctagcttgcttgcttatcacatatagccaagggcgaagatagcatcaaaacaagggggtgtgcactaccattgaaaatttataaaattttaatgcaatactatacattttagtgttttcaagtgagaaattatgaatttaggggggttcatgtgcaccctctagtttcaacatggcttcgcaactgcatctagctagcgcctatatatatagatacatgaagtagttcttctggaagccggatccgtcacactggcaaacattttgatatatgatctctatatatgaataacatgtacaccaattgagtggaaatattcaatccctttctaaatatttgatgccgttaacctttttaaatatatttgaccattcgtcttatttaaaaaatttaagtaattattaattcttttcctatcatttgattcattgttaaatatacttatatatatacgtatagttttacatattccacaaaattttttgaataagacgaacggtcaaacatgtggtaaaaagttaacggtgccaaatatttagaaacggagggagtaataagttaacatgcatgcatggaagaaactaaaagaccaaccagctggaggataacatatagtgtttgcatattgctcacctccacctcatgaaccatagaatcaacgtggcctctcaagttgattggcttgatcgagtcggtacagaagcttatctgcctgctcctggtagccaagtccacgtcgtacagaaccccacggccgaaa

SEQ ID NO: 61779 - DNA, 1125 bp, Oryza sativa
taataaagtaaaccatggaaatatttacgagagagagagagagagagcgcatgtgaggttggatgactaatatacgtacttgccctccttgctctcaaagcactgatcataaaagtaatagaactccttctccttacctaataagaatgtattccttcaattaatttcaatattataggcctatcaaataatatatgaactagacataactctgatgaagtcaacatctagaatacctatcaactcatataattcttaaaaatgcatttttccacagtaatgaagctcaatggtaaaaatataatcaagcttttctttacagctattaatgaaacacactgctgtctagtgtccaccacaaaggcgttactgctgaaattggatatggtaacgatagaaaaataggagaaaggaagaacaccctcaacatgccttgcctgcatgagaggtgacttgaaagtgcacattcctgcaaatgctcctacgacttgagtatttattttccagtttgaagacaggtttttcaatgcacaagttaccattctgggacaagtcaaatcatgctaactgggtgatttttgctaagaaccatcaatattaaaagtaaaaaaaactggatggcttaggcagtaattcaatggtggcaagcgctgccatatataaacttgcaaggccattatatagctaacaagaatatacgagtgacttgtgcattcaatcaccaagtaaacaaactttcaactgacttaccaaagtcgtgttttagcttatctgtcagagtggatatcctagactgaatcttggacagctttgagcttgcatcatcatactccttccgaacacgagaagcctctaaaaaggagatcaataagtgacacagcatctcacatgatttttgaaggatcatagcaggtagaatacacaacctaccagataaatccacaggggtcttgaaaaagttgaatgttcgtaaaacattctgtacagtttgctgaattttatccagccatgatgcttgcccagaggcagtgaaatctgacagaacaaaagaaaaaagaaaaatcgataaccaaatacagaaaggagtcaaagaagagagatagtgggcaggagacatgaaccata

SEQ ID NO: 61780 - DNA, 2906 bp, Oryza sativa
attgcacaagaaattaaaaatacaatgcttgcagttagtttagattcaacaatgggaggcactagggatgtaataatagagtttgtgagaggcagcaaacttgaagagaaaacaaaaggctggctgtcaggattataaattgcaaatagtccgattcatatacatgtatgaacttgtgcatgctattttgactatttgcttacacgatattacaaacaattgtggaagtgctaactaacaccccagaggtattgacctgttgccatgactgcaaacgcactctcatgactaagccccccaaagtagtaattaagcaaatgcgtccccatgactatatggctgagcgctagaacagcgcttagaaatctatcctataaaaccttgaacgtagccttttgaggccgtgggcattagttacatggtaaatgaatggtaacctaacaacttcacatgggtggacactgtaatcatgattcttaaatagcttaaagataggtaaacaaacttaccattttctttgtgtcatatcgagcaacaaagccaactcctgattttctttgttgcccaagccagaaagcttcagttcccaaggagaggttcttagttacactctgaaacacacaaaaatattagtttaatatatatgttagaataaaaacatattctcggcaactcaattcatgcagttaaatcaggcattttcttttggatcatgaccctaacaaaaaaagtgaaccgtttaatcacttttatcctccagtttaatcaacagaatcacatggcaaacaccacaaagttacttaagagatttctggagttatattcttatgcttattgtacaaagaagctaccacggcacattgtttttgaaatatgtttgtcttcttagcattattacttcctctctcccagtttagtgggcgtattttttttttggttgttgttgatgtaccaaaacacaggacacactggggctttcagccaagagtgctctgctacatgcatgcatgcaagcaaggaggtgctggccacataattggtgcatgcagtgtggcgccattttaattggcttatccgtttcatgcatgaggaaacggagcgcttcaatttactagaatttggtggcttggtgctttgtttacatgcattgtctgcttaataggggcagatcaggaagaaaatatattgcatgcaagggccttagcgaaatattttacacaccctgtaaatggggacagagggagtacttcgtctaggtaaattttaagttgagaaaaggaaaagggaaaaaaagctgtctagtcattacatcatattaacaagaactgtcttcatagcagctgtctatgcacttacacaagaatctaaaatgtagaaaatcctcaaagggcatggttattatatgcaaacacataaacacatacctggatgtagttccctccatagaaggcattattcccaagttggaactgtgatctaaaatctttgccctgcaatcaaagatataaaagcaacacaagttataaaataaagtacaccttcagatataattgataggaagaaactaaataaaagatatatctatctggaatacactatatctcaaatacacccctttacacttgcgagaaatttaaacaggaaacaacacaaagtttcatggaaagaaaaagtttcttgcattggccattcccagtagtattcttcagaactagatattatggaaaaggaaggggtaaaactgggaggaaagggaacaaaagaaaactacggaaattatgtgttgttgagaactcctaagaaatgcatcactacatcaacaaacacgtctatcaaattaacaaactagtaaaaattaggggcacgtttcagagtgtgcattccatcttcacattcttgatgttttcgattgaaattaaagatacatgacaataggaatttatttggaatgcaaagtaattgtaggaaacagactgaaaatgagctataacgcatttcattaaatcagccataactttcctttgaaactaaattgttcagcatctgctaagaaagagtcatctgttaatgattcatgagatgcattatgaaaatactacgaaagtttcgatgccatctcttttcttaaaatcgttcggcaagataacaggctttatgttgtcctaagtggaaatttaaaagatgccagaaaaaacaatcatatcttccattattccatcattttaataaaaaaaatagcaacaatataggacacactttcattaagtgagaaggattctataccaaaacacagtagcttgttgaagaaaagaaaaaaaaatgtatcgctggaatgacattgccatcaaataaatttaccaaactaggaaaacccatcatcacaaatccaaatgtacacaaagactgaccttataatcaaagctaaacatgccttgggagtaatggggctcgttcgtcaactgccaggatacatacaaggtaagctaattagtaagtacaaaaggatggtgttaattagcgctaatctcatattgaacacagtttggctcatatggttccaaacaaaaaacctgagcatttatcttgaggcaaagattttccaatagatcgcacttaacgcgcgcggtcaccctcccgtcgtgcgaaaccctcccaatgagcatcatctggcaaatgaaccacactcggatcaacactgaaaccaaccatattagaacaccaagcatgaaccccttcacagaagaaaagcattgcaaaccttgggatccataaagtttgcgccgaactcgtagttggaggtggggaccttgatcacatccgccccctgcgatgggagctccatggatcccatggacacactgaggcgcacaaggattgtcacgatacagccaaaaccgctagtaata

SEQ ID NO: 61781 - DNA, 3997 bp, Oryza sativa
agaatttagggataaaatctttgtaaacgcaaaataacctagctatattaataataatatggtttttcaagggtattatatcataactaatggaacggtaacgcaagagaattcagtagatgcaaaagttagttgaacgagagttaaggtggcaagtagtagtcacacgataaaacgatagttgtcggtgtcaaacacggtagatgtgaggaatcatatattcggggatctaccaggggctccgaatgcaaacggcatgttcgattgtgctagggagtaagagagaacatgatcacgtatacaggtttagcctctcgaataatactcctctcctggtcactatcgaagaagttcgtataagttttgggaggctctcgagctagcttagcaagccagatgctcttgccaatttctagtgtttaaccctcctacagggtttaagatgggcatttataacctacaattaatagtcatctctttctctctgacgagatacaaaacattgtgcacactcataagcttgagctacctccttcgactctccattagatctactatagtagtcgacctcctgttggaatccatgctaggcccacttacagtctcctcgatattttacgcgtcttaaaagccacgcctgatgacctgagagtgattgaatcttggatactttgtatctctttgtatcttggtttggtcttttattttgttgggtgtgtttaatttcattatgaactacactcttcgtttgagtgatacattgtaataattggctgtagctttgatgagcaaaggccggaatgttcattccattatcttaaaaaaaatacaatggacgagctctatagcttgtgcatgctcccaagggtggcatagtgccctattgaacacacatcaacatgtcatcagcacgcgagaatgccactctacccttgacgaggtgccaaggttgattgcaatatgacacatggagtgcagggttcaccctcgggtgcaattatatggtggaccgcgagaaggggtgacctgcctactccacttgatctcactagccaagatacacctagtagtcctcaggcaacccaaagtcatgtacccctagcatgacttggttcctaggtggctagccagcatgcctcatgctccaacgcaaaaggatacgtgattgttttcgagcagctctgggaacgaattcaacttaggttagttgacccaaccagagtctcgaatgtctagcttttcttggcatgtctttagacagatgatggacacgtggaccttctcgaaagaccttgattttggtttaagctatggaggtgttggcccataatccacacagtttcgatggcttgccttctgaactaagcaagatggtcaagtcgggactccctctggcaacaatattcacttgatgaagcaataggtatgggtctacatacggtaatttagtgtcattgatcagggcatgtccatcccaagtgttaaagagtgacgaccgtgcatatattaattattcataacttttatggtcattttcatgctaaatggaaaaaaaaccacctaataagagataacttttaatcctaccgatatactattcctatcttattttatcctaacttttttcactcagttttgttcatatttttttatattgcaaatggcaagaagagtaaaacgttaaccaatgtttaccgcatttttatccttacaagtttgtttcgacatgtttttacataaaaatattcttaaatatgtatcaaagagctttcaacatttaaattcggtgactattgatctatgtatagatggcgttcctctcaaaggttgctaattggaacatactcatcaatgggaacatgatacatgtggtcaaaagagataaatggggcctgataagtcagagggtcgagagtccctgataagtgaggcccacacctatgggcccataagtcagagagacacgtccctttgacgtacgtgagaggagccccaccgggacataacataataatagcactcaaaatcttttttcttcacttggaaaaatatcaattgtagtttgatcaaattatattttgaatgttatgtacttatgaccaaatcaccgaaggaagggaggatgacatttcacattttgttttgatagcacgtgtttgttactttatatcaaactagatttataaaggctaataaatcttaattgattatgaaagtttctttaagacaaatatactaataatatttttattattttaactaaaatgtatcattcatcaaagttttaaaattttgattgatcttacccaaacattgaaattttgtgatagaaaggaggaactagctcacacattggtttatcttagaaacgtgcattttttatcctcaagacgagaaacattttgtagggtgtttaagatgctagaaggatagggagttgccaattagtcacaatctgaaaaagctaaatttcttagcttgctgctactagtttgttttttacactatataaatacttatttcaaaaccaggaataaaaatcaaggtcgagaatgggtagctgacggatgttccttaaatataacatatttggcgtgtttccgaagataatgccagcgcattgcgaaaaaaaaattcaaaatgctaaggaatatatttacagtttggttaattatatcaatgccattataaatttatcaattttgaaaaataccactactatcacataattaaaatcatgtgctgcaaaacatcaaaattccacattatacgtctaaaacacattatgaatcgttttgtgactactctattttttattttttatggactaaaataaaatcgtctcttacaactcaaagaacaacaacactatccttcctcctgccaactccacaattggatgctttagttctaatcaaaattttcaatctaacatttgacatcgctaccacaacaaactgctaccacttcaccattcataattcgtgtacaaaataattgaatgaatatcatataaaaaactacataggaaaaaaagagaaaaataattgggtggtggaggagccaggtcgccgttcacgaccattggcatcgctcgtcggcatggaggggtcgccgtccacgaccgctcaagtcggctagctggcactcattgccagcaccagcaccattagcttggtgctcatcggcgcctagactgcgtatcgtagctgtcgaacgtgtcgtcctagaccttactgcctccaccagtgctaggtctgctcatgttgagctcgccgtcgccagaaccgactttgcgcaacctagatcgaaacttcatcgttaccgtgcgccgccactgcatatgcttgtgtcgagagcaagctttgtatttagctagtcgtcacttgccgccggcgtcgtcgctgctgattggcgctccccacgttggcaagattaggtgatcgatttggctatggtcgttggatttgaggttagggttaaaaggagacataaaaatacagtaggaaagaaaaattcaaaacgcgtatatggatcaaattatataaattgtaaagatattttttaaaacagatgattttttcaatttgcaatggcaatgatcccattaaccccctcccccgctttgaggaagaagcgaacacactccatgcgcccccgcagcacacgtatgcatggtacgtgtccgccggcgtcacacgcggcgtgcagcgcgacgcccgcggcgcatctcggcggccgcccgcgccgccgcctcatccatctccagaggattcctccgatcctctcgccgccctcctttttatcccccacccccctcctcctcttcatcctccaagaagcagagagcgaagcaagctcgaatcgatttccaacccagaggatttgattagctttgacgcataccaagatcatctgatcaatggcgtccatgcagaaaaaccgcgaggagcgcgcggaggcggcggcgcacaaggcggccgactagctccacgcc

SEQ ID NO: 61782 - DNA, 3141 bp, Oryza sativa
gaagggcttcgcggcggacaaggcggagggcgcgcggcgcgcgctcgcgggatccgcggcggcgaggaagggcgagacggacgagtccgcgtggcagcacggggaggacgtgcggcggcgcgccgcggagaaggccgaggaggcgcggcggcggagcgagcctcagccgtcgtcggaggagaagtagccgtcgcctcggctcgccgccatttctctctgttcttgaaagcttcttcctactcggctcacctgaccggagtccgggacgtgtcgtgctcgtgcgcagggggaggtcggcgacggagaacatctacgggtcggcggcgagcgcggcggaggcgttcaggcagaagatgacgatgccggaggacgtggtggagcagaagcgcgccgaggctgccgccggcgggaacaagggaacagccgccgcgacggcgacggcgacgaacaccggcggggaggcggcggcggaggaggtgatgatgcgggtgaaggcggcggaccagatgacggggcaggcgttcaacgacgtgggcaagatgggggaggagggcaccggcatggcggccggagatggtgggcgccgccgctgagatcgccggagccgaccgcgcggcgccacgccacggtgtttttgctcgtcgcgttttgtactaatctcagtataatctgtaatgtaaatatgtaatgcggcagttaaaagtaataaaatatcccctaatcacttgtccaaagcagagaacagtttgctatcccctcactctccctccttacggacggtctagtatcttaattaatctctcgtctaattcacaatgcacgaaactatttaaaacccaaaacatgaatctatttaaaactcaaaaacatatgacgaatctatttaaagcctaaaacccaaaacatatgaataacagatgaaaaataacatatgaagtacgaaaatacttgtcttttgtttttaatttttatcattcgtcttatttaaaaaattataaaaaatattatagaattattatttattttgtttgtgacttactatattattaaatttctaattttttaaataagacgaatggtaaaacgtttacaagaaaaatcgaaatcgaccactatttttttttggacggaagtagtaacaattatcggaaaaccactcacattcatttcttcgttatgcatgctaggaagtccaccatagttcatgatagccatgtaaatgttatacagcacacaagatgtcagaatcaatcagccaatcgagtttgaaaagagggactgtgcaaatgcaacactgcaaagaattggagaggtgcatcaagattcaaggcacatctgcacacagcctacacaaggcctcaattcagctacacaaaaacatcctgaaatttgatcgatgttacttacacctgatcggcggccaagcaatttatttacccattcatcggtgacaggacctgcgttaattttgtcaacagtgaaagaaacatcatctccacgattatgtaccacaatgtcacgtatcaacatatccgttgaagaaaaaaagactaaccaaaagcacgaagcagttttgctacgatgtaggagtactattattatcctcttgcgaacaaacacaaacctcccagcagcagaggtgtaattcagttttgacaaaacggtgtgcaggcaaacacatactacaatgcaaggaaaggaaccgtatgcaacactaaaactgctatcaagaaacaatcggcagatctcatttctgaacttctctttagcttcactatttcctcatgagctccaaaagtttctagtttgtgaagatataagctccaagatgtaaaaatgccactgccataccttcccctgaaagtatcaaaatatgctcatacaactcaggattttcattaatgaatgatgaatcttctcagccgttctgtacatgtactgattaattctgttagagattagagaagcttaaaaaatgcattttccacaagtcaaacttgccaaaggctaagcactgaagtatgaagttgtcaaaatgcttaggctcacctgcacagaaatatgttgggttctgaaatcaaatacacatgaaacatcaggtttctgattatttttgcttcaaaaatcacaaattgggtgtactaaaagaacaactaaagaatggcgaagtggcaaatcctagagcaacatctactaaaggatggcaaattcaattagtcctgaacagtgccaaatccaatagtttccatttagtgtatctgcaatactgaagagtactaagaataatagaaagttctgatcttaagtttagctccaattcactaaattaagcttatgggaggaataagaatattaatttgacttcaggttggtaaaaagtatgatgaataagtgattacttgacctctgatcttagtgagagcaacccaaaatatcagtcaaagagtaatcaagagaacatgaaacgaaaatctttcttctcaaatgtcatgtcatgttgatagaaccatacaacaaggcatgtaactagtcgatccctgagactaccttaagagcctaaggtcttgaacttgtaacaacatttcctaatgataaatacatatgactgctctacgaagtgaccaacaaaaataccagtcactgaaaaaaaatgccaatcatttcctctttcttgtttcacatatgtaaaatggcaatagcagattaatcagaacatcaccaagttggttgaagagccaacgacgaacggctccatcagcaaccgagtcaagaagtagaatgtgacacccagcaagatggagatcgggagtgcaggcaatgcatgcttgcatattgacagcaagataagggtgcagccaagcccagcaatgatggcaaggtagcacgcatacaccgtcatcagatcatacatcgcagccctccccacaagcacgctgtagaagataaaatcaccaagtcccagcttgatgcccctggtggactcgaacatctcgaactccataccagagtctgaagaagagttttctctgtgctcctcattaggggctgcattgttggcagatgccgctgataccaatggcactgtctctccttcctcgtgctgctcaatctgaatcacagcatgctgtgaactcccaccct

SEQ ID NO: 61783 - DNA, 1593 bp, Oryza sativa
catgtagttcttgaggaagcccgtgcagcggtagtagtagagcgcgacgaggacgaaggtgacgacggcgacgagggcgacgaagacggcggcgtcgaggagcgcgccgacgagcttctgccccggggtgtcggtggggctctcgaggtagacgagcgtcgcggcggtgaccggcggcggcggctgcgcggcggccgcggcggaccccggagcggagggcggcgcgaggagggagatgaggagcacgaccagcgccatgcagatggagaccggcgacatcaccgcgagcacctccgcgccgaggccgtcgaggacggtcgccgccgtggaggtggtcgcccccggcgccggcgccggatccggcgagccggcggcgggatccatgcggcggcggcggcggaggaggaggagacgtggggatttggggatttctctgtctcgtctcggagtcgggagtccgaccggggtcagagttctcggggtattttcgggcggctcacgcgtttgtgtaaattcgcgcgaaatttctcaaatttacgggcattttctttcttatggaactgactgctcgattttttttttaatctattgcagggaatttgtttgcacgctgttttttatttttgtccttttcctttaatttgctactacttggctgtgaacatctcagaggcgatgtaacaaattcgttgaatttcaaatgaaattcagcgcaaaccgatctgcttaggagagcttcagatttcggatgacaaaattcgaacaaatttgtgaaccctgcttaactaatacagttaataaaagtgtagtatactaacgacttgtatgtgtagcattttccccagattcctgttgagattgaactttgcacggcgttgaaataagagcagcggtttcacaacatagctaaaaaaagatcatcaaatcaggaagatgctttacttatgagctgattttattattttattggcgacagcaagaacagcactgcaaattccagacatgtatttgctcagtgtcttattggagaacaattaaagcataatcacaattcacaaccttcggtctaattaagaagaccaaactactcaatggtacacacttggcaccaatgccgatacgacataagcaaactggtaaacccatccactctgtgagtaatatcctaagatttgttgcgactggccttctcctcaataccagactgcgagaatcgcttcctgaggacctccaagacctgttccatcctcacgcccttgaccctaagcagcaccatcgcgtggtatagcaaatcacccatctcactgattgtgcggctctcgtcctcgttctcaagcagtgtttggtttagctctccagcttcttcgctggaaaatatgaaaaaccaaatcagtatgtatgtcaaatatatgggcattcacattgagagagggatagggaaaaggcgaaagaacgacggcaatataatacaaggaacacaatatgtatgtcaattgctttcacaacgcacatcgatcatcatattgtacatgctaacagataaactctgaaagagaggccaaatgattaacaacatatggtgcatgagacgca

SEQ ID NO: 61784 - DNA, 2173 bp, Oryza sativa
tagctccaattcatctatagccaatctaataactcatttatacaatagttacatactacactattaatatttggtcccgcctgtcatacacacactgcatcttggaatccgtgatatagctggctacaaatctgtagcccactacccttctctctcctcatttatcttcttgaaatatgtttgcagctggcttatagcctgctattgtacctgctctaagttaaacctaattatcgacatgtgcttgttacttgcctgaatttgcctgaatttgtttaactacataatctactaattagtttgattaattgcatgccaaaaaatctatgacctttgatttagaatggatggtgtggatcaaaggaatgtcacacggtgacattagtgtgtaatgttagaggatacggttccgtcgagcccacccccaagatgccttttaaacctttgttgatccatattaacgaaatcttaaaatggtatcccctgaatggtgttcaagcctaaggctatatcaaaagttcaaaactgaggtattaggatctaattttatatccaacagtcataccctaagaacaagttaagtgtattaggctcccatttgaccatttccaaatgctgatgaaaaagtccgagaaaaaatgttgcaaccagtaataattttatcaacttcagttgtttgcaagattatgtttttttttttcttgacaggtgaatagggagaatatacaagggaccagaagaatatgcaagacctcaccaagggcagaaaaggaagaaatctaacccagcaagttgtgtcctaaaattatttcccgttcgatatgatgtagaatgacaccttccctaaacaggatttcattgcaataacattttgaatggttctattttcatgttgtgctattgtaaaaaggtagattcttctagtagaccaccataaaaatgcttgtcaatttgtcactgtagcgcatggtatcaaaacttttgctccagaactaacagtgtcttcttcaacatctgtgaccaagtaaagatcacatgtgtactatgttcaccatagaaactacttccagtatgttttatgttgataacttgaaagtatatcacagaaactgacatggttttatctcaaaagacaagaagctaaaaacgaggttaagaccagagggagtacacaatattaatagtatcacataatgtcctgcaagctcataatgtttaacaaaaaccatggataaagaataactgtgaactgtcttggatattgaacaagcatacataacagcacatcaattaactaaccaatcggcatacccaatagtgatgactgaactagaatatgagaattaatgacagggaataatgcaatgttttgtcctgagccatgcataatatgcttatttatttaatgtttggaccattagttttatagacgaattttgaaatataacatcacataccttatttttgagcaaagcagccggttatcaagtattagtttttttgtccatgatggcttgccacttccttcagtaactatctcttccttccgtctactaattgtatcttcaagtgagtacagagttgagacaacctgcctatcttgattgggctgtgaaggagtctcatagttaaattatatgtaaaggttcatttacagaaagggcaacccaagaacagataccttcgaaccttgtagagcatcatagactgaagtatagtaacaagtctctgcccctgtatggcaagtaggcccatctggcttcccaaggtatattatctatgtttcaggaaaaaaaaacaaacaacccaattagcagttagtatccactgaagcaaaagtaagcatcgtgacaagcaaggcttacagaatcacggtcacagtccaagaaaatgtcatgcacattgatgaaattcattgatgtctccccttttgtccacaatgaagaccgtgaacggctatagaatgtagctttcctggttgatatagttgttgcaagggcttctttgttggcaaaaccctgcatgagaatggctccagtatccacattttgggcaatagcaacagccaagcctttactgtcccacttcacactgtctagtattgcttcgacctaaaattcgtccagaatgaaaataaaatttaggtaagatatgatataactaagcaaaccag

SEQ ID NO: 61785 - DNA, 2316 bp, Oryza sativa
atctgataattgtgcattttagaataatccctgctaaaaaacagttaattgagattctgatagaatgggtaggacagtaggtgacatgacagggccattcgatgtttcatatctacaagttgataaacgggcccaggatgatgaattgcatgcccttcagtggctgaatacttgttagtgcataaatcaacgtagctacgcatcactccaaaaatgaactgccattgtgcctctaatcagcttgcccacgggtcttatactaacagcatcgttctatcaataactagcgtgatgtactaccatctgcaaagatttgcagcaacaaaataagcttagctcaaagcaagaaatccccaactctgcggcacaagaaatccagcatactcttctatctctacatgaacaacaataaaagcctcacgctacacagcactacagaggtgaaccctcatctaggaattccgacgaacatgtggcggttgtcattctcgtctgtctttagagcaccaaaggagaggcacatccaccctgaaacgcttccggcaacctctcgccgagaaccgatagggatagtggtgcagagaccaaccttaggatcgacggcgacctctcccggcgtggtaccagccgagcgcgccgcgacggaggcagccgggaacggccgccgccaacccggtgccgccgccgccgccacgccagcgcatcttccggaacctcctccgccgacgcggaggaggaggagagcgcggccccccggcgacgcggcggcggcggaggaggagacgggggcgcggggaagcggaggcgccgccatcggaagcagcagcagcagcgcagagagggtgacgggggcgatgtcgtgcgcgatggacgcgtcagcgtcacctcgcgatattccggcccactatatctggaccaactcaggcccagcctaaaccggcccgtaatacggcccacgttagcctgctttaggcccgttattaaggttgggtacgtagatggaactattagcgtatgattaattaagttttaattaaaataaaccgaaaatagatttatttatattttaaagtaagttatatatgcctttttttaaccaaaagtcgagataaaatatgtgtcttatgtatagtacattaatgcaacaactagtggtagtatgcttcgacgaaaaccgatcgaaaacagtgaaaaaattttaggttcaaagcgggacgaaagcaaattggaagtgaaaattttaatggtttttaagaattcataatacgtttgatcgaaatttggtaaatatcgctgtacttcaattaaaaaggtgaaccggctcggagcgcgcgcattgctttttttaaggaatcataataatgtcatcagcacatgattaaatctattagagaataaatgggaaataatcttttagaaaaaaaagcatatttcttttcgtcgcttttatgttccttttcatgatctatttctgggttggatgaaagcgaaatggcaccaccactgaaacttttttcacgggagaaaagagcatagagaaaaatcaacaagaaattgttggggagtttaaaattaggatgacagagcatcctaggcaataattaagcaggcaaaagccctctttaataactgcctaaaaaatgtgttggattaggaggtcatcactgtaataataaagaggaggctggtggagagcccctccctctctggccctgatctcctccccctctcacttgccctgcccaaggtgaccatctctttttttttttgattgattgactgatttggttgatgatttcctctgattttgtgttctttctccttcgatcggttctgtcaagagcgtgttcagaggaatttagggttgcagttgttctgtttggtgcaaagatttgtggttgctcggttggtttcttgatcgtatcctaatttcgtttgcggccttgttgaacatgttgttagaatcttctgttcttggtgttaatttgtggttgccgttcttgttttttttttgttcctggttggatctgagtggttcttgtttcttgttgatggaactttgttcttgatttggggatctgagtgcctttcgatgatggaaaggaaaaggaaaaagaaatcgtgcattgggttttgatctctcggtttgttgaatccttcgtcgcagcccaagagaggaatccaagctgctgcattgacggcggcggcggcggcggcggcgaggagatcgggagcaatggcggaggaggcggcggcaggcgggctgtactactgccacatgtgcgcttcgacggtgagcgccgtggcggcggcgga

SEQ ID NO: 61786 - DNA, 2990 bp, Oryza sativa
ttttaagggtgtttacaacgcaccgaggtggtgttcagcctcgcacccaagaaccgaatattcggtgccacatcggcaattcgcgtggaatcctcgagaacgcggagcacagccggcgggacccacacgtgccaaaggagagagggagagaggagcgaggaggggagggcggggccgaccgggagaaaggagcggcggctccggccgcaccgcccccccgatctgtgccggccagggctcgccagccgcgctgcccctcgatctgtgccggctggggctcgtcgacgcggcgccgctccagcgcttcgctcggctccgcgcgaggacgagctcgctgcttgggccgcccagccgtcgctccggtcgccgccttgctgattccgtcggtggggaggagttcatggttcagtgactttctttggtgggaacgaagactagaggatagagagagggtagatgaaaagtaaaagggaataaagattggtggccccacttaaaaaaatctgcactgtggagtattgttcttgggcgttctcctgcacaggtggcatgcgaggctcctcaaattttgacgacgcactgctactgccctaagtgcaactataaatttccacgctaaattttgatcgtccgtcttatttgaaatttttttataattaatatttttgttgttatgagatgataaaacatgaatagtattttatgttttcaattttttttaaaatttttttaaataagatggacggttaaggtcagacgcggaaaaccatagctacacttaaaataggacggatggctacacttaaaataagacggagggagtacaagtttcagcttacgagtaagaatgttgtttgaaatgctcatttgatgctgtgcaatgctatactgtagtaattcagttagaaatatgaaaatgttactaacttcaacaaactcattctgttccgataaaaattcaattctaaagatatccaaattcatcctcggaattggattttttttttcaggactacatccatatacagaggatggcagacaaaaaaaaagacaaatcagtggtagcagctaaagtaatctaaaagcaacttgctagcataaggctacgtttctttcagattgagattattataatccagataattaggagtaagctgaaagaaatagacaacttattgaagtagacttattgaagtagcttattataatctagagcacagcttattataatccgataagctcatttaggtgagctttttttagattattgggtgaaaaaatacccaccatgccacctcactccctctttagacttgcaaacccaataatctaggctctaataatctagaaaaaaacaactaaccgcttattctactacagattataacaatatagcttatagtaatctaactcaataatctaaattataataatcctaaactgaaagaaagagggcctaagtattcaactccatatactggttcagtttgtcaagaacgcaattcatcctatgaggcatgcattcaacttcccagttgcctcacttttctttggagatctttaactccccagttcattctgattgcagtagcttcccagtttttttttttggcggggagcagtagcttcccagttgccccacttttctttggagatttttaactccccaattcattctgattgcagtagctagggataaaaatggagctgaggataaaaacaggatgaatacagatggataatgtttataccatattcgtttttatcgtacacaaatatcaaaacaaaaatttctcaaaacatgaaaaccacctaaacttctaatagaaacaaataccatcacataaacacaaaataagcttgttttatataaaaaagtttgatcataaattataaacaatgcctaattaagtccaacatgtaaaaaatgagatgtttcacgccttcaacagatatccaaataacattgttcaatccatttggagcagtttctactccgaacggatgaaactatccactccattttatatccctacaagtagtggacggaaactatcaactccatttcatatccctagcagtaaccagttacgcagaaccccgaaccatattcatcataacgaaacgaattcaagaaatgcatttcagccaagaaaacagaacagaatagaactaacaaattacgtaacggctgtcaagtttaatactagtagcagcagaggcagcgaaataagctgcggtagcaataacgaatttaactgtttcaatggttaacccatgaacagcaaacaccgaaggtgcacctgaatgcaaatgccactatcatggcaacaaaagctatagatatgcgtggtaagtaagaatcccccagcaaaaattttcctccgagcaaaatggtgtggattaactgccgtctgccactagttcgctgtcaggagcttgatgacagatgcagttccgatccggtggagggcgacgacggactcaccggagttgcagagccccatcgccttggcgttgctgatggcgaacccgagagcttcttcagtggcttcgttgtcgaaggccttggcagtggctgcactcagcatcgggatcactcccctgacgatgaggctgtgccgcgcaggagcttcgtcgctgcaggtccagtcgaaggagtcggtctgtttcagctcaggaaccacgacggacagaatcggcatggatggcctgtacttggccaccagcctagcagttgttcctcccctagtcaggaccaagatgagcgccgccttggcagagttcgctgtacgcacagctgatgatgcaaggctctccaatgggctcatgggaattggagctgatgcggtaatggacttgaaaacagcggcatggtcgacgcatgactccgcttgcaggcagatcttggccatggtccgtacagccagttccgggtaagccccagcagctgtctcaccactgagcatgacacagtcagtgccatcaag

SEQ ID NO: 61787 - DNA, 1245 bp, Oryza sativa
cttgtagctcattgatatcatgttgtcatcaccctttatgctataatcagttgaaactgtgatttcttgacccttcttcaactgtacgggttttccatctttcagaaatccagttcggatctctggcccctgtattttaagcaaatccaatatctgataagtacacatttttatacaacaatagttatacattaaacaagcaatttcaacaatacttctctagaaaaggaattcaggagattgaatgttgtttcataatttcattagtcacaggactcatggagaaataaataattgctgttaccctcgtgaaattatatatattaaaggcaggggatgctacgattcatgcagatagaaacaaaaacattttgcgtgtacttgtagtatctgcacaaagcacagcgtgttcaaggtatttatttgtaaacaccaactaacgttgttacaacatcttaacccctcaagtacaagtccacataaccaaatgtacgtattcatagaagaacactacatcttaaagaaaaaaaaaccaaagcaaaggcagataatggcaaaacaaccaaaatattgaaatatgccctaataatgcatcccataaattcagactcatgttttaacttcaactaatagttcatactcttcagagtcgatcaactgaagattataccattagcattgtatttttactttacattctttttagactaatacccatataacaggaagacaggaaaccgctgctgcaaaaagaatgggagcacaaatcaagccagtagtcatagtcaaaataaatggaattcctgagggtagttacaggaaggaataagaatttcttaagggctatactatgcagcataattgacagtatactgacagaagagaagatgctcaaatgaaataacccaatatccacaaaataaatgctgttcactaaacgcaattaacacggcttttcttttttcattgtgagagcgactgtctcaaatgcaacatgcatttccatcgcaaatattaacgctgcgtagaaaccaggatgaaaagaaaattttccctacaagtatctatgaagaaaaaatgtaagatgatttgacaattgacatcctgtctattttacaagcactagtctccaccctattgttcactagggtggacagaatctcttattattggtatatatacagataaaactgaaaggaaacttgtcccatctcaaactctggacagaaataagaactacaaatt

SEQ ID NO: 61788 - DNA, 1506 bp, Oryza sativa
  unsure (1)..(1506): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatttctgttaatcatttaactccttactgatttgtgatatttgagttgaattgtagcctcataggccctggcagatgataaatatttcaattgcataagatttgcagtagttgagaatgggtttatgatgattttggctaaactgaaatttaactgcaactatggttaaattctgttgcaaatatggcagactttctataccttttcagtttcatgtgtggtatgatctatggatctccttattcaagaggatactgatttacttgaatttggtatgagatgttacttggagttttcggttagggtgacagctgagttccaccatctctgattcaaactttttgttgtgcttttaatgttataagaataaaattggctgagttccactcaactccgagcccaattatttgttcttaaactgtatcttctgggaaccttatctcccattgcagactaaagatttgtattttttttcttttgctgttattctgactggaaccattgcagctttatgtggaaactatgtcaattttggtgtatttgagctgtatggtgacagagcacttgctgatgcccttgatatatctttaaagatgagcctctcagttccattgtctgacatattggcattcaaaaaggtattccttgcaactttagtgatttactattgttttgctgtgtagtgctattgcttttattaatatggttattaagatctcaaatatattcattctaagttttatagcattgaagatgtaaagttctcattatatcgcaatgaaagtgaattgaatgttatgtatatcaattaagcagaggtaattacttgtgcctcaggaactggactgagtgattttagtgccaatcttctaatctaactgagaaccctgcatttacgcacttggtccagttagacaacgctgttatgacagaatatacaaattgatcagatcctagtatcttagcctgtctagaaagatttgtatattctgtcataacagcgctgtcatttttttatttgaaaatatacacagtaaaattaccaggagaaaacatgaaatgagtaccgccaacagtgggctccagagttctatcaggaaaatttttctttggaacatgggatgctgctgttattttttatttttatgccagacattttcaaacatttttttaagagcattgtccaacccctagaactgtactccagttgtgtttgaactttgcatattttttttcaacat

SEQ ID NO: 61789 - DNA, 4243 bp, Oryza sativa
ttactggcttgatcatagacaaataaacagcctagacaccattccaggtcttgcattgtcccacattgatttatggttaaccagatgattgagatattcttgtttcatccgtggaagcattcatactaggctctttctttatttcagctgtcaaaagcattctatggatatattgaagttctgttcagcagccatatcacttttgttctcaatttggatacaaacaccttcgtgcatattgtcagcactcttgaatctggcttaaaaggtctagatacagggatatcaacacaggtatacgacatgatgctttttactgcttgtaaaatgttccccgcttcttgttacaacagcatcggtgaatcactgcttaaactgtgtcctatcggggaagacatacttccaatctgtggttgctggtagataataattgatgccatcataatactctattctcttttatgtggtttcccttttagtttcttctcttggatctggatgtcatgtgcaacctggttagggcccacatagaagcagcagtcaacctctctaggcctgcagtactgtgcacatgaatagtaatgggaacaacatctgcctatggttactgtttaatcatttccatgttcttcgatacggggtatatcgtaaaggtttgggttgtagaggtttattaaggaagcaatacacacaagcttttagtctcttttttatctccttcccttatgcagctacctcagcactgcttggttcattaagcctaagggcccttaactatgttcatcacattggaatccatcattgttctttagtgctttctgtttggactaatctgtaaattgttgcttccttttggcagtgtgcctctgccattgatagcttggcggccttttatttcaacaatatcacagctgctgatggccctccttcaccagctgcactaaatcttgctcggcatattggagagttccccactttatttcctcaggtttgtgttaataatcttctctaccatatgcagaaaggtctggatgtaattacattttgttttttttctgtgacagatactgaagacgctttttgagatcatcatctttgaggatgcgggtaatcaatggagtcttagtaggccaatactgagtctgataatgatcagtgaacaggtgcttgtctttttaaaacttttaaatcatgttccttagcatttcttttgcactcttttttccagtttgtattgtctttgttttttttctttttttttttgcgagggtctttagatcttttctaatcagttgtttttctttgtgcagatgtttagtaatttgagagcacagatattagcatcacaggtcagtgaactctctggtctgatattccactatgcagtcctgtctttctagttttatttttgggttaattggatccatgccactgcaaatatgccaatttgaaaaaatgtcactactattcagcattcggctatgtgccactgaaaattggagaaactggaaccgttcacattttccgtcaaaaatccctgttagcccccaactgcacgtgggccccatctccctcccctctcttctctttccccttctctctccaccaccgtagatgcggtaggtgttgtcgccatcgtctcggagccggaagatttgcgattcaccctcaccgatctcgcgacgatgggtgatgtggccgcaccagctgcggcggcgcgggcggcgaggccgacgagcccgttgcgcccgcccaaggcgatccgcagcaccaagccaaggggctcgacgaggagaccgtcatggcaccattcgtcaagcaccttgtctcggagccggcctgctgggatgcgcctgcgtcgtcgtcgtcgttgtcgagcgcctcgtctcggagccggcgagccagactgcgcctgcatcgtcgtcgtctgctcccccggcaaggtccccggccaccgcccccgtgccggtcgtcaccccgcccaccgccgcatcgctgtggccaaccctcgctgccaccgccaccgacctcctcccggagcgctcgctttcatctccttcccccgtgccgctcgtccctccgcacttcaccatcggctccccggctgccgattcccctcagccgtcgccctcctgggctcgccggcgtccatggcggagaagctccccggctgctaattccctcgacgacggcggtgagggtgctgcgtccgccggcaaggacgacgaggaacggacgggtcgcggcggctgctggtggagcagcgagagatggagggggggggggatcactggctagctgcagtggcaaggaccagcgagttcgaggtggagtgctcgccggtgtccatggtggagaagtgaagaaaggaagagggagagagatgacggaggttgacagaaaactggatggaagtggcatggttccaatttccccaaattctagtggcacgtagccgatatgctcaatagtagtggcattttttcgaattggcatatttgcagtggcatggatccaattaacccttttttttcctctgcttgaagctttctagtgtcaagttatcaacaatgtttccagtcatcagcgtgcaggtgttaggagacaagtttcttttcagtaaaaatattaaattctactagtacatcttttgattagaactgtatgtccagcttgtgatgtacctaagttttgttaacatatgtctgccaataacagcattagtaatcattattgaagaactaatgtacgtcttgtttgcagcctgtagaccagcaacaacgcctttcgcaatgcttcgagaagctgatgtctgatgttgctaggaacttggaaccaaagaacagagataaattcactaaaaatcttacaacattcaggcatgatttccgtgtgaagaacattcaggcatgacagctgttcaggaccagctaccagctttaaggtggtgcactcatgtgctgtaaatactttagcttagcttcgttttaggaaccaccattcccgtggggggaaagttatggtttaactcagtttggtttggattggctgaaagatgaagggttctcctgctgcacgtggtggcaaaatgcagttgttgatctcttaccttgtcgtgtactagactggcgagtgcaggagattcttcttcttcttcttcttcttcttcttcttcttcttcttcttcttcttcttcttcttcttcttctttttataccttagtgttaattccatctctttttgcttgtacagcaatattcatgtgtaagcctgtgatcgctgtttccctaagttgttagggcgaaagcagccatcgctcaaaatataattcatttgttaacaggttagaagaatagaaaaaaagttgtaaatggttgtgcttcctgttgctgtcaatgctcaaattggaagtgaggagacggtaaatttgctccttgagcttcaatacaggtttttattcagctaacgtctttttttgcggctctccatatttcggttcattatagccccggactaatgttgtgtacagcatttttcttttggaggtgctgtccagagttttggagctcgacggcgccttttgcctatggacctatggaaggcagttcttcagtcttgcccacggtatttgttgattaatcttgttctttagtcttcttcagagttcagattgtttagattgtctgattttccacttgctcttaagatgtattataggttaatatagctagttgggtttctgttctggtttccttggtttgacactattcaggttactattcttgattggtttcaaacttcccatatttcctgtaaaattcggtaccttacaacaagtatgaaagtacaaactattcatataaagtacgtcttaataattaattaaaataaaagcacagaatttttccagcactattgcttagctcactctttacatataattccatttaagaaaataccttctcaatactgcacttgtacaggaagaaccagtaaaaatctaaaacaagtaaacatctgaacaatggataaattggggattttaacgtctttgtgagtgtcactgtattggcacatcactccccagtttacgctctcactacaggccctatttagttcccacacaaaaattttatactctgtcacatcgaaccacatcgaacgtttgaatacccgtataaagtattaaatataggctaaaaaataactaatttgcatagattgcgactaatttgcgagatga

SEQ ID NO: 61790 - DNA, 2034 bp, Oryza sativa
ttaattaggcttaataaattcatctcgtggtttaccaacggattatgtaattatttttattagttcccgaacaccccatacgatatattatataatacccgatatgacgtgccaaaactttacacccctgatctaaacaccctcgtagacttcagcatacggtagttgtgcaatgggcctacagtgccggcgctgagtcctccatccttggggcattcaagccctgtgacacggaaaatttggctttgtatagttcgcgaaattaaaatttttgggtatcacatcggacgtttgaccgaatatcgaaaggggttttcggacacgaaagaaaaaactaatttcataacttgcctggaaaccgcgagataaatcttttgagcctaaaatctgtcattagcacatgtggattactgtagcacttatgtggctaatcatggactaattaggctcagaagattcgtctcgcgatttccccccaactgtacaattagtttttatttttatttatatttaatgctccattacatgtgtccaaagatttgatgtgacgtttttgagaaaaaaaaattttggggaagtaaaccggccttaaataaaggggataacatataacacaagatatatacatgtacattgttgtcgtgttacatctaaattctaatgggaaagagaatataagcagacagtaacaaaaaaaaaagagagaagaaactgcatctgcaacagttaaacccgatgcagaggtcgaaggatagaagtggcacaaaacacgatctgccaagcctgatggaggcaaccaaacacgccaaaatgtggcaaactgcacaatctgaccttaggaggcagaaaaaacatggcaaaaatagacaaaatgcggaatgtccccattagtgcttgagagtagctaccattggtcactagtcaggatgcaacgacaaacaacaatgcacttgaacatttaacaagcagatgctcatctgacaacgaggacaacatatcgatcctgaccgataataggtaggttactttggatatggaaggatgctgcttcacatctccttcatagagttaaagtggatccaacagtaagtccgacaagaaaaccgactgccaacatcgcctcagggtgtatttaattcataccaaaattgaaagtttggttgaaattagaacgatgtaatggaaaatttggaagtttgtgtgtgtaggaaagttttgatgtgatggaaaagtttgaagtttgaagaaaaagttggaaactaaacaagggctcagatttgccaacccgcttgctcgttgtcgctgtagcatttttccagcctatccaatatcccagcaaaagacctcttgcgagtccttcttcattagttgcgcatataaaatagagttccaaaaacaaaacaaaaaagagcacgacctcaatattttcattcaatctttataacataattgagaaagacatgacttatcatattgaattattagcaatgcgaacaaaaatatgcatacattaaatatattgtcacatcaaaatgtattaagcaaacgcaaacaaacaagtgcgagaggaataatgcttgtgttcatcccaaacaagtcgatatacttttgctaaacttttgtatgattaacaaaagtacagaacaaaactcagtttggaaatgaatacttctttaggagcgtatgttgaacaaactgcaagatcatttgctaacaaactctatgcagtcccccaattaagttgatttttcttaatgttgaagtcccatgttacatgttacattccctttgtcagtttggatgaaattttgacaactaaagcaataaggatcgcatccctatggtcagtgtacctccatttccactacaacttaattaatctattaagcaggaatcagaacatgccatgcccttattcggcttccaaaatctgcctcattccaagtcctctgcgtgggcaagccgaggtactcaaacacattgatatcttcactttgtgttggttcgaacgcattgatttacatgccggtgtca

SEQ ID NO: 61791 - DNA, 2508 bp, Oryza sativa
caacccaacagtactcaaacatccctaggatgctaacggtactcaaacatccctgggatgcttaatagaaacaggttatctatgacaggatatagcatcccatgtttgcaccgaacatttcagacattctagaatgagtaaagtgcataggcggtccttaaacttgtagggttgtgtcatctaggtccccaaagtctcaaaatgcagattcaggtcctagaacttgttaaagtgtatcatttaggtcccaaatcgacatagcccctctaggatcctacgtggcgctgatgtgacacgccacatggacgtggcgtatcattctctctcttttttttcttcttttctttttctttttcctttttgttttcttctaattcttcttttttcctttcctttcttctgctcgggttacagagaaaggagaagaaaggaaaaaaaaggagaagaaaaagagaagaaaagaaggaaaaaggaaaaggaaaaaaattttaaatgggttccatttgtctcgtcatgtccgtgtggcatgccacattagcgccacgtaggatcccaaaaggggttgtggcgatttgggacttagatgacacactatgataagttctgggacttggatatgcattttgatagtttaaggacctagatgacacaccattacaagtttaagaactgtctgtgcactttactcttctagaattccagtcattggtgcaactagactaaatgcacattgtagtaatttaaaaaagtaaggcatggacatattaaaaatgcaatgccatggtttcgtatgaaaaatggcatatatactagagcataggatgtgagaataacctgaatctactatacaagggtcaccctttactttctactaacacacaatacaagaaagtacacacactctctgactctcatagtaggcgctatatgagaaaaacaatacagtttgtaatccatgtgaaattaaacattatatatgcagattagatacttttcaacatacaaaacaaaaacaatgacaataaagaaacatatactatcttctctccagcattgttaagttaaatacatggatggtttaatttcctgaaagaaaacttttgctctttctataaaacaaatgaaaatcacatgctgacaccctaaactcttccatagtgttcgatggtacacaattacaatgaaaggttttagaaatcaaatctaaatgccatagattttaattaagtgtcctaatcattcagtccttggctccttgcaagttgcaaggttcaatagtaaacaaccaataggggaaaaagcaaagctgtttctgctgtttgaaattttatatatgaacaagtcatcgaagtgatgccgcttttacttggtaaacacatttatctccatttttttctagacctttcagagtacactagtgaaagtttccaattaactccctccttacttgcttttattcagctcaaatttcataattaccgatgaaatgaacaaactaattgcatgcctaaaaatctgctatcagcctatcacatccttatggacaacaatgtgcaaagtagccactcaattcaatagccagtgggtgtttgatcaatacatcactaagttcaaaagtgtagagggtcaattgaatgagctgcgaaataattcacatagatgcaaggaaaaaaagaagtattgaagaaacgttatgcagggtgctccaaataaaatgataagctaacaaggtgtatacttaccccagaattattcatcttccagatttctaaaatacttccatcaagaaaagctgctccagtcagcagtacactgcagtacagagttgtcaacatgagctaacatctcaaactctaaaatgctgttacatttcaaatactaaaatacttccagcagtagaatacacagaactgctgcaaaaaagtagtgtgtggaatgacatgagtctccaacatcagggtgcgttatttgacagattttgacccaatacatggcattttgttcttcccgtcaccttgctcaaaatctatgtatagtaccagatctggctggtaccaacaatagctactctaatttattttggtagttgctatcttgctggtttaactgtctcagcagtcgttaaaatacaaactgaattgatgagcttcctttttacgaagaaccattggaacatcaatggtcataaagatttgatcctttttcttatggaacagcaacgataatacttttttatggaaccgttgaatccacaccaagtgaattcatgtttgacacaacagaaatggtcataaagactaaatcctcttctttcgtaggtcataaatgggcatgcaatttcaacggtattcattttatctgtactcggcaacatttgcaggtttggttctattttgatctcggtcagacatacatgaacatcctatgctgtcctattatttatgaacttggcaattgctttttccacaatgattccctcgagaaaagccagcaatgtaacggatcagc

SEQ ID NO: 61792 - DNA, 1855 bp, Oryza sativa
aggaggaggcgcggctgtacaaggaggacgagcggatgcggaggtcgtactcggcgcggagtcggtcgtcggagaggaccctgtaggcgtcggaggcgaggcggaagcggcgcgcggcgtcggcgcgcgcggccgcgtcgggggagtgggcgtggcggtccgggtggtcgcggagcgcgcggcggcggaaggcggccttcacctcggccttggtggcgtcctgccgcagccccagcgtctggtagtggtcgccgcccatcgccaccggcggcgacgaccgcggcagcttggagaggatctcgccggccggtggatcacgaaatttctcggcgagggagaaggggaaggaggaggcgatggagcgcgacgacggttgcgtggcgtggcgtggcctttcttcccgccgcgcgtttcctcgggccctctaagcccggcccagttaggcagtcagtttagaaaatggaataagtgcactttcactccctcaaaaaataagtcaaatctgatctcgcacatgtcgaggagatatttaactatttgccacttttagacaactatttgccactggacccacatgtcatagacacatgtagacccacgtgtcattgatatagtggtggcaaatagttaaatactaaatctaaaagtggcaaatagttaaacggtgcaaaataactaagttcaacatgacattgagatatgttgaactcttaactatttaaacggtgcaaaataactatctcggtggtttttggggtggtttttcactgacatggcccattgacctagtctagccgctaagttcgcttcgccccggcaggagcttgcccccaactgctgccactaccctcgtcctcccatcgctaccgtcgtcgttgtggagaagggaaccagaaggggagaggaagataagggggagaagataaaggggggaggaggaagaaaggaaagagagaggatgacatgtggcccccataatgatgacttagcggttggactaggtcaatgggccatattagcgaaaaccacactaaaaaccatcgagggagtcatatgttacaccagttttaatagttaagggttcaaaatatctgacattgcaattgagggatacaaattagatttgatgtatatttgagggagtcaaagtggacttattccctacaaaattgtactccctacaagatgctcctaccccacgcgcgggggccttgtacggggagcttaaggtcctaagaacttgtttgttggtacttgatagccaacttctgagaatataaagaagctgattttctaacttctaagtttaatttatttgctaaaatatataacttctgagtatccgagtgataatttgaactattcgagggaagcttttagcaattgcagcttttaacaaaatctccaactccaccaaacatgtcctaagtcgcgtgtgcggtggactagaaaggtattggtggggtccactggtcgttccacttcaccaaaaagaaatcttcccacgcgcatgccccttcccttttttctttcaggaaaaagttccttctgcgtgtgtttcttctctcttatcttgttttggagttgacttgaacaaactttcaacttagatttaaaaattttcaagtcaagatttttgaaaactttcaactcagttttgaaaaatttcaagtcaagatttgaaaactttcaactcagattcaaaaaatgtttaactcagatttgaaaactttcaagtccagatttgaaatttaaacttagagtgaaaactttcaacttagattgaaatttaaacttagagtgaaaactttcaacaaggatttaacaactttgaactgaagatttgaaactttca

SEQ ID NO: 61793 - DNA, 8990 bp, Oryza sativa
ttctgcacaattatgacataaatcctgtacttttcgataaaccattgttacaaaactctgtagaacattgatttatcttcttatgtgaatcattttgcgataaaaatgcactgaaaccattggaaggatggtagttctctcccaaagcatagtaatttcatgagtatacaacacatagctgcaccctattagacgtgtcaacatgctaacaccagcttaactcgattcaagatattaatggtgaggatgaagagttcatcagacaaaggtatatatggcaatctaacagatatatagaaagaatgctaaccttgctctcatcttcttgcacagtttcatgattttcctgagaatctacctcctgagaggcatctgacgctttcttttcatcagcagcttgcttttcggcttcttccttcatcctcttttcttccttttcttttcttaagcgttcctcttcctctgccttctctatcaatttcttttgttctgcacaacatgagaagtcatagtttaacacaaaataaactatccattgaaaattagcagcgccaacagcatttcccaacataacattctttggtaaatgactcaagacaaaccgccacgaagagcacacctgtgagcttgtcaacaaggccttgtagtattttctcttcacccttcagtttcgctagctctgcctcgtctttagcaaatgccacttttgccttttgaatttcctgatttcgaataacaactccgcttttatatgtagctacttttttcttcaatttatcccttgccgctttaccagcctcccagcacgtattcttgcaagtgacattgctatcatactcatcactcccgtcgcagcaatctaagaggcagcgacaaacacatatgggtaattagaaaaaaatatagcgggaattccctcaagcactatgtttacggaacaaaagcaccctaatctctagccttacaattgattttgtgtacatttactgtgtttacatttgaatgatacagagaatggccaccgattataatcctcttaccacagataccatcattcactcgcgacgagaagatcgtgatgggagaatgcccagcattctggcagtagaacttcccctccgggcacgccgatgtccctgcgccaaggcaaaaagtaaacacaattcgattaaacagctctcttagattgcctacagtaagtagattcgagctactagcacaaacacgagaacctaaaaccagaacacctccgcaaaaagctaaggcaaaaaaaaagggataatctttttcaggcgagagcaaggaagcaacctggctcgtcggtgccgtcggggcagtcgcagaagtcgtcgttgagcttgtccctggcgaacctccccgatccgtccctgcacctgatcacgccgcccctgaagtacgcctcgtctgcagtgcagtgcagccagccacccccgcccccacaggcaccaaatcaagaaccgcatcaagcaccaagaaagagagatacaggcagatccggggggggagaaaaagaacaagatggaaccttgcggcgggatgccgagggtgtcgagcggcggcctggaggcggctgcggaggcggagatccggaggaggaggaggaggaggatcgcgtggagccccatggccgcgcggcgcggcggcagggggtggtgggcgacggcgtcggcgtgcgtgtgtctctcccctcctcctccgcctcccagggaaacgggaagtgtagcaggggagggcgagaggagcagtggtgccccgtcttcaattcaacacggggttgctgaaatttcttgatatgcagtttacagagcatgagattttaatggctgattgattgcagtttacagagcatgagattgtactgtaatccttccgtcccgaaatataagcattggattatacgattatagcttattcgattgttttatggttggtatggcgcgagattatccctcttatacatgcaggatatctaggttttctcgatcatcacattttattactgaaattgagatttatttgtttctgtaaagtaggcgattggctatttggaacttatttagattcactcaaattatacttatgtgctggattcactttatagttttcaaaaaaaaaagtcttaagttgatctatctaagggacagagcaggagcgccacgagtagtgtccaaggcggatgcacgagggggggggggacaagcgagctccatagttggcaatctttcctgctgccatgacaaaaagatatagacggcatatggactaaaaggatgagggagagaggatagagaggaatgaaaaaaatgattatatttactgtaactgacatgcaggtcctacttttttttcctacttattatgtcaagtaggcgtcacgtagacgtcatgtcaaatgaaaaccaaatcaaacatcacgtggatgtcacgtcagctaaaaatcaccgtctaaagcatcttggaactatatttgtactggttttgaaagataaaagatactcctatattggctttgttcggacggcttagctacagcagcattgtggctacgctgcagccaaccagccagtagctacaggagttataactatccagcagcaagcaacaacttcctgtaactatgtgtttgtgtagccgaacggctacgttgtacaacacaacttaaaacgctacagcaaagtcttaccgaacatgctaattgtatccagttttgcggttgagagatatgatttaaactcaacctataatgaggaaccaaatttgaactttctccacccgtaaacccacgtagggcatatgccatttaggtgggccttccccaaatccatgatgagcccagtagttggctgggccttcaatatgcatcatcagcccatcggtgcagttaggaacaaggtcactgtgtaaaaggatgtttggtttgctcccaaagtttaccaaagattgccaacttgccacacctcatgttagtcaagtttgaccaagttagtctattgtttagttcatagccacacttgtggcaagattccttctcatctgtttgggtcccacatgtcatcaactcaccaaagcgtggcacaatccaattttgctagctaagttgtggctcactttttgtaagccacaatttaggcaagtgtggcataaaaaatatggtgaatggtggcaaacttagtatagcatccaaacaacccctaagtacccctggttttgactggcctatcttttcgcttattcttatcagccaaaatttaaaattttaaacttaaattcaaagttgattttaagattttgttttcatttgcaaatatgttgtttcgcttatgcttaaaaacaaccaaccaatggatccggacatctttgtgtttgaggaaaagggaaaagagaagaatggagaggtatacaaaataaggtgagtcattagtgcatgattaaattagtattaacaattttaaattttaaaaaaatatttatatgattttttaaagcaattttcctatatttttttaagaaaaacaccgtttaatagttcgggaagcgtgcgcatgaaaaacgagataaatcttcaatctttcacctgctgaggaacgcagtcatattgagattcatatataaaagtagacttactttgagatgaaatggagggtgtatttttttgttgaaaaaaaagttaaatagcatccctttgcatgcccttgacaatttttgagcaggatcacattaagataatgtttaatttgatatgtatacgagtgttacatgtaatactactagttatacatgcggtactactaatactgtgtgcaaaattaattaattgtgtgataactcaacacacgcgtttgctgcatgtgtagtattgtacaagtaggcgtatgcatctccaccccatgaatcaacggtagatagatagcttccctgcacgaatctcaatgcgggttcctcggatcgtggcggctgttggcgccggagctcgggtagtcctgcgtcgtctgcatgtccatccgcctcgccgccgccgccgccgcctcgtcggcgacgaccggcagctctccctctactccggccatccccaccaccgccgcgtcctccgccgtcgacgtcgtcggcatcaccaccgccgccgcctccctgggaagcagcgccctccggtagccgacgacgctggtggtggttgtggtcaccgccgccgccgccgccgccgccgccgctgcaaggaggagaaaacacagggcaaagatgaggagcatggcctccggcgagagttccggcgagccgaagagctcgatcaagccgtacaaaccgtggacgaggaagacgcaggagagggcggccagcgccgccaggatgaaaggcaccgagcaccgcgccttcgccgccgccgtcctcatcgccggccagccaccaatccaatccaatccaagctagaggaagaagaagaagctagctagctaagccagagtactatgggcagtgacgacgagctacacagattaattcagattggttgctcgcccctttatatagcggaagaagtacaaggaatgtgtgggttgctgtggccaggaagcagccatgggtgaggtagatatatatgtatgcaaagatcgatagatgagaggtcgcgaggtagaagaagggtcacatcaaatggaggtcaaacgagcacacaatcactagatcccactgacactaccaatgtgtacttagagtaattgtttagggtttattaccagcaagcaatatgtagggatgcggattttcaatctctacgtagggatgtggattttcattccttgagagagaggatatctccatgttctatgtatgccgcgttatccagaattttttctaaaaaaagaagatagaataaatcaatatgtaatatatttattgtacaaacatgttatcagggctatggataccacatacctaatagtagttggctaaatctcgacaggactcaccacataccatgttttatacggaaacaaccttcgggtatagaaggagttccggataaggaaagataaatagagttctacatagaaacgacaaggattactcggattgtatccatattggtttccctagttctacttggaaaagggaacacgtatgggtataaatacaagaccccctaggaggagaggggggacgaaacaatagatcaagacacaagatcaacatataagctaacatgcaccaagacaagacgccggatatcgacttcagagataagcatggctagtcccctacgatgtctacggatactgtcaggagagacatagcgctgtctttgatctcgctggatgcggattcgaggaggaaggctaccctggcgtcgactacgagtcagcacttcataccgccaagtcgacaacagttagataggctaccccaaatattgtactggtgtgattatggtgaataaaagcaacgaccggcttcggccaacaggagtagggttattacctgacaattcaggggcccgaacctgtataaaaatcctcgttcccatctcatttacctcaatcttgcatatatcctaataccaacgatccccatactatgcaaataccgtagtcgtgacatcaaacgtcgacacatgtaaattcaacttggacaaaaaaaagttgatatttctcatttatattgatctaccatgttatgtttaaaataaaaaattatttatgacaattggatttaccttaaaaatgagagcgaaatctccttaatgaataaagagttttccgctattgtctatctagtacgaatatgggacatatcgagaatcatagttctatcatatacttcatccattctaaaaaaaaccaattccgtatttagggatataggatgtgacaacgaatctgaatattcgttatactatatatgttatatcatagtatgaggttggttttttatttttggcggagggagtattagctaggatatttttagttagagagagtactatagctggtagtagactactagctaggttaggcttaggtgtagaatcattggtctttttggcgcgaaaaggtggggtcgtgggcgtgcactccactaacacacacaagggtcgatcacgcgcactagaaatgggcgggattacggccacgtatatacgaccatgcacatacatgcgtcgttgcgtttcactggcatccactacgatccaactgtttaattgcgccgtgattatctatcaatctatctaatcttggctggaatttcatcgatcgaaaagccaacgagctttaattagtttggccatggagatcgatcagaaataatggaattagtcagaaaataattaatggttaattatccagtggatgatcacacgttttcaacgtcgaaccatctcgatcgatctgacatgcatgtatgatgtattggtggcagtggatctgtatgtttgtgtgtgatacattaggcatgttgagatctccatgagagataaagcatggtgatctgatgacacagacataagcattgacctgcacatgatcacccttagctttatgctggattgattgacgggcaagtacagaaaaagggaaaaccttataagtaatttacgaccaagatctagctgtttggcaatttggcatacattttctttaagaaacacgaacgcctcgtcgcccaaagatacatcgtttatatcattaaaaaaataattagacataaatacgatcactcgtgtcaagtctaaaacttgaatccatgtgggctgagatttcaccaaacctaatcagttgagctatactcacctcgcaacaatttggcatacataattttagttctcttcatcgtaaaccgtaagtatttttagagctgaacgcatgagtattaataagaaactacataaaaatgatcgtaggaaatcacgattagttgagaagataaattagctaaagaaattaaataaagaataattataattgattgagatgagacgataactagagaaatagcttcatttcaaaacaaagtttaagtggtagaaatagcaacttctgactatatatgtatctagacattcccttacaaatacaaaacagaagaatattatattttggtacggactgtacaacttcagagtgagttttttttttcttttgaagaaatctctgaaagatatcgtctcttcgatcttgtctgaaagatatcgtctcgcagctgcaaagaaagttttctgacggctgtttcgtcgatatatccgggctagctccatgaaaattcaaggagacgcacccctgccgtgtgtgaagtgtcggtcggtatatcacatcatatatatcagtcttcaaaagaaaaaaaaactccctttaccccctaagggattttgacattttactggtattgtttgaccatttgccttattaaaaaatagaattattatttattttatttgtgacttattatccaaagtactttaagtacaactttttattttttatatttgtacaaattttttgaataagacaagtgattaaacgtcacaagaaatagtgaatatcccttatattacgatacggaggtggtatatcacatcattaattggacatgacctaatttctttcggccacggaatttatccaagccgttcatactgctaaacacgtgtggcaattagctgtatagctagctggagtagtactagctagaaccgttactaccaaacacagatctacctttaatacagatcaggcatgatcgagatcgagatggttaaattaatctctcacttgagagtcaaaccacttgcaaaaagtcagcatggaaagaaaagacgataaagctagatcgacacagtacatatatcatgttcagattgagatgatcgatcgaagagacggcgacgatatatatgtatccaatctagaattaattagtactcccttccgcttcagattataaaacattttaactttagtaaaagttaaactattataaatttaactaattttataaaagaaagtagtgctgctattgtaaatattactatttttttctataaaattagttaaacttagagtagtttgactttaacaaaatttaaaacatcttataacctgaaacggaggaagtggtaagttgcaaccggattaattattctgcaacacacttttaaagatacgatttttatttaaaaagaactttcttctgttatatacatgcatcatgcatcacttaaacgacagattatatttaattagattgctagattgattactgatcgaataagatgcatctcttttcttttattttagtgtgtgttccaaacttaacttttcgttagtgcccaagacccttacttgtaatacgagacactatatatagcttctgttaaagatcagatatcttatttcattacagaaagaaaaatattttctatataattaagtagatatatatgatagaacttttcataaaaagcgctagcttagacatgcagataaaattaaacatacatagtccatgcttagtccacacagtgagaatccgtgatacaagtacagagcatccgtagaaatgggcaacttgcaagtcgtgtcgtcaattcgaacagatttatgcgaggattcgggtatttggcaagagagagagagagagaggcgccacctttgatttttgctgctgctaattgtcacacacacacatacacatatatatatcgacatagtgtgggcccggatcctctgcaataatacagtgaacaatgtgagaagcaagataaatcaatgcagtgaacaatgtcgatctattgtagcaacagtaacagttgagtaccacaacagatttactgtagcacactatctgattcttggtttttgatcgaacggtctccatttcctctaataccaggtacttcctctgtattgtattttaatgtatgacgctgttgactttttaactaacgttcgaccattcgtcttatttaaattttttatgca

SEQ ID NO: 61794 - DNA, 8853 bp, Oryza sativa
caaaccagatgcaaatcaaacataaattcagagtcgccgccaaggcacagagcaactagattactcacctgaaaaatctgaaatcttggtctactccaccacagtttcagacacttgacagacaggttacacttaaaaactcaaatccatataaacaccacaaatctttatcatacgtcagtaccagaacctcagagatggaaatttatcaaatcatctaatggtagccatcctgaaattgtacttattttttcactgtgccaagttgagtaaaggcttgcacaacctttaatttcccctgcatcaactttacttagctgagctgcaaagcttcttgagaaaaggccacatcttgcaaaatctcaaggccaaagtacagagcttaaatgcagatccatgcatgcaccaatgacctatgtaaagtaaaggacccggcttagcaaagagaaaaaggccagggttgggtagggccacacatcacatgatcattctgtactaattactcagaccatttcctgtacaaattactcagagcatctgctgtgtaattctgtacaacactatatagatcaatagatgcacttgagagaacttctaatccagtgtgtttattaattctgccgatctactccccccatttaaaattatgtcattctagatttatatgtatcatcaatttatagaaattcatataatttaacgtcataagatttatatttttatattcaccatgaaaagtaatttcgtaatatatactacatacatcccaaaatataacaactttcaagtacaaatctagataaaagtatgtctagattatcaccaaaagttagtatattctaggatggagggattaattaatatgttgttaaacataaaaacatcctgttaaaccacacaaatttaaaaaaatggttgttaaacttaggataaaactaaaacaataagtaattcgaaacggacggagtaattaaaatgaaggagcatcataggataggcatgctcgttattcagccgtgacttctgagaggttcttcaattcgctctaatttcattcatgcatgaccgaatggctattttctttttaaactaagtttcagatcatggaaaatagaattgtttttcttgtggatgaaaggtgcaaccagctttgtgtctttttctggatctaggtggcccatttgttggaggatcatttcgatcggctttggcttgtggtggtgaagagctgtagatcgatgcggatgtgtactggttactgatgtgaagttctcctattaatgacgtgacatttaagagataaacttatcgctttggcttatttatgctgagcattgaacacttctcgttaataaatttcctggggcattttctatttttcttgatctgtaatactccacccattttaaaatgtagctatttctaaaatttaaacatgtctaaaaaaatatagctattcctaggtcaatgctattatgtcaattataatcctatgaatccaaaaagccttattcgcgaacgtgcacacaattgctagcgaacacttcctgcctgtataacaacaataggttagggttaaggggtggaggggggctaagggggctgggctgtcggaacgtgcctacggcttgcgaacacgctcgcccattagacccaccctatgaaccacctcgcacccactaacctacatattccttcatgtcttttgtgttttaaagaaggcattgtggtatttttacctttattccttactccctcgaaaaacctagaaatagacattttgggatagaaggattatgcactacaccctccatcttttaattgtagttttagtcttagaattcgtccttaaaaatgtgtggttttagagtggtccactatacctctttaatgctactactaatagtaatctttttttctcatttgtagttattgaatcactacaaatcatttatttcggttttagagtagttgtttggaagaaagggatttgctctgtgcatttgattggagaagtacagaatcaccacttgttttctctcttgtccatacgggaaaatttccatgaagttttgatgtagcttcgttttcgatgaaatggtaggaaaagaagagaaaataaatataaaccttaggaatactattcacgaattcctttgttccaaacggcgcaacagtaaactcctccaagaggttgccctttctccatctcctccatcttcccatatgagcttttacttgttgaataaattaagagcttacataagctgattgtcaaataattaaaacaaatcatgagtatattaagaattgatgcactagaccttggattaaaaccacatgactcttgacagttgccttagcactgtcaagtactccatccgtattagaataaatttattttttggcacatcacatttattctaaaataagttaatttttaagtaaccattataccggagcttataaaaatacaagataaatacataagggtatcctaatatatttttgtattgatatatatatatatatatatatatatatatatatatatatatatgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgatggattaaaaaataaatttattttagtacggaaatcgtactttactagcatccataacatcatcttgtctcaccattaaaagaaaacagcattatgctgtccccgggcctcgcataattgcgttgctcctcccctcctccctcgaaaaccaaaaaaaaaaaataccaccacgaaattatttctccttttcgttttcggaaaaagtacgaattaccccctgaaccacaaaaccgaacattttacaccttcaactatttttaccgagcaaataaccccctgaatcaatccggagtagttttacgcctacgtgtcagtcagtctagtcagtaattatttattaaaaaagtcggtggggaccacctgccagattctctctcctctctatctctttcccctctctctatctcgccgcgttgtgccgaagaactcctacatgcgctcgcccgtcggccatcggtggagctcaggggatgctgctgaagcacgcggcggcggccagcccgtcgagctcgccagccgggcctccacctccttgtcggcataacatcgcagcaagtcgctacgcggtagcggaagtactcccgcacggcggagctcgggcggcggcggcaagcccgtcaagctcgccggccgggcgtcctcctcctcgtcggcacagcagcacgttgtcggccgaagcactcctgcatgcgctcgcctggcggccaacggtggaactcgggcgaaagaggatgcaacgacggcggagccggagctcgcgcgcaggcagtgacgagcccgctgccgctgtcgtgctttctcacactttgtcagccacgcccggaaaatcctaacaacctacttctagctgccaacaaacactcagaagattggatcaaatcagtacacggaggaagacgagattttggtgccgcgtactgctgctgctacttttctggtttgttatcaacataaataggaaaactacatgcagactcgccatcttcttgtgggtgtcgttccaagacgatgagtccggccgccgcgctcgccattttctcgcgcaagtccggcgccggctgccgctcatcgaccatcgccatcttcttgcacaagtccggcgctgaggcccagctcgtgagcttgactggccagcgtccaccggcgcgcgcctcatactcggcctctgccgccaggaggctcgcagccgccggcgcgccgctcgtcctcggcctccgtcggcgcgtgggattcctcgtcggccttcggcgtgagagagatagagagcggtgggagaggaaagagatagagaggagatagaatctggcaggtgggccccactgacttttttaataaaaagtattgctgactagactgccacgtaggcgtaaaatcacttcggattaatttagaaggttatttgtccggtaaaactagttgagagtgtaaaatgtccgattttgtgatttaggggttaattcgatcgcacgatagttcaagtgggtaattcttattttttcctttcgttctcccccgcgatcgagcgacggcgaatccaatccaggacaaaggcacacccacgtgcggatgcctcgccatgccatgccggcgtggggcccactccgccagcgactgcgggtgggcccggataaaggtggggcccacgggtgggggcccgggggtggcacgtgggcgtgctggtgtggtggtggtggtggggccgaaaagctgacggcggcgaggcgactttcccgggctctccgttggccgtcgctgtcgctttatcctcgcttttgggtgtgggccccactcgctgaacgtgaaatggacgcgcagatcagatgtgggcaacgccaaaatatgccacggccacacgtaacccttacacaaatctcctgctctttttttaaaattttttttgaaaggttggttttttcaaaaacttattacgaaactagattgtaagaaaagcttcattaaatactatttttcggttgaagttttttttttgcacaatctagtttcacagtaagttttttttaaaaataaccaatttgtcaaaaagagggggggacacaactctaagcatagtagtggcggagctaaaacgaaatataggtattactatgcttgaagtgcacatatggtgaaaataaataaataaataaaattagcttgggttgttcgacatcccctagatacatatagctccgctcccgatattaggctcttgctccaaatattaggtgtagcataaaaagaaaaagaatactccaaatataggtgaggagtatatgcagaaattggaagacacgggcaaggttcacagtaccaacgaaaaccgatcgaattccgcaaaattttgacgtttcgacacggctcggaatcaagtttcgatttcgaaggttaaacagtagatttagtcaaaattcatcaaaaaccgtgataccgatggagctcaaaatttagtggtcaaccggtaatgtaaaccatggacacgggaaaatatgtcgcagtcgcatacggcaattttccgtattggtgtatttttatgtttgtcgctactactactatattatccatttgcactgcatttcaaagttgggcatcgctttaccacaagcgctcagattgtatacatactaatatatgctactcttagaaaattaagggcttatttagttggtgaaatgaaaatttttgggtgtcacgtcggatgtttgaccagatgtcgaaaggggtcttcggacacgaatgaaaaaactaatttcataacttgtctggaaaccacgagacgaatcttttgagcctaattaaaccatcattagcacatgtaggttactgtagcacttatggctaatcatggactaattaggctcataatattcgtctcgcgatttacatgtaaactgtgcaattagttttttctttttatctatatttaatgctccatacatgtgtctaaagattcgatgtgatgtttttacgaaaagtttttggagaactaaacagggcttaagtaaaactagtcatgtagtctctccttttgcaggacttttgatctagtttaagaacttttgtatatgatttgttagttagcttagcttttaagaaggttttgatatgagttaatgtatttacaaaatattgattggtctaatcaactatagatttagctaaattatgctatatttcttttaaaaaaaggattcactagaagcctcctgtgttttttccctcatagtctttgcccgtatcatgtaattcccatatgtttagccttaccgtttaatccaatgaacattgtttattaaaattctttatccaacagttttcgatgacatgaagtatttaggggctgttcagattgatgtcattttcaaccgtaccatttattgtaaaattatcaaaaaattaactacatttagtttattgtcaggctttgagaaatatataagaaattctgccaaaattttgataatattatcaacttgtcaaaattttaacattgccaaaatttggtaagatttattttagctataatctgaacaaccttagagtatcataatttaaagtgcaatatgaattgaaaaatggaaccccattgaattttgaaagtagcacaattttttttaattgctagagaggctggaagggcaagtcgaggagcaacgcaaacgcaagtgttctcaaaaaattaaaaacgcaaacgcaattagttcgagtagggcccacctacctgccaaaaagttcatgctctgaaattgcctcgtcaaaagcatccccgtgacgtggatccgccagcggctcacgtgaccggctgcagcaggtcgctgcccgttgtcaattcgggcctggttttcgaaaggacaacacaaaattcgggaaaattcgagttcataaatttataatatgattttataatttataacaaattggtattgtaaaattgtaagttcacgacacctataattacgtgtcagatcccttatgatttcatatacttagagcaagtttaacagtttagccaacttctagctctaaatcatttataaccaatgcaatagctaattcatacaatactccctctggttctatattaattgacgttttggacaagattgaggttaaacttttataactttgaccatcaataactttaaaaatatttagtttaaagaaactagaaaaacatatatagatttgtctttcaaaacactataataaaaataaacatgcatttatttattgtatatattataatagaaaaataaggtcaaagttatatcttatagaacgtgtcattgtccaaagcgtcaattaaaataaaactggagggagtagatgcttactacactattaataactggtcacacctatcatacatgtattacgtcttggagtccgtgctacagctgattataaatctgtaacccactgctcttctctctattcatttatctctttaaaatatgtttatagctagcttataatctgctactatacctgctctaatataacacctaatggttaagatttattgtctccatttaaaaatataaacgcttttagctgtgcagtgagtactgagggagtaacatttccctattacctggaaaagaccctcatgcatacacataatcacgcgcctacatcacacacacattaaaccttatgatttgaatgcaaggcatcctataattctatccactagtagtattcaaacttctaaattagactaaagcgaaatctgttttactattcatctgtcagaaaatgtattttataggttgtttagtatatattaaggttaagggaaaatatttctttactcgtctcagtggttaaaatttaggtaaattttgtaacaagatattgtggctgcgcggttttagatccgcgcaaagtgatttttaaagaaaggtaatctttaaagttagatatttgctggtgaacaccgtatccattaaaacaataattttcaggtgaggaagagagagtaatcacgtgaaacgtcaaaaattctcatgggcccacatgtcagctctcctatcactcttcctaaagaacttaacggaaagccgctaacgaaatctgttaggtgatggcatttctatgacaaattaccttgtacgataatattttataaaattcacgcttatcgatgatattttgtgaaatcgggtgtttgtcaatgacattatttgtattttctcaaaagagaaaaaaaatctttttagagttgaccggtgcagccggtctccctcccataccctgcaggctgcagcagcaatcaatcagaaagcgcgactcagctagtactacttagagcaaggataatggtgagctataaactagctaaatgcttatgtggaagagagagataaataaaagtggagagtgttgactcttacgcaagagttagctacacacaagctccaagaaatatacattaaatttatagagagataaagagagaggatgaaaaaaataaagctaaccttacagctaacattatatatgttagctttaacattaacttataataagtagtgggctgtactactaaacttgctcttagggtggatagtgagccagctcggctcggtaaagctcgttaggataacgagttggctcggctcgttaggaccggctcgttatcctaacgagctaaaaacccggctcggctcgtttaaaagctctagctagctcgttaagctcgcgagccaaaccatacaaaaactgcctctagccctcagcaacagccaacagcaagcatgcataatgatagtacgataaattgttacatgaaaatatcaaaggaggaggccgagcacgaggagcagcttcgacgccgacgagagggagccgaaggtcgacgtcgtggcgacgccgtgggagcggcatggggagaggaaggcgctgcagaggcctgggttaccggcgaatgacgtggcgttgaagtaggcgaactggccggtcgctgggacctcgccggagagattgttgtcggagaaatcgacggccgttaggctctgcattccggcgcgttgtgggacagattgagatagttgaggattcgtagcccggcggcaccgatggccatggggttggcggcgttgagttccttcggtggacggtggctgaggagtggccggatgcggcggcggcgccgctccttcggtggcgtggcggcggcgcttggcggtggtggct

SEQ ID NO: 61795 - DNA, 5111 bp, Oryza sativa
  unsure (1)..(5111): unsure at all n locations
ggccgcctcctcctccgcccagtgacatgccacccgccgccgccgccgccgctgcatcatccccgctcgtcgccgtcgtcgtgctgcgcccgaggaggaggaggaggagccggtgccggtgccggtgccggtggtggcagcgcggacgagatcggggcgccgctatggccgcgcttaggcagggcgacgaccccgccatcaagctcttcggccgcaccatccccctcctcctcgacccccccgccgccgccgccgccgccgccgacgaggtgagccatcgatttcatccaatgccaatagggaagtagtcggagagaggaatctttatctaactccctccccgctttggacgagatgcgacgcgcctcgctttctctctctctttctctcttttcctggctgctttttggggtatcgatgctttgggtttgctcttctagttcgtgtcggctaattaggagattgagaaatgagtttaaaaaagggattaattctttgccgccatggtgttcgatgcaaattctcaagcacattcttcttgttttttctctctccaaagaattcaaataccgccatggtgttcgatgcacggctctcaatacactttttggcaaatactaaattgacaacttttgcttagatccattttgtaaaaagtactccaaaacagcaaaacttttactacccccgtcccaaaataagtgcagccatgagtttcagcgccctactttgatcatccgtcttattttaaatttttttataattagcaattttgtagttataagatgataaaacataaatactaatttactcgtgaattatgtttttaattcttttcaaaaaattttcaaataagacgagttgttaaagttgggcgcggaaaaccatgactgcacttattttgggacggatggagtactattttggaggaactaaacagggcctaaatatactaatataactagagaaaagaacatttttttttcagttttagctcatttatttgaacaaatagagtgggtcaacggtatattagtgacccatgctaatccccaacctcatatttgttggtaggaaaattctgttctagaaaattctgttctatcctttcttgatttcttggcaacatttggggtaagattctgggagtttgattggcttatcttagctttctttgtgcaaagaaccatctttcgataaccatatgcagaacctagaatagatggtactaagtctgtttgtcctgaaacctgatagactggatagtccgtgcctttgaaccaaattgcttatcaggacttgatttcagtgcacttgcactctagtatgggttaacttttgttgccaaaggtactttttacgtactagtatatgagttattccagcaagcaattctggaaaaaaagaaaaaaaaaacagactctaaatgctaaattggagtctggaaaagtagtgttatactatgtactatgatagtggaactgagccttagttttcaaacagtagttgtacgtacctctgaaaaccgtattggtttgcaatttggtttcaaaacactggagaagggactctgatcagctctctgcaagaaggaactgaaaatgtgtcatatatcgtacatgtcgattgctatttgctacagagcaaatttgccatacatcaaacaattttgcatgtcaaactgactccaaagatgattttactaccagccttaaaaataaaatgcccactcattacttatttacatatgcacattgtattgttgctatgtaacaggtttgatactgagtagctctggtactaacatgtgaagtattgagctatgaaactgaagtaatgttttgctcgaagtgctgctttatgcttaaactcaagtgcgccagaaaacagttgcatagccacacagtgataacttgaaatgttaacatatggtatttttagcaaccccaagtatgaactagagttttacaagtgcaagtgaatactgagtataatagagaaaagatcccaacggggagaaattcttagtaacattaggcaataacttatcgcacaaacatggcgactctgattattcagggataacataaaatgatttatatttaactgaaggacattgaaactgcaacagaacattgtaatggcgatgtatcagttgtgccatcaggtagtttccgtgaccccacatgattcagctgaagctgaagaaagactttcatgaaaatttaggccagtagcacctgcatcattttgaatataacatggcttatatgcctcataataattgaatacttgacactatcacactatcacagttttaacattttgctatacttttagctaaatgatccaaaatctctgcttgatattttattattttcttacctcttatgtataatccatttcaggtcatgcctaatttaggaaatggtgtaaaaaccaataatgacttacctttagtctcagacaagcttttgattgtcaaaggtattcctttttgtcccaacaatagtaagaaaaatgatttacaaggcatcagcagaccggatggaagaatagaaatcgattccatgactgaggatgttaagactgagcctgatggatctgtccctgagaagatactcaagaagccagataagattctgccatgtccacgctgcaatagcatggaaacaaagttctgctacttcaacaactacaatgttcaccagcccaggcacttctgcaggaactgccaaagatattggaccgctggtggagctatgaggaatgtcccagttggtgctggaagacgcagaaataagcatgtgtcaaaatactgtcaggcgatgatgacgtgcaataatactgtagctcctggagatgtttctgatgtggttcaccatcaggttattacacatggatcttctctccttccagcaacactgaaggaaaatgaaacacctacagaattcatatcagaagtaccaccatgtaagtcttcagcttcaatccttgatattggagagccgaatgatactgaccttgttcccttggcctctggtgataacaaggaagaaaaatcatgtgcatcttctgtggtagtatccagctgttcagagaatctgatgccagataatgcaattatgaaagagccaaacaacaggtcaggatgttgtaatggtgtggcattgcctttccctactggacctgctttggtgctcccctggagtcttggatggaacagtgttgctctcatgccagctacccagtgctcgatgcagcccgttcttgggttaaaagatgggataccctgcccgccttcatggccaccgcaactgatggtgccggccccaggaatctgtactcctgttgttccaatccctcttgtgccacctctgtggagctgcttccctggctggcctaatggaatgtggaatgcacaatgccctggaggtaatactactgtgctgccgtcaaccgctccaaacaaaatttcttgttcaggaagcagttctctggtgttgggaaagcattcaagagaagaaagcttgcaggaagaagagaaggcgagaaattacttatgggtacctaaaactcttaggattgatgatccagctgaggctgcaaagagttcaatttgggtgaccctagcatcaagcctgacgataaaggcatattcaagtctttccagccaaatgttgagaaaaatggcagggcaccagaatcgcctcaggctttgcaggccaatccagcagcattttcgcgttttcaatcgtttcaagagaagatttgaggagcttttttgtttgttttntgacataaggatcatactgctacctccacaggaatggtcacaatgtttctatccagtgtgatcttgagctcatatgttgctagagccagatcaaatctagcaactcaaatctggcagagttgccagtgatgaacttggttctgtggtaatgtttatgttgatcaaaaatctctgcttctccccaaggagagaattgtgagcttgtgatccggagctcaaaacatgctccatctgaaatcattagtcaatagctgtcgctgtgatggaggtgaaaaggataactgtgaagtctcttttttcttactttctttgaatttttagactggcattctgacgtttgtatatagcttctcaaaattcatgtaatggcttctatgttaacctgcagaaaatgcataattttgtaactggatggggatcaactccgtttggacataagcaaatcagcctagttatctcatttgcagcattgaaatttaccccaaactaacaccatatctgtcaataccattgggtcaaaatgaacacccatttctaaattatcaaaattcatttacctcactgaatcaaagggtgtaaaaaccctatgttgtgcacttgtgtggaggtgacagatagcatgaataaactgaagctaagaaactaaaaatacaaagataaatcagcttatgcaataggacaggatcatcgtagtgatagagtaagaggtaatataggtatataacactcttcaccttacagttgtgctggtcgacacaaggatgagaaacttgcatacatcaaacaatttatatttccttttcagtaaatgttagatgaacacatgcctacatacatacatcttggaggctaaacctatcaccttagtgctaaatgaatttactcgtatacacaccaaagaggcgaaaaacaacagaaaaaaaaagaaatttctataaaggagaattttctatagctatctccttgggtcatgcagacgtgtcattggaacttctgaacggttcacctgatttacattctcgaatttttctatctctcgggcaacttgaatatcactgggggtaaaatactctgtaaaggccttgattacaaaatgtggtaccattgctgcaacaacaatgataagcagcagtaaccaaaacaaacctgtccccattatatgaaagatggccctgaaatagttatattgagtcagtatgcaatcaatcaagaaattgcaaaaagaactcctatttcactttaggagatccattcaagaaaacatgatcatggtgctcgcattacatgatggatgtagcacaaacatgcttgcaaa

SEQ ID NO: 61796 - DNA, 1171 bp, Oryza sativa
aaccatctataaccaatttaatagccaattcatataatagttacctataaacatatactacaatattaatacatggtcccacctatcatacacacattgtgtcttggagctggctacatatctgtagcccggtgctcctctctctcctattttatcttctcaatatgtgtttatagctagcttatagcctactattttacctgctcttagcaccaggtgaaaatacagatcaaaacaaaaataaacttcactaacaatggaccagccaaatgaagaaagacgagaagaacagaggaccacagccaacagtgggaggaaatggacaaacaacacgctaagcgagcaccaattcgtaccagttcaggagctaattcaacgttaatgttccatccaatccacagaatccgcacgcggaatgacgcaatccaactaactatccaatctactacaagccaaaaacgcggacaaatcgaatacccagatcttcagaaactcgtatgcatcgctcatccatcgtcagcgtttcttgccgcttctaacgcgtcggtggcgggcaaatcaatccatccacagtacgaaaagtactactaccaacatccacaaacagccaaacgtacctgattttgagccaacaaaacatgactgatattgtcttttgaccagcagaatagtcagggggtgagaacccaagaatcagggacgagcaacggcctactgtgaaaacgaccgcacaaaagtcttgaagaaaataaaaggtggccaaaattaacaccccaagaacgaaatcacgcgcctgaaaagttggcaagaacagatagatagatagatcgatcgatcgttcgtctaaaatgcaccggaatcatcggatcgaacatggaccaaatctctttctaccctaatctccctctacatatttcaaaggatgttcccaagcgcatagatgaaacttctctctcttttttgaaaaccttaaattgcggatcaagaacaatagatcaagaagaggaaaaattaaaccgagagatcgaggagggaggcagggaggggattggagacacgaatgggaccttggtgtcgagcatgacggcgcagaggatgccggtgctctccatggcggcgcggaggttgtcgagcgtctcctggtggtactcgtgggatccgtgggagaagt

SEQ ID NO: 61797 - DNA, 2804 bp, Oryza sativa
gttgggttgggtccaacgggaaaggcctccacaatgtcggtcaaaactgtggggaggtgtgggccgggggactgacaggtggggcccaccccgggtgtgggtgggggctggtaaaaagatctccaggaataggatgtttcttgactggagggcatatttgcccagttgtccatccatgctgatgctggggggcggtggatacaaccaaggttgtctctcaggatcgagataggaagtatcattttgctcaaagtaatatcgtatcgtagtatcgggatactatgagattttctttttttaagtttaattaacatttatattaattatatatatagccattctatataaaaaaagtagtaatgatatatgtcatgcaaatagagagacatttatcaagagaaaccatgttggttttgatatatttaactgattttcatataaatttgagcatatttagttacattattttcaaaccatgttattttaaataatattttgtagtatcctagggattgtacgtttcggcttggtaggatcgtagtatcgtaagatactgggatacgaatcgggatactgacaaccttggatacaacttgctgccgttcgatctcctcttttggagatattttcagcgcatgtaaaacgagaaaaataattaatatataattaattaattattaataattataaatttaaaaagtatttatttaaattttttaaagcaatatatatatatataatttttttaaaaaatatcatttaacagtttgaaaagcgtgcaaaccaaaaacaagaaaattaaagtttgaagttgaagaaaacttggctttgtgttattttgtttgatagaatgtttaaatatattttgcattaatttcaaaatattaaaatgaaccaggatatgatgtttctaatcacgtaggttagtagtatattttaaaacagagggagtaataccttttatgtccgttcgagcacgtaaaatgagaaagccatttgtgtataattagttaaactttaatcattttaaacttatgagactatatttatatgatattttacaataacttatatataaaaagttttcacgtaaattatactgtttaacagtttaaaaagcacactaccgagtgccaaaataaaatatatatctttattaggggcatttaacatatcccatccacagaaatggtgttctcaaggaaaggaaagaaaatccactgaaatggtagtacatctatcatatctggtggtttgccctgctggtttccgttggctgtctcctgcaaaccgtgcacgcgcgccttgggagcgaagccgagtcgcacgcagaaattgaccgggcgcgtcgtacgacacacacgcagaaattaaatgcgtctcgttctagaagagttggagtcacgggggaatttctcgtcctctttttttgttggaaactttgaacgtctttgaacccaaaaaaaaaaaaaaggtcggtgggagaacaaaatcgcaaatggcttatgcatttcggatatgattaaaagaactcttttgatttcaatctccatcgtacaaatatcaagtttggcaccatgatgttacaaccgtttttgtatttttgcaaatgtatagtgcttcagttgtcagttcgataaaaatagcccttttttaaaaaaaaaaatcggtggagcatttcgttttctctcgtgtttaatagtggtatagacgtatagctgtttaaagttaatataataaataatatgtccccacagccagcaatagcgccccacctgctggtcgagatcaattagtacttattctattaaactaaaccatatgttcagattctcttctcgagcattctctctttaatctatgctctttccaccgaatcaacttaagtcctgtttggttacatgggctaatgtttaaccctcatcttttagtctcaaattagtcctcaaggatttaaacaggtgggctaattttgagctaatgtaaattagcccctcctcgaaacattagcccctccaaggggtgctaatggggctaattttgtgtggggaacatcaaaaagcagctctctctctccttctctctcctctctttctactctctccaccttttagccttaaattataccatggatccaaacataccaccctaggctaatgtttagcctaccaattcataactaaacattagctctcaaaattagccctgagctaatcttccaaacagggctctatacatatgccacgcgtatcgtgcatccgttctggcgaacattcccaacaactatatataaaaaaagaaaagacaaaatatttaaccatcagcgttcactaatttaacacctaacctacatatggcttacacatatggtaaatatctaaaatgataaatagttaaaatgccataaaaatgaactagtactagtacacttggtccaaattggtatccgtctctttacgaaacaatgagcttcaacttcttttagaatatccagctatcaaaagctcgtcagacaatttagatttttcacctaaaatctaactaaaagccagagattaggtttcctagcttgtccagattcttaccagctgtttttaagaattttaagttccacaaataaacccttatattcatccctaattggagtaatccaaagcgattttatcaaatttcacagtttcacttttcaaagatttttccatttgtcctattagcaaccatgaaaacgaccaaaaagcacctaaaaatctaaatttaaattcggcgttgaatttataattcaacaacgagccaagcatacaaca

SEQ ID NO: 61798 - DNA, 727 bp, Oryza sativa
ggtgggcgacggcgacgcggggcggcagggcacgctcccggccaagaaggaggccgtggagtccatgccgacggtggaggtggccgccgggggcgactgcgactccgcctgcgccgtctgcctcgaggactacgccgccggcgagcgcgccacggaaatgccgtgccggcacaggttccacgccaagtgcatcgtgccgtggctcaagatgcacagctcctgccccgtctgccgcttccagctccccaccgacgacgacgacgactcctccaagtccgcacgcggcggcgccgcccactccggcggcggccggcggttgtcccagccggcgccgcgggtcgacgggggaggcctgggcaggttgccggccgtgatgcaggagctcaggagcatcctctcccagccgtcgccggcgtcgacttccggcagcagctcgcacgcgcagcagcacagcgacgagtgatgacgactcaggatggtcgccggtcaccggcggtgctgctgctccggcgaccggcggaggagctcatggttttgcaactttgacaatgtacataatccggggttcgtcgtcgctgtggtgactggctttggtgccaatggaacttcatttttcctcgtctcccctttctttagcaatcatcttgtgatatatcccatgattttaatatacaatttgcgttcggcggaaaatggagtatattagtggcgtgtatatgaactctgc

SEQ ID NO: 61799 - DNA, 2791 bp, Oryza sativa
aacacccctcacaacctggagaataaatagcacacagtgatgaataatgctaacaagaccaatgaaaatgatattgcttttaagaatgcttacctgatgctcaaggccactatattctccctcggtattttcacgaatagtcacaaggttcacatcatcatatcgagtcttgtatcctgggaggctgttgcaaggtctaacatttgcataaagaccaagctctttccttagtgtaagattcaatgaacggtggccttttccaataggcgtagccataggacctttcaagccaactttgtttctccgcaccgactccaagctttcccaagtcagaaaactctctgttctgggatcaacttctgtaccaacatagtgttcttcccattctattggtacccctgcaacattgaatacctgaaacagcaaaaggaaaagttcaaactaagatataataaatacataagaacgagctacatagtcagaaagcatgatcagaaggcacttggcaccatttttggaacaagaaggtgtgacttcattgcatcaatcgccggaagagttatgtaaggttgtatcctattttgcaagaatgaggatatttacatatagaagagttgcctagcatagtagcattgctcagtaagttttggatcccatgctctatgcaataattaaacaccccgtttaaacatgaactctaatgtgcatttatgtccaccaaaaaaactaggaagataattagctcagcataagcataaaatgtactaccttgttccaaaaagaatgcaattctagctatgcacatggacaaacacttgtctaggtgcattgctagacttgcattcgttttgggacggatatagcactatcttaagcaagccagcaacatcacatcaacactagctccaacattcaggttccctagggagatttgattgtagtttgattattagagtatgacagagtaatctgatggtacacaattgacagcagttattaaatcagtttgattggaggtaaatcaaacagagatatcaaaggcatgtgcttgcagccaattaaccaaacatgatttcagacatgaaaagagaaagaaatcaaaaggaatgggctgatatgcctaaatgaaactcaatagtggagctgtgctaagttaaacccaaaggccccttcctttttatttacaagctaaactaactaggcacacatattcaaataaagcaaaagagagatcaacggccggtggatattctactttttctcgattatcacagaaatactatggggtttaaatttatttattttccactgtgaagtttttgatgcacacactctatctactacttatcttagaaagcttataaacacagtagcctggcacacattcaatcaatgattgaatataaaatataatttatcaaaaataaaacacttgaccaaggtgcatattgtaacccataaactctctactacattgcatgtgacctacataaatgatgaggatacattgtgaacaaaaccgtagatatcattaccggccgcataaaatttcaaggggattgaaacatcaaaacaagaaaacctagttgcccaactgacaccaatagcaaattttagaagaaatcagctcaattcagttggctctccaactagaattataaataatcaagtgctctactttcaagaataatagcatatatcatacatagacttgtctgcagagtatgccatgtcaaatttaaactgaaattaccttaaagtgcatgcacgcaatggactaaaaagtcatgagatccaaacagagtataaggtattttaattttgtgcaacatgatttatcctccctaattcaggaacgtgatttaatttgaagggtccaaaatgccgtctcttggtaagaggctagaatttacaagggccttctgcttctttatcgacgtaaatgtaatccttcaataagcaacattcccagtgaacagaaaaactaaggtagaatgtgcaaactatttatgctcattgtcatatctaagttttcatggaaaagaaacaaaacagaaataagcaatgtcctcgttattttcattgccatttacaggcggtagaggtcattattatttacatgcagtagtggcgggggcataagttcacatcaattatcagatggcgtaataagaaccatctttgcacgttctagacagaatgtaaataaatctgtgggcagcagacaaaaaactaaaagagacgaagaatttaatcatcttccctgcacgtcatggccaaaataaatcttaaagctgttgcacacagcttgaaaacaaactaacaaacttgcttttttttttctcatcggatcaaggaaggtccgcgtcggacgaatacagcccgagctgatgggagtcgtggtcacagaggggtatatataataacaaatcaggatatacaaaaccgaaattccgtacctgcttgaccgactcggcgatctccggcccgatgccgtcgcctgggaagagcgtggcgcggacggtctccccggacgccgtcgagaacggcgccgcggcggctctgcccgccatccgcggcaggacgctcccctggagcagcctccgtagcgccatgcccccccttcctccctcttcctgctgctaccctgcgcaccaccacaaacacacgtcaaccctagactcccaacacccgcggaacgaacggggcgcggactagtccaaccccaaccccaacacaaaaatcatcaaccaaatcacgctcgctcgatcgaacgcgcgggggggggggg

SEQ ID NO: 61800 - DNA, 3806 bp, Oryza sativa
cccacccaatcccccccgatggagcgcgcggcgcgaccgcgcaaaattcgatcgatcgggcgaacggcgccccccacgacctccgatcgaatcggaggcgatccgggtagcgaggggcaggggaggtgagatggggaagaggggaatgtaccggacggcgaaggcgactcgcggcggcggcggcggtcggcggcgaggaggaggagagagagagagatggatgggaaaggggaggaggaggagaggatggtggaaggggagactttttctcctgcgtcctctcccatttattcggccgtcgatctggatcggacggctgggatttgcccgggcccacggcgcgttgacggcgacgatgctccccgggtttctttctttcttgcggaggagaaagatgaataaaattgatgctttcaagtgggcccggggatgttcttattccaagttgattgaggtacaacgaattgggcttgttcttgttttaaaaaaaaaattgttaggtttccactaaaagaaatatactactagaacaaaagttgtggagtcagctttgtcatctaacagctcgaagggaattcagtctctcgtaagtattttataaatgcttgcagatgattaagtattttctaagataactttaaaaaatgacaacacttttttcaacaacgataaaaaaacaaaattaaatgatcaatttcgatgtatcatgatatgtttatggttctgagatttgataatttagcacttctacattgtcattctaattgaattgatattggtgacaatgacaaataggcataggtggtttgtacttatgtgcatttcccgtataccaaaaatgacatttaattgtatttgctcaaaacaaatattgtcctattattctagagtggaagcacgaatattggcgtgaaactaaaactcgagagtaacacagcaaatagagataaaagaaaagccattgctcgtagcataacgatacatgtaagtgtgtaactacaatgcacgctacaaaagtcatgaacattttctctctaattagctagctagtcctattgtccgatctaagcctttctaatcaaaatcagcctataatccatcgcacactatttgacctatcatatctattgctatagcatgtcaagaggtggaacaagctttctcaaaactacttacttctatttgctaatgagttgagggtcgtgcattgtacacacgtttaccctaaaaatagtttaagctgaatgggatgtaacttcattagaaatattgaatttgcacccatatacagcctttcctcatgttattcctctcccttatcctttgtcacctccaaatctcgccagtagttgtcgataatgcctctacgctcgatctccatcatgtgcccacgggtactctagcaactaatctattgcaccaacaccttgcttacttagatggcagctagaattcaacaagctaggggcaacagctacaagctaatgccactgcagaatggactcgcatgaggtaggcggtgactggagctcagcaaataggcaagcaggacatgatggagctatttgtatgagtcaggtgtcagccaaagctctatgcacgggccgatgcaaaagggtgatggagatcaagcatgagagacaccaagtgtagttggtgtgctcgcattgaccaatggatggctggagatgaacgcaaaatgggtgttccctacgaagttgtggcaaaagagaggggttccacttggctatgaaatttgcggtaaatgagcaatttttgcacaagttttggtacaaacccctgtcctgttgacaggttatacccacctatggtatttgtaatgtatggggatcattagtacaagagcatacgtgagattgcggtaaaagatatgggagacagaaatttttatacggataatagccctactcccattgtccgaagtcggtattgcttttatatatcaatctcacacaaatacaatagagaggaaaacctaatctagtctctagtggttagctgttgttggcttcattgaatattaactcgacgagattgaaggtgtcttgtattgtcttggcttttgtggcattgtattggtcttatcttggcttatcttcgtctcccccgtctcctcctcgagggttttgtatttataccctcaataccccccttgtccaagtagtattacggaagcaagtatggatactatccaagtagaccttgtaggtatcaagcagggactctatttatttttcttattcggaaaccttccacatgaaattttattccatataggacttggtgtatgatgggtccaccaagtcttaatacgcaggtataaggtatctcatatctagaacactgactcgtctcattgcattatagactaacatataaatctccctttaataaggatattatgaggttgttgggaggaagacctaaccttagtcgaacttgctctcggggggatgttgaggtttgctctcgataaatatcccactcccaagtcccaattggtttgttttttgataatggaaaatatgcatcctagccactgcttcaaagaagctataaccaattattacatcgttcattgctgatacaacttcaattaacacctctcaaaattcaaggtgacaagaaagctgaaaggacagccaacgaaggatagacgtaacatcatcaacaatacgtacacaaatgccccagatctccttgtggtttagctcaacaagcattccattttgccaatctatatttttccaaatgatcatgggcttgtttgttttgctaccataccaaaatctaggcaattttggtagtttcaattttttggcaacttatgtttgtcattggtgtattttggtagcaaaccaaacgctagctaaagtatttaaagtcccaacaatttggtagggtgtaggccctgttaaaatcccaccccaaaatttttcaccctgtcacatgtaacgtttggacatatgcatggagtattaaatgtggacgaaaaaaacaaattacacagtttgcgtgtaaattgcgagatgaatcttttaagcctaattgcgccatgatttgacaatgtggtgctacattaaacacttgctaatgacggattaattaggcttaataaattcgtctcgcagtttacaggcagattatgtaatttgttttgttattagactacgtttaatacttcaaatgtgtgtccgtatatctgatgtgacacgccaaaactttacacccctagatctaaacatcgcctttggcttcaaaccaaaatggcccaatcattttgattaaaaaaaacttgatatgcagtaatctatatttttagaaattcctcaatgggccttgagaaaataaggcataaacactacaaggttagttccaactacttaactttctataatcttccattccttgtcagcttgcttcctatcgaggattgtactaatgaataagaagaccatgaatgaaaggatgccacacccttatatcctgtgtctttaattttttaagaattataccatccttcttagactacttcggtagtaggaggggttgcataatagatatatcaaaggataagatcccaactggtttgctatgggtcacagacatttttttttggatttctgttttaaaaataattttaggagaaattattacttattttcttatcaatcatgaaaagggagtcaaacagcgaaaaggttactaagaaaaccacaaacattaatcataacatcatatgaatcaagcatgctctagccaaattttactatacatcagtcaat

SEQ ID NO: 61801 - DNA, 11141 bp, Oryza sativa
ttttgccatgccaacctgcattacatggacaaaggttcatatcatggaaataaaatttagaagaatttatttttaaaactaaaaattaaaatgctcaaaaaataaaaaatatattcttaactaacctggtgaaacaaaagaagcccaacagtcaggccttatccaggaaagcggagcccaagcccaacaaacccatttacccccagcgtgggcaggcgaaccctttccctcccgtgcctatataaggccacaaaccctaacgcccccactcttccacctcgcagtcgccaccccgagcagaagccgccgccgccgcccgaaaccctcgccgccgtcgcttctcctcggggcgcagccatggtggccgcaaagaagacggtaacgttgtcctcctcccggtctctccctccatcacctcggtccgccgcgcaagcgagcgagcgagcgagatcctgcatttctcatggcgctaacgcctctctgttcgtcgtggtgatggtgtgatggtggttgtgtttgcagaaaaaatccacggacaacatcaacaacaagctgcagctcgtgatgaagatcggcaagtacacgctcggatacaagctcgtcctcaggaccgtcaggaactccgagggtaagagggatcaatgctctccgttccttggtagattacgccaaattatagtttaaggttagcatccgtgttgttagtattgcggttttatagtgagtttgggcatcgtaataactgattaccggtggatctcatcgccgccgcgtatgagtcgatgccacagtgattagccccactgtctctgttcttctgaatgtgcttgatattgctgttcagtagctgatggtggtgtatatacttaggtaggatttacatggacttaccccaagacttaaaacattcccctcttacattcaatctttgtacccaatgaaacttatacccgctctctgtttttttattgcctgtatgttgacttgtacccgctctctgtttttttattgcctgtatgttgtattgctgtgtgctgttgtctacattttagctttggatatgtccatacggaggatatgatgatcctttccccagatgatcgacaatgaacataccgtgcgattgttttctcttaggagataatcaagccagaaatctgatcctcgaattttaatgtagagtttttttttctgaaagatttcctttatcttcaaatgagttggttcttgattagtttcattgtgcttatttaccatcatcctttggatggatgttagtgtgagtatgcgcatcgtataaactgattaccggtggatctcattgctgctgtgtatgagtcgatgccatagccatgccccactgtcattgttcttctgaatgtgctcgatgttgtggttcagtatttggcagtggtgtatatacgctttatggtttagtattaacatagacttagccaagacttgacatattcctgtatgctttttgtttggctgtgttgtactcaaatgtgaatacgttgtcaagctatttctagtttatgtgtttatcagctgtttgtcctagctgagtagcctgtatgttgtagtgcactttctttatttagttttggttgaattggtagtggaggatatgacgatcctttccccagatgatcgacgatgagcataatgtgcgctattgttctcttaagagataatcaagccagaactatgattctccaaatttaatgcagtctcttttgctgaaagatttgttttatctgaaaatgtactgatttgtggttaatttcattgtgctgcctatttttcctgattcttttagcatgttgtggtgaaattttatttggtgctgcttaatatggagaatatgatgatcctttccccagatgatcgacaatgaacatactgagcgctattatttctcttttgagaaccaagccagtattctgattctccaaatcttatgcaggcatttccttttattttgagcaagcagtggttgtttcctagactgtgatggatttattgatatgttcaattgtttagcttgggtatgataacatagataattgtctattatgatctttgcaaatttgttgctccaggttgaaacctttagcgttgaaaactgattaccggtggatttagtaccaatatggccaatgtgtatgagtcaacgccataataattctccattttctgcatacagtaactgtgatgtcaactgcttatttgcagaagtggaaacatgctttatgaaaaacgtttttttactatgagtcttcagtatgattgcaaggaaaattttctgtaactgtagggaattaagcttgtagagtgtccttttttctctctgaccatttgcatgtaatgttttactttcatcagctctttctcattgtgtaaacttttcagagcatggctgcatactaccctactttgttttgtcatctttgctggcagactgatatctaatgtccccgcatgtcttcattacagcgaagctagtgatcatttctaacaactgcccacctcttcggaagtcagaaattgagtactacgctatgttggccaaggtcaccgtccaccatttccacggaagtaagttgacacccatgcttttcgacatctcttgacctttgcaaagatttaaacagtgaggcatgcttgggagtaaatatgtaatcaaattatatcgtagaaacgccatgctaattatttttatgcgtttttttaaatgaaactgaaataaggtgcacagttctatcttctgttgccatggcaatgctgcatttgtttgtagcaactgcaaagtggaccaaagaagacttacaaattcatagataggacaaatgaataaactgtgcagacatcggtttctgccatatgcccatattgcttgattagccagtcttattacattagctgtgtctttgtttgaaaaataacagctatctgtttgttttcagataatgtcgatctggggacagcctgtggtaaatacttccgtgtttgctgcctcagcattattgatcctggtaacttccatacgtctacctagtatttgaaagaaactaaacaaaaccgttatttgatagtaatactgtacaatgcgcttgatttccaggtgactcggatatcatcaagaccacgggtgagcagtaaggatgagcggttccgctggcgcttcagatgctgtcacactgagctgttctagacattgtagttgttgctggacttgatttggtctctctcgtgtatcgaacagcttttaccagtcaaccaaagtttcgtgggaacattgttcttggattggaaaattttgttcctggcccgaatcatgttttcaattagaacgcttggctgtttgttcactgaacttcgcatcattacacgtggttgttaaagagctctttagatgcagaccagcttgcgctgctgcatttgcacgagggttgacgataccgccggtaaccgcgtggcttaccgggggtacggaaatataaataccgtggtaacttccttaaattcatataaatgttaaaaataatttgaatttttgataaattttgtctggttttgtacggtttttatacggtttgggaaatcctgatttgcatgcacgatggagaccggcttcataaactgaccgaccatgggagagctttgccgattcataacgctgtattgagcaaccagcatttcggccatttgaatagaatttatacatctgaattaataggaaacaggacttgtgaaattatctatatatattcctaacattacaaatcattttcttattatttagttgaaatcttttaaaactctgtgatttaacatatagagttagagactttgaattcagtatagtcaaaacagactctgaatacattaagagtaaatttcacagaactacatgtgttttatagttcaagtcgcagaaaaattacatatattttagcagtataaacttggaccacaaaacgtgtagttttatgaaatttactcatatattaacataggccacctatgtctctccatctcgacacctcccgtaggacccatggtatttaactatttgtcactcttagatttgttgtttaattatttaccatccaaatatgtgagccattatctatttatgacatacgtgctcagatgataaatcattaattggcacatttaagagtgataaatagttatataattcttaggaacctgctcgctgctagagctcgagctccgtcgcttccagaacgtctccgccgcgagggaaagcgtagaatgggaggaacgaacagctccggcgacgtcgaaggtgatctacagtggcaaagttaggggagttgagggcatgcggtgatccaagcagccgctcgagctcaagccacgaccaggcatcgaacttagcgtcagggtaagacatgatggagacacacagagcagaggagataggaaaaggagagaggaagtgccactgacagaaacggtcaacttttttcgtagttgtaaaacgccaagtcgagacaaccttcaaaaccgctcagggacgtaaattgatctggttttaggctgtgttctttgccaccccctcttcctcgtattccgcgcgcaagcttttcaaactattaaacggtgtgtgctttttataaaaaagtttctatacgaaaattgtttaaaaaatcataatgatctatttttgaaaaaaaaattagttaatatataattaatcacgtgctaatggaccatggaccgctatgttttccgtactggagggattggctcccaactaaagcaaagaacacagccttaatacttgagtgagcttttatacccgattttgcgacgttaatcttactcggtacatagttgagggagcagttatgtacttttcaagtacataaagactgggttagctcgaagtcgagcccgacccgttcgttgacagccccaaaattaggcccatcgacgacagcccataacatcgagaataaatctgggccgcccgtgccttcgtcgcggtgtgcgtcacgagccgtcggatgggaggaaaaccctaacaaaccctagcgtctccgtccgctctctgtctatataagcgccgccgctctccattgccttcgccctctcgtgttctagggtttgcacacgcggtctcttctcgtgatggctgtggacttctaatctttgctgctgcgctgcttgctctttccagctgggttgatttgatttgatttgttctcgctttcaaatctgtttgcttttttttgggctgttttgtcgatgggattttgtttgggcttgaggatgatggatgatgcagatgaggaggcacaagatttaatgggtaatttgcgtctgaggcatctctgtgatgtcacaccctttttcaccttggagatctgatgcatctacaaatcttctgccttctttttttttcctcgattaacttttattttcttttaaaaagttttcctctattagcccttgttcttttagtctttcgaagaaaagaaaaaacgctggggattgatgatatgatgatcaaatttgattccctattggtttgattggccgccatgatggcctcaaattgtattagctctatctgatcatcttcctccacatttttcttgtttcattttttccctcctggatctttctgctgttttttttgcaaaattttatttgctgtgttcattgtacttgattcctgtatgttattgttgtgctgttgtctacattttagttttggataagtccgtactggaggatatgatgatcctgttcccagatgatagacaatgaacatactatcctccaattttaatgcatgagttgattcttttagcatgttgtggtgaaaatttatttggtgctgcttaatatggagaatatgatgatcctttccccagatgatcgacaatgaacatactgagcgctattatttctcctttgagaaccaagccagtattctgattctccaaatattatgcaggcatttccttctattttgagcaagcagtggttgtttcctagagtatgatggatgtattgatatgttcaattgtttagcttgcgtatgataacacagataattgtctattattatctttgcaaatttgttgctccatgttgaaacctttagcgttgaaaactggttaccagtggatttagtaccgattgtgtatgagtcataataattctccatacagtaactgtgatgccaactgttatgatctttatgaaaaacgcttcactcgtcaactagtagcagaagtgggaatacgctttatgaaaaacgcttgtttttactacgagtcttcagtatgtttgctaggaaaattttctgtatatgcagggaattcagctagcagggtgatgccgtctttctctgctcatcatgtagcaaacccgtgagacagacatgcatcagtatctacagcaaaagcttgattccaaaccaacgatggtagactgcagtaatacaatctgacaaatcttagaacgacgacgacgatgttcgttcggcacttctatttcttctaagctcagagtgcatccttaggccatagcttctcaatgattttatgcatcagggcctcttcactttgaagccattgtcaggtaaagttgccatcagcgatgccatgccgcttcattttccgccgaatgcccacgccgccgctgccattgacgtagcttcgtgtcacgcctcgagcaaagccaggaacaatttaacgacgtggggactagatgaaggtttgctttgacacgttgcccagtcctacggacgagtgaaggagccttgctattaattcctccccatagtttggagaaatttgataattttggaggaattttcgaatatctcaagactacccaaacccgtccaataatctcggcccatttggtccggaagttaagcccatccgtattttacgcccgatctcggcccatttagtaaggaagaaaagcccatccgtaatgaaaagcctcaccttcgaaacagcgttccatcaatcatcagcattgcattaattaaagtcgcaattacacaattgccttaatataagtcgttgctgtgatggcaactataacttaacgatcgattgaatatattggtcgattaattaaagacgcaattacataatattcgccttaatataagtcgttgtgatggcaactttggaagaggaatcttaactacattgtgggacccagcggggctgaagattcctcgcaattctaatctcggccatatatattgctgcttgggccaacaaaaactggaccgcgacgtgcaggttaccattcgcggtaggtttaccagttagttttacttctcaacaaaagaattattaggcaattctattcacaggtcaactacataagtacggcgtaatttccacagtaattgtttggattgcagtaggaaaaattgttcaaaggatggcgtaactttggcgtggaattaactgaaatgctaatcaaagtattccattccaatgggtttaaaatttgaactctaaagacttgacattaaagaggagtgcaagttattagtacatgttttacggagtagttggtatttggccgatgcctttaagcaaaaaaaacacacacacacacacacatgtatgtacttcctatacggttgtgcgagtacgggtatatatatttataaacatatgtgtatgtgtgtataatttttaagttatttgtttaattaggacgttccacgtgtttgactatcaggcaagtgttgctatctgtttgaatcagctgctaactgaccggaattattatttttatataattttgactttgctagaggtgattcttcagctgtgttaggattatttacctttcacataatatcgagtatttctcagttctcacaatttggatttcagtcccatccttcaaagcaacctggttcactcacatctaagaatatccacacctggtaaaacgcttcagttgccagaggagagctgcacatcgcaaatgaaactctgcagtgccggaccgccagtgacaaaccgatagccatggccagtaagggtccatttgatttagaggaaaatcataggaattttggaggatttcaatcctatagtaaaatttcctatgaagcactttgaaacaaaggattgaatccaatccaatcctttgaaattcctatggaatagacaatcctataaagattttggaggaaatttagcaaaagcttcaatctcttggtaactttcctttgagtctatctctctcatctaattcctgtgtttttcctgcggtttaatcaaacgttcattcctgtgttttttctgtgttttgcaatcctctgttttacacttacattcctatcaaaatcctacgtttttcctattcctacgctttctcaatccgactattcaaaggggccctaaatgggagtgtgtaatgtaattaattaccttgcctgcatggcttctgacgagccgatcgatcatccagcaggaagagaagcttgactagttgagtgaaacaggagttggattgcaccgcgctgtagttctgtactgctgtgctatggtcacagcgtaggcaagaacaccttcctcgttttgcctgcacagtgtttccgaaaagtatagttttggatggtcaggcaaggaaccattgtcagttaaggttttgcagcaagtactgtttttgcttaagtcctcccacaagaacagaaacttcttcatctctgataaactgaactgaaatagtactagcacagaacgttgtagctaaaattcgtgcttaagttgttaggcatagcacacaggagacaggtaagacattacgagcagtgtaattggactaatttggtggtgatgcctttagtgtagtagttagctgtgctaccacaagttagggacttagggccatgtgggaagctcaatcatatggtcagtggctgtgactgtgaaataccaactgaaataagccagggtaatcatgtagtatcaacaatcgaggatattttttatatatcttttttgggggagggatcactagattgactacacaaaccactagacgcatgcatagtactagtaaataagatggtgaacttacttggctggctgctgattattgtgattggattaagaatttccatgccaccaataatggatcgcggtacaagtcaagagcgagtgacgcaggcctcacgttgcacttacccctccctgaccgcaagctttagttgactcagggtgatcaatcagtcgatcagatcttgatattctttttcagcaagtgatgacaaagcaggtgtaaaagaaattcccaggtctgatatcagcaaacgggagctccttttccatgtttttcaagaacctgcagtcatcggcagtggttagcgtttggcaacttgcacatggacatttgaactctcaagcaaccatcaacttcaggaatagaaggagaaaaggacgatttaagaactggtcatataaaagctacaactttattcggtcccaatgaattttaacttcattttccacaaaaaaacttgtccaatggaaatatatccaagattctcatgcctttccccctccctaccgtataggcataaagttattcactagtataagagattaggaccattatctaacagtaccgatatgtgtgtgggagatgcgaaggttgcaacaactatctccttaaaaaattttgattggtggaattaacagcgactggtgagaaagttgtagggaaaagaagcaattgaaaaggagagcaaatcacccagcttctgtgctaatgactttatggccttcatcaaatgacagttgagtctcacagcgagatattggtaccctcctccatacctcctctctcttcctcttctctgcaacatttatttgcactgcatacctatttgttttgagctgcaggacagcaagtacaagagggggtccttcccatacttcattctcctgcagaaaaaaaagagctcatgatatctagcttccaaccttccaggttcaagggctatctctgcaagaactgtgctgctatggaggacaccttggacgccggcacgcatcaacatcgaggataagtcctataagatggccatggatgatccatcttgcagttgcagattcctgttgtggttcctatgttttgtagcatgtgttctcctggagtctgctgcttctgttcattcatggtgccccttacatcctagcttgaggcaggaagcaaagtttaagcagaagacaaacaagttctgggagtaccaggaacagagtaatacctgggtggaaataagcatgcctttcaatttgatgtcctgcatcaacgatacctgcacgaaggtaggatcaatcgagcaaccggaaaggagacatggccgtgcttcaatttctagtcaggaggagaaggatgcagagatcgatgacaatgatcaagcagatagaaatgatccagtcctgcccataagaaaaaggatttccttgacgcgcatgtcagaatcatctgtgtgggtgacagggcaaagtggatcaatttatgagaggttctggaatgggctggcatgggtgattgctcctcatgaactaccaatttcagttggctatgctacagcaactttcattgtgaatacaactattcttgctctctcagaggctggaatcctctatcaggtaacttgcatctctatctgtatgacagaactatgctcatatcataactgttacaatacccttccttggtcatctttaccgttgtatgtttttcttcaactgtgaagttctgtaacagaacagtagttttatcccttcccctcccttcttttccccaacccaattccgttgttttgttgcagtaccttatattacatgtgcccaaaatttgaaattgttaagcaaagatcaatagacatgtagtcatgattaatgaagagccgataggaagtcttatgggaagagcagaggaataagaactgtatgtaaataactagggaagtagtttcctctcatgagacaataagcttctgatgaattcaattgccaaaaaaagaaagtttctattatgctagatctaatatttctacacactttcagctacagctaaatgaacatgcacaacctatctgg

SEQ ID NO: 61802 - DNA, 707 bp, Oryza sativa
ttgatgtaacaaatgcaacaagctgaacaatggagtgtctctagtgcatgcctcaacggtgatctttgcttcttatttgctgatttgcactgcccattattcaagatattttttatgcgacaatttgctcaaatactaaatgagttagtccatcgagagatgatgatgaattcggtgcctatagttttctgtacttgtataaggtgcaataagccaataatgcgattgatctatggatttgtggccaagtttatttggagagcagttcagttttcttttgttttatatattcctactagcatatctcatattttttatgattggcttcagggagttgtaaacaaaaagagcaaactaatacttgttggagcttctgccttgtgttgggctctgtggctgagtaggaatgatagggtttttgacaaatcacctactgttacttatatgcaggtcattttcaaggcaacatattggcttcgtctgtgggcacagttacaaaagtgtgataaagatgcagatttcttaattgttgcatgtcgtaagcttgaagtgacggttatgcaactgtttgccaatcatggatggagatttaccaatagactggaataatgttattttgtctagtttggttggtgtgtttgcttctatttggacttcactcttacagagtgctagtttgtaataattggctgtagctcttttgatta

SEQ ID NO: 61803 - DNA, 5795 bp, Oryza sativa
ttatatacaagttatattatagttatagtatagttatagtgaaattatattataattatactatagttatagttatagttgaaagtttttcccttaaaaaacttgctgcggttttttaatagtctctaatttttttcaaaaaattacattgtgaattaagagaatttaagcatgattatatgaaggtaagcctatggctcaaacccaagttaccctaggcttgcctcctagagtctgagttttagcccatcctgtcttattggtgacggcgtctagttctccctctatggtaaagagagactttgatttgcagtttatttaatttttcgatgatatcttctgcttcggttgaagagcaatcgttagtggtgatatgtaggtgatcattctgttgaagaatcgagcataaatttcaatgagtctttgttgcttagagtttgaattcagaacttaggcggtgacgatgtgtatccgctttattgacattaggatcttgctacaaaggtttaagaggataagaactacatacatattatgcggattttcgccttccgcggagagaggtttagcattagaggtcgttatcattgtctttaggttggtgttgtagttagttttcttgttttgtatcaacatgcattttgtatttctgcaatcgttttggctgtagactttataataattggttataacttcttagaagcaaaggtcaaaatgaatttcccaaaaaaaaaaaacgccaggtggagggcgagagaatggtatacatggtgtacatgagatatacatgaactgtgtgtatcaaccaaattcacattaggtgtatataaaatactgattcagaggcattagccatgaacatttcacaaattaagagacaagctagcatgatgaatccatcatattaattggtttctttccttaacagactcagcttcttaatcgacgtagtctatcaaggccttgatcaatccatcaatttccctgtgccatcgttgctccctggagaacaaatttaacaacaaccgaatgctttagttacaatgtgtagatatcatattcgcaaatataaaaaaaaagatatctaggtatgcaaacgcttctcaatggtggtccctattttgaattttttttttaatttattctcgctcttttttaaaaacaacttttgattggaagactacattttgcagattttttgtgaataaaaaaatagttcagttttctcttaaaattggtaaattctcggatctataatgcataattttgtgaaaaaaaatcatatttcagttttctcttgaatttggtattttctcacacttataaaaaaattatgagattttacagcatcagtattaattttctgaaggtcgactagaacacaagaatgcacactgatcagctggcatactataaagaacacactcatccttacctcatttgctgctttgttttttcctcttgacaaagccacaagcagggcgctgcaatacaaaaatatattcttagaacaatttataaaaatgcatttgcttatacataatttgctccctcctgatttattactcccacttcgatctcccacagtcaaattaaatatatgtcagaaaaaagtaactaattctccctctatttcatattataaaatattttaagcttttttaatcaaattttattaagtttgacaaagattataaaaaaaataaagcaacatttagaaaactaatttgatatcgtaaatatttgctaagtttctaaaacaaaattttgacttcaaaaaagttaaaacatattacaatataaaaacggagatatcgaaattaactacgagctgatcagcttaagtataattacctgccggttacgagcgaaaagaacaagattacgggcagcttcatcgacggcggctgaggccgagagaagcagcggccgtagctgctacccgaggcggcggcgccgccgctcccgcggctcgtgggcggcgaggtggcggtgcgagggaggtggtcgtaggcggcgcgggtggcgtcgctgtggaggacggtgtaggcgtcgtacacccggcggaagcggccgccggcggcggcgcgggcggcggcgtcggaggccgcgtggcggtcggggtggtgcagcggcgcgaggcggtagaacgcggccttcacctcggccttgctggcgccgcgctcgatccccagcgtccggtagtagtcgccgtcgccgccgggcgccattgatcgatgtcgacgacgaagacgaagctgcaagaggtgtcgggctagctagcttctcttcgcgcgcgatgcagtaatttaggatccaaaaaactgtatacgaagcgattcaatttagatcacaattaatagggcgcttgtagccttttgatttcgcctgcgagtccgaatagaaactgagtctgagttcgagtaatacatttcgatagaattcgatcggatttgtgtttataggtcagtcaaatccgactctcttttgccggaagaagcccctatttttacacgcgcgtaattcaaacgttcgatcaacttcttgatcgactctaattaggaggtgtttcgctctatcaactccttcaccagttattaatctattcatttcccagccgtttttttcacattttgatcagcttctttaacaactgattttttacaatttgtccctttctaaaagcttatttacaaatacacctaaaaacttatttgtgcctacgtctaaaccccacgttggcgtacggcctggatttctctgtcgcgtgtgagattcacgagagttcatatagtggaatccaatttctggatttgaatttttttttacttaggtcaaatctattaccgagtttgaattttaattaattaaactcttactgtttgctgacaattaattgaacatgctctcggccttgatcagtattcgttacggtagatacagatctgatcaaacttcaaaagtcgcaaacaaagttgaaaaggaaacaaacactttggaagtaataatctcaaaccattacccccaactattacagtaaatcactcgcaataatcaaatctgatttccagttctgcattaccaccaaatactccaaattcaacggatgcagttcaagtatgtttcccatttgcaagtagtattctgattttgggggtgcataacagcataagcaaacgatagaatacctctatgtacaggcaactacaacacaagtcacacaacctttgcattgccagaaaaccggctagctgacttcagatggattaataatcagatctgtatacagcaaacccgttacagtggttagggaacaacacaattttctctcgcaagtgtaggaaagtttcatccgcaatcttatactatactctaaagacccacgagtttccggtgcacgtgttcatggagagagtgttcgtcgccgtcatggtgatggaatacgtatgtcaaaaccccaacgaggcacaggaccgagccgacaaggatcttgtcgtaacgttccacccagtggaacttaatctggctagcaccgtagaatgagagggccaccaaggatgtcatcactgtgatggtactgcaagtggggaaaatacaatcaaacagaagaattggtaaagattttgataaatatctgatctattcacatgccaattaacacaaagcacacaagggaaatcttgaatcacaaaaacactcaattcagctattctagtattcagcaatcttactgatcatacattgcactgcacaaggtatttttataacgttcaatccagctattcttgtgttcaagatgactgaccggaatgcccaatagagtgcacaacatagagatggacctatagttcacaactgaggtgttgctaagacccacccttgaaggttcataacagtggcagggacgcagggtctcaggagattcaaagggttataatgtaagtggttcttaagaatctattaatcttgtcaggcacaccgttgaagactaaatatttatcaaataccaccatttgtttccatacatgtaaagcagtcagtttgtgggaacatttcacatcaactaaagggtaaattgagacataacttatcttaagatattacacctcatataggttacagaatgccatattgagcaaattcattgtgaattaaatattaaaacatttgtagaatccatagttataaacacaacattagctagttggtaaacgaggaaaaagaaacatcccaaaaggaaaggtggcacatggaagtataggagtatttatctttctactttaccacaacatacagtctactaagaaggatatatttcgatgttcattttgtcccaactcaatgtgcttttgtatatctatggtagcctggtaggtgataccttgatgatttgacccaatgaaaaaaagggttttcaatacaaggagattcctataagcctagagtgtgatactcctaagtcctaacaagagcttagaaaaacttctcaacaagacaatcccattattttagtggaaggataaactattattgttccctctttcataatgtgttgcggctataaaaaaaagtatagcaatttattgttcggtagaaaacaagcaatgcaactgaaaacagtggaaaggggtacccacctaaagaggagcacaatgatcgcaaggatcatcatggaggatgaattgccaacagcaagaaacactggaagagttgttgcacagggtgataatgcaggtacaagtacaagacctgcaactgccatcttctccattggatgattatgagcatggccatggccaccttttcccagtgcaaacagcaggatataacttccaccaagaacaatcagcaacagtgatgcaagtttatgcactgtttcctcgcctgctatagtatttgccatagtaacagcagttatcccaagaagagcagtggaaacaacatgaaggacgcctccaaatgcagctgcggaagttaggatattttattagtagtgatatatagaataagaacatggaaaagtaatatgagtattcatcactaatttatgtagaaaatactagggggtagggtacagtatgaaattacaaaatacaagtaactttctaaacgcgtatcatagctgaggctaacagcacaatagtaacacatgaacaaggaatcaaacagaaataaaaggtttattttataagatttagaaattagaacttttttaataaaaaattatacagtaagctttggaggtttgcagacaataaatacaacataggatggaaaaataactacaaagttaggagtctggtcattcaaatgcactttttgttatccaagtgataatgcacagttgaacagaaaaaagaagtgattgtgcgtagtttactgaaatcacaacaatcgtgcaagattaagggataacaggttggtaagctgcaaatattattacaagattaattagaaaagtaagcctgataaaggaacaccaatgccaatgatcaatctacacaaatataaacagcaatagacctcaatcaaaaattttctgtgtgttctgatttaaaaaaatatccccatacttgcgatgaaatacacatatccctgtaattatgacaaaataacatattcacagcataacaaaacagaaagatgcaatattgattcagtttgcattattgttcccaggaattaatcattgatcaacatcccaactaggatattgtgtaactccaagttggatcaatcaaatagttgcaggcttgcagtctataaatcgaactccatgcactcacatacggtac

SEQ ID NO: 61804 - DNA, 2485 bp, Oryza sativa
atgtcaaatctaaagaataattagttataaatacgaacacccatgtcaaatctagaacttgaacccggataaactggttcaaccacatagaatctaatcacttgagctacgctcacttcatcaccttaattgtttgtagtatctggatcatttatcgatggcgtgggataccatccggtttaaacatattaggttgattagttttttataatgggcctgttcggctgttatgtttagcagttgtgctgttgcacaaagaaaacaatgtggctgttggctacaacacaatgaaaatgagtgcagccgaacagagccgatataataggttttttaaaatcaatttttataggaaggaagtggcttttaggaggaagtgggggagagaaagaaaaggagcatgactatctcttttaaacagtagaggccagttaaaatttaaattcaaacagaaaaaaatatggtgtttggagttatgttgcttggaaggtaaattttgagtcacggagaactaatttgatgagtagatagatctttgaaaaagttcttcatcattaatactttagtctttgatcctttatttcagttgagctgatcctttttttaaaatgaattaattgattttagaaccatcaaaataagattaaaaataactcttttcaaaggctgtttagatgatatggggaactacactttttatttgcactatagatggcctgataattaatttagagaagcaaaatgttatgtacatcattctttattttatattagacttttaaatagaaattgagatgtcactccatgagcattattacattaaccttttaaaacatttttgaattatgtttttatagtatctctgaagttagtggagagcgtgaattttctggaatgcttctggaaagaagctatccatctagcaaagccgctaattccacaagtgattagtataattaaaaagaattaaggtcaacaaacttgaaaggacacgccacctatttgcctgctcctatgcagttcttttttattttcaccgcttcagaatgtcaattgagaaagaattgacaatgaaagaaaggacaaactaataaacacatcaacttagcttcttccatttaaaagtatgcatgacagtaactcatcaaaatatgttaatgatatcaagttggctcaatgtattttcgtttctattctttgctgtccttttccccattagatcaacaaaatctaagaagaccaattgtttctttggaaaaagaaaataaagataacacttccggtgaatattggttacgtaccaggaaaacagttctaaagttttgcacaatattagtattgggtgaaagctcagatgaactcactatgtataagcaaaaaagaaaagggtgagagattgataactctagtaatatttttcatgccttggatagttatcaggggcggatctacagtagtatgagcggtgtcaggcgacaccgacgactttcagcaaaatctatagcgaaactgtttatccacatgttataacactatgatctaagcataactaacatactatgacaccgatagacacgttatgacactaacgaatcgattttctgaatccaccactgatagttataggtctaggtgaacaatcatgtcattttggtccattcagacagtcacataacaacaatgataagtggacgagtgaaatagatggtggtactcaccgccgaagcattcgtgcgtgcacaggcaaccgcacccttcaagtaactgccttagtctaaaaagtcaaataaaattaactactaatacattttagcctgtcatgaataaatattagaagttcaataattcatctgtccaatacatactagaacttttcttataaaagcatctcgaatgtataagtaaaattgaaccatatattaaaaaaaaacacaacacgctatgacaaccaactgttgcctataaaaaaaatctaccacaaagaaagagtcaattagttgaacttagcgatgaaaaaaatggtctgccgtagttggctggccgcgcaaggaaggatgtgggcatgtgattagagatttttttttacatggttccacaattaatgtcaaacgttacggtcaacgaaagaaacaaacttttgttcaatcttagggcatgtttagttccaaacaaaattttttcgctgtcacatcgaatgtttggacacatgcatagagtattaaatatttaaatgtagaaaaaaaaccaattacacagttcgccagcaaattgcgagatgaatcttttaagcctaattacaccatgatttgacaatgtggtgctacattaaatatttgctaatgatggattaattatgcttaataatttcatctcgcagtttcctagcggaatctgtaatttgttttgttattagactacgtttaatactttaaatgtgtatccgtatattcgatgtgacatgaagggacaaattttttgccaactaaac

SEQ ID NO: 61805 - DNA, 5392 bp, Oryza sativa
agaaccaaaattttggaaatttcaatctgaaattatgacccctgatcacaatcaccctttcacttcctaccatccccatttaaggggagatatctaagccattttgcttccctgctaattcatgttttgaatactgtacaattgcattcttttctcagatggtgggagtatataacaagttgtatcgtgtttgatatacggcttcacaacaaacctctcatatgtgttgttcctgtggaggcagccgaagaggtttacgggtttgtcaagcgaagtgcacatcaatagagtccctcggatgcagtcgtcgcggcattgccgcagtaccctgtcgatttgctccttcattgctgcttagtttcattaggaagtttgcttcccttttttcagttaacctctctcttattatggttcaactcttatgtttatcatgggcgaagtattcgggatttcaattccctaaatgctgtcatttaataaagtgttatgtgttttctttttttaaaaaaaaacccacggtgtatgatgaaaatgtttcctcccttttgaccatgccactgagaattcccctaaaaaagacccgcattattccagacgaggaaaaactgaagattcttgcaacccaaactggatatgccgatttggtagagccagccgtcattagagccgtccaccaactcacgcagcatcaggtagtcaatcaggttcagtttttttcccgtcggaaatctctgaaatccaatcacaaaacggaacagcaaacggctgagcagtagggggacgggaagaatggtcgctttttttttttcgcatagtggacctcctgcaagaacctattatttccgtgcgttggtagagacattgacataatggctatataatcatgttcttcgtgttgaaaattttggaaggcaaatagtttaatgagttgattttgtgattgggactacctatatttattccgtcgtatttttcataaaatatagttaacacgtacatacatcgtaagtccctaagttatatatgtaattttaatgtatttacaatgtaagttaagttgacgtaaatagatgtaaatagaaaatgctagtgcaaatttaatggaaaacttataactagccattagatcttgactataatcagtcataaaatgtgatgataacattttagcaaacactttgtgatttatatttgtttaaaattttattatatgacatgcagatggtagacttcagccggctattatagagagaacaaagagtgatatgtattattgaacttaccttgtaggacgctgatttcttattgttgttataggaatttgaattttttgaaactcgtggatatttccatgtaatttggagatatgttctttttcgcaaatttttcgtcttttacagagtataaaaccaatattttcaggagcaccgatgccctcgtacggagttgctacgaaaatcaatgtgacgtcgctggcatagaaaactcgacactagtaggacttaactgcaaaacgtaaataaaaaaaaacatagctaaggtaagcaaataattccgtttactactacttccctcctaaggcaccgttttccaatacatgaaaatttcatcctgagatatctaaattaattcattcacttacttttctctaaaaaaacatgacctaaattttcgaacggcgattgtaattggtagggcctattcagaatcatgttattttataccataccattatttagtaaaattgataaatatatgatattatttagtttgttactaaatatttatcatacctagagaattgatcatcatatttaaccagtccttaaaaccttgatagcgttagcaacttaccaaatatttttggtaataccaaattctggaaaaattaaaaatgaatataaagtgaacaggtccgttgttcgtaaaagccacacgaattcaaaagacagtagtcttccatcggctgaccaaacttcgcagtaaaccccctgtactctccagaaatcacaatccaacccctaacccctttcctctcctctcctctcctctgcttcgcttcttcttcttcttccccaaaaaattccaaaccgaaacctctcgattcttcctctccaagctgcctcgccgtcgccggcgacctcccgcccaaatccgacgccaccgcgcgccgccatgcctccggtggtggcccactagccctgctcgctccggcttccccgactccatggcttccgggcgcccgctgctcgacgcctcgccgcggccgacgcagcagccgccggcgtcatcgctgctcccgccgccgcagccggagccgcccctccgagccgaccgcctcgcgttctccctcgaggtgcccgaccccttccgccgggagcccgacccgtcgtcggccgcgtcgcagcggggggaggaggaggggggcggccaggaggagtcccgcgcggttgttgtcggggagccctcgtcttcggaggcggcggcggggttcgccgggaacggcgtacggacggcgaagtattcggtgctgacgttcctgccgcggaacctgttcgagcagttccggcggctgtcgtacgtctacttcctcgccatcaccgtgctcaaccagctcccccaggtcgccgtcttcggccgcggcgcctccgtgctcccgctcgccttcgtcctcttcgtcaccgccgtcaaggacgcctacgaggacctccgccgccaccgctccgaccgccaggagaacaaccgcctcgccagggtcctcctggcgccgcccgccgcgggggagttcgcgcccaagaaatggaagcacatccgcgtcggggacgtcgtccgcgtcgcctccagcgagacgctccctgccgacatggtgctcctcgccaccagcgacccctccggcgtcgcgcacgtccagaccgtcaatcttgacggggagaccaacctcaagacgaggtatgctaagcaggagacgcaactgaggttctcgcaggacggtggaatcggcggtgtccttcattgtgagcggccaaacaggaacatctatggatttcaggcgaatttggagattgatggcaagcgtgtctcgctagggccatcgaacattgtgctccgtggatgtgagctcaagaataccacctgggcgataggggttgttgtgtatgctggaaaggagaccaaggtcatgcttaatagtccggggcgccgtcgaaacggagccggttggagacacagttgaaccgggagactgtcatactgtccattatgctcattgggatgtgcacgaccgcaagtgtgctcgcggggatttggatactgaatcaccgtggggatttggaattcacccagttctttagggagaaggattacacgacagggaagaactacaattactatggcatggggatgcagatattcattacattcctcatggcggtgattgtatatcaggtcatcattccgatctctttgtatatatcaatggagttggtacggcttgggcaggcatatttcatgggtgctgacagagatttgtatgatgagtcatcaaggtcaaagttccaatgcagggccctgaatataaacgaggatctaggacagattaaatatgtattttctgataagacagggacgctgacagagaacaagatggagttccagtgtgcatcaattcggggggttgattactgttctggcaaagattcatgcggatactcagttgtaggtacgatgtctttaatgtatatttctggttttcatgttgaactttcctagtatggctgcttattttctggttttggacagtcgatgatctcctatggacacccaagatggcagtcaagattgatcatcggcttttgaagttactgaggggtggtggcacagatgaggaaacaaagcttgtcctcgaattcttccttgctcttgctgcatgtaataccattgtgccacttgtcctagatactcgtgattctaagcaaaagttgattgattatcagggtgagtcccctgatgagcaggcactagtgtatgctgcggcatcttatggcattgtgcttgttgagcgaacatctggttatgtggtgattgatgtccttggtgacagacagaggtaaggtagtctttcatcatttgctttatggacatgctaattttcaactctgcatgagtgtgttttcaataataattagtggcattatgcaatttagctaataccaattttggtgtatcaacatcattatgtgactaggagtggatgtctgctacagtgctagtgtgctacctgatccatgatgtttacatctctggaaaattatacctacaaaactttattcaactgcaatgtcatatagtcatcaacagttggtagcataacttattcaataacgattttcacaagtgttttatgcactttgctttatggtgtttagtgacgtcattcttttgtcttatcttattggtttgctggtgtgaatgctaactttgagttgtatcttgctagttatcttcctattcctattcttagcatacagttaatatttattcaaaataaaaataataatttggaatattttgggatgcaacgtgccaactccaaatgatttgtggcattaccccacatgagcgaaatttcagtacttagtttatcaggcttacctcttggagatatgttacaactctccaagtgcatgtcttgacttttccttgtgtttatagacatgcttgcatatcctattatagtaagctagtttgtggagccaatactgtaatatattggttgaatatatttgatgaatggagctctttttattggttaatcaccaactgtagagagttaaatgtgtttgctgtaagtccatgtcaaacacctgggctataggcaaaaccaagttaattatcactttgaacccagttattgtgatgagcacatatctgcactagggccataaatttgtaaggagctgcattgaacaggctggcatttataaacaaagcaaatttaggatgtgcatatggatttgcagctgaatttctggataatttggataaaaccatatcatttttcaccaaaccaaatgtttatctaacatttttaataacactattccaaaaggcattcttagttacctcatatgtacgaagtacgctagctttgtttataaatgcccgctttgttactacattgactactctgctccattctttcagttcgttgttctttatgtgtaaattttattttcaatatcttgtttacaagaatggcttatagttccaatttatcttctggtatgggatgtgcagatttgatatattaggacttcatgagtttgatagtgatcgtaagaggatgtctgtcatagttggctgccccgataagactgttaagctatatgtgaaa

SEQ ID NO: 61806 - DNA, 965 bp, Oryza sativa
aaaaggcagggatagttgcacttatcaaaaaccgaacagatgacatgaccttagcaattggtgatggtattattccctcctggttctgctattatggcatataatattctgtgagaaccaatttatgtacatgtgatatatgctaattaatcttttgttgttcaggtgcaaatgatgtttcaatgattcaaatggctgatgttggtgttggcatcagtggtcaagaaggacggcaggctgtaatggcatcagattttgcgatgggccaattcagattcttggtccctcttctattagttcatggccattggaattatcaaagaatgtcatatatgatcctctacaacttttacaagaatgcgacatttgtcttggttcttttctggtaagagcccttttgcattgaagttttcacactttgaaaaaaaaaactgtttttatgtagaaaattatctaaacgttactgtggaaacccccatgttagtaagacctagtgaaaagaagtggactctatttatgttcagttgaattaccaaagttgttgctttcttaatttttgcaatattcagagacattgtctccaaaatataacacttaattttgtgatctcaggtatgtactttatacagcattcactctgacaactgctatcacagaatggagtagccttttgtatactgtgctatatacatcccttccaacaattgttgttggtattcttgacaaggatcttagtaaggaaacactactagcttatccaaagctatatggatctggccaaagggatgagaagtataatgtaaatttgtttgtcctcaatatgctcgaagcgctatggcaaagtctggttgttttctacatgccatattttgcatatagacaaagtacgatagatatgtctagtctgggagatctatgggcacttgcccctgtcattgttgtaaatatgctactagccatggaca

SEQ ID NO: 61807 - DNA, 4246 bp, Oryza sativa
tcagctacgccaacctcgggcgccgccgcacggaggctccctccggccggcctccttccccatccctctcctccctccgtccccctccctctcctttcctccgtctttctcctccctcctttcctccatctctcgcaacaactctcataccttccacagcgtcgtgccgtcatggggaaccctaacgacgcacccctctcagctcgtcctttcggcgccgctcatgactcccttctttttttcttgaggtgagttttgccctaaaaaatcttgttgttactgtctatagatcaccatgttactgtccggtttactgcatgcaagttttgtcaagagaaatttttggttactgcgttgttactgtttatagatctacttgttactgtctggtttactacatatgagtttttccctaaaaaaaatctcgttgttactgtctatagatcactatattactgtctggtttactgcatgctagctttgtcaggagaaatctgtggttactgtgtcgttactgtctatatacctccctgttactgtctggtttactgcatgtgagctttgtcttaagagaaagattttgttactgcatttcaactgttccgttactgcatttcctgtattattttaccgtctgatttactgcatgtgagcttgttcgagagagcatttgccctagcaatcaccatgttactgctagctcttgttactgcatttcaattgttttgttactgcctttcctgtactattttactgtccgatttacaacatgtgagctagttcaagagagcatttgccttaggaatcaccattttgttactacattttaactgttttgttactacatttcctgtactattttactgtctgatttattacatgtgaacttgttcaagagagctttttccctaggaatctccatgttactgctgactggttactgcaagtatttttttactgctcattggtgtatgtatcgcgtatgaaataactgtcggctgtctaagatattgcatatgagttactacaaataattagcggtttcaataacaaaggggagcggttacaataacaaaggggaggaagaaagacaaagaacaaccggtgtcgaaacaagctgagagcaagcagccgaaagaccatagcaaaaggtgcagcgtctgtcacaaaattcaaggacacaatgctagaacatgtcctagtagaagcaaaagacaaaaaaacaatcaaccgccaagcaatagatgattatgacgaagaaaaagaggaagaagaataagtgtacaagtgatagatacattgcttctgacttgtaggacatttgtaatatgttactgccatagtatataactgtgactgtctttaagcatattggttgctaaaatgttttccttcatcacgatgcccagttagggcagcacatcactgctatataacatgcttctagtactgctatattgtaatgttttatcatgattccagttgaaatgacatgttaccagtatgtttactgccatgatacatatatgttactgcaaaaatactaatctgttactgcaggaaagtaagaacaatataaaattgtattgctgttgtgaacaatagatacacgacgtaatgccgattgctgcaatgtcattatgtcctctcgtcaaccttggtaattataaacacgggcgtactgttacatttgtggtaccaaaataaatacaaaatcaggtatgttactgtcagacatacatagaagttactacaaataattagcagcattactgctagattctttcagcccacgttggactctacggaaagctacttttgtgggctatcaaaaatacatacttgttgctgccgaaattacgtagctgttacagctaaatacacacttgttacagccgaaaaatacatagctgttactgcaaaaaaaaaaacacgtatcttttgcatcggagaaatcgaaaaaaagaacaaaagaacaatattactaccgatatgactgagaaaaaatctgccgatatgactgagaaaaatgtgacacatatattctgataacatttgttttgcattcagaaaaccagaactgctagataagcttgctagaacggctgtttctgccaacagtactatgttactacgaaagtacatacttgttactaccgaaattacatagctgttaccgctaaaaaacacatatctgttgcatcagagaaaccaaaaaaaaggaaaaaaaagaacagcatgttactaccgatctagcaaaaatataatctgagagccaagtacaagtactactagtgttactgccaacacttgatcatatgttactgccaaaataaatgtttgttactgtctaagagccactgagtacatgtatttccatacaaagtgggaaggcaaaaagaaaactacaatactacttggtgtcaatctacggcctaaatttctcaagaatcgcaggcaataacggtttgttgttgttcaaccgatggtagaggaattcctgccgaaagtgtgttccatcctcctccataaaaaaacaacagaagatttggttcagttacttgggtttgagtacgattaagggaaatctccagattttcatcaccgtctctaaccacaacctttgttattgtcaaaatcttgccactcttcttatctgcatggaaaaggtagaaaaaaagatgtgttactacagagcaagaaggttgtcactgcaaattaagatatttgttactagaaatgtccatggaaattaaaatcagagtcatgcacaatataggctgcatattaagagaagaggctccgctcccactgccgtcgcgcctagtggagagggggaggaaggtggctggggaagggagggtcggccccagccaccgctgccgcctatctgcggccgcgctaggggaggaaggaagggagggagcccggggaggggggtgggggcgcggagaggagaggggagaggtagtccagacggggaggctccgtcgccgctgagggagagcagcgcgtgagggggaggcggcggagagcagcgcgtgaggaagagggagagcggcgcgtgagggagaggcgagggttctggatccgggtgggagagcgtttttcttttcttttcatcggttttcttttcggttttgggcgccgggtggtggggctggcgccaggtggtgggattgaggggatggcgcggttagggggtacagaatagtttttctatatatatatatatatatatatatatatatatatatatatagaaaaactattctgtatatattgtgattatgataaaaatatatatgctcataaggatataattatattttataagtactcttttagccatgtttctaccataagtaatcttttagtcatggtaaaacatacatatcaaacatatatgttcacgaggatatatggtaaaaacatacatgtacagaggatataataatattataaaggtgtccatttctatcatgagtattcttttggccatggtaaaaaaatatataacaaggatataattatatttttaggaaacttctgaatttgaagatgccaactttactatatgatataatttagagatgccaactttactctttatgttatacattttaaaataattttatttatgtaagtacactgattattaggtgtttaatttttttattttctttttttgtaaaagtgtttaaaaaaacaaacaatgactacgacggttattgatttaaatcgctgcttttcctgttcgttaagcataaattaaaatatgctgaagatgaccattgttgtcttagatgttgagtcctgaatttaggtttgtgttatgtatagtgtttgacacgtattttttgttagaaatatttttttcatacatattctataaagaatcagcttagacattgacatttgttttgattatatttacataatcatgtatatatatgagaaatgttaggaattctatattttcttaacttgtgaattgagaaagacattatttatctaagctctctcgttgtgtttttagaagcatacacatagtgttgtgatgttaaaagcatacacatagtgtgtggatgaatgggtaaagcatacacatagtgtgtggatgcatgggtagaggaattctatattttcttaacttgtgaattgagaaagacattatttatctaagctctctcgttgtgtttttagaagcatacacatagtgttgtgatgttaaaagcatagacat

SEQ ID NO: 61808 - DNA, 3582 bp, Oryza sativa
taggatgcccatatataaaaatgatgttagttaaggaaatataatgcacgattatctcgttcgtattgtctggcctaattttcatttctttttatatcaacttgatatacttttttatcttattttctttctttttttgcatatgtattttctatctaggtgacataaatccatcaaatgaaagttcttttcgatgtctagatttagatatatactgtcatatttattttgtttaattgttgtgtgtgattatcggtttatctgggttgtcacccactcgctgaagaaccctaatgacatattttttatcgcataagtacttgttcaataatttcatgctccctctgtttcagattataagatgttttgattttggtcaaagtcaaactgctccaagtttgaccaagtttatagaaaaaaaatagtaatattttcgacctaagataaatttatttttaaaaaatatttaattattaatttaataaaactaatttggtaatgtaaatattacaatatttgtctagaaacttagttaaacttgaagcagtttgactttgatcaaagtcaaaacatcttataacctgaaacggagggagtatttaatatgctttagacttatgtgttacatcatgcttagcccaagcagtgtttgtttggattgccactgccatgaatgcaatccattatatactagtattttagaaaggttacagtggatggcactgaatctgtcaccaagttggttatttacagattatatgcctttacaacatttttttttcgaattgacctttgatgttaagagcattctaatatttggtttaaacaactgataacatatttaatgaaaaacatattttatttatggcatattgtaatagtttttatatatagcaaagagtgggcatttaactaatcattctaaaatcgtgtatgcgaatgcaaatatatacgaggcccagtcccttattggattaggatgtatagcgatttatatctattatgacggcggtttgtatagattccgcactatgctttcatatatcatgctttgatcaaattccggtcaaacttttcaaagtgtactagaatttgtttcatctcgcctatgtatatgcttatttgtaattaaaaaaatattttttgacatacttttatatatgtggccttagcgattcaaatgcaaaactataaaataaaccttggtggaaagaaaccgcaaaaatcaaaagttttaaaattcgaacttaatcttagaagtataagaataagtggaaatatgaggtcgaatgaattttgaaataatattcctttcatgatcaaataggtttattatatcattaaggtgcattatacctacatatattgtatagtgtgaatttggatatttgctttcatctaacccatatgttctgtttgctgtgctttttcttactaaagcatcaagcttcaaacgttgatattcttttgtgattgtgatggaggtttcatcaaacatgccctatctgataaacaagaatcagatttgataaaaattagtttttgtttacttgattttcagtgtgctgcaactagtgagtgcatttgctatttggctccatgaagctcatttgcaataacgtccacatcagaaaccgattaaagttagtgctttactttttatttaaagtagaatgtacagtttgactattacttagattcattcaactaattccatttggattatgctgtgtgcttttagcatttctctgcttttttttcctacttaaaaacagttaaccacttccagtttatttaagttgactactataaattacgccaggggtatcatctagttatctctctatctacatgtacttgatgttggaaatataagcaattcaccataatatttaatccaaaaataaagattgcaaatcatgacaatgtaagcaaaaaccatagaaatattattctcaaccataggaatatgcaaaatagatatgctataggtgtaaatcatataaacaagcatgtctaattcatttgcgtaataaacagaataaagaaaaaggaaagaagaggataataacacatggtgatggagcagtggttgcaacggtagcggaaagagaactgttgttgttcccgtcgttgttcctgttcttgtcatcagccatgatgaagaagaagtagtcgacgtagtcgtactcaagcacaagcgagcagttgcacaatgctctcccaaaaacttgattcgcttcctcttctcggtgcaagatctggaaggtgggggttccggaggcctgctctcccagcgcgtgtgcacacactcgtcgggatgtgatcattgtagcagcaacagaagtgcaaatggatgaaaatgtgtgtattctcacacgcgggagatcaaatccatcttcttttataggagaaaaaggaagatgaaggggaaaggactcatgtaatgtaaagagaaagatagaaactgattgtcatcaccaagccatcaatcatccttcactacaccaccatgaaacaaccattcgattaattaatcattggattaattctcaaaaaattcttcatcttaaccattgataactcatgagaagatgaatacacatatctcctagcataataaaacttagaatttaattgatttaaatggatcaattacctaattaaatctaacacttgactaatgagttttattgatattttagtgaaacgagtatagattatttggtaatttgaatcaaacagggggttttgtagtgagccttgggctctggcactttttttctcgctctcacatgtccagtcaacaattaactctgttcagtgtcaaaaggaaaacaattaacattgggttgtcttggtttgacattaccagtgttattactggctaacctgcaaattcccttatagatcagaataatccgtttattttgatataagtggattcacggattagttacttacatccttagttattgctactccctttgtggacatcatgggtaccgcatacccacttggcctgcctatccgactagcggtaggaggtggaccgaatccatgtattatgtaatagagtaagacttcgttgccgtattgccttgtatcctaaagtagggtatagagcttcggctgaatactaacatataatagattagaaaattgatgccgtcactactacacaaaacattttcctggacatgggacacttttgttttcaggcgggccccgtaagagaaaccacacatgataatcaggggaccggcgccgagcagttacctgcacacaaaaatcaattttcgtgtgcaggccactgaacgcggccggacgcgagaatagccttatttgcgcgtgcggacatgttaagtggcccgcacgcgaaaataggtgcccaccatttaatccggccgcacgcccactcctccctctcccatctccctcgcccatctccatctccatctcccatctcctccccctcctcccaagccgcccggatctggtgggggggagcggcgggctcggcaaccgtgagcggcgtgcacacggtggtgagctcgtggtggcggtggcgggcgacaccct

SEQ ID NO: 61809 - DNA, 3134 bp, Oryza sativa
tttggtgattaataataatagggttaagggactaatgagttttattgagtaatacttaggtgttttagtcccaagatggcattgtgtggtcaagagatgcttgggagacccccacaacatatattcgagcagaattggaactcgaggtgtgcatatgatagtttatttcttgtaatcgagttttaggaaaaaccgtactattaagaggggttccaggtgtggttctgggatacatcaagtgctcttagtgagatccaagtgtcaaaaattttttagagctatttttgagaatagccctatccaggacagatcaggacggccgaaagttccggtcctatggacccggaagttccggaccattgaagggtgaaaatttcctaagtgttgtccggaacttctggaggacaggaagttccgaacctgtttccagttcaaaaatgtgagtaacagctggatggcatcacctagccgtccccagttcactctttggccatttcacttttgcttttccattccatagccgttgctagcctctcccaagagtttatttgcttcctccacctgatcttgagccattcttgagagagagtgagattttgagggtgaaggagaagatttggagaaggtttgaaggttaggattggtgtgagcacttggggtatcttgtgggctgacatctcggtgcttattactcttggagataatctcctagacggttaggtgttgttcgcgagcttcctttcaattgtgcatgtcccgggaaagtttgtgaaggtattcctcacctccgcaaggaaacgaggtaagtgagtaaagaatcttgtgctgaagtcctagaggttttcctagtgtggtgttttctagaagaaggttgggttggatcttagtggtcactcaaattctagaaaatgacctaaaggtgttggggttgaaggctgtggatttcctctgagatttttgcacaaatgaggcaaggggttaatcgagacccggctctttggagcacctcaacgaagagtaggatcgtgagatccgaacttcgggaaaaaaaatcctctttgtcccttctgtgatgaatctgtgcatgtgtctgtgatattgctacctctctgtttacctgtgattcatctcgtgaattttggctaagttcctgttagtgattcctgaatttgtctgttgcccggaagttccggtataagaacaccggaagttccgaactttttgagcagataggaagttctggtgttctacacctggaggttctgggcctgtagaattttaccgctgcgatttgtttttgagttttctggcaagcctattcaacccctcctctaggttacatctatgcatgttcacccccccccccccggatcgtgcgacaacgacagtgcgcggcccctccctcccctcccttcccttgccttgcagatccggtggaggggaggggcgtcttcagccggtgacgggagcgggcggcggatccggcgtcaggagcaggcgacgacgacggcagtggtggcagcggtctcccagcgtctggatccgttgccagcgaccgcgggggcgacggcggcggctggattacggttagggttttggttttttttctttttttttgtttcaattttttattttcccgtgcgggtgcctcacctgcacgaaaaaattgtgattttcgcagacgttgggttccagacgggtgaaaccaccgcacgcgaaaatgagtttccactgcacggaaaaatcgttattgtagtagtgcgtgtctggctaagtttttctctttgtaactctgcctcccaactaatattagatgggcatgaagccctacaaggacataaccacaaattgatcattagatcaatacaacacccgacgaattcaatccccaaatagaagtagagggcatgaacctgtctaaaccattgacctctttactcattcacttttagaccttgtacactacacccttttcttattgccggtctagaacaatggcatcctccatcctaaaatataaggcataaccaccacaaactcaaaaatgaagaaataatttaattaactagattgtatcacctcgatatatgcacgcaatgtgattagagggcttgatggtagaggattttaaataaaccaaatttagaggaggaagatacactaattaatatatgcatatgtgaacgcattgtattatgagatatgagaaaatgttcaatcttatattatatttttgggatagcgaaagtaataatccagcttggttcagactttccatgctcactgataaattatttatacatgagatgttgtatccagggatgaatctaggataagattggagagaaaactcacattcccctactcttcctcctctccctcttctccatttcctccctccttttataaatggtgaatccgaccatagatgatgttgatgaacgaacattggagttgatcaggtgttacgtaccacacacaccaaaaggccatatatagcgtccgtacgtaccgtacgtggatcggtgtgttcggtcggcatcaattgggagtgccgccgttccgttccgttggggttgcccgtgacgtgacgctgacgcaagcatgacgtcggccgtggacagtcaatcaatcagtcgcctcggtaagggtacgtacggagtagttactacatcctgttttctggagtaacagatgacgccgttaactttttctcacgtgtttaatcattcgtcttatttaaaaaatttatgtaattataacttattttgttatgagttgttttatcactcatagtactttaagtgtgatttatatcttatacatttgtataaaatttttaaataagacgaatggttaaatatataagaaaaaattaactgtgtcatttattaaaaaatagagagagtactacgtacggcctggaccgatcagccacccaacgaagccgtccccatcacgttctgtcgatcaacggccggccattgccatgcacatgcatgcagatcgacacaaccaacgacatgttgactgttcggtactatgctgctcctctatttgacttcctactcgcagactgttaaaaggtgactttgattggtgtattccctccgtcctaaaaaaatcaacatatt

SEQ ID NO: 61810 - DNA, 2724 bp, Oryza sativa
tatataaatccctctgtccccaaactagtttatctttaacctctactatttatcctaaaataagtacattcctttatctatacgtgtgtgcagtccgcaaatcaattttactcgttcaataccccttagctacccatcaatactataattttctattaatcgaggatactttggtctttttactccacattaatttgtgttccaatggctaaagatgaatttatttgaggacagagatggtattaataatggtccaatttgtactcaattatgtacaaacatgtatatatacgtacaaaaaaagtccatttaattatcccctaaactatttcatttgaattaaccgctacaatattttttttcctaattttaccctaaactactaaaaatagttcactttagtactgaatattatttatcaccttttgtttctctttgtatcagtcctattttaagctaaaatttttaagacataaatgacaccctatcaaagttcccaaatatttctattgctatttactttaaatttaaaaccttgatatttagatcagcctatgtactttcaacatatgcaaacgacaataatagaaattctcaaaaatgttaagaggtatatgttataatgcatctactaacccatcaaatttcggagcataatatgacatatatatagacacagacaaaatattgttagggagtaagattgatcgtttttatatgaagtaagatggagtgctttttatagttgagggtgtgaaatgaaccaaaaaaatatttacgggttaaaagctcagcgaaatagttaggagtaaaatgaatttattttctagaattcctactttggcgcaaatgtgctagcaaccgaactggcgaacactttatccacttatccgttcactcgatcggttacccctccatctgattcccttggtttcgccccccaaccttgatgtttcgttccaccatagatgagatgccgctcctagctcccctcgacactaccaagcgaggttcatttcttcctcctcccccagcaccttgcacaccctgccccccttttcttcctcttgagcgattctaagttccccttcctgctcatccttggcgagacattgatggcgtcgaacggacctcggcacctcgctaccaacttccacacgacgcaacatgtgagccgccgctctcatagaccttatgtctcttcttctttggggagactcgattctcctttctcctcccagcgagatatcagtgttgtgggaaaagctacgggaatgggatataagtgagctcccctcggttgaaaatttgagttttctaaatttggaagtttgttatgtaagttaaaactttagaggttatgatttaaaccttttcaaaaattggaatataaagttccggaaaatagttgaaattttttaaagtatgaatggaaagttttggccgtcaagtgaaaaatgttatgaatggtagatttattcgaattgggttgaaaattttataccccaaatagaagaacttttaaagggttccgattgaaatttgagatttaggaggaaattgattaggagatgtattcttaatccaagttcaaatagggggagaaaggctgtgtttagatccaaactttcaacttttttcatcacatcaacctgtcatacacacgtaacttttcagtctcatcgtaccaattttaacccaaacttccaactttgaaagaaactaaacacagctaaagctaactagactgtattatgatagaatcagatagaagcgcaaacacgtttgtctagttcgccacgcacccctttggccctttcttttctgctatagtactacaactgaagaaacaaaagtatgaagctcagccgcagccgcgtcagcgtcatccgctgctactagtcaattgctatccgtcgaggtagagcggtggccgggtcgatctagtccgtccatccgtaagatccgacggttgcgaggaggcgaagaggtgtccgggcggcgaggtggaggccagcagcaggctaatccgcggctggggcgcgtgggtcccacctggcagcctccagccccccttgccatccgcacgaaggcgcagccaaactgtcgcaatcgcaaaatcgcaatcaatcgatcacgggatttctcggtgggccggtggggcccgcagcgggtcgagcctctgacaacgcggcttctcggtttgtcgcctgcctctctgactgacagactgacaggcgacagctgcttgacccaccccacgaccaccaccgccgccgcgagcccgcgactttcttcccttccccttgaagcaacaacaaccaggtgatcaaaccgtttcggtctgggtcgacgcccattgcacaatcaatttgtgttcacacttgcctgcctgacgcgtcccccatcgttactactcccattttgagtttttcttgtacgggttgaccactcgtttaattaaaaaagttagaattattattttttatttattttattattcaaagtatttaagcacaacttctcgttttttatatttacacaaattttttcaataagatgtatgttcaaacaatacaaataaaaactcaaaatctcttatattatgggacatagagagagtacagtccttttgatgatctggcggtgcacgttgctttttttttccttcttctcatggttgcttttatatgtatttttttataggataaaaagaatgaggtc

SEQ ID NO: 61811 - DNA, 6409 bp, Oryza sativa
  unsure (1)..(6409): unsure at all n locations
tatttgacaaccaatgcaaaccttaggtaaaaaaaaaggggttattggaaccatgccattataaatatcatagttttgaaatatgccattaatattcatctatttggattcatgccattataattccacatctatccattatacaccactacttgcccctttaacatattttccaagatgttatgaccaaattacccatatcttcttcttcatcccctcccatctctatcttgttcgtcgaacctgacatcctagcaaacgaaaatgctcacaccggacgaccgacggggtggagaaaaatcggacgctgtctgccactgcagcatgcaaagaatcttttcttttcttatttattcaaaagattttttttatcgtaaactatttatctaatctacgatctgattgcaccactaaattcgttacaattaaatctttacaacaagaccacacatgattatatttcgacaaaaaaatattttaattttttattgatttttttaatgttgcatgtggtttcttttgatgtttcaactagtagttttacaatgtttcagctagtgtactcatgatgtttcactgtgtacggatcaaatattgcagtggaacgcgccgttgcaataaattatccacatattttggaaaccctctattaagagaatttagtttattttttgttccacaaaaaaatgtttcacctagtgcactcacaatgttccactatgtatagatctaatgttgcagtgaactgaaatatttcattgcaacaaaaaaaacccacatattttggaaacctcctattaaggaaatttgttttattttttgtttcaccgaaaaatgttccacctagtgtacttataatatttcattatgtatagatctaatgttgcagtgaactgaaatattcttctgctatttgctgaaacattgtttttatataagttgaaacaacaccagatttaaacgagtgaaacatttttcaatctacttagtgaaacaattccgatatacctggtggaacatcatgcaacatttaaaaataattcaataataagctattttttttcatcggaatatatccatgtgtggttttgttttaaagatttaattgcaacgaatttaatggtgtaatcggatcatgatttagataagtaatttaagagaaaaatcagtttaaaagtagttttgcacgtaaatcggactatgacgtcatgctgatgtgagcatccgatttttccctaaagcatcggacgtccgacgcatagccctctcccctagcaaacgaggcgaggttacgggcgcggggatgttcacacccggccggatgtgctcgcgctccgcctcacgcacttgctgctctcgccggcgcaaccctccgtgcccatggctgccgtgctcctgcgccgttttatttccgccggggtcacaggatgcgggcctccacgtcggggttccccatgtttatctggaagaagctctcctactccaagggagaaggagatggaagatgaacagggtagagattggaagagaatgaggaagaagatagggatgatttggtcctatacatttagaaaatgtgttgaatgggcaagtagtggcatataatagatatgtatgaaattataatgacgtggtttcaaatagacaaatatcaatggcatattttaaaaccataaaaattataatggcatggatctaattaacccaaaaagaaaaacggtcactaacttacaacgagttccattcaaactctgatccattcaaaacagtagctgatcgaccttgatctttttttcttttccaacagtaagtattcaaagagcaatttcatatgctctgataagttaaagtgtcaataacatgtcatgatacaatccccatcaagagccctaagtgttctatttacattgtaactctagttaaagagattaatcctagtactagtgtactggtacagtacaacggtacaagtaccagatctatgacacgtgtgtagtatacctttacagttccccgtttcccgctatgacgcggcacaccaaaaatttcagcgaccccgcttcgacggcggcggcggcggcgccgccgggcggcggactacgtggcgacggccgtccagtagctggtcatgcaggcgctggccggcgtgctgatgatccgcgcccactcccacccgccgccgcacccgtccgctcctcgccgcagctccgccagctgcaaccacgagtccacgaccaaaaaaaaaagctccggtaattagacaaagctcatcttcctggcattctttgagcgagggcgcgcggttcttgatttcgtgcgatgtgatgatgatgatgaggaggggaatcgaggccggtcgcttgcttaccctgccgtcccgtagctcgaagaccaccgcgtcctccgagaacggcaccggccgcgcggccgccacctgttcgacgaaatgcccccagcgccattagcagccttttagactccctagaccctagttactaccaagaaacagcgaaatggaaggggggtatcagaccttctcgtcgcagcttcccacgaagccgtccgcgtagtgcgcgtcggcggcggagcccagggtggcgcagctcttgtcgccgccggccgcgttcatcgccacggcggacggtgccgacgggtgcccgtggctcgtccacctccacgtccagttctcgaggtgtcgccggtagacgtcgccgtcggacccgatgatgaacagctgggagccgtcgaagcacggccccggggcgccgacgatggccacgtcccggtggggcgtcccgtgctccacccactcccacccgtcctgcgggctgaaatggtactcgactaggccgccgtgctccgacaccatgaagatggagccggcgagggagagatgggacggcctcatcgctgtccccggtgaccgtgagaggacgaggtggggtgattggtagtgcttgtgccatagctctgtgattctgttgtactggtacaggcggccgttgcggccaaccgcaaagatgacgtttcttctgaacacttcctgatccactatgaatgcaatcttggtatcaggagggctctggcagtccttccacttgaatttccttaatgcaacctgcaaaagttttagaagggcatcaacttggtgctgttctgcacagaggttggcatatctggagtgttaattattgtcatgtagggtttacttggtatgcttaccatttaattgtactttgtttatggtttgtattattaattaaaaaagtatgtcaaactctttagttactgtttatcttgtctcaactgcaagcaatatgagtaatgattgtttagaattacaagatgttcctaaacatgaattcctttttattttatactgctttgctcatactaaatgctaagaacgtaggaagatgtatggttatcctgaattactgaagtatatgatagcagagatatttgctacatttgccataatatggacctatttcaagcactctgtttctgttctctgcctgtaaactcctatcagtgaatctcatttctaactactctagattagtatgatgcatagacatgccattatcttgagtaatgcattcatcatttgttcattgagtcattatttagcaagaattaatcaattttgcctgctaaatatgcacatgtttaaatcttgggcaaaggaacagctcaactaaaagtgggcacattcgaaatcatttttatttctaataaggctaataatcgcatgaatnannntagggcntgtttaaactnttaccgtgaannnnagtagcctgcctcttttttaacaaagaagagtgcgtcatctgttgtcactctgcgtggtaaacctggaatgccatcccatggagacccacttgcgacctgccttcccttcctcattgctgtgcagttgatccataataagtcatctccatttctttctctgatatgtaagttcccgtgaacatcgacaagatacaagctgccattatagcttcctactgtacctttcatggaagtagtgtgctcatgtcttagccataaccaaacaccattattgtttagatattcaaaagttaagccgttatctgttatgagaaaaagtgatctatctgcatgcatcacccgcatgtggaagttaatatcaatacttcttgatagaaagttatacgattcgatttcatccctctcatgggtattaacgtacaggtattgttgcttatcttctttacgccatctggaaggtgggatattgcccaagtcatttgatttggtatctgcagctacattctttgctccagtaatacaatttgttggaccatgctcttctgtgcaatattctgcattccaaccttctgtttctggtgcatctagaatggaccactcatacttgtttggcactttccttctcatgctatagtgttgacttggaccaaaatcatcaccacccataccaggcaaatgcagctccccaagcctaccatcatccagtgggaatattactcggccaacttgaacctgtacacctcggacatttcttgctacctttgtattctcaggagacatgtgatttacccagagtcctctgatcttattgctttgagctccaccttttccattgaaaatatagatcatgtcaactctgtttcagcttgatattaataataagttgttgctctagtataataattaaatgattgaatgaagacaatttgttcaaagaaaaaggttcacacaagaatgttccacaggcattaatctagttgttttgctttgaatgcatgattctattgtgttacctttattattgtttttttcatagaacattactttttgttgataaaacaagagcaagaactaagaactaagaaccaagaacaatattttttttaaaaaaagaataagtgcatacgacattgaatcaggagcatatggtttagatgaaaggtgttttgctggagatatcactttaagagcagttccttcgtttttttttcttgttttcatatttcaaactgaaaccacacattgaaataaatcaatatatggatctgctatgaaaattttcttcaattctcaaattcatctttgttgtttgtttgattttattgacctttttaaggggaacagtaggggagaactctacgagaatacttgattgaccttgagcaaatgaacataaagaaagcagtatctccaaaggagtctatacctgtatattttggaaactgatactcgaatacttttcctgtggttgttgtaaaatacattgaagttgcatcattagattcatcttgttgcacttctgtgatcgaactaagtctttgactcttaggagctccatgtttataccatttccacttccttctatgcaagcgccgctccactaataaaccatcctgccaatctataaaatatctttagcaaatagataaataccgttttacaatggaaatagaggtcctagccatggcataattttactttattggttaacaagaattcctattattacatatatattactctgaacttatctataatgagttcatgaagaggctgtcaatttctcttcaattgtattataacacatgatcggtcataatgttcttgttgacaccctattttggttgttttgcttctgctacaagatgtccaactaaggaaccatatacatgtttctttttcttttagtacatttcttgatatcatactttttgcaaaactatcataaaaaccacaactttaaacaggattttaaggaaccatatgaactttgcaaaaaatgtttcagaaaatgggctgctcagtcaagatggtttctgacgcattggaccacataaaagagagataaggcacatccttcctgtttacttgacatgggggcagattccgttgaggctaaaatatccacatcaggtaccttaaacagactgaatatgtcttaaaaagtattcttttgtagaaaaaggtttgtgcaaaagcatgatctcaacttctcaagaaatatactaatctttttgcaagtaccttcatcagctctgtcagtctatcaggagcagataatatatttttgagattattttcatattataacaatcagcatcgctagactgtatgcatttataatgttgctgcattagcttggatccagtaagtcatttctgaaaagaaaatccttgcatacctttgttatcaagaaaagtgatactgagttagatcctagcaggccatgtaaagcacacccaactgatgagcttaatgagacattctctgctgtttcttcactccatatgtgctttttccatgatggtcttgattctctgtcgaattcatacaagtctcctgtagaactgcaccccactttcccatcttagcactgaaatacagtaattat

SEQ ID NO: 61812 - DNA, 2486 bp, Oryza sativa
gctccatgtgatgaagcgtcaacgacggtatatggacccatcaatttgctttgaagttttccatgtccgaaaagcttcacccgtgagttgaacagcaacaccttctcccttgctttgaactccttgtgcttgattcgtttatcatgccatcttttggttttgtccttatatatcttggcattgtggtaggccttgtccctccattcctccagctcagagagctgcatcttcctgtgctgtccgaatccctttatgtccatgttccaagtccggatagcctagtgcgccctgtgttccaactctactgaaaggtggacaagtcttcccgtagacaagttggtacggtgacatgccgatgggcgtcttataagcagtcctatatgcccaaagtgcatcaggtagtttgttcttccatgccttccccatctcattgacagttttctgcagaatattcttgatttgtttattgcttgtttctgcctgtccacttgtctgaggatgatacggagtggcaatgttgtgctgatccccaagttcttgcaaaaagtttcggaaggtcttatcgatgaaatgagaccctccgtcacttatcaccattcgcggagttccaaaacgagggaagataatctcggggaacatccggtgggcttgcttggcattgcctcaacccacttggacacatagtcaacggccaccaggatatacttgcagtcataggactctgggaaaggtcccatgaagtcgatgccccatacatcaaatagctcgacttgaaggttgtatgtcagtggcatcgcatctcgagcagtgatccctccatgcttctggcaacttgtgcatctccgaacaaattcctttgtgtcatcatacattgatggccaaaagaatccactctactagatctttgcgtgtgtcctgaatgctccatagtgacctccatatggggcaggatgacacttctcaatgatcttcatgccttcatctaccggaacacatcttcgtagtagaccgtctgaacagactctgtataggtaaggtgcatcccacaagtgcctgcggctctcgtagatcaacctcttcttattttctcccattggcacatgccccgcaaccatgaagttgacaatggttgcatgctacgggtcagagctatgactttcagcagcatgtcgtcacgcagataatcatttattggtagctccttcatgttagtgatttgcatatacgacaaatgatctgcaatagaattctctactcccttttatctttaatttctatgtcaaattcttggagtagaagaatccacctaattagtcgaggttttgcatcttttttagtgagcaggtattttagtgcagcatgatcagtataaactattaccttagctcccactaaataagacttgaatttatcaatggcaaacaccacggccaggagctctttttcagttgtggcataattaagctgagctccagtcaaagttttactagcatatgcgatagcttggtgttttctatccttagtttgcccaaggacagctcccatagcaaaatcactagcatcgcacatgatttcaattggcagcgatcaatcagggggttgaataattggtgctgagatgagcgattccttaaggattttaaaggactttaaacactcatcatcaaagtcaaatggaacatccttatctagcaaggcaattagggatctagcgatttttgagaaatcctttacgaagcgcctgtagaaccccgcatgacccacgaagctttggactcccttgatatattgacaggaggtggaagctgtcgaattacttcgatttttgctctgtccacctcaactccccgttcggagatttgatgtcccagacatttttcttcactattccttcacgaaccatgaatgtggcatttttcccaattaagtatcagtccttttcttgacatctttctaagaccctatcaaagttctccaaacaatgatcgaaagatttaccatagactgaaaaatcgtccatgaagacttccatgatatcctcgatcgtgtcagagaaaatagatgtaatgcatctttgaaatgacgcgggtgcattacacagcccaaacgacattcttcggtatgcatacgttccgcatgggcacgtgaacgtggtcttactttgatttggtgataaccagaatacccatcaaggaaacaaaagaaggaatggtttgctagccgctcaagcatttcatcaatgaaaggcagcggaaagtgatccttcattgtagccttgttgagtttcctatagtcaatgcacattctccatcccgtgacggttcattatgggatcaactcgttgttcgagttttcaacaaccgtcatgcctcccttcttaggcactacttgaacagggctaacccactcactatatggcatgggatagataatcccgacatgtaggagtttcaagacttcctttttgacgacctccttcatcacat

SEQ ID NO: 61813 - DNA, 2050 bp, Oryza sativa
agagtttgtggaaattcagaaggttttgactgttggttccaacggtctgtcccctaagcaatcgaatgcaaaggttgtagacataatattggcaccaacagagggattatacagagcacggactaaattacctccaatgagacaagtaatggttgaggcagggcatcggatctgaatcgattcagatgagagctctccttcccttaaccattcgttactcatgatgatggtcaacttcttcaccgtctctttaagcatagctttatcgagaggatcattagagttgaccttggtcggtggtctcttctcacaggaataattcgaggtgttcccataatcttcgaaaagatcttcctcaaattggaatggaatttccagagaatgaatttcttcttcctccgactccacatgcagagattcctcatggataatcttgacctctgggacagcttcacttcggccgaagaaatcgttcactaagattagatctaagagttctcttccttcggcggttgtcttgtgtgcgaacgatcctctagtggaaatatcgagattttcggcagactccttgtctaacccataccgaaaattttgcaacaacacataatcaatgttgcaacaacacataatcaggtaaagacaagtcccggaaaactcatgattttgcggaacgaacgcacccaatccactttaatatgttgaaaactcatgttttagtgctatttgaactttttcgttccgacgaaaacatcgcacccacgtgtgccaatattgacattatatgacaaaatgtcgctgagcgggtcacagagatatttttcaaaaagaatgcgcccaatccattctaatatgtcaaaaactcatgtttttatgctttttgaactttttcattctgttaacagtgaaatttgataagccccgaagtcatcatcggcttagagttagtattggtttcagagtcctggaatcggccgatgggcattatcagtcgccatttgtcagattcttgatgggttcagttaaggaaattaatctattcaaagaagcttatctagaagagaccaagtttaagaaggatgcggcatggctagttatctattaattagcaatagtctcttagtttccttttatctttaggaaagtttgtttagtgtccaataaggactttatgtttccgttttatctataggaaagttctttcgtatcctacaaggactagtatctacccatgggtataaatatgtacacccggggtcattgtaaactatctccacgatcaatacaaattcgacgcatcgtcaccctttttaattttctactttttcgacgagtttatacttgtcatggctgtttgcattggcggggcttagggcttccacactctgatcttgtcaatgtaaacacctatctatgatatatcttagttaatctactttggtagttcaatttacttgtatcggctgagattcattttagggtttttgtcggtatctactacattgctttaccagattagattagctatggtatccaccatcctgaaaatcagttaaaggcttcattgtctacatattatgtttcttttcatactttacgctgcatcagccctagtcatgcttagaaccataacctctagcctactttttgattgccaataagggtttcatcggggtttcggccgatgagttatctagacgttacatcggcttataaggattatatacaagttggatttagcctatcacaacaaaggtttcactgtttatcaaatattgtggatttaatgacatcggacctccagccgatgtatgctttaaccttcagataagtgctaactctatcatatagttagccgattggtttctacttgattatattgttgttttgttacattaccatcaaccaacgttatttacatcaagtatcagaatctacattggacatatagctgataggtcaaaaccctatcgacatcggctggaactactccatcggtttgtcaaccgatcggctctttgatctgctatttgtatatcttgtccgtagcagg

SEQ ID NO: 61814 - DNA, 2910 bp, Oryza sativa
tggcattaattgacaaaagtttggcgcgcgagtcacgaagtgattttttttccaggaacgcacccaatacactgcaatatgtccaaaaatcatgatttggtgttttttttgaacttttttttgaagtgaaaaacatcgcacccacgtgttccaatgtatgccaatatggtcattaattgacaaaagttcgccgcgcgaatcagggagtaattttttgccatgaacgcacccaatatactccaatatgtccaaaaatcatgttttggtgctttctaaactttttcataccggtgaaaaacatctcacccatgcgagtcacggagtgattttttgacacggacatacccaatacactccagtatatccaaatagcatgtcttgatgctttttgaacctttttaattaatctccaatatgtccaaatatgatgttttagttgtttttgaactttttcattccggtcaaaaacatagcacccacgtgtgctaatattggcattaattaacaaaagttcgccgcccaagtcacgaagtgaattcttgcaacgaacgcacccaatacactccaatatgtcaaacaatcttgttttcgtgctttttgaactttttcattccggttaaaaacattgcacccacgtgtgccaatattgacattaattgacaaaagttcgccgcgcgaatcacgaagtgatttttttgccacgaacgcacccaataatctccaatatgtccaaaaatcatgttttggtgctttttgaactttttcattccagtcaaaaacatcgcacccacgtgtgccattattggcattaattgacaaaagttcgccgcgcgagtcacgaagtgatttttttccacgaacgcacccaatacactgcaatatgtccaaaaatcatgttttggtgttttttgaacttttgcattttggtgaaaaacatcgcacccacgtgtgccaatatatgccaatattggcattaattgacaacagttcgccgcgcgaatcacgacatgatttttttcaacaaacgcacccaatacactccaatatgtccaaaactactgttttggtcctttttgaacttttttgttccggtgagaaacattgcacccacgtacgccaatattggcattaaatgacaaaagttcgtcgtgcgaatcacggagagatttttttttaatgatcgcacctaatccactccaatatgtccaaaactaatgttttggtactttttgttccgttaaaaacatccctcccacgtgtgcaaataacggccaacattagaattaaatgacaaaagttcgccagtatgtcacggagagattttttcgtaacgaacgcagccaatatatttactccaagatgtcaaaaagtgttgttccggtgaaaaacatcgcatccacgtgtgggaatatcggtctatattcgcattaattgacaaaagttcgccgcgcgagtcacagagtgatttttagccacggactcatccaataaactccaatatgtccaaatagcatgtttaggtgctttttgaactttttcattccggtgtaaaacaacgcacccacgtgtgccaatatcggcatttatagacaagttcgtcgagcgagttacgaagtgatattttgccacggatgcacaaaatacactctaatatgtccaaatagcatgttttggtgcttcttgaactttttcactccgatgaaaaaaatcgcacccacgtgtgccaatataggcattaattgacaaaagttcgttgtgcgagtcacggagtgatttttcgtcacggacgaatccaatacacaccaatatgtccaaaaatcatgttttggtgccttttgaactttttcattacagtgaaaacatcgcacccacgtatgccaatatcgacattaattgacaaaagttcgctgcgagtcacggagtgagtttcagccacggacggatccaatacactcgaatatgtgcaaatagcatgttttggtacctttttaactttttcattcgcgtgtaacagcgcacccatgtgtgccaatatcgacattaactgacaaaagtttgctgcacgagtcactgagttatttttggccacagacgcacacaatacactttaatatgtccaaaaatcttattttgctgctttttgaacttttttattccggtgaaaaacatggcacccacgtgtgccaatatatgccaatattggtattaactgacaagttcgccgcgcgaatcacgaagttatttttttccacgaacgcacccaatacactccaatatgtccaaaaatcatgatttgttgttttttttgaactttttctttgaagtgaaaaacatcgcacccacgtgttccaatgtatgccaatatggtcattaattgacaaaagttcgccgcgcgaatcagggattaattttttgccatgaacgcacccaatacactccaatatgtccaaaaatcatgttttggtgctttccgaactttttcataccggtgaaaaacatctcacccatgcgagtcacggagtgattttttgacacggacgtacccaatacactccagtatatccaaatagcatgtcttgatgctttttgaattttgaacctttttcattaatctccaatatgtccaaatatgatgttttagttgtttttgaactttttcattctggtcaaaaacatagcacccacgtgtgccaacaatattggcattaattaacaaaagttcgccgcccaagtcacgaagtgaattcttgcaacgaacgcacccaatacactacaatatgtcaaacaatcttgttttcgtgctttttgaactttttcattccggttaaaaacattgcacccacgtgtgccaatattgacattaattgacaaaagttcgccgcgcgaatcacgaagtgatttttttgccac

SEQ ID NO: 61815 - DNA, 2900 bp, Oryza sativa
aaaagcaaaaaaaaaaaaagcatccatgacctgccatatttgtgccattgcattgttctttttagtttttgcgttgttgaattttgtgttgcatcgtcacgtcgtgttgttggtcttagcgtctagttcgtttagagtttcgagttctggtctcgtttgtacaacagtcgtcgccacccccgtgtctcagttgtcgtcgagacctacgaaaacagaatcagctcgctgccacggttctattttcgtactttgaagaagtttctatcggttagtttttgagttcttgagttgtatagcttctgtttggtggctgtgccgtgatggagtgtgccatgatggtgggcctgtgatgttgcgcgtgaggaagaagagtgaaaggggatagtagatcggtttttggatgaagtgctacaatttgtagattggtttctatttggagggccacgcagaactactaaaaagttactgccgagtctgtttcagtttattacgtggtgcctttccaaaccgaggccgagtgggatctcttcccttccaatctcgtgaccgggacttgtgagtccgactccctcccttccctcacgactccgtttctgtctaggtgtgtcaaacactggtaaaattttcttttggtgtcggattcaatgtccatttgcaaaaaaagggaacctgtaggacgagagcattccatttttgtacaattttaattttgagtttgcacttttgcatttgtgtccctgtaatttttatatttacatttgagtccctgtaaccttacattgaggtccttgagtctgtttttgctaaaaaaatataaaaaaaagaaaagaaaaaaagccgcaccaaaaaataaagaaaagaaaaggagggaaaaaaaagagaagaaagaagaaggaaagaaaagagaaatactgttgtgtttgagctgaacttcatatatcagagttgtgcatgagttgttcctagtgctatcttgtggtatcgtttgtgtctaggctcatgtctctagtactttctagcctaggaccagcacggtactggactttgaacgatcattcaactttgcattatctgatttgagcatttgctatccctttgctacatatttaagcctgccaagagctccacagatctgattgcaaccgtacagcaagcgtttggccaaggcatcgatacatccaacctccattggggtgcttgattgagtcagtgtatgtcaccattccgcttgctttggtaagaacttgtaagagcttggttaaaagcttgagtgtgtgtgatatttgagctgccactacctagtagttgataggagcgtgcatattcctgtgtgtgtttcttgtttgctactatccatggcaggattgtgcaagggaatacgagaacattggcttcttcaccgtctacaagatatgacaacgtctccatgtgatgcatatgaggtacatgactataattttgcgcgagttgaacctaagttaccattttaggatggtaagtatgattctgttgcatatattgattgggaactagcagtagataatgaatttgacaaatatgatttttctgaagctcaaatgattaaggctgctagtaataagtttacctcttttgcattattttggtggagttatgttagtaatcaacctgaaacttgggatgaattcaaaaccatgatgagaaaacgctttgtgacatcttattacaaatgtactcttcgggagaaattagaacatctgaaacaaggtgatagaactgttagagagtacattcatgaatttaaggtctgtatcatctagggtctcaaagagtgcaatgaaaatacaacgcgtagatttttcaatgggcttaattctgaaattcaggttttgcttgataatgtgacatataatcatattgcgtacctattcatgcttgctcgtagcattgagagtcagatcatatcaaatgcgaggaagcatgaacaatgtgatttatctcccatttctgaatctcctatatccttatgcaatgatgatgtgcaaaaattggaggagcaatattttgtctctcctgttactaacgttttgcagggagttcagaacattcaacaaaaggaggagaatggtgtacttgagaagaaaggggatgaagcacctgcggtttcagaagaaagtttgcaaggtaaattaaatggtactgagataaatgaatgtgagtattctcaagctgagctacacatgtccacttttcatgctatagtagagcaaccattagtggaaccaattgctgagatgcctttgtcacaagttgattaacttgctgttccttgtgataaagaagagttgtgtgataatgcttcacttatatccatgccacaactagtgaatgaacatgctatttctagtgtttatttgtgtgctgattttaagcatgttgttcacattgcaaatgaagtagaggaacatgaattgctatcttcattaaatactttgggctatgtttggtttgatgatttttgtgagctcgaaaatttgaaggagaaattatttgctaaatctgatttgccatgtccaactaatgctatttctcatatctttggcgaatataatgatagaggaatatatttggggcatagagtttacatatgttcgtatttagaaccttctgtacatgtggataaaacaagcaaactagagagaaatgttactgctaacaaaattatctcgagtttggcttgttttgattggaagaaacaggttgttttaaatggactacgtgaaaagcaccatatggaaaaaccggggacggttttccataaagatggggaggatgatgtgaccatggctactacggatacaaccattactcacatcatggatgaacaagcagatatgaagatcaagtcctccaagtgctgg

SEQ ID NO: 61816 - DNA, 4866 bp, Oryza sativa
  unsure (1)..(4866): unsure at all n locations
ggattttttgggttttgtttagataaaagtttagcttcgctacttttccgtgtaatcccgtgatcggttagatcgctggtttgctcgttacggaaccccaaacctatcatttgtattcaattcctatctgcaattcagattgcttttatcttgttctttcttgtttcttcgatttgcttgcaggaataaggttgatctgcaccggcaagatcaataacccatggagaggtgtatcgatcgctaaggcacaacacaacaacgtctagtacggttgtagtcgggtcgtcaacgttgctccctaattgtagttatcttcaactcatcgaaagatcgggccaacaacagccttgagtgtctcgagtggaactcagggttcatcatatttatactaagtgctctagtactaggactctagatagagaaggaagttcctgcgcaagtattagagtagtaattaataacttagacgtggtgtctaggttagagattacctttgtttgttgtgtatcccacggagttagaggtaggtggcagatggtgttagccctgagtcccgtcctagtaatcctccatgttcagatacatcatagagctatagccagaaccacgctggcagaccagcaggggtcgatgcccgaagcaacaaataggaaattacctttgtttagcatagataattaaaaacacatagaaagtcctctctagcctagcctgcctatcattagttgttgtccttggatcgtcttagccttaggtagattacacacgttccctgagttcgatatactttaggggtcacccgaaggtgaagtgctacagcggtattccgtgcgcttgcggatttatctgtggtcgtaagaaataccaacaattaataacatgattaatgatgatactagtttaactcctggtttgtaagggcaaattcctggtttggaggtttgatctgtacgaccggggttggttgttcaggtttagttaggcctatgcagcattggtgtactgttcagtgttgattaatattgatgattaattactttactgttttacaattctcaaatgtttgctaaatgctgcttttatacatgagtcctatattgtgccattctttggcatccttgtgcacttgcgtacttgctatgtggcttgcggagtattctatgtaatcaccttgcaataatcaatcaaaacttagttgaagaaaagatgcgaaggagaaaacgttcggcttataccctagttgagctgcctatgtgagtggagatgaagccatcgctagaccgttaatccgttgctgttgttttcttttcttttataaatatgtagctttattatgatgatggatttgtatattaaattgtcagtttgtgtacctcggctgattcctggacaaggattttatgcacaaattagttcagaaattactagtgaaatttctgggtgtgacttggaacacactttatagagactccaacatcacacatttggtttttgatgtcttgcgacacaaaagtccaagtgtgggggaggtcaacgagcttgtcatgacgagttccatcaaccaattccatcctggtttgcagttggtgttagtcctaccttgctaaaaaaagaaaaaaaaagggaaaagagagacagaaggaaaagaagaaaaagatgggagaagaggaagagaactagtagcgatcatgctgcctggatacactcaacccctctcttgagctcatgtgtcgcattagtttagccttcatccactcctagttgtgcacaacctctcgctcccgcagcacctacacgcatacaagcaagaggagatgccctcttcttttctcggtgtttgctactccactctagttggcacttgtatatttgcgtaaaaagatatgcatcctacgtctctgcagcattgtgccaacagatcacgccttcaaggcacaatgttcctgcacgtgaggtgtgtgcataaccaaaccacttacatgagttggcattgtaaagtgtcttcctccgctacaatccgcatcaagacagaggaaagattgataatcacatgtgaccataccaccactccagagatttcaacatatacatcatgctggtggtaagtacacttaggtatacaaaaggcaacaaaagattcacctcatcttttactcatacttatctttatttgaataagacttgagcatacatggttatgtttcttgtgtctatttgcgtatgctctagtttgggtgtttgtgcaagacatctataggcttttgaaattaagcatggtacttaggttaaggtagtcttctttaatcaaattagacatggagtcgagtttgattaatgaactctcagagttaatatgttcgtggacattggatatatatatcttctttggactaacccctataggaaagttttcaaattgacgggtaagtcctcaagttcaattcacaatggaggtaggtcagggccaggaacaaatcaattgcaaacatgcaaaggataacacatcagctttcaaggtgcacggtaagtatactgtcaattgcttctttgttatgatcgtgcaattttatcttaagctctgtataagtttttgcttaatgaaaatttggtgaacagtaaattttttgaaaaatgaaagatttcaagaataaaagaaatgtctctcgaaaaaatgataataataattggcaaacttgtgggatccacgcttcttaagttttgaatccaattcctttttagcatggatgtgaacaactaatcttgaggctacgataaaatcttctcaaatatttgtagttcctcgagtatttgttgtccactaaccttttgcaggaaataaaaagacaactaaggagcagtgtacaaaaactgcaacacccataccacgctccttggtttatgagagagatgcacagggaaccaagtagagcaaatgcaacactttgttacattcgattcggttctaagcttggtaagatctatttggtaagaaacccaagcaccccgtgtatcgtcgcctcatatatccgccctgctaagatacccaccatgctccttgttgctatttaaaaaattagataaaaataaaataaaataaatttaggcacttcatgcgcctaaagttatttgaatacaatttggctcaccggtattacaccccggtggaagcctatttgatttttatgttttttgttgaataaaggcaaggtacaaaacaagtatgggggagtctttccggaactcccgacatgcaacagcatcaacttgacacatcaatatgatgaacaccagcccatggccgtgcacaaaattcagcagccagaaacaagtcctggctgggttggccgaaccaagtgttcgcccgacccttgcctggcccggctctgtcaccctttcaccgtgtggtcaggtttgcgcgtctcctctcttatcctcccatgtttgtgagtcaaacatgcatggaaaattcgaatagaatttattttgactccaaatgaaacttaaaaacattaactctcaacaaataaaattttcctatgattaatcatctatactatttgttctttgctaacacttctcacttgtgaacaaccatctatcataggaagctcatctacccaatagttcaacatgttgttttactcattcatcatcatcattcatcatgtgacacatccaacggtcaaaagtcatctgaataatttgtatccaacgtcccagattagcgcgcgtgcccacccctccctccgcatcctctcccgcactgcgcctcctccgcatccgggcgacgcgcgactctctcgacctcgccgtctcgccgcgcctccttcgcatcgtgtcgccggaccagatcaccgcgccctccctccggcaaatcaccgcgccaccggacgcccttccccccggcaactctccctctgcatcgccgatctgccaccgatccccgccgccggctcgccctccatgatccccatcgcttgtcctccgcctccccgccgcacgaggtcctcccgtcgccaggtcgccgcggccattttgctccaccgatccccgccacacgaggtccttccgtcgccaggtcgccgctgatgagatttggacccttttgagaattgttgtggcaggagttttgcaccttgcctggttctatgttcattgtagttactagacgactcaaacaaaagatgcatgcttgcttccatatttacattgttcatttacacatgtacacctgggatacgtttttcagatgcatttttttttcaaattcatatgctcacttgctgttattccctttattttggattctcttctagacttgttagaatttatcttgtggtttacttccttctgaatggaaacaccaaacccgtacagataaccaattggtaaaagccatatgcagaggccattgagttttgttgcaaactgtacttccaaaaaaaaaaactctggctcattctttctttaccgcagttcatgtatttgattccattgaacattcgagaacaagtcccaatgaaccattttatacaatgttgcatgagaggactcacgtctactgtgacaactcttttgatctcatgcatattcatgattcatctcatgtatccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcag

SEQ ID NO: 61817 - DNA, 1725 bp, Oryza sativa
cagccagtgcattaattatgctaccgctttaacacaaacctttattatcattacatatatacaactgcaaacttgtgcttttctgtttattatcatctgatatgtttgagtggttctatgctcgcagtctccaactagaattgtatgcatcttaaagcacctgaaggggtaagtaatacccatccacccttgaatcatgccttagatttggcaaatttgttccagccactagtcttctctataggacaatgctattttgtgactatttgctgcaagacaaatttcagtattccctctgttctgtaatgtaagatattttggttttgtcctgagttaaacttattcaagtttgaccaaatttatagaaaaatgtagctacatctacaacaccaaattcaaatttgaccataactaaatatatttttataatatatttgtttggtgttggaaatattgctatgtttctttataaactttggtcaagcttaaataaatttgacttcggacaaaaccaaaacatcttacaatatgaaatggagggtgtacatatgatatatcatttgttgtcactagaggagagttaattagggtggagtgaccagtgtgccctttggtgcatttcaaaaatattgctggacatgaatttgaaatatcaatcttaattcacaatcatgctaaatggtgcgcagagtagcaagcatccgagtgcctccttccctctgtttcctcgtttttcctttcttcccgtcctttactcattacatccgcttttctagttttttctgttcctcacctcctccccacatttcacattacactccagagtaaaggatttactcatccactcatctcctgtcctttcaaccatccactcatctcctgtcctttcatctttgtcctaagtaaaggatttactcattgactatctactaatctcattgtccagcttcataactaattaatcctgtgtaaagaatttacttatcgatcatctggttcataagtaattcatctttgctaaagatttacttttatttactcattgaccaataatacagctaggttcatctcccattcatcttagagttctttgctcatggactgctttccggttctcttcatagagtaaaaatattactaccgctcatattagtctcttccataatgtttaacagtcaatctactcccacatatttgttttttcccgttttgccctacttttggttttgtcctgcttttgtgagtggaaatgatatcagtagaaaacttataaaattgtatgaacataaaacaattacacaactcacacacaaagaattacacattagtcttgaacaacgaaaaaaaagaaaaaaattcagttgatgactgacgatgagacgagagcaccacggcggatggaagggctccctagagctgatgcagatgatgcatgatggaggggctgaagaggatgggcatctccttcaatgtcggtgtgggcgcccctcccagcaaagaagcactaaggcggatccacatccgccatgaccgtgagaggtaggaatgacaacaaccgagattcggtcgcaacaccagtagacagatggcgccaaatctagccgcttccatccttgaggccaccggatttgatcagctgcttcctagttcccattgtccaccgtgagtggcaggcatggagcatgctttgagctaacacctcactttgttgcttgtccgccgcct

SEQ ID NO: 61818 - DNA, 4194 bp, Oryza sativa
  unsure (1)..(4194): unsure at all n locations
ttcataatcctgataaattcattttagagagaacagcaaattggtcctgtgagtttcccccctgggggtcactttgttttttagcattcaaattggcataaagcgccaaatgggcaaagccaacgaagaaaatggctactattggtgaaaaaatacaacacaatgaaagaaaaagggaagagaattgattggatcatcccattatgcccttgtatctttgtgggccattgcagtgggcgcccgatatgatattatattagtgtcataaggtttgccatctgttgagttggttttacacgcatggtgttttacctctcaaggatcattttgaactaatggacaaatgggcaaactttgagggctctgatgaaatcaattatcaaaggctagttattctggagtcatacttgagggaccaaattggatattatgtttcctttanggagaaagaagttagattggcaaaatgatcatttctgttctttcaaacacaaaaaaagaaaagatattcatgaacacttcaatcttcctctcagtaggaactgattttttattttcttaaggtcacatggcaaatggttacagaatggcaaccttctatgccaaaagttggcattggtagtgtgaaagaggatgaaatttttgccttttaaattattgcaaatcattgagggtggaacactgaggcagcctcttattaagtatttgagctaactcattctgtggatatggcttttattagtttatataaaacttacagtaagacatgtactagtagagaatcagtatgacgcatatctgttgttccttttttctttagatagtccttcactttcagttattgagaaaagcaaagctagttctgttatgatttgacagtttgtgctggcaaaattaataagtggccctgatgttagttagtagtattgaagctttcatttgttttgctattatgttagcagatattaataccggcaaggtgcaactgtaaagttatcatacaatggaaatatatttttgtccttccattgctgcagctatcatttctttaggattaaatttcagaaaactgcaattatttggtcgagactatcactttgctacaactttaaccggctattttataaattgcaactttagcagtggattttatcaaataactgcaattttcccatatgtgtatgacatgtgggcccaacttattactacatgaatatttcatttgtgtatggaagacatataaagttgtagctttctgataaaattatacactattgttgcaattctctgaaatgcgcagttaaagttgtagcaaatgatatgtgctttgctgtaatttactttcttttaggaagttttgtttttgcatttacatgaatatgtttcttgcctttttattgcaggagttgattgagaaacttagcaagggtgagctaccaaaagatgagtatcactatttgaatgaccctagtcctagtttccggggaattccaagtgcatctacccaaacaagcccagctcaccagccagctcaatccatgagatctaaaggacaggtggcacatgggccaggcctcgagactctgatgatgggtattcaaggtttgtgacctcatacccccatttctactattataaaaattgaagatgtttttgtcggtattttggtacgtcatccgtgtatgagtctgtttttaaattcgtttgcttttggaaatacatatccgtatttgagtcggtttttaagatcgttcacttttgctaatacagaaggaatcatataagaaatctgtttaaaaaaactcacatgctaacttgagacgatcggactcctaactgccgctcataattttctaaaaaaatatatatccaagcgaactcccacagtaaatttcatcttaaccatataacagtaataagattaaaatagatttcacccgttgcaacgcacggacatttttctagtctatttaaaaatttgagttcataaaatattgcccaagctgccgcacaattaccactggtcactatcaatttcggatttagttttatatgtcaaatatcaatgcaattaatgcaattactgcttagttgtcttattgagtagttctttacctttaagaaagctgtattttggccatgaaactgtcacatttgctgcaaattcctttcgcttttgtatgaactttttatgaaccttttgtgtggatcgtgaaagctcctccatttagaccacgtgcattttacaataagctatcgcatattatagtcatggaagtgcatttgcaataatgggttatgataataatgataataccacttttctcatgactaataagccttttgcagtgactcggtactgaagcacacatcaagtaatagcagaaagttgggtcagcgattatttgtttttgttattggtggtgctactcgatctgaggtatcttctcaagcatctgaatttcctttcttctttcacctgtaatgctttctgattcgaatatggtgtaaaactaagaaaggatctaattctcacattctcaatctgtaccattatatgccaatggctattacagttatgtgctgctcacaagctatcatcaaaactgaagagagaaattatccttggctcctctagtcttgatgatccaccccagttcatcactgtaagtttcttgttcatgtctcctctccaatatgcttgttgtaccaagaacttgttaacatgttattatttgcagaaattaaaaatgttatcaaccgatgatttgacacttgacgatctacagatataacaatatacaaaggcctctttcttgactttctcttttataatcatttgctgatcttttttctattatagaactctatgagtgcgcatataacgttgtgtcgaaaagtttacacaggttcccattaaactacaggcttacagcctagtgtgcctataatatagcagtgtgccagaaactgtattatgagattggtggacaatatgttcgttatcgtgtacttcactaatttctttcttcttttggacgcgaataattattctgaattggttttactagtaaaagttgtgatgaagtggtgagcaaaggttgctacttcctttgtttcacatggatctatgtatttgttccatacatatgtccaaatttatattgatgttagtgaatctggatgagtaatgaaggggctaggagtctatggaaaagacgagcgaggaagagctcgtagtccccgactccatggacgcggccggtgaggaagtgctcgtggtcaccaactccatggatgatgaggtccgcgaggaggtgcacgtgaccgttgactatatagacgatgaggccagcgaggaagggcatgtggttgtcgtggccggcgaggtggccggcgaggaagtgcacgtggttgccgactctatggacgtcgcggccggcaaggaagtgcacggagttgctgaccccatggacgacgaggccggagaggaagtgctcgtggtcgccggctccatggacgaaaatgaggagtgtcctggcaccggcgacaccaacattgaggtggttgaagttgaacaaaaaaagttgcattctgatcactaattgatgagattaaaacagaagagattctaccttttttattttgcaaaagaggagtgtgtcgccgctggtgctggtgacaacaacgatgaggagattgaagaacaggacttgcataagcaaaaggtgcattgttgaagcttcttctacctacttattttccaaaagaaaagaaatgaatcgacttacatattcatgcatgtcatagattctaattgctctattgttctgaatttttgaaaaactaattttacaaatagatccctagaaaaacttatcctagaaatagtcctttttggggcgtcagagtctctggcgccgtcccctgcatcatagagtatattgcatcttgagccaccttttcttaccaatgttgcaacttagacagggtaaattaatcttttcactttgggccgggtatatttacaaaatgtttcaatttgagctctcttcttcctccagctccatttctcccatctctgctgcgtacggctcaaaatctcttctcaatcaggagcagcgcacgcagaagattagtgcaagccatcccagcgcagccgcccatcaaagctgagctcaagctcaagtgtag

SEQ ID NO: 61819 - DNA, 1992 bp, Oryza sativa
agaaacaagacccaaagtgaaaagtttggtttacacctagtcaagttgtaactacggtaataaagacaggcccaagatgcaatttactctaatatctctgtattcctataaaccctttagttttttaaactagtactgcttagttagggtttgttgagttttttttttttggttacattcgagtgtcattccttaatataggcagaactttcttatacggacttggaatcaggtaaattatatatccatggacatctacagaaaaagctacatccaattctccccatcttcgcttggttcagtgaatttagaatctccaaattccgtttgcaagattatgttttagagacaagaagcttttcaatatagctttgaaaaattctacgtcacatattttgtccgtttgagcttaaattttatattgttggttcttgtgtgctctttaagtgtgaaaaaatataaaaaaacaaaaataaaaaagttacacatctctcctctatactagagaggaaggaagaaagtggtgtgtgggaagaggggctggcaccaacatcattggcatgctccctttgccacgtcagcgttggcccgccatgatggcaaggggatggtgccagagatgctggcgccgtcccattagaccacggcgccagcgactttggcgtctcaaaaaagaccatttctgaaataagtttacctcttgcttgtgaatcatattccataggaccaaataaaataactttacatgctcctcactgatgttcctttcctatcaaagccatatgtcgagcttaaagataaaaccttatacatatgctccttgctatcattttgagttttctcaaatggttgtgacccttgttagattcttttcatattctcattatccaaatcttgtgcacttaaataccaaatatattgctctccctctgcactagaggattagtaaaatattccacccacccaccatatggtatgcttctatgctggaagtcagcatccaccctatccatccaccaaataaagactccatacatatagtctctgatgaaccctgagttccactcaagaaactcaaggctaggattggtctgatctttcgatgagttgtagatattttattacgcctacaaagatgtttccaatcagaaaaatcatttttaattagaactctagtagcacacataaccatatgtttctcagacaagtcatgcttttgaaattctctatcaaccgctagctcccaaataatgtaagcatgaggatcataatttccctcgaaataaggcagtgcggatttgatcttacctagaacatcgccacttacctcataatggtcatgttgatcactcctcatgtctcgacgaagatgtcgatgttgagcacagttatccccaattatcttgcgtatctctgccattgttagtagaaaacaagaaacatacacaaaatatgcatgttcctattaactactaggtagtggaggctccaatgtgacacgcactcaagcctttaaccaagctcttacaagttcttaccaatgcaagctggatggtgacgtacaccgactcaaccaaacaccccaattgaggttggatatatcgatgccttggcaaacacttgctgtacggctgcaatcaaatccgtggagttttgggtaggcttaaatatttagcatagggatagcaaatgcttaaatcagagaatgcaaagttgaatgatcgttcaaagtcaagtaccgtgctggtcctaggctagaacgtactagagacgcgagcctagatacaaatgataccacaagatagcaccagaaacaactcaaacacactctaatatatggaagcaaactcaaagatacaactgattttgctcttttccttctttcttttctttttctttcttttttttgggtgcggcttttcttttcttctcttttatgcacctttttgcctttctttctctcttttttttgatttttttaccaaaaacaaa

SEQ ID NO: 61820 - DNA, 1251 bp, Oryza sativa
ccaaaactaaccgacataaacttctggaaactagaaaaatggaaccctggcagaaagacgattctgttttcgtaagttccgatgacgacaaagacacggcggcgacgatgacatggtagtagacgtcacaagaactcaaaactctaaacggactaaacgctaagaccagcaacacgactcaacaatgcaacagaatactcaacaacaaaaattgaaaagaacaatacaatggcacaaatatggctaggtgatgggtgcaacttttttatgcctttttttgtggatataggtagataaaaactcaccgagcaacgaaacctctgataccacttgaaaaacgctgagttccactcgacactcaaggctgttattggcccgatgtttcggtgagttgaaatagctacgattcgggagaaacgttgacgatcagactacaatcacacaagatgttgcgttgcgccttagcgatcgacacacctctcagtaggttgttgatcttgccgatgcaaatcaaccttattcctacaagcaaatcaaagaaacaagcaagaacaagataaaagcaatcagaattgcaaataggaattgaatataattgataagtttgggttccgaagaacaagcagactggcggtctagccgacatgcgcgctgtaaggaagtagcaatagctaaactttaatctaacaaaactcaagaaaccctgaaggggtacctagctatttataggagtgcaaggatgaccaagggtgctctagggtcgttctccaccaggttggggcgcaccccacatgggccccacttgggccggggtgccaaacgaagttctaagcccaaaggcccacgataggtgacgctgcaccttgtttcttcatctgcggatgactgggatggaatttggcgatgaggctagatccattggaaagaggactccgagagctttcatcagtactcatgggtcaataacggaggttgtatgcagattcggcggccgttagaagtcaactgtgtagagatggccgaataggattccagcacttggaggacttgatcttgaatcttgttcatccatgatgtgattaacggttgtatccgtagtagccgtggtcacatcagtctctcctccaatggttcataacaaatgacacatgagcttaaaaaagattgagaaaaatgaaaacaatgctcaaaagggaatgagataaagcattcttgagcatgaaaaaaatgagaaaaatatatagaaaaaag

SEQ ID NO: 61821 - DNA, 3560 bp, Oryza sativa
catacggagtcagatcaagacaaactttgtatcaaaattatagagctcgatgagatctacaactttcttgttgactattttttatatgagatcatttaagggtctaaatattcattataaaaaaccatatctatttttacaaaatcttatatctacaattcaaacgacatctgatggagatgtgttccatatcaaagttgtagagctcaatgagatctaccattttgtagtttataacagttgtatttgaaaatgtttaaagtataaaacagacactacgagttttgaagatgtgaaataaaataaataacatgtccaatttatacagcaagaacttgataagtgacatggtaagtaagctctacatgtagtaaaaggtcttaggattagaaaatgaataatcatatttacatgtgggtcccttaggggaacggccatgaaaatcgattttcacatacggttgtgggaccgcctataaaattgacgatataaatgttggagacgttgacctaaattaacaagcgatatctcttccttgattaaggaaactcaatttgaggggatttttatataccagcaaatcttcattgccatattcgttcagtttcgtattccttctgtatctgtattcgataatattcgatttcatttccgtatccgggttttcgattccaattctgattccgaaaaaaacaatgaaaacgaatatgataaagctcatttccgccgttttcatccctatgtgggggtgttgttggtggtcgttaagtacaaattttaactgttaactcctgcataagaaatacaaaatatggtatcaaaccttagtggtaggagtttacaactaaccatttccactagttttggtaaatctatgtattcaggtcaattaaggagaaaatacacctgccatgcgacgaaaacacaactccggataatcggacacatttacacgtattagagggcccacgtgtcaatcaaaaccacctagaatttgtcaggaaaccccttatcaatcagcttgtgaacactggatgaactcacacgaaagtggaagaacacaagaacacgtagaacacaatactgtagacgaacagacaacagaaacagagtttttggtgctgcctgaattgcttgcagctttttggggtttttctctccttttattgtgcagaactgaaacatgcaaagcgacgccaaaaactcggatcgctacccacgactcacggcttgatcgcgtccatccccgcgtccgctcatcgcgcgcatacgcccgaaggcttaggcacaccgcgagctattctcgcttgactcctacacgcacggcttccacacgttggggctcatgcgctgacaatacacaaaacagaatccaaagcttaactaactagctaaaaacaagcatgcaagatttatcctctaacaattctccccctaaaccttgcatggctgtaaaacctcaacaaggccgatcttggaccgaagttccatgaatcgatctcgcccaagggcctttgttaaaatgtctgcaagctgctcctcagtattgatgtattcgatcttcgccctaccttcctcgacacactcccgaatgaaatgatacctagtgtcaatatgtttgctacgattgtgaaacacaagttcttgctaagcaaaattgcagactggttgtcaaccttcagtgtgatggcgctcccttcttctcccctgagctcagcaaggagaagcgccagccacacaccttggcacgcaacagtcgtcgccgcaatgtactccgcttcataggacgatagagcgacgaccttttgcttctgagactgccaggtgatcaaattatccccgagaaagaagagaactcctgttgtgctcttacggctatcaacatcgcctgcaagatcactgtcgctgtagccaacgaggcacacggcatccttcttccttcggtattgacagccatagttggtagtgccagcaatgtacctcaacacacgcttcacagctgccatgtgctcggtggtgggcttctccataaaccggctgacatatcccaccaagaacgccaaatctgaccgcgaatttaccaagtatcgcagtgatcccacgatccgcctataatcagttgcatcaacagctggtgcggcactcgacttactgagcttgaggcgtgattccatgggggtgaggctgggattggtgctgctcatcccagccatctccaatatcttctcagcgtatgcccgttggcacacagtgatgccatcttcagtctgattcacctccaatccgaggtaatatttcaacaacccgagatcgctcatctggaacgtgcccttcatctcgtccttgaactgctcgagctcggcggagtcaccaccggtgatgacgagatcatcgacgtacacgccgacgaccagccggcgtgcgcccgtggctcggaagtacacggcgtgctctgacgagctttgatggaagcctagagccagcagggacgcgtcgagcttagcataccacgcgcgcggggcctgacgaagaccgtacaacactttgttgagtcgcaacaccatgtgctccttgccggcgaccacgaacccggccggctatgtgacatagacttcctcctggagctggccgttgaggaaggcggacttgacgtccatatgatgaacggcccagctctcactcaccgcgtgtgccaacagcagtcgaacagactcgagccgcgccaccagcgcgaacacctcgtcgaagtcaatcccctgccgctgcacgtagcctttcgccacgagatacgccttgtacctggtgatgttgccagcaacgtctttcttcgtcttgaagacccatttgagtccaatcgggcactgacgcgacggcccgtcggcgagacgccaagtgttgttggcttcaatggacttgatctcctcgatcattgcatgtcgccagcactgatgttgctctgcttcatcgaatgacgccggctcttccgcagagaccatcaggagatcctcatcgaactcccgtaccgcctgtccttgtggtgttgctgggccaagcacgttgtcgatggtgcggaacctgagtggcgcatcgtcgtggtcgacgtcgaggttgtcctctagacctgatggtagagacacgaactccaccgccggtgttccagcgtgcagaggagtgcttggcgacgcctagcttggtgacgacacgaacggcgagcctggcgatggtggtgccgcagctggggaaggtggcgccgcatctgactgctgcacggtggtgtactcgatgacgaagtcggtgtcgacgcccgtttcagcctggccgtcccacctccactgagcctcctcgtcgaacacgatattgcgggagatgtgcacctgtcgcgtcacggggttgtaggcgcagtacgcctttgatcctggctcgtagcccacgaaaatcatgggtttactcctgtcatcgagttcttcacatggcccacacacccaaatgtacgaagatgatgaaccgccggcgaaccgccgttccatagctcgtatggagtttttcgccgattctcttcg

SEQ ID NO: 61822 - DNA, 3702 bp, Oryza sativa
ttgatccacatgaagcggctgtagtcatcgatgaggagaaggaagtagcggttcccactcggcgtcactggtgagatcgggccgcagagatcgccgtggaggagttgcaggggcttgctagagcgagacagcgcccgtcgtgggaacggcgcccgtcgatgcttcccggcgagacacgcctcgcaaacctgatcgacctgcgtcaacaatggcaatccacgtaccagggtctccctactcattttcttcagcacagtaaagttgatgtgcccgaaccgagcgtgccaatgccacgcgtcttcgccggcgcgcgctgtcaggcaaactggccgcgcaaggatgatgtcgagcacgtacaagcgccctgggctccgagggattcgggcgagtaggcgccgctgcttgtcgcggacgcgcatgatgccatcctcaaccaatacttggaagctggtttcgtcgagttggccgatgctgacaatgttggcggcgagccgcggcagaaagtacgtgttggcgagggtgcggtgttctccattcttgcaggcgaacaacaccatgccgcacccctcgatagggatgatcgagccatccccaagccaaacgttgccggtgatgccagtgtcgaggtcggagaaggccgctcggcaacccgccatatggtttgacacaccggagtccatgatccagctgcgctggtcgcggtctgcttcatgatctaacccagcgaacaccttcttctcgacgagctcaacgcagacgcgctgaggcgccggcgtcgcgcgtggcggtggtggcggcaacatggagcctgcggtttcgacgtagcccccagtcaggagcatgagcgtgggcttgtcgtcttgggccacatgggcctggtcttcgtgcttaggcttgctccggcactccttagcccaatggctgagcttgccgcagttacgacatttgtcatccctgcgtgccggcgaggaggtggacccatccgagccaccgccgatgcacccctttccgccgcggcgcttgttacgtccgctggaaccggcgccagagcgtttcgcctcctgctcctttttgtggtgctccagccattcttcttcggttaggtagagcttgccatcggtgttttgggaggatggcggggtctggtaatcctcggccgcctagagtctcccggtgatttcctccaacgacaaggtagatatatcgagaagagtttcaattgaaagaaccagttggctaaacctcggtcgggcgacgtgcagatacttctcgacaaccttgtcatcgggctcgggatcaccgtgggtggcgagttggttgacgacactagtaagccacatggcgaactcctccaccgactcgccgtcccggaatgcgatcctctcgtactccgtacgcacccgttgtgcgctggccttgcggatgcggttgtcaccgacgcgcattgtcttgatgcagtcccatgcctccttcgccgatgccttcgtcgccaagatcgagatcatctcgggtggaaccgcactatagatcgcatcaagcgccatctgatcctcgtgcagctcaacggcagcgcggccacgttcgacagcgtcccacaggcaacgtgcctgcaacttgatcttcatgagcaatgcccagtcattgtaattcgtcttcgtgagaaccggatagttcgcagacgatcctgactccttgaccacgcggtgtataaccagcccgctgtccttcccgccgctgcccgaagcgcggccgccggaacctccaggagtgcgctcgctcggcgacaccgaccaacagcgcggggagctcgtgcgacgccttggcataagtgcttcttctagtgcacgatcacgtgtccaagccctaaaccttgctctgataccaattgtcaggaaacccttgatcaatcagcttgtgaacactggatgaactcacgcgaaagtggaagaacacaagaacatgtagaacacaatactgtagacgaacggacaacagaaatagagtttttggtgctgcctgaattgcttgcagcttttcggggtttttctctccttttattgtgcagaactgaaacatgcaaagcgacgccaaaaactcggatcgctacccacgactcgcggcttgatcgcgtccatccccgcgtccgctcatcgtgcgcatacgcccgcaggcttaggcacgccgcgagctattctcgcttgactcctacacgcacggcttccacatgttggggctcatgcgctgacaatgcacaaaacaaaatccaaagcttaactaactagctaaaaacaagcatgcaagatttatcctctaacaaaattaagcccagccatagtataagatgttagggggggcatcaagcagcctcccaatcgaaggagtggttgggaggtgggctaaaggggtcggccgaaccaccattgtgtcctctcgccatctgctgacacgtgtaggtccctaatgaagtcccgatggtggttgtgcggggttcacggcttggataaatgtcaaaaccgccataggatggctatataaggaggtgctcatctcacactcaagacacacaactcaagtggagtacaactcactttgatatctaggctactctctcgtagagttagaatatgggaagagggtgagggaaagctccaaaaggagtgccccaaagttcggagttctttataaggagttccggaggagtgttggagttgtgagcactctttccatggcagtcccagaggaatgccagagtgtcggcgctctctccgatcttgtaccttggtggatgcttcttttataaagtaagtatttgagatttctttatgttatttaattggtttacttaagtgatatatattctcatttgcgggtttgtcgcttaggggctgttcagattgatgccaaaatgaaccttaccaaaatttagcaatgtcaaaattttggcaaattgacaacattgccaaaattttgataggattggcttaataatgttgctaaaattatatacgcattgccaatatttggtaacaaactaaacgtagccatataattgtcaattttaccaaataatggtatggttgaaaatgtcatcaatctgaacaggccctttgtgtgcaattgagtgctctagtacaaagactctggataaagaaggaagttcttggccgaggctataatagtaatcgataacgtagacgtagtgtctacgttagaggttaccttcgtttgttgtgtgctccaaggaaagtgaggtaggcggcaggtggtgacaaccttgtccatcctttgcattcctccacgttcgggtacatcatagagctcaaggttagactcagtctggatgaccaaaggagggccggtgtacgaaacatttgatagagttttacctttaacttaagttagctagttgaatccatagaaatcctctctatcctaagcctaccatttagttgttgtctttggttgaatcctgttcttagactaggtgataccccacgctttcctacgggattcatggatgagtatatgttaaatattgtcaaaatgatgaaagttgatatgttgagaaaataatgagaggaagatgatttgacacatacttgttgatctctataatataatattgtagatgatatgtcatgcttgcacgggatttaaaataggctagaatagtaattgctagtgagtgaagatgtggcatgc

SEQ ID NO: 61823 - DNA, 3887 bp, Oryza sativa
cagatttatttgtgtgcgtaacaaataccaacatcggggatttcttccacctttagtcggcccctctctctctccggtcgggaagcccttgcggcttgctgcctccactcgcccacttgccatcttcccaaattgattgacaggaatcaatccccacctcatcctctcctattccccataatttcccactcaatcccattttattcatgttggattttgatagcacccatcaatgttgagctccaccatggcgcggtcgatctctctcctaggtgaccctctctcccctcttcggcctataaaagggagcccttggcctcctcccttctccccaactaccgcccgcacctctctccctccccggccaccacgccgctctccttttgcgctgccaccatcacacagctccagttgcccctcgctggcggtcgagaccccctcggacactggtaacaccaccgacgacttcgcctcctccacctctcccccgtccacccctccgtcgagcatgaggaccacaagaataacaatgatgccgatgacccgaagctccccgtcgcttctccctcaccgccggccaacaccaaggacatctcgccccatgcattcgcacggttagaactgtcgtttccttctctctctctctctgtttctcccatttgcgcattcgtcgcatcgccgccgcggcatcaactaccgccggcgagccacttggctcgagcgctagtgaggaaatgcatggctagtctccatacttcccactggccactgtgcacatcatttcacacaagcattggaaattaaaaaaaaaaacactatagtgcagaaaatctccgaagcaaatgagcaatgagaatcaacacctggtgtcaatcgatgtcttgattaattatcacgggatgtggttctggaagggagggtgttgatgcgaaaaacacacactggcctgcgatatctgcttagctctagtgcaggaccaagggttggtgagatgcgggcatgctagtcagtttgaccctgcaactgacaagatatgcaaacaaaagatcaaatagccgatcagctgacaagccgatggagtagttccagccgatgccgataccagccgatagcgatagggttttgagctatcggccatatgtccaatgtagataatgatataaagacaatcggctgatgataatcaatataattaaacaatataatccagtggaaaccagtcggctagcaatgatatgatataatatgcactgatccgaaggttaaagcatacatcggctggaggtcagatgttataaaatccacaagattagattaaacagtaaaatctttattgcgatcggctaaatccaacttatatatgcaatccttataagccgatgccatgtccagataagtcatcggctgaaaccctgatgaaacccttattggcaatcaaaaaacaggctagagattatgattctaagtatgacttagtagatcaaacttaactgatgtagcagtaagtacgaaaagaaacacaatatgtagacaatgaagctgttgactgattttttgtaacaccctgaaaattcgaccgacaaaatcaaaactctaaaaatacggattttcaaaaacctttttaaattaattgcatcatgccgatcttattcgcctattttatctggatttgatctcgaagattattaatcgtgagtaaagaatagttaatcaggaataaaccttaaaaacaaattggtaaaataaatataaattaaaaataaagattaggtgtggataataataaataaaatattatcacgaccatatttggatcaattaaatttaaatacgatggaataagaattaaccctaataaaaactcaaataaattatataaaaataaaatatgagtaatattaatctagggtgaattcattagttaagataccacaaatattgagtaaaatgcatatatgtaaaattaggaattgtggaatcaaatttatatggaaaatacactaaaatcgggataaataggaaaagtcactgtttattgcctcataggtgttcgattttggtcctagccctagacccttctctgccacgcgcccggccatgcccggagccccgcgccgcccctaccgcgccgtcgccgtcaccgtcccgtcgcgccgtcgcctgccgccgcgccgacgtcgccatcgccgcctgtcgccgtcgccatcgctgccgcgccgccctagccggccttgcgccccgcgccgcgagccgccccgtcgccccgcgatgcgccccgtgccgcgctgcctcgcgccccgagccgcccgcccgtcccatcgccgctcgccagtcgtctcaccccgtcgccgtcacgccgcgctatcgtcgcatcgccgcccgtcgcgtcccgccccgagccgcgcgccgccactgtcgccgccgccgtcgacgtctcgtcgccgcgcgtcccatcgccgcctcgcgccccgcgccgccgtcgcgtcgccccttcccttctcttcctttccccctcctctcccctataaaactccaccccctccccattttccccactccatctcccccttcctctccctcttccccttctccatgcgccgccgttgtcgtgccgccgtgccgccaccttcgaagccgccgcgtcgtcgccctggagccgccgcgccgtgcgtcgccgccttgcgccgccgtcgccgtcgcgccgctctcgcgccgccacaccgccgccttcgtgccaccatgtcgtgcgctgtgcgccgtcgtcgcgccgccgtcgccgccaccgccgtcggtaagccgccgcctcctccccttgctcggtcgccgtcgccgccccgggtagcagggagccgagagagagagaaagggagaagccaaggaagagagaaagaagccgggagggaggagagaaagaaaagaaaaggaaaagagagagaaggaagaagaaaagaaaggagagagagaaagaaaaaaaaggaaaagaaaaagaaaggaaggaaaaagaaaaagaagggaagaaaaagaaaagggaaataaataggaaattagagggagattagggaagtttagaaaatttaaaataattagaacttagttatagattagttatagtcgtagaattgcgaaatttaatataaattatggattattcttggtaatttctacaagaaatcaatttgcggtagtagtttaaatgtaattaagaactaaacgattagatgaattcttatagactattatagattattttgggtaatctctataagtaattgattcacggtagaaattcggacttaatcactaggaattttagacgtatattatatttagtcgtttagtcctagactaaaattaaatcctataatattataagataatttttggattccgtccgatatttagcttgcgatagaaatttccaacctattatatggatataacgctcgggtagattaaattaaaaacttatgataacaaaatatttatacccacaaaatagtttaggatatataaatcgaaattgggtttgccctagtacgcgaatagtaaagttaatataaaagaatcgactttcacgttcgactttcatttggatttatttggatttttatttgaattctaatcgaatccaaatcaattttcgcacgtaactatagagcccgagggagttgcggatccaagtgaaggccaagacccccaagaccttgagcaaggcaagtcatcactattccttgaacatgttgatcccaattgcgaaattattttgtttataaataaaattgcatgcaatgatgaacatcctacttgtgattatgccatgccttgattattgtttatcccttattccttcgtaaccatgtttacgtatgagtccctagtcaattatg

SEQ ID NO: 61824 - DNA, 4562 bp, Oryza sativa
gatttgtgaaaggaaaataaagcgaaaacaactgttttcgactggggcggacggatgatttgggtggtatctggaaaaggctagtaccgtccccagtcaattaaggactgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccgagaagcgtgccctacatcggtgtcgccattggtaggactgccatgagtgtgtgagagagagaacttaacttgaaccataatttaatatgtgtgtgagacttctctttccctggagcgccagaactcctctcactgctagaaacatggacgcctagagtgcatgaggatttaagttcatggagcgggtattgccaatgcgaggttatcgaaaagctttgccgtgacgcgtctcatgtgttgggacgaggctcatgtgttgggcagtcgcggagtgcgggtaaagtgtacatccactatagtgtgagtaaaccaaatctattcgaatagccgtgctcgcggttattgagtaccgggacatgtattacacttggctagtctctaaattcttaacttgtgtgggatgggttgttgcatgactaatttttatgctgttggagccacttcctgaggagggggaaggtgggcgtcctcagaaaactataacgactcaatggcgggaagctatccttaggatcacaatggatggtggacagaaccgtcgttgtttaaatacaaacactggtactaaaatttgatcagtcaatgctaggtcttaggtttgtgaaaagaattacaaaactggcttagcgcaaaagagccatagccatcctttgaaatacccctttcatatgcattgttgctgtggtgacttgctgagtacggttggtactcacccttgcaaatataaaattaatcagaagcgggagatgaagcttcggaggatccctatgcctactaccaggagggagatgaagacgatggcgctcagtaggtcttagtacggtcgttgcctgtggcaatggcgtgccgctgccttaactccgctgccttacctacttctgtttttggaatgtattccggaccgctcggtccgatgatttaagactgtgcctgcgggcttatgatgtaataattcatactagactctcgtgtatgtgcacttgatattttagctatgagttcgtgtgtaccagactccttgatccagggaaatggtactgtttacacgattgattcctgttataaaaacgggggtccacatttttagggtggtagatgccttagctaatctagtctaataaaacaatttagccgatactggcagaaaccgtaaagcgagagacaaccgatagagctaaattgagatactaagactagattaactaagacatatgataaataggcaggcaaaaatatcatccaaaccagagcaatccaagaggtcgaatgtactgatgcagccttgaacgacgctgacgtagacgaaacaattgcctgggccagcggaacataggacttaccccttcgccggagatcgaactaaaccgatgcaaccccgcgtcaggtgccaaattccgccggttgataagtaaaaacctctggaaagagggtggcgatgcgccgagagtagttgtattgattgagatattgtacaatgaccccgggtgtacatatttatacctggagagatactagtccttctaggacaagaaagaaactttcctaaagataaaaggaaaacataaagtccttataggacactaaacacactttcctaaagataaaaagaaaataagaaactattcctaatgaatagataacttgccatgctgcatcctccttaaactcggtcacttctggataagctttctttaatagatcaatttccttaaccgaatatagaaggaatctgactactggcgacgtgataattctcttagaggcttaccaaatttcactattaacagagggatctatacttgtgtcactggatcgactcatcgctggcaagcgaaaggggatcgattctgaattttgacttagggtttagggcttccaaactgtcaccaccactggggctcccttgcggcgggatcccatcccatattgcttggattggattgctgcctccctaatctccatcccatcccattccatctaccaggtaagacggccttcttgaacacaaggcgagtgctagggggagcggtggggctagtgtggcagacgacaagggcttagtgttggaggaggaagccggagcggatggcatggaggcatccttgcagacggaaggatggaggcgactgaggcaggatttgtgcggcagtgggaagcgccagcgacagcgtgaggacggaggcgatgaggacaaggtcttactatgattggtgcgatgtgaggacatggatttgcgtggtagtggggagcgtgcgacggcagcatgaggatgtggtgggtggagatagggacgggtgtaatgcgaatatgcgatggacgaatgaacggatgagattagtgcgatgtggatggacgtggatgggttcgtggatgatgatttgacctaaaggatcaaatcggtaagtctctactattataaaaattgtagatgattttgctagaattttgatacgtcatccatgtttgaaacggttttaattttatgttttggttttaatctatatctctactaaaaacaagaaattcctgtcctctgcaaaaacgaaagaaaaaaatccgactcaaaaaagtaaaaaaagaaagaaagaaaagtctgacttaacgagcgataaaaaaaagcttccgtcgtcagtaaaaaaaagaaaaaaaaacatctcttgtccgattcccatagaaaaaggaaaaaaaatcttccagtaaaaaaacaaaaaagtccgtttggttttcttagcatcagtattttttttccgttttttctttgcacgcaaaagagttttttattcgcacacgctaagacttttggtttttttgtcccctttttttaatccgacctgttcactgcgctcctgggtgtttttagttttttttgttcaatctttttgtcgccggttttttctctcgtgcgctttttgtttttctcatagtttttttggtcaatcttttttgtcgccggttttttctctcgtgcgctttttgtttttctcatctagttttataatcccatctgttcaccgcacgcctcccgaggtgaaccctagcgccgcgccgccgccatatcgatcgtgtatttttgtcctccaatttgattgcaaaaatcgattccccaatcctctcttatcattttctccatgattttcccttcgattcggctttaattgccggatttaatctctggtttacaattaccgatgatgacagcgatcttccccggtcatttttatcccgatcgtgtgttttctcctcctatttgattgcaaaaatcatttccccaatcctctctcatcattttctccatgatttttccttcgattcggctttaattgcgggatttaatctctgttttacagttgccgatgatgatagcgatctttcccggtcatttttatcccgagttttacgctctgattttagggaaaacggaaagagtagatcgagtggataaaaaacccttgaccaattttggctgatctagaaagattcggccggatttgatggggagatttgctccgataaacgtacgggtacgggcacaggattatctttgggaggttgaagatggtagtcatatttggaaagttgaagatggtaggtttgaagagagcagaccaaatggaggaaggtagcctctctctctttctccctctatattcgtttagatcagagaaatacattacctctatcctccctcctgtttttacacaaatgaaaagcacatcacaatgtctgacctccatgttccctcctttatctacagaaatcaaagcacacatcatgctcgccaacggaaaactacccaataaaagcagtaatccaaaattctaaactgtatgatgcttacatcagagactaacaaaaagaaatgcacacccagcggaactttgctcagacacctccttgctaaccagtggtctacatgcttccaggcttcaggcgctgctgcaatataatccacacccagccgcctagcctactgagggctccgcttgggtacaaaacacagtcccgactcacagcaaaacaaatccacaataaatcccgccggtgaggaggcggggagctgccagatctgggggcctctgagctcgggacagccgatctagcgactccccacctcctcacctgggggcctctgagctgtcccgccgtcgatcccagcctcgccgtggcctcaggcaccctccacatggcagcaccttacgccgtcgtcccctccctccctctctcttctcagcgcgtagaggagaagattgggagtggccagtggcttagtgccttcagacttcagtgg

SEQ ID NO: 61825 - DNA, 2118 bp, Oryza sativa
tccccttcggacgccgccgccttcttcaccgccgcgacggtgggccccgggcccgaaggcgacatcgactcggcggcggcggcgtcgcgtccaaggcgcttaggcccctcgcccaacctggtcgtggcggccgcgaacgtgctcgaggtgtacgccgtgagggctgagacggcggccgaggatggaggcggtggcacccaaccgtcctcttcgtccggtgccgtgttggacggtatctccggggcgcgcctggagctggtgtgctattacaggtgcggtgggcggtctcttgcttcttacaatttaccactggttttagatttcagaaacgaaaggatttggtcctagtttattgtgtactaatttgttgatgaatggcatgtaggctccatgggaacattgagtccatgaccgtgttgtcagatggagcggagaataggcgagccactattgcacttgcatttaaggatgcaaaaataacttgtttggagtttgatgatgctatccatggcctgcgtactaggtatgcatactgtttcctcattctccttttataatcgttaaattattgattcttgattactgtgaatatagtccccatttgcaaaattgtagattttgtaacaaatgtatgtgtgtaccaatgcaattaatgtatgtcaatcttcaccattggaccattggaatcacttttgattcccacaaccaccaaccaaattaataccacctaaccaggtaataagattaaaggattccccttgggaccagcttacatgtcaagtaacgaaccaatgaagtaagctgtaaggatctaggagtcttttcaaagacccctagcctttggagtggagctagtgtgacgaactagagtacatttagaattttggcaccaaggaaactgccctttaaactgttgctcaggctgcatttataggtctgaccgtctgagcaggatacataagaaattacatgtgggtggccttaataaaggtgtctatggcctgggtgtacattagacattttcttatattcggtgcatggatcgttcccacggggagccatggactgtgtctatagcgaggtcgtccctggctattgagccaggaatgaagaacggaccactgtgtctcttaactggactcagtgtttggtagtcaaaggagtcttctctgtccttaatgaattgcatgtgggtgaatccttcttctcttggtagcttgtcggatggcctttgatggtcaatgtgtcttcaatatccaaagggcttggtcattcatcgatcgttgagggtgccagttgggaccatcccgcaaaacctgctaatcggaaaattttgaatgatacagaggctgtttctaactagcgttattcactttttctgccttttttctaatgtagataaaattgaaaactccatctctttagtgcaactattttgctatcttttccttgctacaggctgatgcgctatcagtatttcattatcattcttgatgtttcagttcaatgcactgctttgagggcccagaatggcagcatctgaagagaggcagggaatcatttgcttggggtcctgttataaaggctgatcctcttggaagatgtggtgctgcacttgcttatggacttcagatgattattctaaaagctgcccaggtgatatttccgtgatgtatcacatatttttgtcttgaaatatatatattttgtcccatctctatctcttattacatttctcattaccatcaggttttcattatgccaacacttgctctaagaatatgggcccatttagaaatgctagtgctatggatagtgattacttgtctggatcagtagattacaaatattttactctcctccaacgttgtgtgtttgattgataatctttggtatttttgtacatattaggttggccacagcttagttggagaagatgaacccacctgtgcattgagttctactgctgtttgtattgagtcgtcatatttgattgacttacgagctttagatatgaaccatgtcaaagattttgcttttgtacatggtgagataagatctgttttgcacatactatatcgcagactacacacatttgttttttcatgtttttctata

SEQ ID NO: 61826 - DNA, 6057 bp, Oryza sativa
gtgctacaactatccaaatgtgaaaccttgctattcatgctgttttccatttatgatttctttaggttatattgagcctgtgttggtcatacttcatgagcaagagcctacatgggctgggcgtatcttatcaaagcaccatacatgcatgatatctgcatttagcatcagcatgactctaaagcaacatccagtgatatggtctgcagctgtaagtgtacaagattgctcctaagcattgtcttttctgtctttggtagcttattcctatgttctttcggcaataaattttggcgttcagagtactagaatgtactaaggtggcttgtggtattcactaaataattacttatttcttttgcatagaacacggtaggtttatctgtgattggtaaatgttccgaatttagataagttatcaaattttgctctatttcaggactaatcctagtattcaagtccctcattttaggtcagcaataccgcattgaggtgaatggtattgatttgtagtggtgctatcatttctgtccactagatcaaatgtgtgtcatactatgatcgcgaatcctttttttttttcttgtagattgctcaattgtattacatattttagggattccattgcgtttaagcactggatttatttgactctatatataacttcttgccattacaaaataatatacttaccattacaaagtgtttgttcctttcagaatctgccccacgatgcataccaacttcttgcagtgcctccccctattagtggtgttcttgtgatctgtgcaaattccatccattaccatagtcaggtttgatccctttaaatactcgtggtgaaggcacatactttattttgatttgctgaacgtggatcattgatttgaagttctctttgttattgtagtccacatcgtgttctcttgacctgaacaatttctcatcacaccctgatggcaggtactgtttgtatatgttaaatgcaaagtactaattggattacgatagtttgttctttttctcggatcacatacaaatgggccctgtttctgcttaactactacacggctacacacatatcagtggtgcagtaccatcacaatcacataccaagatcaccaatgtggatacctgatttaaaagtgataagctcaagacgtgtagtgtggtctcttcttatatggttgtccatagaaaataagattaaaataaccatcttgaacttcccctaggtcctagcaacctaattatttaatttttttggaagattatgtttgaagctacatacttttaaatccattattactaaaggtgttaactgagacattagcacagcatttgagcccatcttgatgtactggtaaacatgtgaactgagtaattcgtaaggtgaaattactagaaggtgcttgctgttgattatgggtgattgggtgtgcataacacacctcattgtacttatttggttgtaaaaaggtagtcaaatctactgtactggcatgcttttcttgctgagagcaaatcttacatgaaaatagtgggttgatccaaaaagatatagaaaacctgcgaaatatggcacatatactactccggcagcagtgttatacctatcaatattgaatagttgattattcttaagttctgtagtctataccgtattgatattgcttagcttctttctttttcagtagatttgtatgctggtaaccttctgttcttttgctggctttgcagcccagaaatttctaagtcaaatttccaagttgagcttgatgcagctaaagcaacttggttgtccaatgacattgtaatgttctcgacaaaggctggagagatgctgttacttacagtggtttatgatgggcggtatgataattctatggttcattgtcctattgtctgtgctactgttgttcagagttgatcattacatgttcttttattctttttacagagttgtgcagagattagatcttatgaaatcaaaagcatctgtcctcagttcggttggttacctatgtacttctgtgcttatatgcttccttttttagatattgctcttttttaagtttactaacctatttatggacaggctgtgacatctattggaaactcattcttcttccttggtagtcgtctgggggatagccttcttgtgcaattttcctactgtgcatcaaaatctgttttgcaagatttaacaaatgaggtgtgtactgagatatctgtgttgatttactttttatctttgaagtaaaacatttcactacatgtcggatacctatatttttggaacaacacctgaaatgagttcttttttactgtcattatagaaaacatgtaactagagatgcaatatttctgtacttgtggttttgaaaatttgaacccaataattcaccattgggcttgaatgcaatgatttttttgaactgagcttgaatgcaatattagttctaattcttctcatggtgttgaagcatgaccatggcagcataaccatatgggtgctgctactttgtgccggtgcccggtgatccatctgctagtgtccgattgtttacaccattgtttgcagcttgcattattgatcctcctgtcaaacagatgatgccacatctatggcactcactgtcaagtcattctattggcacctcaattttatgttccaaatgcctcttatcatagttattaaaaccggaccggactgaggtgtgatctgatttgattaaaagactggggatgcacatgaatcggtagaaactggttatactgcccagttttgtataaaactggctaaaaacctggagcagtctctggccggctatacttttttcaagaaaaatcaaactccatgcgtgggaggagggatcgatcccgtgatcactggcttgcccatgtacctagtaaaccaactgagcaagccacattgttgatttcacaaggagaagcactcgatttttttccttggagtcaaccaaaacaacaaaaagtaaaaaaatgttatttaaccaacggtcctgccaatgaactgtgaactgatgggctcactggtttgatggccggtccaggtttaacaactatgcctcttatgtttctcaacttgccatatagtttttctgttggcagatcagtagaaatggttattgggttggtttttaggattttttagaccaacgtgatacttgagaactggcaaccagggtcattttactgccttgtggtggcttgtttttgtggtggcgtgagttcttgtacttttttctgttttttttgcgtgtttggacacctttcttcttctatttatgcaatgatacacagctcttgcgtatttgagaaaaaaaaagaactggccactcgttagagatcattaaaggttatttcctccattcccaaatgatcatcatattagtagtatttattccaaggtctatttgttatgtgtgcataggagtaaatgtacattgatgcatgcgtccatgcacacaaccctttacaaccaacatgcaatgtcttggtttgttattggctaggaaatagtggggatggtgcatgcatcagagtttgttactagattaaatgtagtacatgatagttattagcttttattggtttgggtgcactcctgtaatatgatgatcaattgggaacggaaggagtacaagccttggcaaattcatcttccatccactgccttttcttctcttcctctgctactaccacctctctatgcttgttcgatggtatcatcatttagggcattcaatgaatataaggttcattttcaaggctagacttttgacagaagtccagaaatcaaccctgaaccttcgagttaagacattttacgatcttaaactctcaaatacatctgctttaccccctggttcgaaacattacgtctttatgctgacctgacaccgtgtgtatattagtggcacataagatttgttatgagatgccccccttcccccctacacacctcacaccattgtatatttttgttaaagcatctaaagatacatttagttaattaaccataaaatgtacttctacacaatattaaattatacttttaattaatactagtatcgctatagaataatagtaaaatatgtacataacatggatggttatttttgttgcatgtagcgttgagcctttgaaaaataccacgtataaggtgagctatggctgtcccttgaaagcattggtgactaatgatatagcaatctacttttgtagcgctctgctgatattgaaggtgatctgcctttctccaagcgcctaaagaggattccttctgatgttctacaagatgtgaccagtgttgaggaactttcctttcagaatatcattgcaccaaacagtttagaatcagcacaggtctgagtattactttcagggtttcaactgtatgctagctacctgtggttccagaatcatatgttctaattatctgtactcctttaaaaagagcaagtggtggtggtgaatctgccaccacctcatcaccagtgtccccaattttgatatgtgggacctactagcggagaaaaggttgtgccaaacataatccttcaaacttggttagtcaatatttgctaatataagaaagttgagataaaagaagaaaagcgcacaatcttactcatttattggttatgtggattgattatacagtgacgtttatccttcctgtacaatgcacaattccattatctttttcaattaacaaagggtcttcatcttgtatatagttgtttactatttctttttggctaccattccaatcacgaactatattacttattctcttaaaaaatatcacagttgcttctcattatattctgactatataattcactggctttttctttgcagaagatatcatacattgtgagagatgcattgatcaatgttggtccactgaaagatttttcatatggtttaagagccaatgcagatcccaatgcaatgggaaatgcgaagcaaagcaattacgagttggtcagtggcatggcaatctttacttttgatcttttattactgttgggtctttgtcaatcagttctatggttgatttagctactattgttggatgtgcatatgtggtttgttttttttatctttagtatggcaaaccaaggtttcaaatcctacctgtaagcagcaggttacagctggttgttgaaaattccaaaagtttctgatattagtactagctaggttttgaagattagttgttctcaagtcaaggaattaaatacaagataatgaaaagattaagacaataaactgaatgtttaccagaatgggtaaattgctaactggaactctgatgagtttatatttatacatagtacatgactgaataaacataattaggaacaatgtgccatctgtaatcaattgaggtgttaacatcaatggtccataatgtatgctattgaataatctgcatgaatatgtgctaattattatgttgacgatattcgatcttaacattttactttttttatcacctttcacatatctgtcaattcagtgcaacaattaaaggaatgcaataatctatttatcctgatttaataaaggatagtatatatatattccacttcaaagcatgcagtttacaaaaatgttgctgagaattgtggattgggaatatgccattgcaatatggaggcaaatggactgatttaaccccattattctttcgtcctttcccatctccacccactccatggctgccattgaccaactagtggtgttccagagaaggcgggtgccaactgaatgagtaacgagcagtcatggcgtccttggctgctgataagctctagaaaaatccgtggagttatctcttttgataccaggtccagccagcatcattgtccttccactgacctacttttcttagtttctccaacgcaggcctcctaggcactagcgcaacccaacagcacacttgacattgacatagcctccgcaaggttcaccagtgctagtgtcagcattgtaaacattgatgagcattggcactgcctt

SEQ ID NO: 61827 - DNA, 1216 bp, Oryza sativa
gttgcaacccagtcatccttgtgtgtccttgttgactattacaacctttggctatagatattgttgtggtttgtcaggaggagacatcgagatttagtatgctatttgtatcttcggaaacgtatcctgttccacaactctgacttggtttaattaactagataaatctccttaaagacatggtaaaacttgtccctttgcccctgttcaacaatagttttgacattgacatttctttctttctttatttgtttgttcagttcaaattaaaaaccattcaggtccatgccatcatgttgaagtgaatctgagcaacaccaatatgccattgccatgggggaaaaatcgcctcaggaattacctcagtccttgcttagatgggactcaatcccaatccattcacgtgtatagggagggaatttgaaactaaaatcttgggccatccaaactgctcttattccgcaagtttagggggttaggaacctggttatgtagttcaggatgagccagagttcagggaataaactgaattactctgaagccttctcatccttgaaaacctgaccatgttgcatctttgcaggtccctttgcatggcaccccacatcaggtcacgtattatgcagagcaatctctttatcccctaatagtgtctgttcctgtaagtattagtatatgttattactgcaattctaacataatttatcattggcatctaattatgtttttgaggcattttcgaatatgttcaacacataaagtccaaataacaccctccgccacctaaactttgattgagagtccatctagcatattgaactttaaaaccggacgttcaaacccccaaactaaacaatacagtttatacaaccccctaaggtgattttgcaaagtggtttttcatctaatttgcatgtatgttggatgagtttgatcacatgacatacgtattagacatatatatgttaaaaatctccatgcaaaacttttttttcactcccttattcgctgcaacaacattgtgaaagtgtcacatcactatgtaagaagaaatttatgacctactattaatgatatgtaaatatgttgtatcagttattcaaagctgctcatttaagcttccaaatgtgcaaactaccctagggggtaatacgaatggtattgcaaagttttttttttttttttttttttgggggacgggggggggggggggggg

SEQ ID NO: 61828 - DNA, 6058 bp, Oryza sativa
agtgtggagttaaaaataaagtagttaccatacttttgagttgaagtgatatccctcttactgttttttaaaaggagtaggaactgcatactcgaccacaggaatgacatcatcaatagtactacaccaaaccaaaatatccgtcaaatgtgtgcaccatttggtttctctcaaactcaagttctgggaacctgaaaactgttccctttgatcataacaagaaacctgtgctagccagtgttaatatagactataatgtattttttttattactagctaatctgctcatatgttgccatggaatcttaaaaagagaacctttgtcatactacctcagtccaaactctaaaagtttagctaaatttagctattattatctggagggagtacattttaaagcataaaattgtttaactgttttagtcaatttttgccatcagtttctaaatacatgctgagctaggcaggggcacagagcactgttgcttcatgatgaaaaactgacgcaagtctttttttcattcactttctggatgcctgctgaattaatcatcttctctatttaatgtgaattcatgttatttaggtgcaatacaggtcagtacaattctgcttgtgagggcaaaaagacacaaacatatgcacattgcataataagttatgacaattcagtccttaataaattgatttctatcaatacagcactgctgtgatatcaggcaggccggctacactctcgtacaccagcaggaaaggcctggcccatttacaacttgctaaccttaactcccatttacacctgccagcggcctgcagcttgcaccattcgttgcgtcctctcctccctctatgagctggaccacgccatgcttcctcccttctccaacgttgccactcctatctcctccattctcaagcgccatcggcgccagcccctggccctctccagcaccacctgcctccagtcccttctttggcgagtctatctagcagggtcacgtctgcaattctgtccccttcccctagtacgatttattcccgtccccttcctctccctctagcaagtgaaccggcagcgccgagcccgggaccaccagatccgctcaacctgagcgctatggtgctctttgagcagcagcagcaacaaaacagccaacaagcggtgcgttgtggtggaattgaccatggcggaaggattcaagcattggcgaagcacgctcagctaccgtgctgccccgccaaattgacaaacagtggtgagtctctgcactgctgtacaaatacagtggcatcagaagctggcgccctgccagatccaagcatgggcggcacaattcctgttgcgagttccatgggcaatgtccaaggcaaggaggtgaacgggggagtaggcgaggattcccgttcccctcctatggatctgtggtccccacatgtcagaaggttggtggcagaaccaccaccaccaccactaacatttaaagtagtatagatttcttgtacttggtgggtgcatttccaatgctaccttttgcatatttaaattaagagaaaatctattctatgccattgagtttgtcctggttcaacaatttgccattgactacctctttctataacataccactgagcatatcaattgttctacaatatttcttagaaaaatgcctttatagacataagattaacaatcgatttatcccatccgaaatttcaaaaaataatgatgttgttttgtgtagcctcgttacgcagcataatagtttgtttataagtttcaaatttttgcattactattattttataagatataatttatgtgttatatgctacttcctccgtttcacaatgtaagactttctagcattgctcacattcatttagatgttaatgaatctagacatatgtatgtgtttagattcattaacatctacatatatgtgggcaatgctagaaagtcttacattgtgaaacggagggagtacatagaatacttttttgctgctgtttttgatgtaaatcatctaccatgtgttacacaaaatatttttatagtattatcttttgtttaagcaattactcatgtaccacacaaaagtaactttttaaaaggacgcgactacagggagcgcatgcactcgttagtgctaaccagcgaccatcttttttaccaaaatagtacagtgggtatcaactcgttacccttcttaatagcacctgccacttgcatcctcattgcccatctaaattccaaataaaatttttctcttaaattatttgtcggatctacgatccgattacaccattgtgctcgttgcaattaaatctgtacaacaagatcttacatgattatattatgatgaaaaaattatttatgtttgtaaactacttttattatatactaagttacttttatcatatatataaattacttttagatttgattaaattacttcctatacattcataatgctatgaggtgattacttttattattattttagtcaattccataatttgtgctgattaatttagtttctagatagagttatgtttttatactacaacggatttacttctaatgtcatgacaaaattactttctttttgtctcaagttacttctataatatatgtaaattacttttagactttattgaatttacttttatatgtctaagaagtaatttagtgaaatctaaaagtaatttagatatattataaaagtaatttgtaaattttcatcgtaatataatcatgtgagatcttattgtaaagatttaattgcaagttgcaacgaacacaatggtgtaattggattgtagatcagataagtaatttgagagaattttataagaagggaaaaaagacatggatgcctaacactccgatgcttctctcaaattgtaaactctgatgcttctcgactaaatcggatggccgcgccagtcgtcgctgtgtaagaccagatcgagaggcctctcgttatagattttacgtttttaaaaatattaaaaaagaaaaaagtcttaaaacatttacccaaacttctttgtcatgcaaggagaccaaacggaaaatttcataattttttggaactgctattggtgtcaatcaattgccaacccttgtatgtatataagggcagtttggttattctttcaaaaatagctgggcacactgtagaaacaattgacgaactcggtggcatattgtagaaagggataaagtcgatggcaaattgttggacctaggaagttgataaactcagtgacgtagagtagagactcttaaattaactgatagccatgagcctacggacagaaatatttagtaagtttttgacccaatgaatggtgcaataagctgcaaaggttacagaaaatttgtataattaatttttaaatttgaattcaatgtctgcttgtacattgtcttgatttcatgtgcttgcaatgttatgtattatttgtacatttcaatccatatttaggctatcctagattacaggaactcaatttgtaatactattttgcatttcaacatgcataagctggcaatttgcaataatgtgcactgctttctttaatggttgtggtgtctgaataatcctctgagattgtttctgtaacaggtcaaaaacttcgttttgtttggtgatattcataaaagcatttattttctgagctggaaagagcaaggttctcaattgagtctcctggcaaaagattttggatcactcgattgctttgcaactgagttcttaattgatggaagcacgctgagccttgtagcttcagattctgataagaatgtgcaggtcattttctttctcataattcttttcatgcatcagctctttttattcgagtttcatactacctccatcccaaaaaggcttcatttttgcctatcccatacaaaccaatacaaagtgaaaatactagaatgtctcccacttaggtctcgcttgaatctgctgaaaaaggggataaaaatttggatactcgtggaacgcttttcaaactgctaaacggtgcatttcatgcgaaaactttctatatgaaagttgctctaacttatcagattaatctatttttcaagtttgtaattaatcatactttaataccacctcattttacgtgaaacacttaatcttcattttcatcttcatcttcatctttacgtgaaacacttaaactccatgcgttgattgcttcaaagatagtctttttgggacacatggaaggcggcaaaaatgaagtctttgtgggacggagggagtacattattggcttacatttacgatttaatccatctggctagctctctagcaatgagattttgtgttgtcacttgtgtgtgtttcatgggatattattatgttcgtcagggtccaagatagcatccagtaattgcttcttttagaagtaaacaaaacaactggacaaacattttctcctagaactcctagtgataataatctggcctatatagtctgccatagacttgctattgaaaaataaactggtgatccggaatcttggtttggatcgttccggtgcataaaagttaagcttccctgcagcaaagatgagcaatagatcagatagatctgttctctggagctgcaatccaaaataagtgttttgagtcaattggtgaatatttgcagctttatgccaggagcagcagccagtggtggagctaggataaaattatagtgggggctaaaccaaagtgaccaataaaagttgaaacatgtctcatgtaaattggctatatgtctaatacaaagtataaatatatgtcattaacgaaaaataacatcatccataccaaagcaatatttaaatgtccaatagatgatgacatgatttgcgacactagtacaccctatcgccaattattcttcatcaggggtaatctatacaaaagaaatgtcaaattaatgaataatgacaattgacaaacaatagcttcaaataatttaaagacttaggtagggaatggaggcatggagcatatcactaaattatttgtaggcagtaacatccgacgttttttcatatcttcaaaccttcgatgattttttcattactaatacttctaaaaatatgcttctcagtatagcatatcatcaagtcattcagccattcatcccccattttgtttctcaaatctgtctttataagagacatggctgaaaaaatcctctcaactgaagccgttgccaccggaagtatcaatactaactcaatgagcctatacactaatggaaaagttcttttcttcctgtttgaacattaattctaccctaggcctctttgactgacttgcaatctcattattgagtggaggatcgctggtatttgtgttacttgaactagaataatatgtgagcagtgttctttttggcatcttcacaatctagcaatatagcagagtagcaaactaggaatcacaaacaaaattttcaattcaatatctctatgatttcttgaagacttgaactattaataacaactagtcttgacaattgaaattgattttaaataacaaatcagaaattttctatacctcatatcctcaagtacttggcctgctgctggcactgcttgcctgcttgctgctgccacccttggcggcttggcccttcgctgcttgcctgctagttgttgttgcacgcctgccagtggccagcaaccggcgtgcccgcgcgccgcgtgtttctgcagtgttatcgcgccgcgtccccccgcggccccgtcgccactctgcgtttatgcctggaggcgctagtttgccggctgccgccgcgcccgccgcatgcggtgccgtccctgcccccttgcgcgtttccgcctctctctacgcgagcagcacgacggcgcctctgcagcaagagccaagagcgaccgagggagatgagatttacggttgggtaaggttttttttgggtcttctcagccttttgggccttctaaaaatctcagacaaagtctatttaagttccccttcctatagatatatggattagaattttaggggagtattatg

SEQ ID NO: 61829 - DNA, 703 bp, Oryza sativa
catttgtttcctttgtcttgttttttaataattgacagcattgagtcctattcgtactatccatttgttagatttattttcaatagtactattataatagtatagagttcaaatattcttaaatttattattattattgaagtagtggttaaagcttatatagctcagtcaacgatgtttaattattgaaaaacgaaccccactgtctagttaataattacagtatctggcaccatttcatcaactgaaacaagttgtgacatgcagatcttctattacgctccaaaaatggttgagagctggaaggggcagaagctcctctccagagcagaatttcatgtcggagcccatataacgaagtttttgaggctgcaaatgcttcctactcagggcttatcgtctgaaaagacaaatcgtttcgctcttctttttggcaatctggatggtggcattggatgcattgcgcctattgatgagctaacattccgacggctgcaaagcttacagaggaagcttgtagatgctgtcccacatgtgtgtggcttgaatccaaggtcattcaggcagtttcattctaatgggaagggacatcgtcctggaccagataacatcattgacttcgaacttcttgcacagtaagtttaccttcatatgagcttgattattttcccatttgcttttgggttcttatgttcgctgcaca

SEQ ID NO: 61830 - DNA, 1033 bp, Oryza sativa
cagggttgcacggccgaagatggcgttgtagttgtacgggatgtcgacgacgtcgaacagtacttgctcttcgtgtctgttctctccagagccaaaagctaccagcaaaagtgcttggccaagaacttgaactgcttctccgccgaaaccgcggagcgatgctggtgccggggtgagggcttgggtgagcaaccccatcttggtatatgcttcggcgaagataacatcggccgaactccctccgtcatccaggattcgagggacttcgaagccagctatctcggctgagatcaccagaggatcttgatgcgggaacataaatcctacagcgtcttccggcccaaaagaaattagctggttaagatattgcggtgccccttcacccgccgaagtgatgctgtggaccgttcggatctgcatcttcttctgccgtttggacaattggcttggcgggtcagcccttgtaatcacttggattacccttcgctgtgcacacatgggtgcgatgttttcgaccagaatgaaaaagttcaaaaagcaccaaaacatgattttcggacatattggagtgtattcggtacgttcgtagcaaaaactcacttcgtccttcgcgcggccaacttttgtcaattaaagccaatattggaacacgtggatgtgatgtttttgaccggaatgaaaaatttcaaaaaccactgaaacatgatttttggacatattggagtgtattgggtacgttcttggaaaaaaatcacatcgtgattcgcgtggcgatcttttgtcaattaatgccaatagtggcacatgtgggtgcgatgtttttgaccggaatgaaaaaattaaaaaagcaccaaaacatgattttgggacatactggagtgtattgggtacgttcgtggcaaaaaataacttcgtcattcgcgcggcgaacttttgtcaattaatgccaatagtggcacgtgtgggtgcgatgtttttgaccgaaatgaaaaagttcaaaaagcaccaaaacctgatttttggacatattgga

SEQ ID NO: 61831 - DNA, 1880 bp, Oryza sativa
ggtacgttcgtggcaaaaaataacttcgtcattcgcgcggcgaacttttgtcaattaatgccaatagtggcacgtgtgggtgcgatgtttttgaccgaaatgaaaaagttcaaaaagcaccaaaacctgatttttggacatattggagtgtattgggtgcgtttgtggcacaaaatcaattcgtgattcgtgcggcgaacttgtgtcaataattgccaatattggcacccgtgggtgcgatgttttttaccgtaatgaaaaagttaaaaaagcaccaaaacatgatttttggatatactggagtgtcttgggtaggtttgtggcaaaaaattacttcgtgattcgcgcggcgaacttgtgtcaattaatgccaatattggcacacgtgggtccgatgtttttgaccggaacgaaaaagttcaaaaagcaccaaaacatgatttttggacatattggagtgtattaggtgcgttcgtggcaaaaaatcacatcgtgattcgcacggcgatcttttgtcaattaatgccaatagtggcacatctgggtgcgatgtttttgaccggaatgaaaaagttaaaaaagcaccaaaacatgatttttggacatactggagtgtgttgggtacgttcgtggcaaaaaataacttcgtcattcgcgcggcgaacttttgtcaatttatgccaatattggcacacgtgggtacgatgtttttaccggaatgaaaaagttcaaaaataccaaaacatgatttttggacatactagagtatgttgggttcgtttgtggcacaaaatcacttcgtgattcgcgcggcgaacttgtgtcaattaatgccaatattggcacacgtgggtgcgatgtttttgaccgtaatgaaaaagttaaaaaagcaccaaaacaagatttttggacatattggagtgtcttgggtacgtttgtggcaaaaaattacttcgtgattcacgcggcgaacttgtgtcaattaatgccaatattggcacacgtgggtacgatgtttttaccagaatgaaaaagttaaaaaagcaccaaacatgattttgggacatactggagtgtattgggtacgttcgtggcaaaaaataacttcgtcattcgcgcggcgaacttttgtcaattaatgccaatagtggcacatgtgggtgcgatgtttttgaccggaatgaaaaagttcaaaaagcaccaaaacatgatttttggacatattggagtgtattgggtacgttcgtggcaaaaaatcacttcgtcattcgcgcggcgaacttttgtcaattaatgccaatattggcacacgtgggtgcgatgtttttgaccggaatgaaaaagttcaaaaagcaccaaaacatgatttttggacatactggagtgtattgggtacgttcgtggcaaaaaatcactttgtgattcgcgcggcgaacttttgtcaattaatgccaatattggcacacgtgggtgcgatgtttttgaccggaatgaaaaagttcaaaaagcaccaaaacatgatttttggacagattggagtgtattgggtacgttcgtagcaaaaactcacttcgtcattcgcgcggcgaacttttgtcaattaatgccaatattggcataattgcacacgtgggtgcgatgtttttgaccggaatgaaaaagttcaaaaagcaccaaaacatgatttttggacatattggagtgtattgggatgcgttcgtggcaaaaaatcacttcgtgattcgcgcggcgaacttttgtcaattaatgccaatattggcacacgtgggtgcgaagtttttcaccggaatgaaatagttcaaaaccaccaaaacatgattttggatatattggagtgtattgggtttgttcgtagcaaa

SEQ ID NO: 61832 - DNA, 1783 bp, Oryza sativa
cgaacttttgtcaattaaagccaatattggcacacgtgggtgcgatgtttttgaccggaatgaaaaatttcaaaaactaccgaagtatgatttttggacatattggagtgtattggatgcgttcgtggcaaaaagtcacttcgtgattcgcgcggcgatcttttgtcaattaatgccagtattaggatacacacgtgggtgcgatctttttgaccggaatgaaaaagttcaaaaagcactaaaacaatattttcgcacatattatagtgtattgggtgcaatcattgaacaaagtcacttcctgattcgcgcagccatcttttgtcaattaatgccaatattaggatacacatgtgggtgtgatgtttttgaccggaatgaaaaagatcaaaaagcaccaaaacaagatttttggacatattccagtgtattgggtgcgttcgtggcaaataatcaccccgtgattcgcatggcgaacttttgtcaattaatgccgatattggtatatattggcggacctgggtgcgaagattttaaccagaaagaaaaagttcaaaaagcaccaaaacaagatttttggacatattggagtgtattgggtgcgttcgttgcaaaaagtcacttcgtgattcgcgcggcgatcttttgtcagttaatgccaatattggcacacatgggtgcggtgtttttgaccggaatgaaaaagctcaaaaagcaccaaaacatgatttttgcacatattggagtctattgggtgcgttcgtggcaaaaaatcactccgtgattcgcgcggcgaacttttgtcaattaatgccaatattggcatatgtttgcacacgtcggtgcgaagattttaaccggaatgaaaaagttcaaaaagcaccaaaacatgatttttggacatattggagtgtattggttgcgttccttccaaaaaatcactccgtgattcgcgtggcgaacttttgtcaattaatgccaatattggtgggatacacacgtgggtgtgatgtttttgaccggaatgaaaaagtttaaaaagcaccaaaacatgatttttggacatattggagtgtattgggtgcaatggttgcaaaaagtcacttcgtgattcgcgcggcgatcttttgtcacttcaagaagcaccaaaacaattttttggacatattataagtgtattgggtgcgttcgtggcaaaaagtcacttcgtgattcgcgcggtgatgcagcaacgggggttcccgatctttcgatgagaggaggataaactacgatttggggaaggatacgacgttggcggtccgactacaactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccgggtggtctagccgacacacgcgagtacaaggaagtagctgcagctaaacttacatcaaaacaaaacccaaagtgcaaaatggtggctgctaggagtttatatagttggaggaatgaccaggagaggaggtgggagcaaaccctaggttttgtggacccctaatgggctgtaatgatacaaggcccaagcccaagtttctgatgtaaagaactattttcgtcattctgagcagcctgggtcaaacttgatggtgaggccacatatagctgaaagt

SEQ ID NO: 61833 - DNA, 4026 bp, Oryza sativa
gcattgtcattaatcttttgtagcactttgaaaggaccatcagctctaggtagcaacttagattttctcaaattagggaacctatcctttctcaaatgcaaccaaaccaaatcaccaggttcaaaagcaacatgtttctttcctttgctcccagcaagtttatacttaatattcatgcgctctatgttctccttagtggtctcatgcagttttaacatcaattcagcacgatattttgcatcaaagttcactctctctgaagttgggaggggcaaaagatcaattggagcacggggtagaaggccataaacaatctcaaaagggcacttcttagtagtagaatgttgtgaacgattataagcaaactcaacatgaggcaaacattcttcccacattttaatattctttttcaaaacagccctaagcattgtagataatgttctattcaccacctcagtttgtccatcagtttaggggtgacatgtagtagaaaataaaagtttagtccccaacttagcccacaaggttctccaaaatgactaaggaattttgtatcgcgatcagaaactatggtgtttggcactccatgcaagcgaacaatctcacgaaagaacaaatcagcaacatgtgtagcatcatcactcttatgacaaggtatgaaatgcgccatcttagaaaatctatctacaacaacaaagatactgtccctccccttctttgttctaggcagccctaaaacaaagtccatagaaatatcctcccaaggcacactaggaacaggcaaaggcatatacaaaccatgagggttaaggcgtgacttagcttgttggcatgttgtgcagcgagcaacgaacctctccacgtctctcctcatcttaggccaaaagaaatgatcagcaaggatatcctccgtcttcttcacaccaaagtgtcccatcagccctccaccatgcgcttcctgcaataatagcatacgcacggagctagctggaatgcataacttattagctctaaacacaaacccattggtgagaacgaatttgttccaagtccttccctccttgcaattcaacaacacatctttaaaatcatcatcgtgcgcatattgctcttttattgtttctaagccaaaaattttgaagtcaagttgggatagcattgcgtaacgtctagacaaagcatcagcaatgacattttcttttcccttcttatgtttgatgacatatggaaaagattcaataaattcaacccatttagcatgcctacggttaagttttgcttgacttcgaatgtgtttcaaagattcatgatcagagtgtattacaaattctttgggccataaataatgctgccatgtttccaatgttcgcactagagcaaacaattccttatcataagtagaataattcaaactaggcccactcaatttctcgctgaaatatgctacaggtttgccttcttgtaacaacacaccacccaatccaatcccactagcatcacattcaagctctaaagttttgttgaaatcaggaagttggagtaaaggagcgtgtgttaacttatctttcaaagtgtcgaatgcattcctttgtgttgcagcccaagtgaatgtgacatttctcttggtaagctcatgtaatggggctgcaatggtgctaaaatccttcacaaagcagcggtagaacccagcaagtcctagaaagcttctcacttgtgtgatcgttgttggaaccggccagctatgtatggcttcaaccttggcttgatctacttcaattccctgcggagtcacaacatagccaagaaaagagactcgatctgtgcaaaatgtgcacttctcaaggttaccaaataaacgtgcatctcgtagagcatcaaaaacagcacgcaaatgaccatgatgatcctctattgatctgctatatatgagaatgtcatcaaaatataccaccacaaatctgccaatgaaagcacgtaaaacttcattcattaatctcatgaaagtactgggtgcattagtgagaccaaagggcatgactaaccactcatataggccgaatttagttttaaaagctgttttccattcatctcctaacttcatgcgaatctggtggtaaccactacgcaaatcaattttagagaacacaagtgaaccactcaattcatcaagcatatcatctagcctagggataggatgacgatatctgattgtgatgttgttaattgctctacaatccacacacatgcgccatgagccatatttcttaggaactaaaagcacggggacagaacaaggactaagagactcacgtacataccccttgtcgagtaactcttgcatttgacgctgaatctcctttgtttcctccgggttggtcctgtatggcgcacggtttggcagagaggccccaggaatgaggtcaatttggtgctcaatccctcgaattggtggcagccccggtggaacctcctttgggaaaatatcagcatactcctgcaaaaggttagtgaccggaggaggcaaagaaataggagtatcctcaattggaaataaggtttctttgcaaaccaaagcatagcaaacaacagtgtcagtgtcaacttcatccaaatctgattttgttgcaatgaaacaagatcccttcagcttaatctcatttttattattttgaacagagttggtgggtttcttcttatgcttctcaagttcattagccgcaataagatgctcactcctagtatgctcctgatttttttgtttgctagctctagcaagttcatcctttaaaataacttcaggagacataggatgtaacacaagtttttttccattatgcacaaaggagtattgattggatttgccaaagtgtaaagaatctttatcaaactgccatggcctacctaataacatagaacatgcttgcataggcacaacatcacagttgattgaatcatgataagaaccaatggcaaaatgtactcttaccaatcgtgttacctttaccttgccgctgctattaagccattgaatatagtagggctgcggatgtggctgtgtgctcaatgcaagtttctccaccatttcagcactagccaaattattgcagcttcctccatctatgatcacgcggcaagagcgttccttgatcacacacttggtttgaaacaaggtgtggcgctgattctgttcagccctttccatttgtgcgcttagcactcgctgcaccacgaggctctcatagtgctctgcagcttcagccctaatgtgttcctcatcttggtggggcgcgtcaccttcccctgcattgttagttgcaagcaaagcataggtttcttcatctaaatcactagcggaggagtacccaccatcagctctcacgatcattacacgagtgcttgggcagtccttgcgcacgtgaccatagcccttgcagcgtaggcactgaatatctcttgtccttcctgatgaagctactgatgatgagctcttggaaggtgtagcagcaacccctcttgttggttcactcgggcgtggtgtagagtttgttgtagagggacgcagcttgttgcttgaggacgatggtgctgctgctcgagttgacggtgcagcagcgttggaagatgtccaagagctagcacaacctgcagaaatgttagtcctgaagctagctcttcgtccctgtacttccctttcagctttacaagcaagatgaaacaaacgattaattgaattatattctttgtaggctagaatgtcctgaatttctcggtgaagagcattgacttcatcaaatcagcgctgctagtgctgcttgcgatttggttcctctcccatattcctaacaacaagtagatcacaacaaccatttagtagcacccaattctgagaagaacttgtatgattagctaggaatgactttacctgataattaagttcacgagctcgagctctagtcattggtccttgctgtgcaatacgcgtggttgtatcgttggaagggatgtcctcatcacgcggcgatcttt

SEQ ID NO: 61834 - DNA, 2693 bp, Oryza sativa
tggtatacacacgtgggtgtgatgtttttgaccggaatgaaaaagttcaaaaagcaccaaaacaagatttttggacatattcgagtttattgggtgcgtttgtgacaaaaaatcaccccgtgattcgcacggcgaacttttctcaattaatgccgatattggcatatattggcacacgtgggtgcgttatttttcaccggaatgaaagagttcagaaagcaccaaatcatgatttttggacatattgcagtgtattgggtgcgttcgttacaaaaaatcacttcgtgactctcgctgcaaacttttgtcaattaatgccaatattggcacacgtgggtgcgatgtttgaaatgaaaaagttcaaaaagcaccaaaacatgctatttggacatattggagtgtattgggtgcgtccgtggcagaaaatccccccgtgactcgagcagcggacttttgtcaattaatgctaattgcacaagtaggtgggttgtttttcaccggaatgaagaactttaaaattcaccaaaacatgctatttggacatattcttgtatattgggtgtgtccgtggcagaaaatcactctgtgacccgtgcggtgaacttttgtcaattaatgccgatattggcacacgtgggtgcgatgtttttcaccggaatgaaaaagttcaaaaagcaccaaaacatgatttttggacatatcagagtatattcgcgcgacgaacttttgtcaattaatgccaatattggcacatgtgggtacgatgtatttgaccggaatgaaaaagttcaaaaagcaccaaaacatgatatttcgacatattggactgtgttgggagcattcgtagcaaaaaatcacttcgtgattcgcgcggcgaacttttgtcaattaatgtcaatattggtatatattggcacacgtgggtgcgatgtttttgaccggaatgaaaaagttcaaaagacaccaaaacatgatttttggacttattggagtgtattgggtgcgttcgtggcaaaaaatcacttcgtgatacgcgcggcgaacttttgtcaattaatgcaaatattggcacacgtgggtgcaatgtttttgaccggaatgcaaaagttcaaaaatcaccaaaacacatattggagtgtattgggtgcattcgtggcaaaaaaatcacttcttgattcgcgcgacaaacttttgtcaattaatgccaatattggcatatattggcgcacgtgggggcgaagtttttgaccggaatgaaaacgttcaaaaggcaccaaaacatgatttttggacatattggagtgtgttgggtgcgtccgtggcaaaaaatcactttgtgattcgcgcggcgaactcttgtcagttaatgccaatattggcacacgtgggtgcgatgtttttcaccggaatgaaaaagttcaaaaagcaccaaaacacaacgatttgggagaaacgttgacgatccgactacaaccgtacaagacattgcgttgtgccttagcgatcgatacacctctccgtgggttgttgatcttgtcggtacaaatcaaccctattcctgcaagaaaatctaaggaataagcaagaacaagataaaagcaatctgatgttgcaaataggaattgaatacaaatgataagttggggttctgaagaagaagtagacggacggtctagacgacacgcacgttgcaagcaagtagcaatggctaaactttaatctaacaaaacccgaataaccctgaaagggtacctacctaattataggggtgggaggacgaccaaggagtgccaatggtcgttctccacctagttggggcgcacgccacatgggcccaacttgggccggggtcccaaacaaagttacaagcccataggcccaagacatgtgacgcaacaccttttttatgtgattgtggccaaacgacatggaaattggcgatgaggctggatcagttggaaagagggctccgagagctttccatcaagtactcacgagccgaaaacggaggtcgtatacagattcggcggctgtttgaagtcagcagtgtagcaggtggctgaatcggattctagcacttggagaacttgatctcgatatctccttgttcatgcatgatgtcagcaatggttgtatccgtagtagccattgtcacatcatcctccccttcttcacaaaaaaaccgtcctcggcttttccatatggtgctcatcacatggtcgatttaaaacaacttgtttcataacaagacaaactagaagtaatatgattagaaataacatgcctctctagcttgcaggttttatccacatgtacaggaggttctaaatccgaacatatataaactctacgcaccaaacatattcctctatcatcatattcgccaaagatatgaaaaatagcattagttggacatggcaaaccagacttagcaaataatttctcctccaaattatcgagctcacaaaaatcatcgaactaaacatagcccaaagtatttaaagaagatagcaattcatgttcctctacttcattagcaatgtgaacaacatgcttaaaatcagcacacaaagaaacactagaaatagcatgttcattcaccagttgtggcatagatataagtgaagcattatcacacaactcttctttatcacaaggaacagcaagtaaatcaacttgtgacaaaggaaggg

SEQ ID NO: 61835 - DNA, 2214 bp, Oryza sativa
aaaaaaaatcacttcgtgattcgcgcggtgaacttttgtcaattaatgccaataatgtcacacgtgggtgcgaagttttcgaccagaatcaaaaagttcaaaaagcaacaaaacatgattttgggacatattggagtgtattgggtacgttcgttgcaaaaaatcacttcgcgattcgcgcgtagaacatttatcaattaatgccaatactggcacacgtgggtgcgaagtttttcaccggaatgaaaaacttcaaaaagcaccaaaacaatatttttggacaaattgtagtgtgtttggtgctttcgtggcaaaaaatcacttcgtgattcgcgcggcgaacttttgtcaattaatgccaatattggcacacgtgggtgcgaagtttttgaccggaataaaaaagttcagaaagcaccaaaaaaagatttttggacaaattcgagtgtattgggtgcgttcgtggcaaaaaaaatcacttcgtgattcgcgcggcgaacatttgtcaattaatgctaatactggcacacgtgggtgcgatgtttttgaccggaatgaaaaatatcaaaaagcaccaaaacatgattcttggacatattggagtgtattgggtgcgttcgtggcaaaaaaaatcacttcgtaattcgcgcggcgaacatttgtcaattaatgccaatactggcacacgtgggtgcgatgtttttcaccggaatgcaaaagtttaaaaaacaccaaaacatgttgagtttgcttataatcgttcacaacattctactactaagaagtgcccttttgagattgtttatggccttctaccccgtgctccaattgatcttttgcccctcccaacttcagagagagtgaactttgatgcaaaatatcgcgctgaattgatgttaaaactgcatgagaccactaaggagaacatagagcgcatgaatattaagtataaacttgctgggagcaaaggaaagaaacatgttgcttttgaacctggtgatttggtttggttgcatttgagaaaggataggttccctaatttgagaaaatctaagttgctacctagagctgatggtcctttcaaagtgctacaaaagattaatgacaatgcatacaagctggagctacctgccgattttggggttagccccacgtttaacattgcagatttaaagccatatttgggagaagaagatgagttagagtcgaggacgactcaaatgcaagaaggggaggatgatgaggacatcccttccaacgatacaaccacgcctattgcacagcaaggaccaatgactagagctcgagctcgtgaacttaattatcaggtaaagtcattcctagctaatcatacaagttcttctcagaattgggtgctactaaatggttgttgtgatctacttgttgttaggaatatgggagaggaaccaaatcgcaagcagcactagcagcgctgatttgatgaagtcaatgctcttcactgcgcgcgaagcacgaagtgagttcttgccacgaacgcacgcaatacactccaatatgtccaaaaatcatgttttggtggtttatgaacttttgcattccggtgaataacttcacacccacgtgtgccaatatatgccaatatttgacaaaagttcgccgcgcgaatcacgaagtgagtttttgccacgaacgcactcaatacactccaatatgtccgaaaatcatgttttggttgtttttgaacttttgcgttccggtaaaaaacttcacacccacctgtgccaatatatgccagtattggcattaattgacaaaagttcgccgcatgaatcacgaagtgagtttttaccacgaacgcacccaatacagtccaatatgtccaaaaatcatgttttggtggtttttgaacttttgcattccggtgaaaaacttcacacccacgtgtgccagtattggcattaattgaaaaaagttcaccgcgcgaatcacgaagtgagtttttgccacgaacgtacccaataaactccaatatgtccgaaatcatgttttgctggtttctgaacttttgcattccggtgaaatacttcacacccacgtgtgccaataaatgccaatattggcactaattgacaaaagttcgctgcgcgaatcacgaagtgagtttttgccacgaacgcacccattacactccaatatgtccaaaaatcatgttttggtggtttttgaactttt

SEQ ID NO: 61836 - DNA, 703 bp, Oryza sativa
ttttgttgaatgttgtgaagtccctgcaaaacgttagtaacaggagacacaaaagattgtcctggcatgtttgcacaccatcattgcataaggatataagagattcagaagcaagagataaatcacattgttcatgcttcctcgcatttgatatgttctgactctcaatgctatgagcaagcatgaataggtgtccaatatgattatatgtcacattagcaagcaaaacctgaattttagaaataagccccttgaaaaatttgcgcattgtgttttcattgcactcttttagatcactgtagatgacacaaactttaaattcatggatgtactccctaacagttctgtcaccttgattcagatgttcgaatttctcatgaagagtacatttgtaataagaactcacaaaacgatttctcatcatgtttttgtattcatcccaagttttaggtttgttactaatataagtccaccaaaacaatgcagaagaggtaaacttattaccagcagccttaatcatttgagcatcagaaaaatcatatttgtcaaattcattgtctactgctagttcccaatcaatatatgcaacagaatcatacttaccattatagaatggtaacttagattcaactcgcgcaaaattatagtcatgtacctcgaatgcatcatgtggagaagttgtcatatcttgtagacagtgaag

SEQ ID NO: 61837 - DNA, 702 bp, Oryza sativa
attcctgcagccctatatggcaatattggcatcaattgaccaaagttcgtcgcgcgaatcacgaagtgattttttggtaggaacgcacccaatacactccaatatgtctaaaaatatgttttggtgctttctaaactttttcgttccggtcaaaaacatcgcacccacgtgtgccaatattggcattaattgacaaaatatcgccgcgcgaatcacgaagtgactttttgccacgaacgcacccaatacacttagaatatgtcgaaaaatcttgttttggtgcttcttgaactttttcattccggtcaaaaacatcacacccacgtgtgtatcccaatattggcattaattgacaaacggtcgccgcgcgaatcacgaagtgactttttgcaacgattgcacccaatacactccaatatgtgctaaaatcttgttttggtgctttttgaactttgccattccagtcaaaacgatcgcacccacgtgtgtatcccaatactggcattaattgacaaaagatcgccgcgcgaatcacgaagtgactttttgccacaaatgcacccaatacacccgagtatgtccaaaaatcatattttggtggtttatgaacttttgcattccggtgaaaaacttcgcacccatgtgtgccaatatatgctaatattggcattaattgaccaaagttcgtcgcgcgaatcacga

SEQ ID NO: 61838 - DNA, 1275 bp, Oryza sativa
atcggaaagaagttcagagcaaatgcagtaaccgcacttacagagttctgctaaaatgtgcataaaacatggcccgtatagtatagaagttcaatgatcttgaaaacgaacttacagcttcaaccatgtcgcactactataaaaaaaaggaaatccagtaagctcaactagacttctgctgaaaagagggcgcagacctaattagcagtagattagtctcgtccttataaaccactatggcaaacacagtgcctttctaattaatcttgatcacttccaactgtcaagtgtcaatgatctcttttacattgtggctgctatcttcacaaggtgtcaaatggtcaggtcactgaattttggaagaatatccagcttctccagcatcatgtggttttaaataaaaatcgtagactagcatggttgtcacagtttgctgagataattcccttaatggcatacatcaactattaacccttgaggactagcaaggttacaccaaagctggtgccaattgccatgagatcacagaaattaggaagaaacttcatgtggcttcagagttggctaactgccagcttctaaatctgattgacgctattatttccaatgtaatctacaagaaactagtgcccagtgaaatatcactgaagttggacagtatctgcgagcgggtagttccaatctgctgtgcaacatcaagctgctcatctaatgacaacatctcatagctacaagagaaaaaaccggtcaattagctaggcatgttatgacgtacaatgattaaataacccaccataagaacttcctacaacacagtacaatttgcatcaatgcctcagaaaaccagttgcctgctcacttcgcggccaacagtagaatttccgttcaagcaatatccccagtcaaagaagcctatcagattactacttgtttgtgtagtcctttcggagaaatagtatgagttcgtacaaggtattaagctaccattatgattaaaccattacttatagacatcagttgtgtatcatgttgtggggactaaacattattaccgaggaatatatccattttacaccacttaacaattgcaaaggtctaaattacatgcttcttcaaaattatctgtttcataaaggtaacttttatattatttatctgaatctcttatgttctaaaacagggttaaaacttgtctgaaggcacaactcaaccaagggcgccagctggtctatggcatagactagtttagcaattgacggaatataaagtggataa

SEQ ID NO: 61839 - DNA, 844 bp, Oryza sativa
aaaaattgtccggacagacggaactatccgtaccagtttcaaccctgcccccacacttatcctttacccgtccttcagtaaagcttagggatctactagaattttgattttctgcccaatgatatgacacacaaaatattccaaggtttcagggttatggataccacatacctaatggtagttgactaaatctcggaaggacccaccacgtaccatgtcttgtacgaaaacaacctgcggatttaggaggagttccggataaggaaagacaaccagagttctacatggaaacgacaaggactactcggattgtatccatattggtttccctagttctacttggacaaggggacacctatgagtataaatacaaggccccctaggaggggaggggacaatacacacccaccatagaagacacggaacaacagaagctacaacatacaagccaacatacgccaagacaagacatcggatatcgacttcagggataggataagcacggctagtcccctacggtgtctccggatactgtcaggagagagaaagcgctatctctgatctcgccgggcacaaactcgaggaggaagactaccctgttgtcgactatgagtcagaccttcagaccgccatatcgaaaacagttagataggctaccccaaatattgtactggtgtgattatggtgaataagagcaataccggcttcggccaacaggatgtagggttattacctgacaattcaggggcccgaacctgtataaaaattcttgtctctgtctctttcacctcagtctcgcatatatcctagtaccaacgatccccatactatgcaaataccggaa

SEQ ID NO: 61840 - DNA, 1033 bp, Oryza sativa
aaaaatatcaaaaagcaccaaaacatgattcttggacatattggagtgtattgggtgcgttcgtggcaaaaaaaatcacttcgtgattcgcgcggcgaacatttgtcaattaatgctaatactggcacacgtgggtgcgatgtttttgaccggaatgaaaaatatcaaaaagcaccaaaacatgatttttggacatattggagtgtattgggtgcgttagtggcaaaaaataatttcgtgattcgcgcggcgaacttttgttaattaatgcaaatattgtcacacgtgggtgcgatgttttcgacaggaaagaaaaagttcaaaaggctacaaaacatgattttggacatattggagtgtattgggtacgttcgtggcaaaaaataacttcgtgattcacgcggcgaacttttgtcacttaaagccaatattggcacgcgtgggtgcgaagtttttcaccagaatgcaaaagttcaaaaagcacaaaaacattatttttggacatattggagtgtattgggtgcgttcgtagaaaaaactcgcttcgtgattcgcgtggcgaagctttatcaattaatgctaatattggcatatattggcacacgtgggtgcgatgtttttgaccggaatgaaaaggttcaaaaagcaccaaaacaagatttttggaaaatttggagtgtattcgagtgcgttcgtggcaaaaaaaatcacttcgtgattcgcgcggcgaacttttttcaattaatgctaatattggcacacgtgggtgcgatgtttttcaccggaatgcaaaagttcaaaaagcaccaaaacatgatttttggacatatcggagtgtattgggtgtgtttgtggcaaaaaaaatcactgcgtgattcgcgcggcgaacttttgtcaatttatgccaatattggcatacgtgggtgcgaagtttttcaccagaatgcaaaagttcaaaaagcaccaaaacatgaattttggacatattggagtgtgttgtcgaaacgacaaccgcataagtcgaaagacgtgg

SEQ ID NO: 61841 - DNA, 829 bp, Oryza sativa
ggttggaaaaataaatatggggctttgtgtactgggatacagattgtgggtttgagtgtctctgttagttgcttcagattttaaggagcccatctagagatgttctccattgcgagctgagttttcctacgaggagaacactctagtaggagtagcttgcattgtggatgccctaatgaaggccttacgcatcctgctttctagaaagtgtaataccagccacctccattgacgcgtgggccccaggagactcctcccttctggccccacccgccatagacccctccaaaacccatcggccaagtcccaacggctccatcggccgcccgcctcgcacgcttcctgtaatcccgttggaggaggaagccagttaccacctcccgtctccctctcttgcggtggtggatttcttgccgacgtttccgtccccctctctcgctctccctctccgcagtccagaatcctctgctccgcccgaatcgccgccgcttcttccgaaccggtggcgcggccgcggagccctaacccctaacgcgtgctgtgacatctccggctgtgacaaggcagtgggggcctccggggacctcattttccgcaagtggaatccgctgctccacccgaatcgcctccgcgtcttccgagtcggtggcgcggccgcgagccctaaacctacggcgtgctgcgacgtcaccggcggtctcgaggcagtcggggttctccgggcggccatgtcgatggactcggtcatctcctcgcgcagcggcgccgactacaggagcttccgccagatcacccgggatcgtgagtgccttcctgccctgcccccacg

SEQ ID NO: 61842 - DNA, 1416 bp, Oryza sativa
gatgacatgacgtacatccaaaacaacttttcatgacctgatggaacactatataattaatgttatgtttgtaacatgcaataagaacagttagtggctgtgtcgtacatctttgttatgagaaaagaagttgtagtcagtacaatgcatgaacactggaaaatccaaagtcccagctggctcataggcattaagctccaattatactaacctccacaatagaagtcagggttggctcaaaactccaaagctaaaacatcaggtaaggccagattcagggaaccactatttacatagccttgtgtatgaagaaacaattaatgcattatttctttctatttaattgttcctatcagcattatgcatggactttcgaggaaaaatgatgcctagagaacagaaaacaggaactaaaccaaaagttacgtgctcaaaacctaaaagcatattaattgaaccaaaagctattcaatactcacaatgttcaggctcacaacatgcaaaggggcatcatagaatgcaacagcagtcaattcagcaccagtccacttgtttaatgtgatcttaggaccagaagctatcagcagatgaccttgaagagacgcaacagctgatacagcacctttactctcttttgagtagacttcagtgacctgcaattagtgtttacatgttatcaaatcaatcgatacgtaacggaagtaataacctttttcccaattgcaataatgctccctcacagtaccagattttgagaattttcacttttcgtgaaagagaacagaagcacacgtcctctagcagctacatcctccccaagaacataagcagtcccaatggccaacagggtctcattttccttggtggttgtattctgaagtaaaaatgcataactgttcagtgaataatataattaaacctacagacatgtgtacctttgatcattaaattttcaaacaagataaatctcaagcatagaaatgacatggcaaccatgcatttggaagaaaagaagatagaaaaaggaagtaatgatgactttattatagctgacagtttatgctaacagctccataattgaattataaagggtcaaatatagagtatagagggcatttagtttgcaaaaatgtgcttgtgggttgctaaaatatggtgtcttcaaccagacaggttcacttggtttgtcacagaagttcatatagtttggtttcaagtgggaatgagaaaagacgcatacatgtaatgtaacaatgcgcacgttagagcattttcaaacaattgcattggaattgtggacttcgtctcccaatgtccaccaggtttctccagctccaaaatgcggacctcaaattcatcaacagtatatgtcttatgaagggcatcagtgcttgtaacatcgttatccatgtgatg

SEQ ID NO: 61843 - DNA, 2208 bp, Oryza sativa
tttcagctagtacatggaaaagcttgtacctccaggatgggataaaaccgggacaacatccattttgattcttctcctatccgctcctttctgataccatgccttttctaaaatttgtagagttaagtacaattaaaattactatggttgaaaaggtacatgacaacaaaactaaaagcctaatgaaataacacaagataccttacgtagatcaaatttcagagtaaagccacctgccgaagactttttagaatcatgcccacaaaggcaacgcatattactcactgcaatcatgtcatcagcagataatcctgcgagctgcaaagaaaatgggttcttgctgaatcttgtggtattagtcagtatatagtgtagcaactgaacctataagcttttgcaataactatttctaatttatctactgtggaaaaaatgaatgaaacatagacctttggggaaaaaaacataaatcaagccccccatcagaacataggaaaaatgcaagtttagaatcctaatttttttccctttgaacccctttggatcgaaggaatggtcccatgaaatcctatgaaattcttaagttcaatcaacgggaatttttgaagacttctagcatgatgtttggacttcaaggaaaatttccttacttttggtgctgcatgcgctgaatggaagagaaaaaagtgtggcaggtgtgtatagccattttggcttcaaatgaaattcatgtcaattgatagcatacttatacctcaacttatttagtactacctccgtttcaaaataattgtaattttagattgtttagcatatattaaggtttgagaagaaagactatggtgccccttattaaattgtgtataggtaagagtgggagggtagttgaggtacaataggaaaaattttgaatgagaagtgattgatgggacaattaatactgtatcgtgacaaatatttttggacaaatttaaattctagaaatataattatcatgggacggaggtagtaggaaatactgatgtactccctccatactcgtaaaggaagtcgtttaggacagcgacacggtctccaaaacacaattttgacttgttgtttctataaaaatatttattgaaaagtgatatatgtatacttttatgaaagtattttcaagacaaatctatacatataatttttgcattttcaaactcaacaacttgagagttattcatgatttatattttcaaggtttgacttaaacattgtcctaaacgacttcctttatgagtacggagggagtattaccaatcaatagcacataattacatcaaatttatatcggtacagcagtttacactgaaagacatacatccatgtgattaataaatatatgcctatcctatatacttatgtgactacttcaacctgggcttcaactgaagatttgatattttgcagaatggaccaactgaaaacatgtaatcaaaataaataataaaagaactagctgctacaggtagttcatcttttcaatttttaattgtttctacagcttacattgtactttggttttttgaagtccccaatgtgtagatctccagattgaattttttttttttatgcttatgaaagcacaggcagagcttcctatgaatatggtgtcaaattgccgggcttcaacttcctatttttcatgcttaaattatgttctgttagggacaaggtcaatgttgctctacacagagagtccaccattacatgagacctaatttttgttcactgtacatacacagaccaagtaccataaatattacgttgccttttaatcaaccccatttgtcatgttgagataacactgatgttttcctaaatttcttacgcatgatagtattttctgcagcaacgcataagcatcatctagcaatcaggcatgcatgaatcttgaggtgcttgttcagtgacaaggcaccattcaagttggtaaagttttattttaaaaataactgagcagatttcatgatagaaaagtaaagttacctgcatcaactttgcacccttatcacttcgagttttatctggattgatggcagcataaaccataagcaaacgcagcttattttcacgactgatatcctgcattagatccatgaaaatattaatattatatacatacaggtaaaatattccaataatttgtccaaatagccattaccaaatgtgtcc

SEQ ID NO: 61844 - DNA, 4941 bp, Oryza sativa
caggcattggtagatcacatattggcagtgatcattgcatattgacaggcggacaaggcagggaatgtaactactaacctcaacatgaagcgcaagcttgtcaatttgatcactgtactgcggaagagcttgaaccattttttgcaactctttggttgataaatctccaccatttctgacaaatataacacaagcatttacattacaaaaagaaaaggatcctatcaacagaaataattaattcaacataaaacaaatctttgaataccattaactattcagtatggcaagtataccaagaaactagatgcatcagatatttaggctgtcattgtacgttgcagaaagtattaaattctcactaattgaaaaaccaaaataaatggaacaatcaagcaaacaccgtgtctcaatgacaaatagtaggaacttaaaataatcttattgacacaaatggactaaccctttgggaatcagtgcagtagtccatggttcaatctgaatctgagctatatcaaatttacccgctattcaccttagtaatcatctgttgaccactataaatgtttctaaataaccaccagaatattcatggctcatcatttcaatgaatagataataatacatcaagtcatcaacaaaagctaacacactctggcaaacagcctaggcaggagcgaagctacattaacttacccaggtgcacgggacacccagtgttaatcagtttccagtagtatcgttgcatgccctaagagagggacaccccatgggccaagcataggaacacccgtccaagccaaccagctgagagcgcagcctaggaatgtctccgttcagcagatatcgctgttcagcaagataggcctgggcaaggatcaactcactgagaggctgagactgcgtagctatgctgtcgtctggagtgtcttaagcctaccaggtgctatcgtttttgcattcctggtttctttgaattatcccatgttcaattatctgtcctacacaaccaatatttatttatgataaacacttctataactaaatatctgtctgcatattattagaaataagattaaaatgagctatgtttgctctcaaagcctataaatgatcacgttaatcgaaaaaagcaaaactatactgtcaggtcctgttcatttttagctttttgtctggattattgtcgcagattatttgctccacccttctaaaaataaagcttctcaaaaaagaaaaaaaaaggactaaccctttgggtataatccatgtaaataatccacacaaaaatctgtttccaacagggccatatgactactacaaaaaattgcctaagcaatattgatgtataagttatagggaacacattgttttagggacttaggaaacatgccgcataccagacacaagccataagcgaaaaatagcgcacaattagtgatacatatggggcacccggttatttttgttctgggtttgctcctgagcctaggttttgcaatcatttgcacaaaaaagtaagcataataataaatgcaataatgcatttaatataaattccaacatatgttgttgtaatagttgcagaccacggtcagttagtattccattcatccccctaatttgtgacaattacatttattgaacaaaccttgcttgatgtagttgagcagctttgttttttgatacaaaattggtcatcttctcatgcaatctttcactagcctgcaatattgactccatgatgcattaatgaagcatatagataatgtttggagacaatggtgacagtctcacattggctatatgtacatgccgaagctaagccatattggatcatgatcctccaacaaaacctccttgttctcagtgcctgaaccagacttgcttgggacctgttgtttcatggtcagcattcaagagcacaacagaactgaaaattggtaaacaagctactacaaatgaagattttgacatgctcacctgttgtacatacttgttgccatccatgcagagtagatcatgacacatggcatcataggtccattcgtgaataattggtgcgatctgaaaacattaaggaaacatgagaacaaatcattgcttcattcaatgtggtagtcagtcaaactaaaacactaaaaaagggaaaattgcaaaaatcaccccagaaatgacttgaagtttgacattccacctcatacctgatctattgatcggtctacgataagtaattcacatgtttcagtctgagggaattcaggtatcatagccttaaatcttgcaaggcaattccacacaccagcagcaagctttgtgggtgccaaatctcgtagtgttgtcaaagtagaagcatcaatcgtcctggcaacacgatagtgcacacgaggaaattcctaaaataattgaaagcaaacaacttaagtaaaatgtatggcacaaagaagtttttttaagccaaaagtttcttaagaaaatagacacccaaacaaatattagcaaaacacaacaaaataaaatttgaatgactcgataagtcgtcaaatagttcttttacttttttagtaatatttttaatggaaaattgtaagtatcgggtttcaaattcttttgctaaaatagcactcactcagcacgccatatacccaagcagaatgccgactagccctgtcgacacgtggcgtgctgaaaaggtggacatgtgtccggagtggccgtcaccgagacaggtcctcttggcaaaaacacatgctgacaggtcatatccgcaaaccatttgccgatagggctacctggttaccagcaggccgttggcctcctcccatgccaacagatagcgaggcagctgctagcctttcaacacagtgaatgaatgtgtacccatgcagtgctattttggtaaatttgtttgaaaccctatactattttagcaattctccttttaacaaataatagtaaaatatatttaaaaactctcaaattggatcctgttttgaggaataattcttccatatgtgtatcagtggataattggatggaacaacctatttgtttgatatttctttaagtttgtttcctccattggcagaaaaacaacaacccaccacatctgcagtgtgcatgcttaattttttatagttccaggcttgcagaagacatgcgttacaattaccatatgtttttcctttctcattctttaacagtatattaatttcttacttatcaccaactgttcttttcatgtttaaaccataagaacaggaaaataaacatttaggtatatagacatgtcaagtagcataaaatgggaaaacagtaccctcattgatgcgaatactgtagcaatacgagtggccatcatgttaaggcaagagttatacttgagtgaaccttctgcattttcactaaatagctcttctagggccttgtcatggtcagttgtaaagccctgtatataacaacaatagattcactgaagccaaatacaaaattttatgatgaactaaatcaataaggagaaaggattgatttctttatggtttaaattaagtcattaattttttttaatctaaagccagcagtatcaaaaggctatgctaatatacctggctatcgatagcaaaatattccagattcatctgcaagcataaagcacaaatgaattaagaggaacaagtgtaattgcaatgttgaaaaatgagaacatgcaaggaacagataatagttaaactgacctcactgagtgcacctatgcgtgctctaacatttgaatctttttttatttgggccaccaactctctttgtacgggtgaactgaaaaacacataggctctgaaacacgtaagtatcgtgtccaaaataaaccatggttggtaaggtgtctccagtgttaccaggaatcagacaaaccggtttaaccggttgtttaccggtttgattgcacagcggtcttttaatcgaaccagaccagtaagagcattggttccggtttattctggtcggaccggcagtccagtccggttctaataactatggcgacaatcctaccacgatccaattgattctctcgtgtactctccccttcctgtatttgcggatctattgcttcctgtactaattgtcttcccctatgttccttcccaacgcttacatcccctgctgttgtactcttctatgctcttcctccccaggcaccatctgttccttcccacacttacatccagttgtgtactagtgtctaagccgtcgcctcgccttatgccttgccgctaaggcagtctagggtcgccttaggttgccttactgccttaacaaccatgaactaaacttggaagtgatacaacatgcataaacaagtaaatgcacaggacacatacttcttatacagtggtattttccctgacatgtcggacatgaatatgcgaatgctgcatcaacaccataataaattggttagagagtttgatggacaatacaactttcaatatcagcagcaaaccattgacatatatgactggcagttatcaatatcagcaggaaaccattgtctatctatatttccacatatgtttttcagtggaattaaatgaaagctccagcacaaattaaaggataaaaacaaatttaacacatcatatataattattcactaacaaatggaaaaattcggttttgtgcctactatcaatcagtaaattatttctgtgatcaatcagtaacaatggtaataggatgtggtaactagtcacacttacttttccttagttggttgaatgaaataaattgcatccatcaatggtaatggttgcctccgcatgtataagtcctcaaccactgcaaaaaaaaaaaaagaagcaaattctcaaatgtatatagatagacaatatttctgcgaggaaaatttcaaaaaactaaagataaattatcataacgatacagggg

SEQ ID NO: 61845 - DNA, 3237 bp, Oryza sativa
cattggtgatgcccttaggctgtgtttgcaatctggttcccaacatgcacagtacgcacagaaaatggagcggtccattaacacatgattaattaaacattagctaattttttaaaaaatagattaatataaatttttaagcaacttttatatagaaactttttacgaaaaacgcaccgtttagcactttgaaaagcgtgcgcggaatatatttgactacagaagataaaaaacagataattatggaatgaatacaaataatagtgatttgaatgaggacaaaacaattatgctcaaaatatcataccctaattatgtttgcccaagcagcatcatcagcaataatctgcaccgttgattatcccaagaagctccactctgtttccttgcctccttaagcaacctataatctcgttttaactgcttctccttatcttggatctgttgcttattcatggtgacatagggatgtctgttacgaaattctttgacgaccttgttccatgcttcacttgtccacccgttttggcaccggtaatgtcggttattgtgctcatgaagtaaatcaactaaagccttttctagtcccgggttccatgaagctcttaattgttgagctattagacaaaattagatgatagtaagtaaattttgtaataattaacatgaaaggaaaatactccacaaaaccaagttagatactacctttgggagaaaccttcttcttctgtgtgctacagctctttggcgataccttcttttgtagatgcctttgttgttgctgcaataggcttgctttcggagatagtcttccaaacatcataactgtattgcaatattttattgaatgaggaaatacaaactacattacttactattaattgcccatatcataaatgttgattacataaataaatacaaatcataaaaaaccaaaatattatctatactattcttgctagctacaaacataatcttcccacatctaatactattcccactgatcatttgattgctaagagatgccacatcattttggtattcactgtcaccttccggtagatcaacaaaattagtaggctttatattatcaggtgggttgtccaaccagccctcatcaccattaagaaatcggatcatgttgtggaataccgcagcagctgctggaatccacacttggttctttatccgatggaaagtacctactttcaagatgggaaatcgcttctttaaaacccctagagctctctctacatggtttcttagaatggaatgtcgatgattgaataactccttgtagtctctaggtcgacgatgaccacatccaaactcctttagatggtaccgaacaccacgataaggagcaatgaactgtggtgtgttggcataactaccaactagagaaaatttaccatctaggacttgaaagccactattcattgctgatgtaaggaccctagcatctgttgcagatccctcccaaccacatgagataaaagtgaaatttaggtcaaaatcacaagcaaccatcacattttggctcaaagtcccctttttgttcctataaggagctgccttctgtcacaccctaaaaaatcctaaatatataaattgttgtttaattggaattattagaatttattttaaaaagcctagaagagaagatctaattttaattaataaattccaatataaaatggggccagataaaatttcattaaatactttgcttaattctataattcctagatttttctgggatttatttgagctaaggaagtatttttaataaatggaattacatttaatgaataatttaaattggaaaaggttttaaaaatcctcttttggctttgggccgaaagtcggcccaaaaccttctctctccctctccctggcccaagtcggcccagtccgcccgtagtcgcccgcgcgcgcgctcggccgctgacaggtgggtcccacctgtcggactcgtcgtcctcctcgcgtcgtcgcccggccggaaccctagctgagccgcgccgccgtctccttccaaattcgctcgcgcctttccttctccggtgaaatcaatagaggggaaatgatcttcgggatctcctctaccttttctcttttggaatcgtcggctaaaatcgtttggaaatccgtggattcgagttcgattcggatcgatctctctcctccgaaccctagactttccttcgtgtcgccggtcaccgtgggccttcgccgccgcctccttgctcctataaaaggacccccaagcccgccgctaaccgccgccaccctcgtcgtcacctctcgtcgccggtagagccctagcatcgtgtagcctagcgccgccgtcgccgccacagctctagccgtgcgccgccgtcgctccggttgttgtcgctgctcggggaggtcgccgtcgtggtcaccaagccgtcgccgatctcgtccaccccttcgccgacgccgtaagtcgccggagcaccgccgtcgtcgtcaagccgaaggttgccgccgcttcttcctcgacgtcgtcgccgtcggttgatcttccgccgttgttttggtcaccggtgagttcgccgcttcgccctctacgtgttagtgtcctccgttcgcgtcgtcgcgccgtcgttcgccggcgagcttgccgcccgagccgccgccggtgatgacgtcatcgccgacgtcatcgttgtcgtccgtcgtagaccggttgtagaccgttagatcttggccgttcgttggggataggatcgatctcggccgttcgtttccgtgagccgccgccgtgcacccggttcaccgcgaaccctagccgctgacgcaataattctcttttccttttcaaaaataattcattattgcgtcataattcaattaaaatccatataagtgatttaatccgatttaatctttaaaaattcataactaattcatctcagctcggatttagttggttcaagtctctaaatttttctaaaattgagatctacatgttaaaaatatccacatgtactgttcatgcttgtttatgtgctgttttggtgtttttgctcttttctgtttagattccgacgtttccggagagtccgttttcgcaggagaagaatttgaggagttccaaggccagcaaggcaagtcacacagatcctaaacacaatcctttgagcatgttgatcctatatttaaattctctatttatttcaactgtgcatttattttcgaatgtcactg

SEQ ID NO: 61846 - DNA, 1332 bp, Oryza sativa
taccttgggttattataacttgactagttgagctttatatattggttcggctagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccgattcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgcgctgtagtggattgtgttgtgcaaggggtactgtcacagctcctttccgaggtaccgtggtggtattaaggcacatggtgacatgttgtggggctgtgtcttgtgggtacagtggtacacctctggccagagtaaaactattcgaatagccgtgcccgcggttatgggcgggtctaacaatgtctttcatgattagtctcacacttctcatcataataaaagatgctataactggtaataatttgattagctcctggtttggaatggtatattcctggtttggagatagaactatgcagccgggatggttgttcagaatggttgggcctatgcaacagggtatgttgtatagcgttagattaatattgtttaattattacttaactgttttattaaattctgaaatgtttattaaatgctgtttatgcaaatgaaaccctactatgccatcctttgttatcctgtgcacttgcatatttgctgcgtggcttgctgagtatgtcatatactcaccttgcaatcattcatcagaggaggagttctacagtgatgctgatggtgtggaggattaggtgtagccctggtcaagctgcctgtggagtggagtcgtctgcgccgtttatcttattttttccgctgcttagatctttattgattgagaggaactatctacctctgtaatgacattttattcgcttattaattagagtgataattgtactctattatcaatttgttattgtgtgcctcggctgattcctggacgagggtcacacacatgtaagcgtttggaattttgaatagaaattccgggcgtgacaccttctctccatctatagttttataggaatgtgggtgccatcaataacccctatgtaatt

SEQ ID NO: 61847 - DNA, 3203 bp, Oryza sativa
aagttagcattcttcatttgtcaaacatttcatccatcatccacaaaataatactccatgtcatttatgcctcttcctccaaagctctttcaaaaaaaaggaagagagaggcatggctatgcaaaaagaaataaaaaaagtgctcatacaagtatggagcatgatgatgaaaaaaaaaagaaaaaaagaaagccatgcactctcccaaattttcaaaagaaaaaaaataaatggaggaggaggtatacaaaaggagttggtcatatttttcctttttccacccacaaattaaccatacacatacacatgcacattcttgaccagaaagtatgtcttgtatttccatatatcctttatttgactttgcaatatgtgttatgcaagtaatgctctactcttttccataccttgagctccacataagccttattagatgataggaaaagaaaaggcacaatcgtatgcctttgtgaggaatcatacaccttgagtgattaagagaatcaattgaggagcaaagcaaagttataattttgtgttacataaaagaacccaagttgttcttcatgaaaagttagggtgacttgagtcaagattgttccatttctcaattgctcaggatcgcatggtagacactacgaagatccaaagtataggtattactttgaataatttgtttgaatgattattagtaaggaagtcatgaccctgttatagagtccatagccttcactcgggacgagcaaaggttaagtgtgggggtgttgtggacggcccttaaatcataatatctgaccgtcaatacttgcatataatgaaataaaacatggtatccaacttagtgtaatcatttctactagtgttggtgaaatatgtgtatgcaggtaatttgagaagcaaacacatccgtcatgcaacaaaatgcacctccgcgcattcgggacgcatttacacggattggaggcccaataagtcaataaaacccatttagaattggaccaaaacatagcccaggttgttggggcccattaagcaatctcccagctgaaggagaggccgggatgagtgtttttgggttcggccgaacccaccaattcggccaaacccttcctgtcgcttcccgccatctgcttccaggtggacggcgtggattcctcccctatggcggttgcagggtgttttggtcatttcctatacccctaaccgtcatttggagcctatataagaaggtattcatctcacttcaagcatacacaaccttgagctgaattacaagaggctctattgtatcttttgtacattagaataatgtagagagtgaggggaagctctagaggagtgcccggaagtttggcgctcatccaacttctacctcgacgagtgtagtttactaggaggaattcgggaggagtaccggagctgtcggtacactctgcttcgggttcggagaacttcttctataaagtaagcattcgtgttcttttcttatgttatttaattactttgtctgagtaagatagatttccatctttgcaggttcattgtttagtattttgatgtgaccatgactactaccgatacaaccattactcacatcatggatgaacaagcagatatgaagatcaagtcctccaagtgctggaatctgattcggccacctgctgcattgctgacttcaaacggccgccgaatctgcatacgacctccgtttttggcccgtgagtacttgatggaaagctctcagagccctctttcttacggagctagcctcatcaccaaattccatgtcgtttggaagcaatcacataaacaaggtgctgcatcacctgtcttgggcctctgagcttgtaactttgtttgggaccccggaccaattggagcccatgtggggtgcgccccaaccaggtggagcacgaccctagggtcctcccacctctataaatagttaggtaccccttcaggattttttgggttttgtttagataaaagtttagcttcgctacttttccgtgtaatcccgtgatcggttagatcgccggtttactcgttacggaaccccaaacctatcatttgtattcaattcctatctgcaattcagattgcttttatcttgttcttgcttgtttcttcgatttgcttgcaggaacaaggttgatctgcaccgacaagatcaacaacccacaaagaggtgtatcaatcgctaaggcgcaacacaacaacgtctagtacggttgtagtcgggtcgtcaacgtttctcccaaatcgtagttatcttcaactcaccgaaagatcgggccaacaacagccttgagtgtctcaagtggaactcagggttcatcaggtggtatcagagctttcgttgctcggtgagttttcatttacctataaccagaaaatagccaaaaaaaatttcatacattacctagccacatttgtgccattgcattgttctattcagtttttgctttgttgaatttttgttgcattgtcacgtcgtgttgctggtcttagcgtctagttcgtttagagtttcgagttctggtcacgttttgtaccacagtcgtcgccgccaccgtgtctctgttgtcgtcgggacctatgaaaacggaatcggctcgctgctacggttccatttttctagttttcagaagtttctgtcggtcggttttggtgttgttgagttgcatctagggtttctgccgtgtggttgtctcgctcccgaggttgtgccgtgcatgctgttctattgtgcgcgaggaagaagatctgttgcgcgaggaaggagaaagaaaggataacggatcggttattggaggaagttttgcggattagattagattgggtcggtttgtttccatctaagaccgaacttaccatcttggcatagttagttttccaccgcacagaagttggcgttgttccctgactccgactccctctcgtctcggttccaatgcataccgtgagtggctagacaccttggtaaaaaattttggagtgtcgaattggagatctgttcgtaaaaatggaaccagtataaattcagcattccatttttgtataatttgtaatttgggttttgacttttacagttgagtccatgtaattttttttatttaagtttaagtccttgtaacgttacattgaggtccttgaatctgtttttgtaaaaaaaaatcaaaaaaagaaagaaagaaaaaggc

SEQ ID NO: 61848 - DNA, 1394 bp, Oryza sativa
gtggaaagcaataacttatacaccaccacggacggctttgcccaacgtggcgagctgaaccccccaacccgacatgcatatattttttgaaatttcggaaacacaaaaactgatgtccgattcatacccagatggaggcaggcaaggcaggaacgaggaggtcgccgcgccgcccctccaaccctgctcgccgtcgccgcccgccgtgtgcggaagcagaggagccccgtccacaccgcgcctgcggaactcctcgccggcgacgccgcgccctagctccgcctccgcctccgcagattgggaacggagagagagaggagaggagagaggggggagatggatcgagagagaggcggaggtgggggaagtagtctctccacttcctctctctgttcttaaattctcttgggagggagagctcgcctcccattggagggaacacctggcgggttggcgggtccggatccgacacaggtcaagtgcctgtggtgtggggccacatgtcggtgtcagaggatgagggatgtgtgctcctcctgccgtgctggaagatgcttttaattagctcgtgttactgatgattattagttgtagtagctcgagttagttggaaaatggcggcagatgggaaccgtacaaggtagttggttaagtattgtttgtatcgaaagctccaattattgtcacttggtacacaaacagtaggggctcatgccttaaccattctttgttgcgtagggagtacttgtgtagggtaactaatagccaaagcatcacaaatcacaaaccagaacttgacagaaaattggcctttttaaccagcacctgacaaccagccaattttctgttacagcacaaagtacactgttacagcacttgacaaaaaacggtgggcctgatcggaactgctggctgctgcagccgtcacgactgtggccgttttcagctgctgctgtagctgatttttagctctcgcagccgcagcggcggcagcagcaagcgctaccgatctctctcagtgtttgacatttccgacctctttaaaaataaatattttttatacaattttataaagctacttaaaatctgcaaaatttttacaatccaaaagaaccatttttttatgctactgctatttacattgaggtgttgctttgttggcaaatggcaaatcacactgaaactctgaaacccgatcatatataccttgacagcgtgaaatggctcgattaatttctctaggataagaacgaattcgcaaatgctcctcctacggtaaacaagcacatcaccatccagggtgcgcacgtacgcagcacattgcaattaccttttttttttcccttgcttttttgcagctagtgagtggagtagtgaccatacttatccacagc

SEQ ID NO: 61849 - DNA, 836 bp, Oryza sativa
cgtcctcgcgcgcgaactcccccttcgtcttcagtgacagggtccccctgtacaccgacccgtacttcccggcgccgacgaggttggcgtcggcgaagtcgtcggtggctttcgcgagctcggcgtacgtgaccctcgggtagtagttgccgttgagcacgctgcgagcggcggcgtttccggttctcgaactcctgatcttgcggcgccaccggagcaaggcgaacatcacggcgaagcaaagggccgccgcgacgacaggcagagcgatcttgaggaagagatgagctcgtcgtgtggagttgcccggcgccggacatggcggcaaccgtagccgcgccgcgccgccgcagagcgcggtgttcccggcaatcctcagcccggtcgtgttcgcgaacacgccgtggactggaacctggccggcgagacggttgtaggacacgtcgagctccatcagcgagctcatggtctcgaggctcgccggtatgccgccggacaggtcgttccgcgagaggtacagctcttgcagtcccggcatcccgccgagctccggcggaatgctcccggacaacctgttgcccgtcaggttcagcctcctgagccctttcagcccactcagagatggcgggatgcttccgacgaacacgttgcgggccaaatcaaggaactccaagctctggcagctctccagctcggtcggcacctcgccagagaagcgggttcccccgacaacgccatgaacgcgagcttcgtgagctggccgacgtcgggagggatcgggccgtccagctggttgtccgacaagtccatcagcagcgacagcgacgagagggtga

SEQ ID NO: 61850 - DNA, 738 bp, Oryza sativa
  unsure (1)..(738): unsure at all n locations
tccaggaagtcatataaaccagaatcgccagaattttctgctgatgactgtaaagagatgaaagttcaaactggtcattaaaaaaantgtgtgcacgataagagtggtgttgagaagtcaagttatcaaagtagcattttgtcttcgttccaaaggagctaactctgtttttaaatatttgatctttttttcataaactcactaatgcatatcactaatacgagggaaattgtaagtgaatagtgaatgaagataaataatggtttgagagagagatagagggtgaactaaccaatatatcccaactgcatacaatcatcaagggcaatgcgtgcatgagtgatagaaatcatggcagcaagtatcattattgtgatcacattctgcatggagaaatgtattttttccaagaatataagcccattcctctgctagtaaagttcccatgtcaacctattttactttaaaaccaaagaaactgtaaataaaaaaacgagatagagatttgcaattcactgggtacaaaagttagatgcacttctttaacattttagcagattgcttccaacatatgacatcaacttcccagtcagttggttattttacaatcttgaaaagcaatatttttctatcagtccaactaatttgagaaaaaaaattctgaatgagatatgtcaagagcagttgtgaggctgaattgttcagggatgtatggaaagcaagcttgtgtttgacgca

SEQ ID NO: 61851 - DNA, 2078 bp, Oryza sativa
ccaattcttgacgtgcggtgcccgcaaccaaacagaactgcagaaatgttaaaatgctgtagatttccatgtactcccatcagagatgactttgagaaggctcaaattcgtagactcctctcgaggttttttctacccaggggatgaccgcgatctcataagaccgacaggaccttccaaaaccagagcacgaactacggagatgagacacaacattgccacaccgtaacaacctcagcacaagcggacaggcaaaacacaagcaatacacaaagcaagaatagtctgcagaaaactgtaccacgagaatggggaaggcatggaaagaacaaactaccagaagcactttgcgcatatcggacatgctcaaaacacgccccatgcggcacgacaaccgcaccaacccgtctaccggtaagactcgtccaccttgcagtcaaatggacaacacaggggcgcactaagctatccggactgggaacatggacataaaggcgaaatttccagagacaagaccaaccaagagctaaaagaaaatggccaaggccctactgcatgaagacctgagaaggaaaacggcagcggcaccaaggacacatacacaacaaatgacccaaagaactaatatgaaagtgtgaccaaaagacccaaaaaaggatgagcatggataacacgaaatccaagccacaagggagtacaacagcaaggccaaaaggtgctagctgatacaactcacgggctgacagcctttcgggacatggcaaaacatgcaacagcaaatggatgggatccatataccgtgcgttgacgcttcatcacatggagccgtcacgctgagccacaatgaaggtaacattttcaaggtaaatggccatcatttaaagttttccttgctccgttagaagttgatcgtgacttagatgttgtgaatctagtctcttttagcttctacccggagtctttaggtcccccttgatccgttagtttttaatgccccaagtccttaggcctgataggcacgcttaggtctaggttgtttagcttatttatttcatttcattccatccttataatgtacctatcatgataaaaataaaataaaataaagttggctccttggtcttccaaccaagtgagtcctttttgcttcacttttgtctttgtttttctttttgtgtctaataaagagtcccatgtacaaagacaagtgtggaggtgatcttgcacatcaatgccataaccaaaacaagatcaccccagaagtgatgagccatgacgaaccacataaggaaaattgatgcagtcagaaccaatgaggggtcagccaaacctccagttcggctgaaccacctctaccatgaatcatcctctgttttatacaaagcgcaggtttgcacaatttttcctttggacatccattctatcttgagtttaatttgattatcaattctaaaatatcaaagataattaaactcaagctagggatagtaaaattagagttcatagtctacctgaaaataatatgcatgcctattattctttgctcattacttgttacttgtggtgacatatccaatagggaccctatgctatctaggtaattaatgaatgagatacggtctgatgatagaaattctgctcttcatgttgtgcacttgggaattttataaaaaaaagaaaaaaaatataacaatgctaaattcctcattgatatttttattcccactagagccataggttgatcattcatgattagcttgctacatacgttgcttgtcattacattgagcattgtcaagttttgtgaccctagtgaaatgcttttcatactttcatggtcgagatcacatatactccacatacacccacctatgcttgacttctacactggaagtgagcattcctcatttaccattcattccattcattttccacaaaataaatactccatatcatttatacgtcttcctccaaagttcttcaaaaaaaaaaacagagagagagaggcatgtctatgaaaaagaaagaaaaaaaagctcatacaagtatggagcatgatgatgaggaaaaaaaaagaa

SEQ ID NO: 61852 - DNA, 1577 bp, Oryza sativa
tctatctttgcgggttcattgtttagtattcatactaagtgctctagtactaggactccggataaagaaggaagttcctacgcaagtattagagtagtaattaataacttagacgtggtgtataggttagagattacctttgtttgttgtgtatcccacggatttgtcagaggtaggtggcaggtggtgacagccctgaatcccgtcctagtaatcctccacattcaggcatatcatagagctatagccggaaccacgctggcagaccagcaggggtcggtgcccgaagcaacagatagggaatgacctttacttagcttagataattaaaacacatagaaagtcctctctagcctagcctgcttaccatcagttgttatccttggatagtcttagccttaggtagattacatatgttccctgagttcaatatccttttggggtcatctgaaggtgaagtgctacagcggtattccgtgcgcttgcggatttatttgtggtcgtaagaaataccaacacacatagaaaggattagagtatcataaagatgtaagtactaattccgagaatacaatccgccataacaagctttacctattcgtcagagatcgaacccgatgcagcccaactcgaaagcaaaaactcgttgaaacaatgaaattaaaaaagggtggcgatacaccgaagtattattgaactgtcgtcctttgatcacaaggtgtcgggtcctatttatacccaaagtacataatatatccttgttggacacggctcttatgtctaatacaatttaaaacacgaacaagtcccctaggcggactattaccaaaaatatctctaagaaaactaaaaatatcataattaatagatacaattactcattttcaagactccaatccttgtgtggtaatggctatgaagtgctttgatagatcccgatgatagatgtgggaccgtctttttcaagactgattgcatcggcttgactccgttggatttggcgccaacctatatatggcagccgatgccgctcgtggccgatatgcaccctactcttcttaaacagaattcctccaaatcgactttgattctagctttgaatctggcccatggcattaccaaatttggtcgttaacagatctacgatccgatcacaccattgtatttgtcgtaattaaatctttacaacaaagatattgcatggttatattgtaatgaaaaaaaagatgtgtgttcaaccattataattcaatatttcctatgtcatatagatatgtttcccattgtgttccaaaaattcacacaactacctccctcttctctttctcctgcttctctccattctatccatcaatgcatggatttagtgagctttacaatgatttttcttctaaactatttatcaaatctatgatccaatatcgtaccatttgtatttgttgtaattaaatctttagaacaagatatcgcatgattatattccgacaaaagaaaaatgtacatttcaggacattaaagctcattgttttatatgtgacagcaacatgttgcaacacacgttctcattgtttcacaaa

SEQ ID NO: 61853 - DNA, 1163 bp, Oryza sativa
tgctttttgaactttttgattcctgtcgaaaacatcacacccacgtgtgacattattggcattaattgacaaaagttcgtcgcgtgaatcacgaagtgattttttgccacgaacgcacccaatacactccaatatgttcaaaaatcatgttttggtgctttttgaacttttgcattccagtcaaaaacaccgcagccacgtgtgccagtattggcattaattgacaaaagttcgccgcgcgaatcacaaagtgattttttgccacgaacgcacccaatacactccaatatgttcaaaaatcatgttttggtgctttttgaacttttgcattccagtcaaaaacaccgcagccacgtgtgccagtattggcattaattgacaaaagtttgccgcgcgaatcacgaagtgattttttttgccacgaacacacccaatacactccaatttgcccaaaaatcttgttttggtgctttttgaacttttttattccggtgaaaaacttcgcacacaagtgtgccaatattggcattaattgacaatagttcgacgcgcgaaacacgtagtgattttttgcaacgaacgcacccaatacactccaatatgtcaaaaaatcatgtttcggtgctttttgaacttttgcaatccggtgaaaaacatcgcatccacgtgtgccaatatatgccaaaagaaatgatcagcaaggatatcctccgtcttcttcacaccaaagtgtcccatcagccctccaccatgcgcttcctgcaataatagcatacgcacggagctagctggaatgcataacttattagctctaaacacaaacccattggtgagaacgaatttgttccaagtccttccctccttgcaattcaacaacacatctttaaaatcatcatcgtgcgcatgttgctcttttattgtttctaagccaaaaattttgaagtcaagttgggatagcattgcgtaacgtctagacaaagcatcagcaatgacattttcttttcccttcttatgtttgatgacatatggaaaagattcaataaattcaacccatttagcatgcctacggttaagttttgcttgacttcgaatgtttttcaaagattcatgatcagagtgtataacaaattctttgggccataaataatgctgccatgtttcca

SEQ ID NO: 61854 - DNA, 1380 bp, Oryza sativa
tgatgggccatcgagcgatcgccggccctatggccccaaggcttgatgggctggaaaggcttcttcggtcctcgcgggggcgaacttgccatggcaaagtcgtcttccttcggcaggtactcttcgccttacacccttcgtccgagacgcctctggcttgacaaggtactcgcacgacccctcgcctctcgctgttctcgctccatagtcttcgccatgggtttcggcagatttggtcgaagggcctcatgccatccttcgaccgtgcaaaccatgtggtatggtatgcggcgccccctttcgaccgatgctcctgccgaaacctacaatgttcttacgaataaagtttgttatttgcgcggcctgtactattttgccgctcttcgcctcctgcagtctgtggcatacatatatatattttttacttttccccggccgaaaagaacagtattgggctttcccttcgtgggcttttttactgtgctgcccggtcagtgggaatttaccgtttctcctacccttgcgacacgtggcgctttattactggtgggtaggcgaaccgtcgctcgggtgagctatatattcccacccctctttcctttccaccgccacacttgacatttttaccgcgtgcgctctcttcgtccgttcctttcttccatagcatttcttgaaccctcaggtgtttcgcccattctcttccttcgccaccgcatacacgccattcgccatggcccctcgcaagccaaaccttgcttcggcgaaagggccggatcccggccgggtcgatgacgacagcaccgccttcttgggggtttctctcgtggatgacgtcgagctggcgaagttggtcagctctggtgcgttggttgaggggcaggctttcgccccagggaaagccgtggtgccgaagcctgtcgacaatcggacggtggtgttcgccgtcctttttgaggcggggctacggcttccgtgcaacgtgttgttgccggagatccttcgcctattccaggtggagcttccacagttgagcccgtcggcgctagtccggatctccatcttcgactgggcgtgccggacctccgggtttgagcctagcgtcgagctcttcggcaccatatttttcgccaccgtgaactcaaagacggtgattaccccagcttgaacaaagaagacagtgttcgggagcgtgaactttaacgttcgccccgagcggtccgatctttggccggtgaatgctgccatgtcgaggtggttctatcacaccatccccttcgaggctggttccgactcgacgaaagccctccggtgccggcgtagggcgattgcgccgaaccgaaaaccctagatcgccgtggggggcgctatggaggcgcggtt

SEQ ID NO: 61855 - DNA, 1712 bp, Oryza sativa
cctccccgggcaaacccccacaaagccgacgacaatgcaggaccttcgcgaaagcgaatgcgcggacaagtgaagcttgcccctaggaagcgaatggttcctgcttcgtcgtactccgacgccgacgacgaagacgatgccgaagagcatgacgcgaggaggaaagagaggaggaagaggaggtggaggccgtggccgaaaaggccgcgaacgaggcgatcaaagaccgcgtcgacacccctggctatactcctactcccagtccaggtcacaaggagaccggggtggagtcaaacagctccccccttcgacgaaaggatttggaaggggcgaaggccctagttgcattttcgtcgggcaaggcggtgaaaggaggtcgggtcaagaagatctctaaaaagaaaggactcgttgacatcgctcgcgttttcagcgacgacgagtcttctgacgagacttcgactttgcccgctggccacagtctggacctttcgactgctccccttcttccactcggcgttgctggggcaggcggtagcgccgccgccggagcttcagcctccgccaaacggatcgtgacggctgcagcgagggtctttgggagccctctgcgtgaaccagctgtttcgccgttggtcaagacgaaggggaagggtgtggccgccgaagcatctgcctcggaatattcccttgcggcgccccacttcgcccctggtgatttcgagacccgggcggaccttattccctttgtggagggagtaagcaatcttgtcctacccgccggtacctcgagcctgttcaccgaactgaatgagttcgatgaggggtgttctgctattaaaagcttggctgttcaggtacgctttttctcccttcttcgttttcctctccccccttttttttacatcacacaattaacattttgttctcttcgcccgctcttatcttgcctccagatccttgcggctcactgttcgacagagcgaaccgtgcgggcccgtcttgacggatttaagaaccgtcttcgggccaaggacgacgaaataagccgcaagaacttggaggtggaggccctcgcgaacactctcaaagaggtgaaagttgaagtcaagcgccttcaatccgagttggagaaagggaaagaggccagggccgaggtcgatcgcctcaaggccgaactggagaaggggagagaagccatagcggaggttgatcgtctgcagaccgaattgaaggaggagaaggcccattccgccgtgctgactgattactataacctcactgagccgaagatggaggctcttcgcctgaaggttagcaaggccgaagcgagtgctgtggaggagtcgcagtggttttcgcgggagatggtgaaaactaccgaatccgcgagaacggcctgccaaacgctccgcctcgcccttactgacatgggcgcgaaggtgtgaggggtccctgctggctggtgattctgtttcggactgcgccaccgcgtacggcgattgctgcgtgcgtgtatcggcggccttcaccttgggccttttgcaacagttcggctgcgagcacgtcgccgagttccctaactatgcgaagggggactaggagattagtgcgcgtggcgaaaacagttctggcagaaggacggccggtccgctgccaaggcgcgcctttgggagcaactagcaaaggcgaaggtggcagaccagtgcaaa

SEQ ID NO: 61856 - DNA, 4615 bp, Oryza sativa
gtttttatgttgatcgaacataacggcgttcggctagttattttttgaaataagctgttgtggtttcaacgttcggtgagcgatgcttcggccgattcgtttcgcccccctggcctttttcgctgatcaggcgtttgccttggtgtttttccacaaattatcaatcacacaaaaaataaaaagaaggcggaggacacaaaggttttatactggttcgggcctccgtgatggataatagccctacatccggttttttttccttttcttttatttttctgccgaaaggcttacatagtgccgaagggcttacataacaatatgtacatttttacaagttggcgatttgggtgccacccattcttagacatagaagcgcttgagagaggcggtgttccaggaatggtcgaactcgtcaccttctagtgtcgccaatcgaaaagatcccgtcctagacttgtgtttgatgaggtatggtccttcccactttgattcaagcttgccaacagcaatcgggttcgctttcttccttaggacaaaatgaccaggcatcagttccgtcggtcgaacttttttgttgtaagttgccgaagtgcttgtggcatacttgcgcatgtgctcaagtgcttcaactcttaccccctccaagagttcgagcgacacttcgcgcccctcttcgcctccagagaacatcacccttggtgagttagcccctagctctgctggggtcattgcttcgtcgccataaagaagcatgaacgggctaaacttggttggtcttgtgggggtcgtccgaagggcccagagaacggatagcatttcctctggccatttgcccttcgctgccccctcgagccttttctttagtgcttctaggatcttgccatttgtacgttcggccgccccatttgactgcgggtgcacgaccgatgcgaacctgatttccaggttcagccctacgcacatttctctgaacttgtcagagttgaactgcttgccattgtcggtgatgaactcttttggtactccgaaacagcagacaatgtttttccacacaaacttctgtactgctgccgaagtgattgccccgaggggttcggcttcaatccatcgagagaaatattccactgccacaattgcgaacttatacccgtttcgcgccactgggaatggcccaatgatgtccaatccccatctggcgaagggccagactggcgcattgggctgcaaatcatactggggcgcggtttggcttcgaccatgacgctggcaactttcgcacttcttgatttgctcaacacagactttcaacacagtgggccaataaactccgtgtctaaacactttggaggccactgttcttgcggcctggtgagcgccacatagcctctggtgtatctcctttgccatttccttgccttcggcgaaagagatgcaacgaagtaagggttgaagtaccccggagcgatagagctggcccgagaccatcttatacttcgtggctctaagttgcaagcgctttgcttctgcttcgtcttccggaagctagccagtttcaaggtgttttacaaacggggttcgccagtcgtatgggtcttcgcccagtttcacctggtcgattgccatgatctccaagctgtccgtgggcacacttggtgcatgcaggacttcgaaaaagatgccaggcgaatgtgggccaccacaagcagcagatttcgccaaggcgtctgcttcctcgttctggcctctaggtaagtgttcaaccgttatgccggtgaagcacttttccatggaccgaacggcctccaaatacctcttcatccctttttcttttgcctcgaaggatttgtccacatggcctttgatgtgaccatggctactacgaatacatccgttgctcacatcatggatgaacaacaagatatcaagttcgagtcctccaagtgccaaaatccaattcggccacctgctacactgctgacttcaaatggccgccgaagctgcatacgacctccgttttcggcccgtgagtacttggtggaaagctctcggagtcctctttctaacagatgcagcctcatcgccaatttccatgtagtttggccgcaatcacataaacaagatgctacgtcacctgtcttgggcctatgggcttgtaacttttgtttgggacccggccccaaatggggcccatgtggggtgtgccccaaccaggtggaggacgacctagggtcctcccacccccataaatagctaggtaccctttcagggtttcttgggttttgtttagatgaaagtttagccattgctacttgcttgcagcgcgcgtgtcggctagaccgtccgtctgcttgttcttcggaaccccaacttatcatttgtattaaattcctatttgcaatatcagattgtttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagtttttatcttcctataaccagaaaatagccatacaaaaaaattcgtatcatttacctagccatattgtgccattgcattgttcttttcagttttgctttgttgaattttgtgttgcattgtcacgacgtgttgctggtcttagcgtctagttcgtttagagtttcgagttctggtcacgttttgtaccacagtcgtcgctgccaccgtgtctctgttgttgtcgggacctacgaaaacggaatcggctcgctgccacggttctatttttgtagttttcagaagtttctgtcggttagttttggagttcttgagttgcatctagagtttgccgatccttgtgtgtgtttgttttggccgtgcctgtgtcgtgcacgagaggaggaaggtgaattaccatatctgattttggaagtagtcaagtttgttttggaaagatatagtagattggattggttaaaaatcagtttcctttttatcccatacacaaaattcggctgccatccactccacctcctggccgagtcccactcgccccattggccgagtccgactccctccctctcttccaccgttccgagttgtgtcaaacaccttggcgaatttttgtttggtgtcggtttcgagatctgtttggaaaaacggaaccggcataaattcagcattccattttttgtataatgttaattttgggtttagacttttacatttgagtccctataaattttatatttatgtttgagtccctgtaatcttacattaaggtccttgagtcagtttttgttaaaaaaataagaaaaaaagtgagaaaaaaaaggcagaaaggtgcaaaaaaaaaaaagaaaaaaaaagccgcaccaaaaaaaatcagaaaagaaaaggaaaaaaaaaagaaaagaagaaagaagaaagaaagaaaagagaaaatactgttatgtttgagctaaacttcatatatcagagttgggcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacccagagctccacatatttgattacagccgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatatgcaagataattggggatagctgtgctcaacatcgacatcttcgtcgagacatgaggagggatcaacatgaccattatgaggtaagtgatgatgttctaggtaagatcaaatctgcactgccttatttcgagggaaactatgatcctcgtgcttacattaattgggagctagcggttgatagtgaatttcaaaagcatgtcttgtcagagaaacaaaaggttatgtgtgcctctagtgttttaattaaacatgcttctaatgattggaaacgtctttgtaggcataacaaaataccacaatcttggaaagacctgaaacgatatttcagagatgtttatgttcccatgtattatgctgacattttgttcaacaaactacaatgtttaaaacaagataccagaactgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttac

SEQ ID NO: 61857 - DNA, 2437 bp, Oryza sativa
gaaacaggttattttgaatggactatatgaagaacaccatatggaaaaaccgaggacggttttccgtgaagaaggggaggatgatgtgaccatggctactacgaatacatccgttgctcacatcatggatgaacaacaagatatcaagttcgagtcctccaagtgccaaaatccaattcggccacctgctacactgctgacttcaaacggccgccgaagctccatacgacctccgttttcagcccgtgagtacttgatggaaagctctcggagtcctctttccaatgcatcaagcctcattgccaaattccatctcagtcggcagcaactgaagaaacaaggtgctgtgacacctgtaatgggcctatgggcttgtaacctcatttgggaccccggcccaggtggggcccatgtggggtgcgccccaagctggtggagcacgaccctaggcacccctaggtcgtcctcccacccctatatatagctagttaccccttcagggtttctggggttttgttagattaaagtttagccattgctacttgcttgcagcgcgcgtgtcggctagaccgtccgtctgcttgttcttcggaaccccaacttatcatttgtattaaattcctatttgcaatatcagattgtttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcactgaaagatcgggccaacaacagccttgagtgtcgagaggaactcagggttcatcagccttccaccaacttggagtcggttcggattagcaagcgccggaaccccagtgctttcgcctttcttagacccaggagaatatcttcgtattccgctgcgttgttggttgtgttgaactgcagccttgcagcgtaccgaatcggcacaccattcggtgaaatgagcactgacgcaatgccttgtgcgaccacgaaccgtcggagcacatcacccagaattattcgatgagctcgggctcaggggcaaataccggtgtccattcagctacgaagtcagctagcacttgagacttgatagcagtgcgtgcaacaaaatgcaagtctaacagggatagctctgccgcccacttgctgagccggccggtgacttccttgcctcggagtatttcgcccaaagggtactatgatggcactatgactttgtgggcctggaagtagtgcttaagcttgcgcgaagccatcaccagggcgtaagtgagcttttccatttcaatgtatcttgtcctcgctccttgcaatgcttcggagacgaaatagaccggtttttggccgaactctgtttcctggacaagggtagcgctgacttccaccggcgaagcttctaagtatagtagcagttcgcttcctggtgttgggcttatcagagctggcgggctttgcaggtattactttagctcgtcgaacgctgcttggcagtctggtgtccaattaaactttcccgtgccccggagggtcttgaagaagggcaaacctctttcggctgcttttgagaggaattgactgagtgccgcaattcggcccgcgagcttttgtacttcatgtatgctcgatggatgattcatttgctgaatggcatcgattttctcgggattcgcctcgatgcctctttcagaaacaaggaagcctaacagattacctgcgtgaacgccgaaaacgcacttgtcaggattgagttttatgcccgctgcacacatggtcgaaagccttgcggctttttacgacgatgtcatcgacataggcttccacgtttcgccccaactgcttgcaaaggaccttatacactagcctggcgaaggttgctcctgcattcctcaggccggaaggcatcctgaggtgacaaaatgtgccgaacggagtgatgaaggatgttttggggatgtcgagtgggttcatgtggatctggtggtagccggaatattcatccaggaaactcatgagttcgcagccagctattgaatccacgagctggtcgatccacggcaaagggaaatcgtctttcggacatgccttgttcaggtccgtgaagtcgacaaacatgcgcaattcccgtttgacttccgcaccagcactagattcgccagccactccagatggtcaatctcttgaatgaccccggctctgagaagtttctggacttcgacttttgctgcttcttggcgatcggcggacatcttgcgcaacttctgtttttttggcttggtattcggtttaactgccaggtgatgcatgatgagatatgtcgaaacacctcccacctcatcggggctccaggcgaagatatcaa

SEQ ID NO: 61858 - DNA, 763 bp, Oryza sativa
atttgctagccatgtaacacaaaacaatctgatattgtaattatacggtatcgttagaatcaaagtatgtatattttggaatgaccgaatatgtaataattgtaaagaacttgtatgtttgttgctcatctttcttcagatggaccctttaattttttttattcttgcatgacgcttctaaaaaaaattgcaagttgtcttgttcgtagccgattgcagttaggctaatctaggatgtatgatgacacatagagggcggttttaaaatgactaatgagtgaattgcacttttggtgaccttttcttaccaaagttatggtttggctcgaccacccttcactcaacccactaggaaattttaccaccacaattctcttatatatccacatctaagttatcctctgtcaacgaaccacatctaggcataactgatttcagaagagggcagcgacaatgaggtcacctttgaagctcgagggcgagcctcggcggagggcttggtgaaggcgactgcggcgaaggagaagggtaggggtgtcagtgatggtgaaggggaggagtagcctcatactgcctgagctagtggtgacacgacgaagaggaggaacgtaactagcggccgcggggaagcccttggttggcggtgacaatgctggccttgcgccactccaggcccgatgcgagggctgtgctaactggtggcaatggtagctgcgacgatgaccagctgctgtgaggaggtgagcaaggagggctgctgctg

SEQ ID NO: 61859 - DNA, 4855 bp, Oryza sativa
agtggatcccccgatgatctgattaggtaccccaaaccgatgcacaatgttgatgaaaaaatctctagctttatctgctgtgattgtgatgaccggtttagcctcaatccacttggagaatttgtcgatagccacaaagagatgcgtgtaatcgccgactgcccttttaaacgggccgaccatgtcaagcccccagacccgcaaatggccaggacaatgggatggtttgcaattcttgggctggcaaatcaatttgtctggcaaaaaattgacaaccttcgcatgtccgcacaatcttgtcagcgtcggacaccgctgtaggccagaaaaaaccttgccggtaagctttgccaacaatggtccgtgcagcggcatggttaccacaaataccagaatgtatatccttcaacaactgtctcccttcttcgaaagacacacagcgctgcagtattcctgatggacttttcttgtacagctcagtgtcatgaataatgtaaagtctgctgcgcctggaaatccgcttggcttcatttttgtcttgaggtagttcttgtttgctcaaaaatttaataaactgttctctccagtcggcttcgatcatgcttacgccttgaatatccatggcttcgactgtctcttttctgggcacggtcggttcgtaaaggtgttcgacaaacacatctgaaggagctgcttcccgttttgaaccaaaattggccagtctgtcggctgcctcattgttatgtcggaggacatgggtgagctcgagtccatcgaatttattttccaacttgcgtacctcttgtcgataagcggtcatattatcatctagacatgatcactctttcatgacttgattgacaaccaactgagagtctccacagacgattagtcggcgaatacctagagatattgcaatccttagtccatggagtagcgcctcgtattccgccacgttatgggacgcagaaaaatgtatccacaatacgtagctcaatctttctccagtcggggagattaaaacaaccccagctccagtgcctgtaagcctcttcgacccatcaaaatgcatagtccaatattccatcttttcctctagcatgtcttcttggcactcggtccactcggcaaggaaatcagctaaagcttgtgacttgatcgaagttcgtggcttgaacgatacttccaaagacatcaattctaaggcccatttcgcgatccgtccgtttgcttcgcggttatgaagtatatccccgagtggaaacgatatgactaccgtgaccgggtgactttgaaagtagtgagataatttcctgacggtaattaagacaacatatagtaacttttgaacctgaggatatcttgtcttggagtcggctaaaacctcgctaacgaaataaattggacgtggactttttgaacatggccttcctcttcacgctcgacaaccaggaccgcactcacaacctgggaggtcgccgacacatataacagtagcggctcttgcggatgggcaaggccaaaactggtggagtggtgagaagtttcttgaagtcttcaaaggctttctgtgcttcgggtccccactggaaattgtcagttttcttcagcagcttgaagaaaggcatcccccgctcgccaagtcgtgagacgaaccggctaagcgccgccatgcatccagtcagcttttggacgcctttttgggagcttggcggtttcatgttgaggatggcgttgattttctccgggttggcctgtatgcctctttgagataccataaatccgagcaatttccctaacggtactccgaagatgcacttttccgggtttagtttcatcttgaaagcacaaatgcttgtaaaagtttcttctaaatccgcaatcaggtcatccttctgcttggtcttgacgactacatcatcaacataagcttcaacattgcgaccgatctgagttgaaaaacatctttgaatcatgcgttgataggtcgctcctgcattcttcaatccaaagagcatggtgatgtagcagtaggccccaaagggcgtaataaacgaggtcttcaagcagtcggattcttttagtcggatctgatgatatcccgagtaacagtccaagaagctgagtaactcgcagccggctgttgagtcaaccacctggtcaatgcgaggtaacccaaaagggtctttgggacaagatttgttgaggtcggtataatcaacacacatgcgccattgccccgtctttttccggaccaggactgggttagccagccagtcgggatgaaagacttccttaatgaagcctgctgctaacagcttggttaattcctccttgatcgcatccttcctgtcctgtgcaaaacggcggagtcgttgcttgatgggtttggcgtcttccttaacatgtaaagagtgctcaatcacctctctggggataccaggcatatcggatggtttccacgcaaaaatatctttattactctgaagaaaggtgatgagcgcgctttcctatttacaatctaactcagtgcctattacagcagtcttatcaggatcggagggacctaagggaatctttttagtcttggcatcactttcttcggtcttcgtcagcttggttgcaggcacttctccctcgcttgccgtggttgcagccagtcggatctcttcacgggcgagagtagtctcgtgagtttgggccatctcgcaactttctttatcacatgtgacggcttgcttgatgtcgctccgtagtgatatgacccctcgaggaccaggcatcttcatcgtcatgtaggtgtagtgtgggacggccatgaatttggctagagctggtcgtccgagtatagcatgatatgctgtctcgaaatcagcaacttcgaaacaaacattttttgtgcgaaaattctcccgagtgccgaaggtaactggaagagtgatctggccgagtggtgtagctgacaatcctgggataacaccgtggaagggtgcattactcggctttaattccgtgcgaggaatctacatatcgtccagagtcttagcgaaaaggatgttgagtgcgctgccaccgtcgatgagagtctgtcgaagcttgatattgcgaaccactgggtctagtaccagggggtaccgccccgggtggaccactcggtcgggatgatccgatctatcgaacttaattactatctctgaccaccgaagatattggggcgtgttaggctgaaccgcattgatctcccgttctgttagcttctgttttctcttagattcataagccaggggtccgccgaagatgtgattaagttctttgcgatgatcttgaaaaccaatcggggcatcgtcttcatcatctttcttctttgatgtgccttgatctccgtctgagggtttacgtgcgttcttaacgtattgctccgcgaactgtttgtagacgaagcaatctttggccacgtggttggagttgggatgatgcgggcattgggagttcattatcttgtcgaaggtgttgacacaggaacgttgtcgggaagacggagaggtggtcaccacaagttcttcaggcttacgcttgcgatccttgtggttgttactttcactccctcctgcggtcggcgtatccttctttggcttccaagtggtgcccgactgcttggacgccgtgatagcatcttcagctttggcatactcattggctttttcaaacatctgtttgaccgtcttgggaggtttgcgtccgaacttgccgactaggtcctcgtggcgaatgcctttagtaaaggcggcgatgatgacgtcgtcggtgatgttggagatcttgttgcgttgctcagagaagcgtcgaatgtattctcgaagagattctccagacttctgaacgatgttatagagatcgaagtgtgtactgggccgttcaaaagtgccttggaagttggcgatgaagtggtcgcgtagctctgcccatgatccgatcgtgccgcggggtagcccgtgaagccatgaccgggcagaatccgctagggccacaggtagatagttcgccatggctttgctgtctcctcctgctgcgcggattgcaagaccatagacggtgagccaagactcagggttggtggtgccgtcatatttctcgattccagttggcttaaagccggctggccaatccactcgacgcagatcgcttgtgaaggcagcaacttcgtccacgtcgtcgtcgtagcgatccggtgaatgatggcctcttgctgcgcggcgctagtcgatggtgtcgcgaagatcgatggggcgccttcgatgtggggagtgtggtcattcaactgagcgctccctatatcgctcgggaggcgaatgaacagaccgttcgtcatgtcccctactactgcgactagattcggcgccgccaatgctaaggcttggctcgtgatagtcttgagatcgaagatgagggactcggctaccagtcggggtgcgggtgcttgcggagttggccggaaccgaggcagcgatcatggtcttcgtctggttcaagatgttgactacatgatcagcttgcttgagtgcgtcttccttgaggagggtgtcaaggagagtgattgctgcaaccgcattctgctggggggtgcgaaagaccgctgtcccatcgacgtcttgttgcccaatgagctctctcgctcgccgcccagattccaaggtgcgttgttgtcgatcttcagcctccttcgcaatccgctcgcgatcttgctgctcacgctgtagttgttctcgctcttgtcgctgtcgctcttcctccagtcggcgacgttcagcttcttgccgtgcgcgatcttggtccgcttctcgggcctagcgctgtt

SEQ ID NO: 61860 - DNA, 4443 bp, Oryza sativa
cccagtagattggatctcatccgagtggtttgaagccgactcgggagagatgatcttggagtaggcctcggccgagttcgcaataccgaacggcacggggacctggtctctccccgactggtttgaatccgtgtcaaggagagagatcttgccgaagtcgttggtgataaacttgaggctgccgaactggaacgcctgcccgggaggaaaggcgaagtcgtcgatgccagaaacaaaacccatcacacttagtcagcgagaacttgacgctacccctacctggcgcgccaactgtcgaagcaagatttcggcaataataaaagggggtggctatcaagctaggaaagtggatgggtttggaaacaaggaattttatataggttcaggccttcttattcaagaagtaataccctactcctgtccggggatgattccgccgagtgtgttattgattgtataaactgggaaaaagaatcgcccccaagaggcacacggaccctccttatataggggaaggagtccgctttacaaaatacagtccatatcctaacggaatatgggattatagataaaatacaatcgtaaccgactaaaatcccaggtatttccttgacatacaagtttagaacctaacccaagacttcatagagatattccatctatatttggtaccgtatatccgactaaattacaactgtcatgtagatatagggtatccataatctccacaccctgtatatgctctatgttgatattaggaaaaagtacaccgaaggtccctcaacttgacaccgagttacaaaaacgtcctcaaaccgcaaaaccagatatcaggcgtcccttaactaatctaaaccggtcactttaggtcctgcggtggttttgaccccggttttatcctacgtggcagctaagtctgcgtgggacccacgggggccccacatgtcaggtgtccacgtcagcacctctctatttcccctcctctttctctgtttctctccttccttcctcgttctcgctctctgctctcgcgagcttcccccaggcggccgacgagctcgaccacgtcatcggccgcgaggcggtcggagacccacgtcttgagctcgcaccgcctcgagcaaaaagagttggatgaggaggcggcggccatggcggccatggggctagcatccacgaagcagatgttggacgcggtgtcgtggtggtcgtctccgtcgtagcggctggggatttggtggttcttggcgtcgtggctatgctgctgctattgctgccggttcgctggagggacgagacgagctgtctcgatgagctgccgagacggagcccgagaagtagctggcttcccgaagcgtccgtgggttcggcggcgacgatgacggcatgccggtggccgagcgtctgcagcggcaggacgccgggccgcccgaacggcgtggccgcaactagcatgccggatcacggggtcttctaccccaaatctcacgcgccggtcgctgccgcgagatggacgcggtagcgtcatccttctgctcctcgccagcggcggctgcagccgcgaacgcctcatcgtccggctcgcatgcttcttcaaggaacgctcgcgtaagggggtccggccccggatgctgcgacggcgggggcggcagcctagccgctccggcagcattgccgatgtcatcacctttaggagaaggacggcgtacacgcgcgaacggtagttcgggcgtcggagcacggaggcgagggtgtcgaggaagccgccattgtccttgccgaggatacggcgcagggtgggctcggacggcttgagggagtagagcacgcccagtgcctccttcttcggcgagctcgtcgacatgggggaatcgatcatcgagtcgagcaggtcatcgtccaacctagccgacgtggaggtggaggcggcggcgtggctctggacgacgacggagacgaggaacttgacggcaccgggcgtggcctcgatgcagcgcttgttgcggtcgctctcgacggcaatggccttgatctccctgagcgcggcaagatgccgctgcctgccaccgccgccgccgccgccaagcatcgtcgtcctccatcaatgaggcgcggggtggggaatcgctcaacggcgtgcgcagcgcaccacgcctggatgagtcgccgcagcgtttggttgggcgtcgcctcccactccgccggcgctagctgccgggtgatctcgcgcttcctcttgggatgtccttcgccgccgtcctcgcgcaggtgcgtcatggcgagtggatttccttggcgttgttcgtgatcctctcagtgatgttcgtgccatcaaatgtacacccagtccatgacaacgaacacgcgacgcaccgtgtagagcagcgacaccagcgccctcaccggcggccagaacgcgccgcgcccagggtgccgaccacgttctcggtgaggatctggcacgagaggagaaacagagaaagagaagagggggaagagagaggtgctgacgtggacacctgacatgtggggcctgtgtgggtcccacactgactcagctgccacgtaggacaaaaccggagccaaaaccaccggaggacttaaagtgaccggttttgattagttaaggggcgccggatatctggttttgcggtttgaggacgttttgttaactcgatgtcaagttgagggaccttcggtgtactttttccttgatattaagaaaagaagagaagtgtaaaagaggtgatttctctctcttttgccatcggccagcccagcccattgattgggctttctggttttttctttttcatgttatttttcagtttatgatgaagttcatgttctcattttggttgcatttgtggatctaaatctctgaatgtgaatatttcctggggaggagctagggttgttttgaagtggcagtacttttttcttttttgttttgattctttagaaaaaaatcataattacaatcgggtgtcttaaaacatagctaactgcaataagtgattttcgtagacggcccacactcggtggatcgtttgagaaaagcaaatttggaggatgattgtacgagccacatgtcctgattttcacatatctctaggtgcaggcgagtgctacatttgtctacgacaaaccatttcgaccgcatttggtagttgtctcgacgctacaagtctattctgctgctactgaaattcctagtgccttccattcaacaagccaccgtgatcatctgcgcacagtacacataagctctccttgatgtgccccctcctattatcactccaagattttattatccggaaaacatatggtgtgctctctagctagcttctcgttgagtctgattccaagagcattgtagtaagtctgtccatgcacagtgattttcttctccgtattgataccgtctgtctgtccagggcaagggtaagcagatctaagtatccctcattaataaacacctcaacaacctgcaagctagtatttgatatggatgaaatagacaaatagtcacgttgctctttcgataaaaatcaatgcgtgtactattttttttttttgtcctttttccaaatcaaaggttatccctgggtctgcattttcgattttgatcaaaatttcggtactttctggatttttggcactttttggcacaaaattatttgaattttaataaattttgattgaatttcaataaacttggaccaaattcataaaaaattaagaaaatttctgaaaattttgggtgagacaattactcgttggggatccaaaatttcgaacctgaattgcaataactcgacgccataataccttgcattttcgcaagtaggagcccagtttttcgtttaacaactttgaatcaaatatcgctgaaagaatcttgaatttaaacccattttttagattaactcaaaccagattgaatgaaattcaaccaaatttgaacaacttttagtggatcattaattttaaccaaatttgtaaaaatcttgggaggttctgagctagcgcgatattggcatgttccagctatatatctgtagcgcccgttccgtcatggagcctagcggaaaaattatctcttaaaaaccctaattgcgaaatttgtttctttgcttgttgtctagtgtccgtgccatctcagatctcaatccccgatctatcgtcgagttcaattccgaatccaaatccttccaaatcaattcctccgcaaaagtctattttgcctcccccggggtcgatgggccgaatttctctcggcccatctaccccgggggtggctaggctgacttttgcggtggacttgattcggtcggatttggattcggaattgaactcgacggatcgatcgggggattgagatctgagatggcacggacactagacaccaagccttgaatctaatttcgcaattagggtttt

SEQ ID NO: 61861 - DNA, 2649 bp, Oryza sativa
  unsure (1)..(2649): unsure at all n locations
cgcgcctgtcgcccgtgtcgccgctccgctccaaaccacccagccgtcatcgccgtcgtcatcgcccggcccccgccactccgcgcgcaagctgccaagggacggaggcagagctcctcctccctctgccgcgtcgcccctgctccctcctccttttcccgaagaggcaagggggcaagcccccttttctctccctcgtttcccctttttcctcccgccggcgtcatcctcctccctcctccctgtcgccgctttggccgcgactgccgagcgctagccctctcctttgaccgccctaagtcggttcccaaaccgacattgccgtcctataaacccaagcctccccctttcctttcctctcccattcgcctccacgccattgccgccgcctcccgtgctcttttcgccggtgcgttcgtggacgcggaaggggactccgggcgcgccctctccttcctcttcctcggcccgaggccggagagattactcccgcgccgtcagcctctcgtcactgcgccccgtctcgcacggtagtgcatctctccgttctccctcctcgttccatctctcccccttagttttcggtagtagctcgagtagcctccccgtagctagccggcgccgccccgaccgttgccatcgctcgccgagtgctcgccgccgtcgccgcccgtgctccgtagcacccgctcgtcgccggcctcgctcggcgtagctccgcccaatccgacgctagcaacggattcccgcggccgcataaatgctctcgccgccgggaattggcccctcgtgacctcgtcgccttttcccccttcttccgcggccgcttgccgccgccgcaattcgtcgccgtcaagttccctccgacgaatccgagccgttggctcgtctccccttgtcctgtgcaaccacccggtgttctcgctttcgcctgtatcgccgtggttcgctccgccgctcgccgctgtcgtccgccgtccgttccggccagcgtcgtcgtctacctcccgccggcccgcgtggcagccacgtaggcgccacgtaggcgccacgaaggcgccacatcggcgccagctcggccaagaccgggtcgagccgaccccggtcagcccttcaccgtgcgcgcgttccaccgcgagccgtgaggctgcgcgtgggcccgccgcatccgttcctccgcgaaccgcgcgcgtgcaccgcgtgcaccgcgtcccagccccgcccgcacgcgtgcgccgcgtgctccctccgcacggtgagtcgagccgctgacaagcgggtcccactcgggaccgcgcgcggtgagcccggtccaccggctctctctctctcctccctcccgcgcgcgcgctccctgggtcgccttgggccgcccggcccatttaagctcggccgagccgccccaattctctcgggcagcgccctagccgcccgaggaaagtctaatttccctccctcttctcttttcttttcttttcttttccaaaaaggatttaattaaatccttttcccttagaccaaaaatccaataatcttagaaattcaatatcttcccaaccgtaaatccgtttgactccgtccaacttccaaaattcctcaaatctcgagatctacctaatggcacgcttagaggtcattaatagggctttattttctccatttgttgagttgtcccgtttcgcgtgtagtttcggagcccgaagacccgcagtgcgaggatttcgaggatcaagctccagatctcgagcaaggcaagccacctttgaacatcttgaggctatatttgaaatttaattatgttgcttgaaaaatattatgcattgttaggatcgcacttaatctgtttgtcccgtctacaaggcagattggcggacctacctaatttgttacatttgacccttcctttgttatttgttatatcatgtcccccttgtatccatctagttgcgtcatgatattcgtgcacccagtgcgagtatcgacggacgccttcaaacttaaaatctgaaaaaaacaacttgggtaaacttgggttttacaaagacttggaaaacccgacacctgggtcggtgcttgcgaattaaatgaatttccaaaaccgcggatcggggaacgtaccgggtgtacggctttccgctctcgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggagctaacctgttgttggtctgggacccctctcgtcggcatatggtaaacctgtgtcggctttggaaatgccttgtcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 61862 - DNA, 777 bp, Oryza sativa
acaagtcgagcgtgctaacggcatgatactgcaagggatcaaagcatgagtttttgaccgactacgtccctatgctggcaagtgggtagatcagctgccgtccgtactttggtctttacgcactactcctagtcgggctaccggccagtcgccgttttttttggtttatggcgcagaagcaatgttgccaagtgaagtggaatttgaatcactacgatttcggaacttcaacgaggagggctatgaagagggccgagtagacgacatcaaccgactagaagaagcccgagaagcagctttaattcagtcgactcaatatttgcaagggttgcgccgttatcataatcggaatgttcgatcgcgagcctttttagtcggcgacctggttctgaggaaaattcaaacaacacaggatcggcataaattatctccctcatgggaaggaccgttcataattgctgaagtcactcggccaggttcttatcgactcaagcgcgaagacggtactctcctcaacaattcttggaatattgaacaccttcgtcgattttatgcttaggcatttcgcttgtatctttcctatttgactgctaatttcaagtttttccttgaagttttcagtcggggggctactatgataataatggagtgtgatttttatcaattcaatttgcttacttgatttatcattgccctgtttggtctttcgacttagccaatgaggactgaaggtttttaatagcttttgcgggttttaggctcaataaggcttgacaa

SEQ ID NO: 61863 - DNA, 1678 bp, Oryza sativa
tggcacagggcgactggatgttttcttccttggagtagcctgttttggtagtttcttggttgtctctcggtctccaggcctcctggcggtatcatcggcttcgtcgtcacttagaaccagcttcctctttcgagaatctgactggccaattggatcagaagcacttggttgagtttcagacctaattcttggtcctccgctcccttgcccagtttggtggcggggcgatcggcgttgagcgattgggggatccgacttcatcaaagcaaattcctgggtgtaatatccttcattgttaactgattcaataagaaagcaagatcatattttgagaaaggttgaagtgtatgaatacgtaccggtggaggaggattgaatgcattgaacggtacgactagcagcaagtgtgagtagctgacaacgatggcgtttgagaagatcttatacatcctttccttcatgaccttgaagtcaagagaatctggatcttcacggtttgggtcatgcttgccgtcaaattcgaaggctgtgcgagatctttctttgattggagctaactgacacttgataaagtaccgggtaatctgttctccttgaaggccctgttctttcagctttatcatcctctccatcagttctactgcttgtgcagcttcgtctcccattggcagtgagttccaagtatcccgataaactggaggaagacaggagtattcgggaagaacaggctcggggttttgaacataaaaccaatttgcgtgccagcctttatttgaggtcttgaagggcatggagaagtatttttggcttagtgttcccctgagttgtaaaccagcacccccaacgacgcatggtttactcttgtttcgttggggcttgaggaagaagatgcggcggaacaaggcgaaatgaggcctaatgcccagaaaagcttcgcaggcatgaataaaattggcaatatgcactatggagtttggattcagatgatgcaagctaatcccgtagaagtttagaattccccggaaaaatcttgaggttggaagagaaaatccgccgtagaagaaatgagcaaataccacgatttcgtgtgtatcgggggtctggaatgcctcaccaaatgccagtcgccacccgatgatctcttttgctggaagaacgccgtgcgccaccatctccttcagattgtcttccgtcacatcggagggcgcccactgactctcgaagctttctctttcttccgccatgaatgtgaactggatggtctgatttagttcgagatacggctagaaagggatggggaatcggagcggtggatgcggggagaaatttcgtgaagtttttgagggtggattggagcggattgatgaaccctagtttgcccggcgcagttttgcactgtagcaggaaatagggaaaatggtgagagtctcggcggggaagacgaagagacgtttttcacttcggtattattagggtatcgggagtattaatgggcctgggcctgtacagtacttcagcccaatactataatcagcgtggcctgttgtgatctctagggacttaggcactttttgctttggcaatctgtgttcacgatggtgtggcccaatgctgttaaaatcctttttaacgcgattcactaattctttggaattattatgatgcacataaaaaggtg

SEQ ID NO: 61864 - DNA, 5177 bp, Oryza sativa
ctgacactgttctcttgtggctggtgatcttagagcaggggaaagaggacatggtgttgctgattgaggtaacaaatgatcaatatggtggtcgactcaggccatcagttcaaggatgcccatatggaggcgatgctgagggggacaattcatatttgaggtcgtttaggtatccaaatatgtgctacaatacgtgttggtatctatttggatatatctttagtatatgattgttttttttttcaaatgccttcggatggaaagaaattttcatatcagagttgtagattccgatgtacatcattgtaatggacaattttcatatttaagataatcgatagtgtacacattatatgttttggatagggagattaaaaaaaatagaatttattatagtcaagaagtgctttacatgtgagattgtaacaacgctacttaaggagtcctttggcaagtcaaaggatgatatcaacgcctccaagagcgtgtattagccaaatcaaatctaggtcaaagtatagtcacaggaaacagggttgaagggccgaaggcagcattccttgacccagaaaagatatatccccatcccaggaacgagaggacattatcgttaccacatcataaacctctcgcaattagcgtatcacactactacagaaaacacatacagttcaatactatatgtgccggaacagttaaaaccaataactacagatctcttcccacctttgcatggtgaaaaaaataaaataaaatcgacaccttttaccaactataggtgttagttctaaagaaaaaccagcaccaacacttttaagtcccatttttttaacaaaacggtacctatatatgtaggggttaaaagtgtcagtttataaaataaccaacactttaatgcagccgagccgagcggagagagagcgagtgaggaatccttttctcctccccatcttttctgcgtctcccccacccctcattctcttccgcgtcttccggttgtacgtataacaaggcttgtctaaaagaagcaaatgattaataaaattatatgtgggtaattctatttgatgatttcgcttgaattaatataaatgtgtgctttattctctatgaaatttaaagttagtactataaataggtaggttggtccactgtttatggcggagctcacctagctagctattccacaaataactggcacctcttaaaggaaaaattcagagagaaagattagcaagaagggatgaatgttttcttgtatccacgatctacagtgcttatctgtacagccacgggcaatattacggttcatgggaatgggaggcattggacttcttctgatatgttgtatgtgtacaaagagggttgttcatgcagtttgtttgtatgtttgggactaatatatctaacttactgtgcatttttctgaataagtgatctcaaatgagaagagaacacccggaggtgaattgttggtccactacactggacagggtcacctgtgacgggcccaaaccctcacctttaacggctttggatttggtcagtgatcagtggtcactggtgagtccagtcacctttgacgggtggaggaccgtcactaatgacagtcacctctgatgggctagaactctacggcccgtcagaggtaagtgtctgcgctaatccatgccattttgcaacccgtcacagatgactcacctgtgacggctcggagagtaaaaaccgttacaggtgtgtcacgtgtgacggcatgtatgtgcaaagccgtcactggtatagttacctgtgacggctttttcaatatgaaccgttagtgaggaggtacatccagaaaaaaaaaatttctaaatattggctagccctaggatttgctagccaatatttagaaattatatatcagcagcagcacaaaatatatccatcacaaattagccagaatataacctaaatttctcatcaacaatatatccatcaacctaatttgcataacaaaatttccctgcatttccaaatatatcacatatattcccaaattccaaatctatcacccatgacagtaagggacaaatccatcacacacatgagcaaatttttctaaggggaggagggaagaagggggagaggggtgtacctctgcgttgggccatcctcctctcctccacatccgccttgccgccgcgcaccgctgcccctctttacctcgccgccgcaccgtgccactgtcgctgcaagaatcatcggatctagaaattagagaagggggaggagaggagaaagaagggggaggaggatggggatggatgcggcgccgccagatccggtggttggggctgggatccgcccatgagctccagatcccgccggcgcatgcaatctcccggcgaaggctggccctcgagaagaacggctcgcggtggagaagccagcctccaccttgcctccttcgacccttccctcgcgccgcgccactgccgggctgccgcccctatgcctcccctccagcccctgccggatgtggaggaggggagggcgccaccgccaccgggccgccgcgcctcccctcccgccactgccgggccgccgcgcctcccctcccgccactgccggaccgctgcccctgcgcctccctcctgctcctgccggatctggaggaggggagggtgtcgccgcccctgtcggaccggcgccgccaccgcgcctcccctcccgcccagctgcagaacaatcgagagggagagggagagggagagggagagcgagtggagagggagagaagaatcgagagaagtggagaaccggtcttatctcctctaggtgtctgccccgttgggagaaaatcgagagaagtagtggagaagccggccttacctcacctttgacggccatccgggttgcgatccgtcacaggtgactagtcacctgtgatgggttgaaaatgaaacccgtcataggtgaggtttacaccaccttcgacggtttccacttccggcccgtcacagatgactagttacctgtgacgggccgtggccggatggctcaccgatgacggcatcccgtaggacccgtcaaaggtgaccttcatcagtgaccgttttctttgcccgtcagagatatgccgtcagaggtgtgaggatctggcgtagtggtcttgcttgaaagtgtttatggattaattgatctcgaaatgcgtgtgcattgtttcctactagcacatttgaagatagcactgtacagtgtttatgaaattgctgtgtggttggtcacgtatggtgtgcagtgtttatgacagagttccacggctatttcataaaagcaggcattaatattttattaacaagagaggttttacattgtttgcattttaaaaataaaagtaaacatctaacgctccacagtaaaagataccattaagaggtatttaaaacctagcacatgtacttaggtagttagggtaaaataataattgttctaggagattgagaagggtttaattgtttttagtattagttctagctacataggtacctatcggtaattgtacttgtcttgtcttatcttgttatttacgtgttcgtttttgagatttatatttcttcgtaagaacatgttcacaggtaatcctccgttacattatttaaatgttttgtagaattaattatttatcaggatttacttctccctctatttttttctagtaaactaattcaaactctagaataggaatgaaatgatgtgggagaaaagaaagaagatacaatctgatttttttggtgtgtagatccaatcggtgcttaggaatatttacattttctctaatgtacatgcagtaccgttcaatggagccaggtatccaattcgacaataatgccaatatttcattagttaattactccgctatcaatatatactataatttctatttcatatcttgcccctctacagatgaactgttcatattactccacctctcaatatccctaaatatctcgtgaacaccatagaatctgtcgactatatatataggtcagggcatcaaacaaaaattgcttcaactgcagaggtagctctggttgagagagcgggaaacgtaaaattggcaagaaaattaaaggttgtgctcttattcaagcctgcattcacaggaaactagtgatttttcattttttattgcccgaaagtagtctagaacaactttggtgaacaataatttatacacgctcccttgtgctttagattacaataagaggctcgacatctcggcatctgctaggttcctcgtttgtaaccctgcctctaacctatataagatgggtagggagccctcgaagaacatgagcacagagatttacaaccagatcatcagatctatactatacctgttgaaacaatatttcagcaatataaaggggtaacgcacaagacctaaaagtggatggatgcggagacaaggatttaaacaggttcaggccctttcgatgagaagtaataccctactcttgtttgaggatttgaatccgccgggtatattatagatctgacgatttagttgtgaatcatctgcccctagaggcctccttcccaccttatataagatggggggcagtattacaaaatagaaaccttaaccaatacggtatcagtttcctaaatctactttataatattatcaaatcaggactttaggccgttccataatatacaaggaaacgtaatacccaagtcatgatccgttacatatttcataaaaataagttatcccctataaccagtcggataaccatgccgtgtgggtattgtcagggttacgggttaggtataccctttaccctttgatatacgtcacatatcgatatggcatgtccacgtgtttatgaacgatcctctacctacatggaggaaatccttcatggagttacagatggaaagaatcctactcggacaagactgggtcgtcaatgtatcgtgtagggtccgatgtctccgagttctacttggaaaccgcctgacctgcgatataaaagggaccccctgagaggacctaaggcatcgaatctcatagccaacacaaccaccacagcctatgaagtcggagcttgcaggagccaaatcgccaggagatctagtcgaaccaactcgattacgatctcgtcggtttcatcgagttccatcgttcc

SEQ ID NO: 61865 - DNA, 8757 bp, Oryza sativa
agatgaagacaaggaacaagaaacgctggtctcagatcgattcgttggcataatcgacatcgattcccacgaaccatcagttctgcatctactcgaggactatgtctcatcgccaacaagtacgccacgcgaggtattagctatcgacgggaccagcacatcagcacacgctaatgcggaagcgcaaaatcaagtgactacaccggcccagcacctcaggaccatcaacgcaatactgagggagaccccctacgatcccgttctaaacgatgatctcacacagtggacagagcggctacgggagtcagtaaccaacctcaacaatgctttcgaagagaccgccgctgcagcgcacccgaaacagccaccaactggtggtatcaatggcgaaaatctcgaacagcgggaatcaccccatcgagctacccctccacctcgcggcgctggcgatctacgcgaccacctcaatggccaccgagaggcacgacgcacacgagacaacgggaatcgctcccagcatcgcgtctcttcacgacatcgcgataatgaagaacgagagggccgctctaacgaagaccgagaccgtgctaatcaccacaatcgccgcgatcatgatgatcgcgaaaggcggacgcagggcgatactggtcgaggacaccgccataacgacgaaaacgacagagaacggcgccgggacaacaacggaggccgacgacaggattctcgagaacccagccgacgacctcgtaatcctacaccggaaccaagcgatccatcgtcatcgtcgtcttcttcttcatcctcatcgtcagacagacatccacgaaggacacacgatcgccgacaacccaccgccccccaccgctgggtgtggagctttcagtcgttccctgcgtgatgtccgatggcctgagagattccgacccagagcaatagagaagtacgatgggagtaccgacccagaagaattccttcaagtctactccacagtactctacgctgccggagcagacgacaacgcgttggcgaattatttgccaagtacgttaaaaggctctgcacgttcatggctgatgcatctcccaccctactcgatttcttcatgggcagacctgtggcagcagttcgtcgccaacttccaaggaacttacaagcgccacgcgatcgaggacgacctacatgcgttgacatagaactcgagtgaatccttgagggaatatgttcggcgctttaacgagtgcagaaatacaatccccgaaatcaccgacgcttctgtaattcgcgccttcaagtccggtgtcagagatcgctataccacccaggagttggcgacaagacacatcacaactactcggagattattcgagattgttgagtgatgcgcccacgcagacgatgcgctgagacgcaagaacgataagccgaaaaccgggggagagaagaaaccagccacggacgcacctgagtcaagcaagaagaaaaatcgcaaaagtgggaaaaagaaagctcaagcggaagttctcgcagcagaatacgcgaacccacccaagcgcccagacccacaaggtagctaggcgaagaaagcatggtgccccatacacaagacggacatacattctttggaagattgccttgttttcaaaaagtcgctcgagaagcacatggcatcggaaaaaggcaagcgagtacacgtggtcgagaaggatgcggaggcggctgctcaggaatcggactcagcatatccagactctgacctccacgtttcacacattttcggaggctccacagcgtactcctcaaagcgagaatacaagaaagtggaacgtgaagtctgttcgacatggcagggggctgcacccaagatgaagtggtccgaacagaagatagaatttttggaagaagaccatcccaagactgccgtcatcgtcgaacccactattcggaacatcaaggtcgcgtgggttcttatcgacggtggtagctcaatcaaccttctcttcgccagcaccttggatgcgatgggaaacccacaaagcgagatgacacccaccgatcagcccttccacggaattactccccagtcctcgtccaaacaaacaacttccgaacggagtagatcatctttgatgtcgctgaattcgatacagcgtataatgccatcatcggcagaactgcacttgcgaagttcatggctgcatctcactacgcgtatcaagtgcttaagatgccgggaccgaagggaacaatcactattcaagggaacgcaagctagcggtacaatgcgacaagcggagcctcgacatggtcaagcaaacgcccaacctacccgccacaactgagcctcccaagaaaatgagcaagacaaacaagacgccgaaaccggacggcgcgatcaagatcgttccactctcttgtgccaaccccgacaagaccgtcaagatcggggcatcactaagcgagaaatagtaaatcgcgctcatcaccttcctccgcgacaatgctgacgtgttcccttggcagccgtccgacatgccgggggtccccagagaggtgattgaacacaaactcatggtgcgatccgatgccaaaccagtaaagcaaaaactgcgtagatttgcaccagaccgaaaacaagccatacgagaaaagctcgacaaacttctcaaagctggctttatcagagaggtactttatccagagtggctagccaatctagtcatggtgcggaaggccaacgggaaatggaggatgtgcgtcgatttcaccgacctcaacaaggcgtgtcccaagaatcacttccctcttccttgaatagatcaactggtggactcaacagccggctgtgagctgttgagcttcctcgacgcttactccggctaccaccaaatcatgatggcgaaagagaacgaagagaagacaacattcatcacgccgttcggggtattttgctatgttaagatgccatttggactgataaccactgggaatactttccagcgcacggtccagggcgcccttagtgaccagctcggcaacaatgtcgaggcatagatcgacgacattgttgtcaagaccaagacaagcgactcattgattgacgatctgcgggaaacgttcgacaacctccgacgatatcgcctcatgctcaatccagagaagtgcacgttcggggtaccgtcgggcaagctgctcagtttcctcgtctctgtgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttagattctccttggtctaaaaggagccctcaaattttagtggaattttcagagcacaaataataattgagaagaaataaacaaagttgaaaaggttttataaaaagaaaaaccctaaaagaagtcctcttttccccccccttccttcttgggccggctcggcccagtccctccctctctctctctctccccccggcccatcggctcaccgcgcgcgcgcgcgccgctgacaggcgggcccgcccgccactctcgctgacgggtggggcccacctgtcatctccctcctcccgccgcgccgccgcccgcacgtgccctagcgccgccgccgccgcggattccgccgcatcccgtcgtctccgcgcgcattaaagagaggggaatcactccccgtgattccctctcccgtttcccccgattccccctctctctctccctcggattcgttcgaatcgtgcccgcattcgtcgccggcgcaatcaatggcggccgaaatccccgcggccggtttccttcctcctcggccgccttctctcccttccgacgctataaaatcgttgcccgagctccgctcttccgtttccgccgctcgccgctcgctctcgccgtcggatccgtgctcgcgccgtgctccgctctctccgccatcgccgccgagctccgttccgccgccgccgccgctccggacttcctccttactcggcgacccctccgtccgcttcgccgcgtcgccgtcgaccccgtccgccgctccgcttcgcccgtcgaccgtcggagcgccgccgtcatcgtcatcccgaaccgcgccgccgtcttcttccgctccggccgccgttctcgtcgtcgtcgttgtcccggggtgagccgaagaccgccgttcgctttcccccttccctcctctctctcgggcgccgctccgccgcgccggtggtcgccggcggtgaccatcggggcgcgggcgcgccgctcccgtcggccgtgccggcgaggccgcccttgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacccccgtggacccggtccgcgcgtcccctccctcggctgacgcaataaatgggttttttaattaaaatttaaatgaagaaattcgtaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttatttagccatgcctatttacctttgttatgaccatattattattgttattgttattattattaccttgttcaccctagacaaacaaaacctcaactagtggacactctactcatggtatccctagtataattttaggtagatgcttcgcaatttaattaggcaacattaggtggttttataactttagacttgggaaattctcatatcatttggacaccatggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgtttaataatattgtgtagttctaagatcgtgtttacaaaatagccctgagcaactaaatgtcttttaaatgctgtttactgcaaaacttaatccctatattattattcccttgtacctcccttgcattaattatgcatccgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaaatggataaaacctaaggacatattttataaataaaattatttgcgaaagttcctctttttctccttcccctaatgctatttgcaaaaagtttactcttttctttcttcggatttcaactaagtactagatggtcagcttggcgaagaagaagatgtcgtcagttgtttgccgaagctccagaagactgcaggatccgctagcgaagcgaaggaagcagtgaagccagctgtgaagcaggagtgaagatcttggagaacccgtcgcagaacctaagccaccctctagtgtttcgtttgtcgtgtgtttccttgcttgtgtgtgtagcgcgtggtttgcatcggtgggttgtgatgtaaccatgctaggttgtttgcttaatcaacttgcagaataagcctaacatacatcataacagtaaaagacttagatctgttaaggtcctatccttagtttctaatctgtctctcccctttgttttccctctctccccctccaaacctttgcaacagatggctgacaatgagaaaggcaataaggtcagaagtcaggacattggtacctcaagctcccgagtgaatgaagcaccagacaccagttgtgtgacactagtccaacacctgattaaccagaaccgattgcttatagagatactacagcaacaccagacgccaattctgaatttgagtcaaatacaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactatgcaaggaactgtcctcagcagaaaagaaaagcaccaatgcgaaccgaagatgaagtccgtaagatggtcattaccagcacagaatggcctccaccaggaatgacaaaacgtcagagaaggaattccttccgaggtgcacaacagttgacagagcatcttttagctaatggaggtagagtgtctggtagtgaagattcagatcaagtctcctcagatgaggaagatgagaagtctccccaaggtttcaaccagaataaaatagaacttaaggcatgctctcgttgtggagaaatcggtcatgttgccagctcgtgtgcctctacatgcgttcattgtgaggaagaccatccacccaataggtgtccaacgagcaggatcacttgtttcttttgtgaaggaactgatcatgtaccaaaagattgtcgattcagttttctgctgacgaagaagatggccaaccaacacgcccgttccaacggagagaagcatcaaggaaacacaaatcctcgccaagattacagtttcagcctaactccagtgccaggacagaggaaacaaaatgagaaaagaaaatgccgagtccgggaagacatctgttgcttcaattgtcaaggaatgggtcatttcgccgacaagtgcccaaaaccgagaaacatagctgccggcacgtcagtccacgcgactccctgcaaccagaagcttgctcctcaacgaattgtcatccatacatcccgaagcagtcctatagcccgcgttgcaacagctccaactccaatgagtgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccgaaaactgtccccaaccaaggcaaaatcgacctccacattaccgccaatttacacgaagcagacattccaatcgtattgtggtcactggagcaaacgccgtacccgtaaggcctcgtgataatcagaacccatagcagaaacaatgcaccaatgctcctcctgctgcacctgactcggcaataaatcatagcaaccactctctgcatcgacagcctcagcaaagaattgtcgtagatggaagaagttgtgtctctccccgacctactccaggccgagccaagggcaatcaacatccggagggcgataccaagcagaagaccgtcatccgcttcagaaggaagcttctcctgtgaatgatagcattatgcagtcctatcacatcatcacagaaccaatcaaggatgcagtcactagaacaatgccagctatatctccccagaatcaaaatgagcagccatgtttgtggttttcagttcgctacttatcatggtgtaatcgaaagtttgcagcaatcatgtaattcataaa

SEQ ID NO: 61866 - DNA, 9138 bp, Oryza sativa
tagttctaagatcgtgtttacaaaatagccctgagcaactaaatgtcttttaaatgctgtttactgcaaaacttaatccctatattattattcccttgtacctcccttgcattaattatgcatccgccggtgtggcttgctgagtactgtggttgtactcattcttgctcaatccttcccctcttcagtaagagaagctttggagaagatgtcttagggggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacactctggcagaggaatagaagcaaatcccaagaatatcaaggcaatcgagaacatgaagtcacccacaagactcaaggaagtacaaaagctaaccggatgcatggtagcattaagctggttcgtcgctaggatgggagaacgaggacaacctttcttcaccctgttgaagaagtaagataaatttgtatggacacaggaagccgaagaggcattcattgcactcaagcgctacctatcgaacccccctgtacttgttgctccccaacctgatgaagaattatttctctatattgccaccatgccatattccgttagcaccgtcattgtcgtcgagagagagaaagtgcaacaaccagtctactacgtcagcgaagctctccatgacgcaaagacaagatatccacagatccaaaagctgctttacgcggtaatcatgacatcaagaaagctgcgccactactttcaagcccacagagtcacagttgtctcctccttccctctcggtgaagttgtgagaaacaaagacgttgttggccgcattgcgaaatgggtagtcgagctaagccagtttgatgtccactttgtgccatgaacagccatcaagtcccaggtactcgccgacttcgtagctgattggactatgcctgataacaaatcagacaaccaaatcaacaacgaaacgtgtacaatggcgttccatggtgcactcaatagccaaggagtaggggcaggattcatcttgacatctccttccggagatcaattcaagcacacaatccacctcaacttcagggcgaccaatgacacagccgagtacgaaggactactcgccgggataagagctgcaaccacacttggggtcaagcgactgatcgtgaaaggggactccgagctagtcgcgaaccaggtgcacaaagattataaatgctctaacccagagttatccaagtacctcgcagaagtcaggaagctagaataaaggttcgatgggatcgaggtccgacacgtataccgcaaggacaacatcgagccagatgacctagcacgacgtgcgtgcagacgagaaccactcgagcccggcacttttctggacacctgacaaagccatcagtgaaagaggttagctgcgaaattgacccagccgcccccgacatcagctcggaggccacagaggcagaacgcgccgttgctgatatcgagaacacagacgactggcgtaccccactgatcaaattcatcaacagcgaagagttgcccgaggatgacgcagaggctgagaaaataacccgtaaacaaaaatctactgcatgattggcaacaatctatacaagaaagcgccaaacggggtacttctcaaatgcgtctcgtccgacgacagcagacacctcctccttgatatacatgaaggcacctgtgggtcacatgccaaccgccctcaaagatacatgcgatatggtccagcggtgtgaagcctatcaattccacagcaaacacacaaagctacctacacatgcgctccagaccatccctctcacttggccgttcttgtgctgggggctagatatactcgggccatttccacgaggacagggcggctacaggttcctattcgtggcgatcgacaaattcactaaatggatcgaagcggtgcccacgggggaaatcaaggccgacaacgccatcaaattcatcaaagggatattttgcagatacggactactgcatcgcatcatcaccgacaacggctcccagttcatcagcgccgatttccaggattactgcatcgggctgggagtcaagatatgcttcgcctcggtttctcgtcctcaaagcaacggacaagtcgagagggcaaacggcatagtactacaagggatcaagacccgtgtctacgacaggctcatgtcatatgacaagaaatgggtcgaagaactcccatcagtactatgggtcgtacgcaccacaccgacaatgtctaacaaggaaacacccttcttcctcgtgtacggctccgaggccatgctccccagcgagctacgacatcaaagtacacgagtacagaggtattcctatggggatcaggaggaacagcgaaacgacgatgtgaatctactcgaggaaaatcgcaaacaagttgccgtccgagtagccagttaccaacaggccctccgccccacgagaagcgcatccgagcacgcatgctttcgatcggcgactacgtcctccgacgggttcaaagccaagcagggcgaaacaagctctcacccaaatgggaaggaccctacacgatcagacaagtcctgtggccaggcgcattcaaaattgcagacggcgatggccgtgagttggcaaattcttggaacattgaccaactacgtaatttctttgtatgagtcaatatcatccatacctgtaagacaccttacagcatcaataaagcctattttcaggcgcatattacaatcacagtgttccaacccgatgatcccttacccagatgacacctagcgttgaaacctatcctcatgtccctttacgccaccctgacaaggcctccgaggaacctaagggatcttcggctggggacgcccagagccgataaggccttgtcagatcctgtagagacgaaagactatgtatgacctggtcgtgtaagagttctcgccgtgcgtattaaccaagccgtataatcagaaattaactttccaactttacggctgggggctaggatcaatgctttttcaaccgaggcaggtcaaaggtccaagagccttgtcctccgagaagaattctccgacgacaaggctgggggctagggagagtgtaccactcaaacgactagccaaagtcgggaactgaggaggcgctcttacacactacatcgagagtaagaaggattgatcaagatagatttcttttctatttcacaagatacttcttacaattttatacatgtccaaaactatattacactttttccctaagatatctataacagggtacaaagactaccaggaaggccaatgccagtccatagactggaaaactttctccgccagcggtgccatcgacttcgctaggtggtctatctccgctggagtcccccgagaacgagcgaacccttcatggagaaactcgaggtgcagttcggacgatgatctcgtatgcaagccaacacgtgccctccaacatatcggctcgatcgacggcattcctgtttcagggctccgtcaatgcgcttgacgacgccttcgagctgagtacaggccccattcagccacgagatgtatccggccgccgactcctcgggatttccacgcggtactcggagctccctacaaatttcggccatggacgtgcagcaactcttcaagtacgagttgaaccacacctcatgacctcggagtgtttccacagcctgctccttcttcacttccagcatagttctctcaagtttcgctacttcaaatttcgtcttccaatattggatacgacgatcttggtcagtaagcgcactctcgagatctgtttagcatgaaagcgattaagtcaagatgctcttctctttcgggaacacagctaatcaagtcggaaggagcaaaagggataaagagaccaccaacctaaggaagtcgtcgccacccccgttgtcgagggtaaaatctcatctacatcgtccggcgacgcgtgtgcctcaaacgcgagagccggaatgatcgctggcgccacaggctgcccacgctgctggacatcctcgacatcgacatctctacaaaggacaacaaatactcgggatcaaaaatgctggggaaaactgaagtgacgaccgcacacgcgaaaaggttgagaacaacaatgtttttacaaagcgtgactggataaaaggtacaggggaactaagatcctactcttcaaagagcgggagaacagactctcccagatcgccgacttcctccatcacgcctctacacgcgtcgttcgtcgccccctgctccaagatccgctagagatcaagttccggatgcgccaacctgacacacgcgaggacgtgacatgccccggtgtagatcccgttggacgcctcctccccgatcctggccgtgtgcttggaggatatcgcctccatcgccgtagccagttcctcgagcaaagacgtcagcgagaacttgtcggggttcaccgggatcgtggtcttgacaccacattccccggcgagctggtgtaggccagtgtaggtgactcgcaacaagccacggagctccgataggttgctctcgagttctgccatacggccctcgagaccccgccgctgtcgctcgttgccggccaccagctccctcatcttctggaggtcctcgcgaacctccgccagtttacgctccagcttgtcggcgcgcttgttggccgacgacgccgccgctgtcctcgcctcggcaatctcgcgacttatgccacgagcaccagcttcgaggaggcgccccatctcgacttggagctcccccctgctgaggacatcggcaggcgggccgcgaacaggcccgagatcaccggccaggcagtggggcgtcgccttccgacttcgtggggcgaccacgacgtccgtggaggccaccgcaggagacgcgctggaggtctcaccagacccatcttgtgccgccttcgcccgcgcccacctatagaagattattgcatccgaatatcaagactagtcgccagatcttcaaaacaaggaaatacatcaatcctcgtctacttacttctcgcctagcgtcaccagcttttgtcgtcgaggaggtggcggagacgcgtccgacgcctgagtaaaccaagggcgatttgagggggacattttccgactacaaggttaacggcgcaggaaacctaccagtacggaggtgaactttcttcccctcctctgggggcggctcccactactcgcggcaacagcagtggccgcatcggacgtctcctggacgactcgctccttcaacgaggccgccgcctgatggtccacgagcggtccaatgacgtcagtcagagggagagcctacactgcatgaaatcattattcgatccaggagcaaaagtaaagggattgccgaatacactcacgttgatcaccgcttcacgctcggttgcctccttctcacaaaggggaacggggatgtcgcctgccattgtcgggccgctgatcatcagttggccaacgcagcgctccaccgttttgctgttcaagcctgcaagtcatgaaccggaattcggtaagccaggaggagcatgcacataaggaggtcaaatcaaatacaagaaaaataccccgaggagaaacccgggtcatctcctccagcccagaatagtcaaaggctggatgggcttgagcctggagcggctggattcgcctaccaacgaagtcggcagcgacttcataccccgacaaacctcgcactcggaggtcatcgatggccttgacgaaggaccgaagggcaggggtcaaggtaggctttgcggtccaagacaaaatcttgtctggttgttcctcgggaacaacaaagataaaatccgaattctctatctgaagatagaaccaccttgcccgccatttgctacgagaagaagggcactggaaggggatataacgcgacttcaggccatcccgaagtcggaatccgacgcatccagacaccctgttggattccatccaacgcaattcatagtaaaagcagaaaagatcaagaaagggctctaccccaatgtaggtctcacaaaggtgtgcaaagatactaaggaaggcaatggaattggggttcaaatggagcaaagaaaggctgtagaagttcaagaccaagagaagaaattcagaaagtggagggagaaaacgacaaagaatgtagtcctcgatcgcaaccatgcgaccaaggacaggctggggttcagtacctcctacttctctctccatggctccacgaccgggaagggcgccgtcctcctagagcttcttcagtgacgcgttggtggaggtagacttgccgagatccatcgccgactggagatcgctggagaaaggagggagattaacaagctagggttttttgcgggagctgagaagacgagaggcgcttggaggctggaaagttttttcacaacaggcagacttcaaaatgaatccccaaaactcccttaaatagacgcacttccaacggtgcgaattgcaaggaaaggagagagatagccgccggaaatttctaggtccgttacgcgcggcagtcttccggacttcagtttaaattcactcaagaccgttgagcttcacatggtattcttgactacgtcccgtctctgcggttctcacaccgagaacgacgacagcctcgacaccagaagtcgcgaattggttacacgagttcatttaagcagaagtcgggggctactgtcagggttacgggttaggtataccctttacccttcgatatacatcacatatcgatatggcatgcccacgcgtttatggacgatcctctgcctacatggagcaaatccttcatggagtttacagatggaaagaatcctactcggacaagactgggtcatcaatgtatcgtgtagggtccgatgtctccgagttctatttggaaaccgcctgacctgcgatataaaagggcccccctgagaggacctaaggcatcgaatctcatagccaacacaaccaccacaacctacgaagtcagagcctgtaggagccaaattgccgggagatctagtcgaaccaactcgattacgatctcgtcggtttcatcgagttccttcgttccctttgtaacctgtgatttccgtcatataattccatatcaactggattagggctattacctgttaatgggcctgaaccagtataatcttcgtcttctgtttgcttgatgtcgtattacgtagatctttgtaccaacgtaccccaataccctctatatccggtctacgggtatcacccgtcgacaggtatggggtacccataatctgcacagtagcccctgagaccttcacagtcgaaaagataatcttctctcgaacctgattactccaaagccgagtgcttcaatcatctttgccattgtctcccgagtacttttaccaaatctgaagactgcggaggtctgaaaaataaagtcaggtgcatcgactagatgcacctaataggtgtagcccccgactatgtggttagttgaacaaactaagcatatagtcaaggaataaataatccaaccaaccaagtggttttgataatcgtagtcaaccaagtgacttaatattaatatatagcatatgcggtatgaatcccgaataacatgatccgagtgatataccgactgctttgtaaaatatgatgccagcaacctaaagttgtgtacatcatgaaaaattcacatagcaaaacagctataaaaaaagcttgtatgctatgaataaagaaatttccaaagtattgggcatacagcatgcgcacactactttaacaaatgtgcttaattccctaaaagacacacggtttcaccacacccagaaatatacagcatacgtggtgtaaaatcggagtaaataaactcataaaggatttaccaaccgcctaaaaaatgaccaaacatataattagcctaagctataatattggtcaataaatatgcacaattacatggcaaaaaagcaacgatattgtatccaatcaagtttttgataaacccaaacagcgccttgactatataaaaaagtcagcggggcagcaatgaaaaacttcactgttgggcaccttttaaaatgcattgtaccaactcctaaaaagttgagtaactgcggtataaaatgattttaaggtattgggcacgtaatcacgtgcacttttgcctaagcaaaaaatgcttaagtccctaaaagaacgtgacaggccacacctgaaaatatgggctgcagacacattaggcctagacctaaaatatgtctaccgatacccttaaaatatgacgtatagaacacgtcaattaatatgatcccaagtgataaatatcctgggttatgtagatcaatcataattatccctcatggagaataccaaaggagatatgataattgaatcccgactggcgcaagcactcagctgatggccctcatggggaataatgaatagtctaatctttgagcataggaaatcgactcatgactataaattcatgatgcacttattcagaagaagtccaaactgaaaaatatgatccttgtgcttgagctagtaagcctctaagcgtatagcttgtccttctgttgtagtcaaaattgtccatcgaaggtaactgagacaatcagcatagaaacgagatgaccaacatgaagatgatatcacccatcaaagctggcgaagatgttggtagtggtaaaaaaatatcaccaatcaaaggtgatgaagtcgcatagccatggaggcgaagaaaccagtcggcaacagacaattcagccagcagtgtagacatggcagcgaaataatcagtcgataacaaacgaggcgctcggtgaagaagacgaagacgcacatcagcagaggcataataagccagccgtgaaagtgaagacaccatgggcggcggcggaggcaagccagtgtgaagacatagatactcatcaatggcaatggcgaaatcca

SEQ ID NO: 61867 - DNA, 1603 bp, Oryza sativa
ttttacggtggcaacgttaattttgatagcactattctaaaattttagtcctctttgaatcgataagcaatgagaaaaaataaacatgaatagtgtaacagtgcccccctgccaacttgcgcaagttgaaagagggagattttatatttgaaagcacatgctaattaccaacatgatgaatcaaatcagcaacggaacttggctgtcactatgtttattattcaaatcggaacatgcatttcttcatggacaagccaaaaaaaaaaatcttactatcagcctgcaactaattaatcctcttcgtatagtcgaacaacttgggtcttaggtccagcggctcaaagctttcgcgtctttaaaccgcttgcattcatagcgccaaaaacgattcaaatcctgccattagaatttctaatgcccctcattccaacaagctgccagcatcatcatctgcgcagcacacccaattgctcactggtatcccccttcaatctttattcctagctactgttacaagaaaaaagatttgactgactccaaaagcactagctagccgctgcacacacgcgatggccgacgcacactggggtttgtttttttacttatacatagtaccaagcaagcagacacttaataactctcattgttcttgaacacatctcaaccaccagacagctgtttttgctacggagggcctaccatggtataacaattagcatagtagcaccatacatactgcgtgaagattgtgttacatatctcaatataaaaaacaagtgtaactaactaatgtgaaacatgagaacaacttctcacagccacagtgtaatcagagaaccggcccaaacaagctgtgtaggatcgaaacacaagaactaagccatcaagagagaggtaaatggttggtatagctaaaaacccaaactttcagcggaaataaaagttaccctcaaattcgatggatcgcggtctgaccgaaagtgtcgcgtcggtctgaccgtctggaagccgtcgttctgaccggaattgatcgctcggtccaaccacctaaagatcgcctctgcctcctgtcatcctcgtaggtctgaccgcaggtctgccactggtctgaccgccgcctagccgccggtctgaccatcggtgagttgccggttagaccgccgaacccgacgaaacacaaatcgaagaactctcaaagtagatgataactttattacttctctctatgtttacaaagtataacaacatcactccctataaaaatctcgactaaactagaaaccataactaaactatcaactcaatttctcttaaaagcgataccgcgaagcctcacgctccctctctatttatatatgaggtaggcagcctaaagccacgaaccaaactcatactagaagtcctaatccacctaggaaaccttcccgtacaagaaacaaactttacaaactccgatcataccaaatttggactccttccaaattcgaatccgcatcccatacgcacataatacctccatcgtataccatatggaatcttcaccaaccacgtgcactgaactctacccttagtatcccgcatgatatctgaccgtcacggacat

SEQ ID NO: 61868 - DNA, 1371 bp, Oryza sativa
cacctgagattatgttagatttctcaatatcaaaaacaagtgcaacatgagcacaacttctcacagccacagtgtaatcagagcacaggcccaaacaagctgaggcatgaacatgtagcagagtacctagctgctttcaacaccggccacttgtccatgatggttgtgtcaatgagggcgattttatatgaatttattaggtcttcagtgatggtctcatataaaaataaataaatttgtacatagtacattgtacgaatattttcatcgacgaaaagaaatataattagattatgcaatatttttatatttcgtttcaaagagcatgtatttagctagtgattgacgaaaattcttcatccttttgaaaataatgtgcaaactagggatagggaacacctaagtacaatccctgatgaagtctatgaaaccacccaagcaattcttctaacagactaagaatcggtttcaagactattttatcaatcgttacataagaagttgatggtgccaagataacaaccccataaaaatggatggtgtaatggactcatgtccaagtcctacgtttgctagtactttgattaacgtgatgacaccttttcgtcagttgaaacaagagatcgcatgtgtatgatcagttgaaacgtagagaaccttgttttttttttcttttagaggcatgcaagtagcatcaaatgtgttgaacgaattatggcaacagttcagaagttcatacggtttcccattcggatgagcccggtcatcttgcatctgctctacaaaatgctcaccattgtcaatactaaagttctacaagaaaacacatggttgtgagatttttttaataaaaagatgccattgcatggctagcgaaatccacacggctaaatctatctccatgatagtttattgctacaaatagggctcatgtcacttgtgaatgggtagtgtcaagattgcaatgagcacattgcataatgtttctatacatgcattaataaagagaaacccgtgacattcaagcttggtaagaccaataatgtttctcatttctctttaatgtgaagacattagctagaacggagaatgaaagaaaactctcctagtgatgtcaccatatttgacacctagccgatcatatctgtttgagctaaacttcaactgtaattaaaggctaagtcgggaccaggttcagcgtacaattgatattcccactgtctctcattccgatgaacaacagtctcctcagcaacctaagcaagttccctttcctgtcctattgtcatcagtactaaaattttacattcaaacagactgatctgctgtgcagcttctgttcaatttggcgtgcagagatgtgctttattt

SEQ ID NO: 61869 - DNA, 2095 bp, Oryza sativa
gttcagtagagtttttcaggtgcacattaacaaagtaaaattcaaagcaaatttgggagaccgctgccgccaccgctgtcattgtcgcccgctccagacgctggatccgctgccgctctcgtcacccacgccggatccgtcgcccccatgcctccccatcgccaccgacgccaccctcttctccggccgtcgtccccgtggtcgccggccgaagacacccctagctcgtctccaccggatatccaaggggagggaggggaagaggagaggaggggccacgtgccgccatatccgctgcctccatgcctccccaccgccgacgaagccaccctcccctccgaccgtcgtcccttggtcgctggccggagacccctgcgcgtctgccagatctgcaaaaaaaggggcggcgatccagcgcccccccccccccccccccgcccacgccacgcactcagagaggatgggaggagaggagatgagagaaagagtgatggactgatgagagagattaataaaatgagagagtaggtgagagatgagaggaggagtaatggagtgaataataaaaggaaaaaggtagagagagtaggtcaaaattttgaagtgtatgggagagaatgcatttttgcgtgcggttcagttaagacgtcacctgcgaaaacagtctcatttttgcgtgcggttcacttaatacgtccgtctgcgaaaattaatttttccgtgtggtcctcttatataaaccgcacaggaaaatgagccaattttcccatgcggatcgagttaccgcccacatgcaatctaaaatggtccctgtccaggaaaatcatttctgtagtagtgcttggtggtggttgaacctggattgtggacccatatacttgaattcgtgatgattcattcatcacttctgaaatgcaaattttgcccaaatatttgtagttagaattatggtattgtctattttatatattgtaaatatgggcaatatgtatcttgaattatgtatttagttatatataacacaacaattcaaacaaattgagaaaacgacatgtaactcaggagttgtgatcatttaactatctgattattatttttttattgttagctagaaaataggagaagttttcttagaaaataagagaggagaggagaggagagtcagagggtggagggagtatacgtgcatgcgtacatatggtatggtgggggtggcggcatatgggtgtttttttaatctaattgttaaaattactggatcatctatttaaaggatcatctatttattggatcatctaatagttaaaattatcatattttctatttttttcgaatttattagagcatcatgtggtaacataggagcatttgtaaagcgttgtatggtagcttaagagcatttgtgacatgtttagtaaaattttaatatataatagatgacatgagctaaccggcaggcaccttctatccaaaataatttaaatttctctcaagatttctgtctgcgtagtccaaaaggcctgtaacttttaccacgactccatcaatcctataggtgtgggaaaaaatacgttctagctgatgttacattcccacattatatagattccatggacagcagaaattcctagtgctttccattccaaggatccacaactgtttgagactagcagtagtgaaaaagcaaaattgtaattccaataatttcacaagaaaaaaatcatgtgtggtctttcattgatcaatatttctcaaatagaaacaagggcatggcatttatacaaaaaagcttagtaaccagccatatcagccataaaccgcacacgaactaggcaaccacccatcaacttcccaggtatattttagtgagcaactttatggtccttgaggaggtaccacgaggtaccattttttctattgtaaatttagtacctctttgtacctaggtactataagataccatgaagtaccaaattttacgctaaatttttggtatcttatggtaccttctcaagtaccgtagaattctctattttagtagtacgatctttcaaggttttttgtttgactgcttgctctcgtgttccagcgtgta

SEQ ID NO: 61870 - DNA, 3143 bp, Oryza sativa
acgctgcaattagaattcctaacgccccacattccaagaaatcgctagcatatgtcatctgcacagaacaagcatgcaatttctcattgatatatatcccctccaatcttcattcctagctactcttacaaggaaaacatgtgctgctgcacgcactgtccatgcataattgtttgcattctacatatgcatatatagtaccaagcagacatacctaacatctctcattgttattgaacacttctcaactacctgcagccaactgttttctatggaggacctactagtgtacatatatacgagttgctctatatattcatttttgtcgttggtatagcaattagcacagtagcaccacaatgtgtcatgacaaaggagattctcttaccgtctcaatatcaaaaacaggtgtagtaattaatatgaaacatgagaagaacttctcatagccacaatgtaataagacaacatacccaaactagcggaggcatgaacttgtagtagtgtactactacatccgtcccaaaaataaaagattttataggttgagacacattccagtactatgaatatgaaaaaggggtctatctatattcattgtactagaatatatcatatctagatctaagtttgttttttgtgtgatggagggagtaagttgtcttccctatcctcaaccatgtctttctcactacaaatattttacgtgcaaacatgctgatatgttgtgctcctcctgttcaattcacgttatttatttatgcaatatttgcgtaactcggttataaatagtactacctccattttttaatagataatgccgttgactttttctcacatgtttgactattcgtcttattcaaaaaatttacgtaattataattattttgttatgagttgttttatcatttatagtactttaagtgtgatttatatcttatatatttgcataaaatttttgaataagatgagtggtcaaatatttgagaaaaagtcaacggcgtcatctattaaaaaacggaggtagtaccatccaccgagcggcgctttttcaagagtttacatttcagtacaatgcacgcatatttaaagatagtcacttctagaatatttccttctgataataaggaacatacatattttgcaaaatgttggaagagatagtgcatctcaacaaattttttttttgcacgaaacagccaaaatcttctgatccaacttaattaaagagacgaagccaacctagattcttagacatagacatagacccaacaatcaaacaaataactaataacttcaatacaaatgcaacaagttctacagttatgtttggcacgggcatcatgcatgttttatgggccgatgtgccgcatggccagcaaacaaatggattgtgcagttgtcatcttcacagcttacttacaacagcaatcttctcgaacagatcatacgaatctatggctgtttaagctttacccattagcagctacaaagagaaaaatctgatgctctgaaccaaccctaacaagataacgatatgaacagacaggctggcttccatctaagtttcactaaagctttctctgtccacacactacaagaatcctgttaatccatgatgaaaaatttccgtcacggatcactgaaaaaccgtcaccaaacaacatctgtgatggtttcagaaatcatcacggattgagcgtcatggattgacctgtgtgacggtttgtcgaaaaccatcacagattaacagaatcggtgacggttttaaaccgtcacgatgaagcccgtggtctagttagtccagccaagcccatttcctgtgatgaaaaataaccgtcacggatagctgccacgtaggatatttctctgtcacagattagctgccacgtaggatatttttccgtcacgaaattgaatcaccacgtatgtgccatgtgttcgccaaggtggacgctgatgtgtcatcgatgccatgtaggatttagcccacgtgttttgtggcccaattcttttccaagagctttcggcccatttatgacctaatggttttttttttgttttgggctgattttttttagtgttttttcggccttttagtcatcattcagcccagctcaaattgggctacagctagattttagcccaacaaaaattcagctgctgctaaatttagcaaatacaaatatttcgtccataattttagcaaaattaattactgatcatcagttgacattctctcatcatcagtaacaaaatagttatagatcagcacataaatattataaaaacacattacaaccttcacatctcatacaacataattttttagcatatctcatacaacataattaaaacctgttcaaaagcacatgacagtacccaacagccaccaaagcattttggccactccatcaaagttcgcatatgtttgagcccagcaacctgatagtacaataccatgtgttagattatttttttatgcgctagagaaacaacaagaaacaatctacagatacgatattagtttttgaatgatagggctactttgcaacaccaatctgatgtccccataatacattgcactaacaaaactcaatgtccccatcaccaacccacctcatttcattggccaagcaagcaagcaactgatgctatagattgaaggaggaaataaatgtggtccttttgcaggacagagcaagaaatccacagtttctgaagcaaagaaacgcaacaaaacagaactatcaaagatctgtgttatgtacaattaatctttaaacatcttagttcaggaatagctctacatatcacacgtactgacaaaaacctctgtacaagaaactaaaaatcaaggcagtgcacaactagttcagagttgttctgagttcagataattcacatccaccaaactatagatagattcacaaacaactaaagtggttagagatatacacagacaaattctactgactagacctgctcatcatggaagcaaaaccaaaaatggcatttacagccataaaacgacactgctagtttggctccttttgcagcttaagaaagttattaagtatatacatcaaacaaatctacttggttcatttgcagattaagaaaatgagcaaggatatacatca

SEQ ID NO: 61871 - DNA, 10820 bp, Oryza sativa
ttcagtgcattcgtagaactgatttcaatctgaaagaaaaaaaaacaaattcagtagtagatacacgtctgggatgcggagaactgtaaagacgggaagaccgctgcaactatgacgaggaagtggatgacgacggccaggacagatgggaggcaggcaggacgtgcttctatttgcactaattcaatctattagaaataagagaaagaagggggaggaggatgggggtaccgtgggatggatctggcgccatcgctcgcctcctcctcgccgcctagcgccgctgcaccagaccaccgccgctcacctcctcctcaccgccgcacgccgtcgagccctcctcactgctgctgctgccagaggagatctctcgcggtcgctgccgaagcggttggcggccatgaggatgcccccgatggcgccgagcaccccgcacgcgaggagagcggccgcgaaggcgatctccatgacgggcgcgccctgggccctcccacggcgctgccgacaaggtcgtcctcgtcggagatggagaaggagtggtccacgtacgccacgcctggctaccctcgcctcctcctctgcctctgcctgtcggtgccggatccgatctatgaactactcttccccacctcctccttccgcgctcgcagcctcgacggcgccgcctccaccagcgataccgccggcagcgggagaaggaggcctacctccgcgtcgaacagcgcgtactcgccgccaaaccatctccgccggaggttgaggaggaagaggatgcagattcagatggggacttggcggcggctagggttggggattgcttcgtttgattttggatcggctagggttggggaacatgggtatgaagcaacaacggatgcgattttacaagaatagccttggtgcatgtactagcttctgatactatttggacaagatggacatttcacgtcaattttggcttgaccgcgcgcagtggcctgaccgcgatgcaaacctgggcggaaaattttggcgcttgccagtatgtttatttttggcaaaaaaaaaaaaaagatcttgtgctactcgtactttttaattttaattcatgagaacttcaaatttaattttaggctgatttttgtgtttcaaatgcaaaaatcataaataacaaaattgtagaacttatcgaaatctacaactattgtattggtcctttttacaaataagttcatttgaacaattccaattttgaattttcaaaatttgacaacttcgaacaaaaattggggtaaataaatgatttcaaatagaaaagtcaccacaaccaaagatgtagaactcatcaagatgcaaaatttttattttggtcatttctccatctgactctatttgtacaatttgaattttgaaattcaaagtttgagaacttcaaatagaattttttattagtgaatgacttcaactgaaaaactcatcaacaacaaagttgtataatccatctagatctacaatttttattttggtcatttattcatccggcatagtgattttaacattgttaataaattttacatatctccaaatatggtttcataaattataagagagatgtatacattttgtgaacaatgttactatcactttgtcggatgaagaaatgaccaaaataaaagttatagatattaatgagttatacaactttgttgttaatgactttttcagttgaaatcatttactatttgaaaatgttgtttgaagttgtcataatttgaaatttaatttgaaattcaaattcaaattattgaaacaaagtcatatagcaaaatgtccaaaccaaaagttgtacatcttgacaagttatacaattttgttgttgacaatgttttcatttgaaatcatttactacccgaataattattgaattgagaggagggatgtaaaatagacttctcagcgagggaggagcagaaggggccggcggcccgaagagagtggaggagagagaggctgcgggctgagggagggagagagtaatacttgggccgaaaaaggcccaagtacagagagaggaattttaattcgtttttcatttattttaataggttaaataaactttatggtattaaaattagttattgcgctccgaaaatttatggaaaatttcagaaaaaaatttagaccacgtagaatattaaaaaaaattgcggcaatgatttttaaagaaaaattttagtttcctcgttaattcacttgattaaattgtttaaacctttaatatattttttctagtaatgcaatatataaatctatgacgtttgcttcaactataataaattatagaatcctaccgtaacacaccagacaactagcgcagtggtaggatgggttatcttcaacaagaggtcatgggtaatttaccaattcgagttctcttttcatttttgaaacgccaactctcgagtgacattgggacaaataaaaatatttaagtgcacattgggacatctagaacaagtggttcaaatggtaagacacgttcctaccttccagctaagttgtgggtccaaatcccacatgctgcagattttacccatgcgcaccatatttttttagtttgccatattatgcatcatatacatgtaacaaattaacaaaattattttgttcaaatttaacaaatcgtattttgggtttgattcttcttgcaatcacattttttatttttctttgcgctaaatatgttttattttttattgctttgggctaactagagtatgacgaatttaaaatcatacattgtgacagtcttgataaaactgtcacaagttagcgggccgtgaatatccactgggctgatccgtgacgaaaaacaaaaatcgtcacgattacgtttgtcagtgacgatctgtaaatccgtcaccgagaatccgtcatggattaacaagtttcttgtagtgacaatagggccggcccggggggggggtggtcagcccgtgcgcaggcccgaggccccccaaatccaggggcccccatggctaatgggccatggcccacgttaccccatatgcatcgctacttcccaggcctaggatcctttcctattgaagacggaagacgaaacgaagaggagcgaaggaaaagcgaagcgatttgactcccgttcccgtcgcctactcgcctcgatcacgcctcctccatcgcctcgatcacgccgctggccgatcgctcatcgctacagatgctacgtcgctcggtcgctgctggctgctgcctgctggggtgagctctcgcctctcggcttctcgtgtcgcaactcgcaaggagacgaggccatcaggccaaccgcgcaacggcgacgcaccctctgccctcatcggctgatcgacgtctcggcgccacgcctgtaggctatagcctgctgcagtgctgctcgaggtaattttctccatcttttttagtttttttcctcttcatagatcaaaatttattagcactcgcactacttaataattcatgattattttttcaacacaacattaatcatgtcgttgagaaaatatgcatcgggtagcgaaaaaaggaaacagaaaaagcgtttgagatgttcaagcatattagagatgtggattgttatcctaatctctccattgcttatcagaatagttctatttgaagttttaaaatgttatatatagataaatttatcacatcgaatattaaatgttgtgtttttatgagactataaatatatatattagtttatgtgtatatatatataaatgggcctcccctggtccgcatagttctgaaaggactgcagtttttaccacgactccatcaatcctatagctgtggaaaacaaaacgttctggctgaagatacactcccacaatgcagtgacattagggaaaagaggaaattcctagtgcttcccattctaacgatgcacaactgtttgagaccggcagtacagatacggatgcagcatttgtaattccaaagaacttcacaggaaaaatatcatgtggcctttttgccttgaatatttcttacacaaaaaccggtgcctactatttatgccaatatacactagccataaactgcgcagcaagaacccataaaacttcttatgcatagtttagtactacctccatccccgaatatttgcatttcactattaaaattttgtaaaaaaatgttatttctattgagatgggacctaataaattaattagattgatatactaattccctcacccttgttattagtcaagtttgcaagtatgtaatgtgtgcgtgcagtgtggtcatttatatgtggtgctaatctgtatgtaatatcctagaaatgcaattattcttggacatagatagtataatctttcaatttcacacctaataaactataattcaaaccacatctttcaaacagaattaatagcataaaaattttgttccaccaaaaataaagaaacaattaataccaacatatttattttctcaatcttacgcgtcatatttttttccacgataaaataagattcaactttcacatctccacgatgaccttacccgtggcatggccgcccatgctcttctcccacgcctccgccgccttctcgaacggacaccgcgagtcgaccaccgtcctgagcttcccttctccgacgagctccatcagaaacctcatctcctccttccccagcgacatgagggccatcatggttatcttcttcctggcaaacatggtcagcatcgccgcgacgtagttcccggggtttggtgttatgtccaccaccctaccacggctgctcagggtcggcttcatcgccgaccagttgacgttcatggcggtgttgatgatgtagtcgtacttctcgtcggaggccgagctcgtcagggcggcgccttggggggtattgtagtcgaggacctcgtcggcgccgagggagcggacgaggtccatgttgcgggcgccgcaggtggcggtgacgcggtggttgccgagcttggcgagctggacggcgtaggtgccgacgccgccggaggcagcggtgatcagcacgttggcgccggtgccgccggtgccgtcgaatttggtcccgatggacatgagggccttgagagctgtgaggcctgcgaccggcagcccggccgcgtcgacggcggaaactccggcggggcggacgacggtgaggctctccggtgcagcgacatactcagcgaggcctcctcctttctgtattgcaattattattctggtgagaattgatcattttcttgatgagaaggttaagcaataaaattgttacaaactctatttttttaatgtacgacggcgttaacttttttataaaaattagattatttggcttattaaaaaattttgatgataaattaagtcataataaaataaatgattttataaacattagattatttggcttattaaaaaattttgatgataaattaagtcataataaaataaatgataattaaattttttagatataacggatggtcaaacatatctaaaaagttaacgacgtcatgtattaaaaaacggagggagtattaaagaagaaatgcatcagaaaattcaggtgctatacatgagatgaatcatgaacaaactggatgtttgaaattacccagaagttcagtttggacaaaactttgtcaccaactttgagctcatgtactgcagaaccagcctccacaatctccccggcaacatcagtcactgtttcatggagtaaattgagagatgaactaaataatattagattattccattggtgttatatacttcatcaccggtcaaaaactgaattatcttcataactaagagtgtgcattactgaaatagacccgttcatttgcaatcaattgcacataaatatatgtgttgtacgaagagtaccttttgaattagtacttctgtctagtttcataaacaaatggtccttactaatgggtaaacacctggaataaatggaaacttgggaagaaatgggcgtagcatccctttctgaatactccaatcaatcgggttaacgcttgcagcttcgactttaataagaacttcatgtttcttcaccgaaggaacagggatttccacgtgctgaagtgaaactaaactgtatttaaatcaataatagaataaacaaattttacatacacatatggtgtgttcaatattttcttcaaaaaatcattgctagctatatattctcactttgatgaaaatgttcagataagtcatgtcctggaagtgtcgtctatttcttggaagcaactagactcatgaattacagatgaatcggaaaattgtactagaaataaacaaagttcaatataatcgacaaatgcaatttttccaggacaaaacgaaaaagaacatgatcaaattttatgtcagagcagtagtgcagaatatcctacgaactcgatcactcgtagagcattaaatcaggaggaagaagaagatagcaaaccttgagggcaccggcgccgccgccgtagccggtgtactgcaccgcgcgcatggtggccggaatcccgccgccggcggccataatcccgagcaattcctgaatttctcctgttgtctgaacaagtcaatcgatgatgatagatgaatgcagtcatctgggcagtgtgcgttttgtactagattaattcttgtgacttaatgtcaaaataaaataaaattcttgtgacttgggcgtgaagggtttgaccgggatttgattcaataagcatttgaatatatggaagctcatcacccaggcgctgatgtcattgacaagcgtcgtgcatggataatcaaactaagaacatatatataattaattatatatgatcttttgatggtttttgacggctttcctcctctcgtatactattactagctactccctccgtttcgaaatgtttaacaccattgactttttatcatatgtttgaccgttcgtcttattcaaaaaatttaagtaattattaatttttttcctatcatttgattcattgttaaatatatttctatgtaggcatataattttacatatctcacaaaagtttttgaataagacgaacggtcaaacatgtgctaaaaagtcaacggtgtcaaacatttcgaaacggagggagtaggaagcaaatatgtaaaataaacatttgagaccaccgattgtttatgcgtgcaagtatgtcagtataatagaataacaaaatagagatattgtttctcatgtcatttgatagtttagtcctctttgaatagtgtaacaatgcccgtgctgacttgccatgctgacgacgacagacggagggagattttctatttgaaaccacacagtgattaccagtatgataaattaaacaagcatcggaactcggctagtaggctgccaacatatgcattttatttcaaaccggaaaatgcatttttttttttttggtatggatcagctacaaccacagaacctcaatttcagcctacaaacgggaacagtgcaatatccatcaagaatgcacaattcaagcccgatactatcatggagtttccgtttggcagacttattgtaatgtccatcatgtcaactaatcttcttcacgtagccggactactactgcctcagattcaactgctcaaagatttcgcgtctttagaccgcttccattcatagtgccaagtctcagcgcaatgtatcatgttatgtcattgagccacacggtcaaatctgtagacgctgcaattagaatcctaaaaatgcccctcattccaacaagcgccagtatcatttgcgcagcacaagctatttctctttaatatccttccaaaaacactatagtttttaccatggtctcgttaatcctgtagctgtcagataaaaaatgttccggctaagtttcattaacacaactcatggttagaacagaacaggcgaatttcctagtgcttcccattccaactacccacaactgtttgagacgggcgcctgtgcagttgtagacggagcatttgtacttcgttaaaaaaatttcacaacgaaaatatcgtttggccttttttctttgttcaatatcttctcaaatagaaaccagtgcccgctatttatgcaagtagctaggtatctcaggcataaaccgcgcaccaaccagccataaacttcccaggcatagttcagtacaatctatcgatttcacatctagcaaataagtactccgtccgttccaaaatatgaatgagattttggttcaatgtaacacatcatagtatgaatctaagatgtgtcacatctaactcaaatcctttatattttgggatagagggtgtacaaaaaaaacagacaaaaaaatatttttgggacgatctcgttttgttactccattttgggacaaaaattatacattcagaccaaaatataattttctcaatctttcccatcatttttttaggacaaactaatatattactttcacatctccacaatgaccttccgtgttgcatgaccaccggtgctcttctcccacggctccgccgcctcctcgaatggatgccatgagttggccaccatcttgagcttcccttctccggcgagctccatcgtaaatctcatctcctcgtttctcatggacatgcatgttatcttcttattggcaaacatggtcagcacggtcacgatgtagccaggggcgcgggccaaggactttgaacttgtgtattcgaaatgggaaggggtaaaaactttttttagcttaattatacgcctaaaagcctaattattaacttttatagtgtgtcacacactaatcattatataatatatagcgtatataacacaaaaagcataaattcacacaacttattgatagaattgatcatcacttgaaattgtttagcatatagaaatactaatttgtaaacattttaaagtgccaacatatatgaaatacatggaggatagaaaatgataaagtgagaagaaatctcacaattatttaaagatcaacttttcaatacttgatattttgaagcagctctctccaaaaaagactttaaatcaacaacagggcccttcttcctttttcatgtttcagttatgaaaattaaacaagattctatttatactattatgatacaaacaactaagatgagatctctgaattactatgaacaaatcctactatccaaggctcctaatcctagctaactgcccaacaagctaatcaagtttgcaagatagtagctactaactaggaactatgaagtatcaagaatgaattactaagtacaagtacaaactacagttctactccctccatcctataatataagcatttttaactacgaatctggatatatgtctatctagattcatagttagaagttgttatattttaggacggaggtagtaccaactaagcaaaagcaagtagtagtctagtagataccaggtaagtataagtgtagtcagtgaactttagtttgctaaccttaatgactcaacagttcaaatgttcaatccctcctcgattccatggcttgcggctgcttgggacatatgtctgtctagattcatagttagaagttgttatatttagggatggaggtaataccaactaagcaagagcaagtagtagtctagtagataccagataagtataagtgtagaacaaattatgaaatcagtgaactttagtttaatttgctaacctcaatgactcaacagtttaaatgctcaatccttccctgagtccacggcttgcggctgcttgggtgcctccctcctagtggccagaggcacaggcattatgcccacggcactgctggccgttgtcccgcaccagcgccatcgccgactcaccgtcgcgcaactgctccgcccccccgccacaccgtctcgccaagtcacgccccaccaatgcagttgcaccgggcgtctgcactgccgcctccacacaccatgctgctctcgtggcagcaccgccttgatctctcgccgatcgccgctcaccagccaccacccgccaccgctgagatagggttaggtgagggggagtcagttgagaaagggagtcggcagtgagtgagagagagagagagagagaggatgatgaaggaggctcaagaaaagtagtttgattgctttttggttgtttaaggcattttatttattttttatacatatgcgaaagacagagtatatatacctcttttttcaaaaatcgtcagtatatatctgaatacctttgagtcatagtgggcccaccttggatgtagttcccggggtttggggttatctccaccaccctaccatggctggtcagtgtcggcctcatcagtgaccacccgatgttaatggcgaagttgatgatgtagtcgtacttctcaccggaggccgagctcatcaggatggcgtcctcgggggtgttgtagttgaggacgtcatcggcgtcgagatagcatacaagctccatgctgcgggcgccgtaggtggcggtgacacggttgttgccgagcttggtgatctagatggcttatgtgccgatgccgtcggaaaccagatggagaagaaacatcataggaaattcaaacacgatgaccctatcgaggcacgatatttggtaccggagttcagctgtggcctacatctccagggcattgattacgagtgctcctttccgatccaagatattacaacgtatcagtgttacaataacactcgagtagatgccaccagcagccgcaacctcttactatgctaagtcgcctaatatggttacaacaggtccgcgtttctatttaaaatagaacctcatgctcagatttc

SEQ ID NO: 61872 - DNA, 3724 bp, Oryza sativa
attagttagacacctatttttgatattgagatggtaagagaatctcaggtgccatgatgcagtttggtgctactgcgctaattactataccaacaaacaaaatgaatatatagagcaacttgtatatatgtacactagtaggtcccccatataaaacagcagtggctgcaggtggtagagaagtgttcaataacaagagagatattaggtatgttagcttggtaccatgtatatgtagaaaacaaaacaattacgcatggacagtgcgtgcagcatctagtgttcttggagagtcggtcaaatgatttccttgttaaagtagctatgaatgaggattggaggggatatatatcaataagaaattgcttgcttgcgcttgtgctgggggcttcttggaatgtggggcgttaggaattctacttgcagcatctacagctttggctggcctgcttgatagaatcggctaagccttggcactgcgaatgcaaaggttctaaagatgtgaaagctttgagccgttgaacctgagacagaatgagtcaatgtctgtgaagaatatcagttgatacaaaggagatgacagcaagattattcaacggaacaccacgatattattgggctgcatttttcattcttgttggggtactgtacagtgcttatttgaaggctgaaagtgaggtgctgtaattgtatggctgatccattaaaaagcacatgtttatataggtttggataaacatattgacagcccaattcggtagcttgtttgattcatcctgttggtaatcaacctgtagtttcaaatataaaatctcgcttcgtcactcgtcatcagcttggcaagttggcaggggcattgtcatgctattaatgattatttctgttcgcgtttatcaatacaaagaggactaaaaatctaaaatgttgaatgaacatgaggaataacaacatttctgttttttacccgttcgtacggacaaacgattagtgggcagaaatattcattttacaaatttgcttcctgtaacacgagagcaagcagtcaaacaaataccatcaaaagatatcagtcaattatggatggaggatgcttgttaatgatatcagcgattgggtgagcttccacgcacacaaatgcttattgaatctgaccccggtcaaactaaacccttcacgcccaagtctcaagaattcagtacaaaacgcgtactgcccacttggctccattcatccagctctacggccgagtttagttccaaaatttttcttcaaacttttaactttttcatcacatcaaaactttcctacacacacaaacttctaacttttccgtcgcatcgttctaatttcaactaaaccttcaattttagtgtgaactaaacacacctgttcagccaagaggagaagctagttcagaaaattgctcgggattatggcctcgatcccccggtgggataccggccaccatatgcgagcggttcagtaaagtgcgacaacagcggcggcaccggccagtatattactaactaataggtatagtccgattcttactctatttttatacatagtacaactcaactcctaaattgtaatcgattttgtactttaacacaaactctaacttggcaaatatgccatgccaacttgaatatgttacttgttcgaaccttcgtgtagtaggatttgagttggttctcctgatgttcatgccaagcagcccaaacagtttacgccaggctcgccgccttcatgattgtgcacagcaacactagcatacctaccctccatgacttcacctgcaacttccttatggcttgtacaaacatgagctttcctctcaccatacataatattctttctgtccttcataatattcatggtctacttactacagtctgcctgacacaaccaacatatctcatgtaggcttttaagcaaaattagactactccttattgctggcacacatgtctcacatccgaaagtagcgtcccatttctatcatacatcttgaacaccaaacttgacatcacccgctcaaacaacatgacaactcatgtcatcgcccaagtaaaaaaaaacaaactcacaagataaccacacccattccctagggcactgaattggtcaaaaggccaaccaaggcttagccaatgctattaaaattttacatggaaaccctttttatgttcgagtccacatattgatatacaattgtagtaaccattaaataatattgcaaatgaaccctcaaatcattttaataaaaactgttcaattcataaatgcaccctcaaataacatgtaaagacattcaatatggagagagggaggttaatgtcgatccctcaataaacttcttttataataaagtccttctgcaccccttagggtgtgttcggatgcccctcttccgaaccctctccttcgtttttcgcgcgcacgcttttcaaacggctaaacggtgtaatttttgcaaaaagtttctatacaaaagttgcttaaaaaatcaaattaatccatttttgaaaaaaaaactaatacttaattaatcacgcgctaatagaccgctccgttttccgtgcagaggcactatgttccccacctgagcatgcgaagtttcgcgaccgaccggatttcgcgaaatttcgatgtttcgatgagactcgaaagtagaaaccgtctgagatttcgagaagtttcatccaaaattcaaatttgcattaataaaaaaaagaaaaaaactaaataaaatcttataaatactatgatatttatagaacttgttgggatataaattttcgaaaaaaatgatgtattgtgtgtatttactaaaacttacattaggaaagaaaagaagaaataattaaaaaaaaacacttacatgagccaaaactgaacggaattaaaaaaaggaaaacacttattgatcgaaattttgatgattttgatcggaatttcgccaaaaccgatcggttttcgagaacttgttggcaaacttagggaatttgatttaaattttggtttatgaaatttgttcggaatttaccggttttccaccggatttcacgaaattctgaattccgccagtgcccgaaacggaagggcttgtcggaatcgtaaaccctgatgtgaacacagccttagtgctactctttttcattttcctccctttctaacgctcgcttccacctgtgtcctcagtcctcatgcgccgcctactccctcctcttgatctccaccatctcggccttctcccccaccacgtcctctcccacctctccaccaccaccgtcgtcatgtcctccatctcgccgtctccatcgctgcctccatcctcgtcccatgggatcgatcaggcaacgatgacgcagcttgatctgagatggcgtgtagcagaatcgtcgatctgttgcggggatggggacatgagacgaggcggcggcaactacgcgtcatgaaaaatgtcagcacgccctcctccattcttactacctagcttcctagcctcgcctccacactactggagaaaccatctttgatcggtcggctaaatttcacaatagttctggttcttataaaaattgggattaaaaaacatctttagtcccagtttaaaagctcaggggtactttttgatctttagtcccggttgataacatcaaccgggactaaagatcatttttagtcccgtttcaaaaaacagcaggcagagatctattat

SEQ ID NO: 61873 - DNA, 3325 bp, Oryza sativa
agccataaagcgatgcatctatccgtcagttgatgatgacttttgaacatcatgtgctctagtcttatatgagactttcgttctccttccgttgctatgtcctagcattgttgccttccctcaatcaataactaaatggttaattggacccatgctactatcattttgatggttttaaaaaataccattactattcacctatttgaactcatgccactataattacaccgttattttgatatatgccacaaattaacctttgaacacatatacacattttctaaattttttagaccaaactgtccatcgtcttcctcctcgaccccttctctctcttctgtgttcaccttccctcctcatggacctagcagctcgtccatcagcgattcaatggacggcatactgccgggcccagcagagtgaggtcatcttgctgctgctcctcacagcacctacctgtttgcatgatagcatgagctgagctcccattctcctccacccagcagcgaccatggtcgccctcatcacaattcacaggcttggatccagcggcagcagctgaaaccggtgtcctccccccttcctccagaggccgcgacgaagcactacgcgtcagcgaggagcatgatgaacatgtcggtgggggccacgggacccagggaatcctgcgccggacacgatattgttgttcccatgcgacaggatgggtaactagtatactactcctatgaatcaaataataacaaaattggtatagcttcaaataggtgaatagtaatgtcatatatcataaccataaaagttataattgcatagatccaattgacccataactaaatgactaatattattttaaataagagaaaagagatgaacagtggacaatgatggtcttcaatgaaatggcagtgaaatttcctgtaactaggttaaaccccgtgcgtgttgttgcgggagtttagtatgatagcactaagtaaaagtaaagtgtaagatagctacacaatataaacttacgtaagttgatgtggtttctaattgaggtttacgataatttaaatttaaatagtatatagaatgatgattcaaacataaaagtgagtttttttcgcaaaacataaaagtaaattgatgtggctttctgagagaagaaaaggcgggagatagtttggatcatagattaatcatctaatagctaaaaataattgaggagatatgacttaataagagaagaaaaggatgtaggatcgaaattcaagaactaagccaaccagagggggtgaatggttggtgtacccaaaaaccaaaacttttagcggaattaaaagttaccctcaaatttgacggatcgcggtctgatcgaaagcgatacgctggtctgaccgcctggaagtcgtcggtctgaccgaggtagtaacaccaattgaaccgccgagatcaactccagaagtcgcctgatgccgtcgctggtctgaccgccacttcttcactggtctgaccgccgtcatgtcgcctgtatgaccgctgatgactcatcagttagaccgctgaaccagagaaaacacaaattgaagaagtcacaaagtagatgacaactttattacttctgtctgtatttacaaagtgcaacaatagcactcctcacgaaaatctcgactaaactcaaaaccctagttaactatcaactcaatgctctcaaaagcgataccgggaagcctcacgctccctctctatttatacatgaggtgggcagcctaaagccatgaaccaaacccatactagaagtcctaatccatctaggaaaccttctcatacaataaacaaactttacaaactccaatcataccaaatttggactccttccaaattcgactccgtttcccatacgcacacaataccttcaccgtatgccatatggaatcttcaccaaccacatgcattgaactctagcctaaatatcctgcatgatatctgaccgtcacggacgtggccttatccccaagtcgactcccgatccatcaccgacgatactctcccgaggcatcaagtgaccctacacatggatcgaataaagaaaccatattccgaggccaagctatctccaacttgactcattgttagcaaacaatagtattacatacgcatagtatccatctagaagccataaacacgaaacaatcacggatatccaaacaaacaacccgaaaccgaaaccgacacagagtcggccagtcagaccgcgggctagccggtctgaccgttcgcataactacggtctgaccggccgcaccagcccggtctgactagaccctacaaaacagtaaccctgttcatcacctgaaaaatcaatcatcttcaaaaccacttcaccaataatctccaaatatcaaaaccaataatcacagatgccaattgttcatcacagaataagaatcaaaaacactttgattttacaaaggaggggaataatttggacaatagataatcatctaaggacaagacaattgttgtgatatggcttaatgaaagaagataaagagcacattaactaagttaggagttaggatgaactatataggtacataagatattatgaaaagagatgatgagacatattaaaatattatgtgaattatatgagataatgatttaacatgcttgcatttgaaaagctataaaatttaataagtataaaattatagataacataatatgcttgcatgatgtttaaatgtcctagttgttatagtagatgatgtgacatctttgcatgttaagctttaggatttagtgggttctaactttatagtaatagaggattaacgaaaaatcagactcatgtgtcacctctgttggcgaatacggaggcgaaggcgcgtctcgcctgcctcgcctccaacggaaatgcggccccctgtggtggtggccaacggtggtggtgcctccctccctcccccctctccggcaagatccaggcatctctccaacgtgagaggccaaatcccctattgcggtggtggctggcgatggtcatgatggtagcaagagggacgaccagatttggccccttctagtcatatctggcgcgtcccagttggggtcgggcaaggccaaaactccggtgcgaggtcgttcggcagagcttggaagtccaatgatgccaacggtatggcttcacaactcggtgcagctctgctagtccggctaggtggcagagctggtcgtcaatggtgtctacccggtctttgtgcaggtcgtggtgtgaatagtacaggtaccttcggtgtgcagctagcatttggtggcttctgctggtgctacatgg

SEQ ID NO: 61874 - DNA, 9350 bp, Oryza sativa
caccaaaaattttggcatctctggtgttcttcgttcttctccatatggctaactctgtccccttgattttcttcagcttctacaaagaggagttcgcacaagtggtcggtcccttgcggtggaagcggcggcggcggcggcggcggcagcggtagcgtccctagagacacctcacagatccagcggccgtcctcacggccgatctctccagcgtccagctcttccaccggacctgcaaggaagaagctggtttgtgtcacatatctcctcgcctctttggattttactgatttttctctcgatttttagctgattttctctattggtttttcgccgcgtcggccgccgccactgtactccgggacatggatccggtcgccgttgccgccttccctgcctcccaactgatggccacccgcggatctggcctccgggatgcagatccggccgccaccgcctcttcctccaaggccacccgaccgctggccgctggatccggcctccacgaggtttagagacgtggatccggcgaccaccgcctccatcccccaaccgttggcatccgtggcctcttccccgactcctccaacgccacccgaccgccggcgtccgcggcctccaccgtctccttcacccaccagagccgccgccattttgactcttgcttgattttttgttatcttgcaaatgttcattgccaaattttagattaggccatattctgtgttgtttgtgtggatgtctagtttgttaagatgcagatcattaactgtgtgatgtatattgttactcaagttgtgtgatgttggcttgcatcttgggataaatcttgcatcttttgcttcatgttgagagctggtggctgagggcttttgaattttttttttatgatttttcacacctgtgacgggtgataaattaaacctgtcagtggtatatgtcacctttgacgggctggaaagagtcatccgttacaagtgattctcacctgtgacgggctatttctatgcggccgtcagaggtgttaatcaccattgacgggctttcacccgtcagaggtgaggtgcagttatcagtaaccactaatctctgacgagggccaaacccgtcagaggtgatgatatgggcccgtcaatggtgagaggatccagcgtagtggttgttcaccttattgaaggcattgatattggagcccttattcaattctacatcaagatatttctccggatgaaaaccttaagattcgtttggatcgggtgatgtgttgtcgttccctcggtgtatccttcttgaaggcttcgttttaggagttttttctcttgttggactgttgttattaggttcagtatgccaatgccagggttttcgtcggttttacataaattaaccatgtttacgtaaggtttttgttcggttttccttataaaatgaatcaactcactctggtttttgggtccggttttccatatcctttttgcgcctacaggttgtaggatagtagaaggtcttcccacccccaaacgctagccaattaggtgaggggctccccgggccacttatatatcagtttctttgtccttacacaaccaatgttacatcatgcatttggtggaacaacataaacctgctacccttatttgtggtttaatttatcacgtggctgttccaccaatatcacgttgtcctagctctgccaacgacttcatcttcattatctgtcgttggctgtggaaaccaatggtagcccatctgatctgtcctttcgtcaattctcaagtgatattgttcttactccaatagcttgattggtatgggttcgaggagtgatgtggtgatgggcaaacccatcattcaatttctttaatcaaacagatcatcaagaattaaattgtttaaaaaaatctagatattttttttatattagcatgagcatacttgattttatttaaagaggtgtgccatcacgctagctggttccacacacgtagcctatcgtctgtaaactgcatttcgccatatagctttgtttacctgatacatttcgttcttgatcatgtctgaagacatggtgagctcaccctcgctctggcgccctcctgttcccatcaaagacgcgatcgagcaagatgccatcaccccgttccccaagcctgaggctccagaggaggaggaggaggagtcacaaggcgactgctaccgccgcctcatgtcatccctaccggtgaaggtctacggcgagcgccgttacctcgagtaccaggcgacgtggtggcctgagtccgccgtccaagccgtgatcgccatccaacgccggttccggccgaggccatcggatgtgctcctggcctcctaccccaagtcgggtaccacatggatgaaagcactcgtgttcgcgatcatgtcgcgcaaggtttaccccctgcgggatcacccgctgctgcgtctcaacccgcacgactgcgtggtgcacctgtctggcgcctacgcaacgggcaaggaggcggtggtggaggcgctcccttctccgcggataatggccgtccacatgccattctccaccctcccggcctccgtcgtcgtcgactccagctctggctgcaagatcgtctacgtgtggcgcgaccccaaggacgtgctcgtctccctgtggcactactaccgcaagctacgccccgaggaagcccatgtgtccgagttccacgacctctacgagtcgttctgccagggggacaccgtgtttggcccttggtgggacaatgttcttggctacttcagggccagtgtggagatgcccaccagagtgctcttcttgaggtacgaggacatgctggaggatactgccagcgccgtcgtcgccattgccaacttcgtgggatgcccattctcggcagaagaggagagagccggggttgtcgatgccatcgtcaagctttgcagcttcgaggagctcaagaatctggacaccaatatgtccgggagcaatgggcatctcatcaagctcccaagctcctcctacttcaggaaaggagtcgctggagactgggtgggtcacatgacccgggagatggccgaccgtattgattcaattattcaaggcaagttccaaggttcaggtcttgagattaaacgagcctctacctgatcaatctttttatgtaattatatatcatatatggagtgttgatcattatgcattataatcactactcctatcttccgtcccaaaaataaaaactcaatcctagatttaaacctgaataagaattgagtttttcctgtagggagtgcttgtgatgcttgtcaggacgaacgcagtaataaatatataatagggagtgcttgcgatatttgtcagtacgtatgcagtaataaatattattgatcaggcacagctttctgtacgattgtaaatttatgggaaagtcgatttacgatatgtgaacaacactattagaactaaatttatgtgtaattaaccaacacgctactggtgcagtatgtctatatatagctctccttttatagtttttcgatggttgtatattcttcgagcaagctagtatgtcctttcagatgggcccgccactcagcagattccgaagatagcattcgttttaatcggatgtgattttgcaattcgcagtcgttcgatgtgtaaataattgatagtaattttcttgaagcaaatatatcctgaaaaatatacactactgcacaaacgatttttactccataatttttacaaacggaccataacttgccatgtctgaaaaaatcgagtagtattttcgcgtacagctccttaagagcccgtatggaaaaatcgatttttccatatgggcgtatgcgaaaataaaatttgaaaataaaatttaaaaataaaattttcaaaatttgaaaataaaatttgaaaatttaaaactagtttatctcattcatatacacttcaaattggatgattcttttttctaaatgtttataaaaccatgcttctatcatgttattatgttcttactgctattattttggcattttttcttctgactttgttttataaattgaaattttgaatttcaaaacttcaaataatattttgaagcaataaacaatttccgctgaaaaagtcatgaaaatataagttgtagaactcatttattttggtcattttttcatccgacaaagtgatagtaacagtacacaaaattagcatatctctcttatactttataaaaccaaatttacaatgttacgatcagtttgtagattttttgtagattttgaagagttatataactttgttgttgatgtctttttcagttaaaatcatttagtatttgaaaatattgtctcaagttgttatattttgaaattcaaattcaaattgttcaaacaaagtcatatagaaaaatgaccaaaacaaaagttatagatattgatgcattatacaactactacccgaaaaattatttcaattttttgtattttaaaattcaaattttatatagttcaataatactcggatggagaaataacaaaaaaaaaggatatattcaatgagttctacaactttgtttttgataactttttcatatgagttgatctagtgccataaaatttgatttgaagtttaaagagcggcatgaaaaaaaacgatatttgcatacggacgcttaaggattcctccttccctctccaccagttcaaaatttttcactcccaaccttaccattctatcattcctcaccttgacgaccgagagcagagcggcgcggcacgcgcacttgaagtactaatgcagttggatctagtggttcttggtatctggatgaaccttaaggaagcaaggcagaagacatagggagtggtagaagggaagacatcagaggtggcatgccaactgaattacagagggtttggcatgaggggtcagtgtgctaggctgctagcctgacagagagaagagaggaggatgaattggaaggagctaggccggatactaaagctgtgtttggaatcctgagtttctaacccctctccatcgtattccgtacgcatgcttttcaaaccgtctttttgcaaaaaattttattaatataatagtaatcatatatagtatttttttaaccagcgcagatgaggggtacggattgattgttgtgtaccgatggcatgatcaaatatggtaatagcacatacatttaaatgacagcaaagcttagagccatcgctgaatcttaatctcacatctccacgatgacctttccagtggcatggccgctgaggctcctcgcccatgcgtccgccgccttctcgaacggatgccgcgagtcgaccaccgtcctgagcttcccttcccgcatcagctcgagcagcaaccccaggtcctccttgctcatcttcaggctcaccagcgacagcttcttcctccgggagaacagcgtcaccaccgacgccacgaagttgccgaagttgggggcgacgtcgacgaccctgccatggctgctcaggcgcggcttgaacaccgaccacttgttcttgttactgatgttgacgatgtagtcgtacttcttgccggaggggctcgacagcgcggccccctccggggtcttgtagtcgaggacctcgtcggcgccgaggccagcgacgaggccgaggttgcgcgcgccgcatgtggcggtgacgcggtggttgccgagcttggcgagctggacggcgtacgtgcccacgccgctggaggccgcggtgatcagaacgtcggcgccgccgctggtgcccgagccgtcgaacttggtgccgatggccttgagcgcctggagcgctgtcaggccggcgacgggcacacccgccgcgtcagcggcggagattccggcagggcgagcgacggtgagcttgtccgatgtggccacgtactcagcaaggccccctgctgtctacattgcagatttgcagaaagtaaattggtcaagttatattttttttaacgactcgcactacacagagcgaagttctagtgatatataaaaagagaaaaatataagattacaaccatggaaggttatatataggaagaagaaaaaaatataccatcatccacacactgacaacgccaaacacagacctagtagaaagttagcaccggaccagctgccgctaagtggtatcgaccgccgctaagccagcaacggaaaacatccgagattgcccaaaacccaacccttacaactaatacaaaaccacgctctatccaaatttttgggattcagggagagagggtgagagagaagaatcgaaccgctctccgcctagaccattcgacgtggccaacttgcggaagataggacgccgacataagaggataagaatctagagcgagattgcaccaattgcttgggaggttttgatagaggggtgcctagacgacgtctccaaggagagtagcaacggaagaactgccgccgacgtctgtcaaggtcctaaagagaaccgagactgggcttttaccaggcaaccacactagagggagtgagacggcacgacaacaccctcaggaggggagtggcgctcgaacgccactgttgccagcccggccaaggccgtgctgggttttcacccgccgtagaccccctgttgctcaaaagctgtcctccattgctccaactaccaacccttcaccatcagcgtgtggacatcactgaaccaacgccccgcattggccagccttcacatgcctccacatcagcctcccactctccgctaccggacagccgacaagccgctgccaccacccgccgtgcctccttgcgtcgtactggcttctaccgttgccaaccgcacctccttgtgtcgtgcagatcctcagggccgctgtgccatggcctgcagcctccactgctgccttgttggcctccaccgccgcctgcacgtgccagtcgtgcctcgccggcttccgcctccccttgcatgcgccggccgctcctccccgacctctgtcgccacctagacacgccggccacgcctcgccggtctccatcgccgcttgcacgctcccgtcggcctcctccaccatctggacgaccgcccctaccacgagaagctgccgtctaccactccggtgcccacgcctcctaccctgccgccacttgctgcctccgacgaagacgtgccgtcccacctcatccgtgacggcctgccgccgaaacctcgccaccctgaccgccaccgtcgcccgtcaccgccgccaccactcatccccgccgccagccaccacccggccagatatggccggggtggcgtggatatggacagggctccgccgccgtcgccgccgccaccaccgtcagcccccgccgccaaccaccccctggttagatctggccggactcggccctgatctggcctcctccgccctggacagcctcccccagccgtcgagcgtggggtgggtgagacgaggccccgccgccgccgtccttgcggccgcgtggctttgccagcgcccgctcaggcggcggtgaggcaggaggagtaggaaacggtgggaggaaggtggcagcaaggtgtcgtctctcatgccgcccaggggagggcgacgtgagagagaaagttttggtcaagttatattggcgtccaagctggtgaaaaattcggtgcattttgaatcgaaaaatgatttgctgagacgaatttggagccagatcattggaagtacgtacccagaagtctagtttggagacaactttatcaccaactttgaactcgcgtactgcagagccaacctcaacgatctctccggacacattatttactgctcaaaagaattatacaagagtgagtacatcaatttcatcatcgtttcatggtaagaaaaaaaaaatgatctgaaacgaatgctacctggaataaatggaaatttcgggtgaaaggggcgcatcatccctttctgagtcatcaaatcggattgattgatgcttgcagcttctacttttacgagaacttcgtccttcttcacagaaggaacagggatttccacaaactgaaatcaaattaccccgaaacgtatatggaattcaaataaatcaccacggtaatttgttgaccaattcctctcttagacaaacagggctcttcacatataaattaaacagcacaactcacgcagaaatccaggcagaagttccccattgcgaatatgaaaaagtaagaacttttgaagcagatagaactcaccttaagggcagcggcgccgccgccgtagccactgtactggacggcgcgcatggtcgccggcctctcgccggcggccatgttcttggtgagatcaggtgatgtctgctcacgccgttgtcagaactggtgagctatttgtgagactggaggaagaagaaagctccccactacttcatacaacagctccatttggtagttgagctatctgcgtctgtaaagcttgcgttggtgcacaaagaatttcggaataattatataaattttatagtgatattaaattacacagtctcaaagcatctcctgcttagtgggcgggcaatcattgtaggcaatcagcttttgatgtaccgactagattattaaacatcaccataaccactgatgcttagaccttgcgtgctttaatttcttttcagcaacttgaaatattttatatggaagtcctttaaccataaataatcatgcgccattgatttttttttcatttttcgtgccatcaatgagctaccgccaattaataacctatcccccggattcccccccccccgcatcgcccacgcgctggcgacacggggggcgaaaccctagcggcgccgccgcctttcctctcccccctccccccacctcgccgccggaaagccggcgggcgagccatgatggcggcggcggggcctccttcatggcggtgacccttcccagcgcgcgagaggcggcgaacggcggcagttggggagcaacagcggcggccgatcccggcgaggagacggcagatccggcgtcaccttcgccggatctggccatcccctggccggatccggccggagtgggtgctggtggcggaggaggccgcggcgcggcgacgcgacaagggcggcggcgacggcacggtgtccgcagcggaggcggcagtgacggcgcggggacgcggcagcggtgacggcgtggcatctggtggcggccgccacgatggcgagatgcacgcgggcggcggtgctcgcgccgcccggggtgagcgacggttgcggtgccgccggccctggtggcagcgggccgagcaacaacgtcaacggccgcgcgaggctcgcacacagcggctaccgacagtgctggttgtgatgggcaac

SEQ ID NO: 61875 - DNA, 11454 bp, Oryza sativa
gcagccgcggctgcgacctgaggtaacagcggcaatgccgtcggtgcggaggcagaggcctcggagctagtcgcagcggcggcgtcatcggctgctgtggcacggtggaaggaggcacgatggtgcgttcggcagcagcggctgcggtggcggtgaccacggtcgccggaggcgccggaggcatgggggcctcggacggctagctaagggggtggtagacggctacatcgggccggcacggcattgtttggaggaggggtcggagaccggcttggcgaagagtggcgcagtcaatgacagtggagccggctcggcgcgagaggcgcgagcggtggagttggaggccgccttggcacgagaggcgcggccgatggagggaggccggattggcgcgagaggcgcgtccggtggaggaggccggcttggcgcgagaggcgcggccggcggtggaggaggcgacctcggtgtgaggaggagctgccggtgggtgtggcgagtctttggtgcatgaagactggccggcgggggacgccggtgcaagggtcccgcatgtcagcagagctggagaggtggtggagcatcggtgtgtcagccaaggattcacaagggtgatcttgtctttgttcctttgttggtctagcggcagtcagtcacgcttagcggcggccggtctggtactagccttctcctggttgtgtgttggcgctgtcggtgcgtgggtggtggtatattttttttctttttgctggttacgaccctccagggttgtaatcttgtaattttttcctgctctatcaatagaactttgcaccgtctcgtgcgagtcgttaaaaaaaattaatagcctatccgaactggccgtagttttttttttctagtgacactctgatcaggagaaatcaacccggctattgttaacatctgccagttttggactgtagtaagtgtttaagttatgcattttgtccctcggttatttttcaataatagaatataagtttcatcctctgtactactatgtccagccatggacactaacacctgaacctgttcgaccatataccatatccctgcaaacgggcaacaccatgtcacagtctagtgatcttcaggtgcaaacctgcaattggggctctgtttaaaggactgcaaatgtgaagggaaggatcatactgcaaaatcattgctatggaagacatacgacagcacaagctacgatgctatgaatgcgtagtcagtcacaactctgcgagggtatatttctcccgtcaaaaaaaaaaaaacaatcatgctggataacgtgttcttcatctgtcccataaaaaacttaatattaggtttgtatctggacatatatttatattcagattcaaaattaggattgggttttttatgggacagagaaagtatgtataaatacatctttagaaatagatttttcatttttacggggggagtacttacaaatgaaaatacaccagggtgtgcataattgtgggcaccagatttaaatattggtagtatatgtaccatcgatatggattcggcagtggaaatatctatatgtatctcaccgcaacactttttgttctttcgctaatttccttatataatgcaaagcggagagagaatacttgtttgacaagtttagagcatctaagtcagtattatcgattgcaaagttataaaagaaaatttaacaattaataactttgttgagctacctgttcacccctcctaccaaatatcactcatcagccactaataatcaattcaacaacagagccaaaggattaaaaattcacaatccgtctccatccctagctaaaaaaaaaattgctcgcttaccaagttaccatgattaacatttcttttatatatagtaccagtagctgccaagcaaagtcacattatgggcatgtttggattcttcaggctattaaatatccttacagaatcttgctatttagtagtattaaacgtaaattactaacaaaactcattccataacctctaggttattttgcgagacgaatctaacgaggtatattaatccataattagtggatgattactgtagcatcattgtagcaaatcatggattaatatacctcgttagattcgtcttacaaaatagcctaggacttataaaataggttttgttagtaatctacgtttaatactcctcaataacaagattccaaagagtccatcgaatagctcaacgaccagcttgctttctggtatcttagcacaaacaatcatgtcagtctactaataagtgaggaaaatatcttatacacataggttttcccaacacacttcgtgcacatttttctaatagccgtaacaaaatggataaaattctgacatatcattactcttaaaattgtaagaatttttttctatagataaaatataatgaatttaattatgagacttacattgatcggttttccgatttcttcggtctccacatattaaaacacatgaatccgaacaccgaatcttcacctattataaaagttttaagatatttttgccgaagactttcatacgtcgcgcagtctgattccctccagtatgtgaaacggacaactctagggtttgctatatggcttgattccgagatcgatacgatgcgattttgctctaattcttggaaaagggaaatagaaggagataaggatcaaaacccctcaatcaatttcggattatctccgcgaatgcggatggatttcatcgaaggaggcggtggtttctagcggcgtcgggaagctgtggagtcggacagaggtaggagacgacactgtggcattgggacccacgtgacattgggacccacgtgacagggagaggagaagggattctgattagactttctggttgtttgatgggccagatgcgcgctttcaggccgaggtggaagggaggagtatgggctaaagaaaaaatgggctcaaaatggcccaggagaaaagagggttttcatttagattttcatttaaataaatgctaaaataatgtttgtattattaaaattagcaatggagctctgaaaatactgaaaatttttcacatagtgtaattaatcatggagaatttaataaaaattaaatccagccatagtttatttggaaaattctatttccacatttaccgtgacttttatgaccctttcttttcttcaacatcgtataaatgtattccagtaaaaaaacatcggatacatctatagttgcgattttatattttaattaattacataatgtaaatatttctcaaccttttcttaaatttctcatgttttttcccattgcaatgcacaggcattttttctagtaataaaaacagaaaccgaaagaaaagaccgatcaccgaaaaaccgacagtttggttctgttacggtgcggtccggttcggctttcggttgtcaattttttatgcccacccctataatcctgctgtcctggtctcttccctaacatatctctttcctctcctcctcaagtttggtctccactccagtgcaccaccgtagaatccatcacactactacataaatgatattcttgtacgctgggccctgttgtttctaggcggaccatgattgggaccgcatgagataatggggcaaccggcgccgggcggacgcccgcacgggaaaatagattatccagtgcgggcatcttaatccaaccgcacaggataatcctcattatcccgtgcggttgacttaagtggatcgcacagaaaaatcgattttcgcgtgtgggctttttaagtgaaccgcacagccatataaaatatcccttcctattttccctctcacgcacttcaaatttttcacaccctctctcctcccctcccctctctctcctttctctctcttcctctttcctcccctcactgagcggcctctttcctctcctcccctcctctcctcaccgagcgcacggggctccacgggcgccgccgctgatggcgcgggaggcgacgcagctgctatcggcggagcggtggcgaaggcaagcttgcggtgaatacaatgacgcccatcgacggcagtgcgatcaaccagccatgtaggtgaaaacaccagtcgacggcagcggaggcaagccggtggtgaagacgtagatgcccatcaatggcggtgtgaccagccaaccgtatagacggagacaccaatcagcggtggcgcaggcagccggtcggtgaatatgtagatgccaaacaacagttgtgtgaccaacaacttgtagaggcggagacagcagatggcgacagtgaaggcaaccggtcagtaaagatgtagacgcccaacaacggtggtgtaaccatccaaccgtgtaatcaaggacaccagtcggcagcggaagtaggcaggccgacggtgaagacgttgatgcccaacaacggtgatatgacaaccaaaccgtataggcgaggacactagtcggcagcggcaaaggcaagccggtggtgaagacgtagacgcccatcaacagtcatgtgaccatccaaccgtgtaggcgagacaccagacggcggtgacgaaagtaggccggcagtgatgttctgactgatccatttccgacgcgtaggagataagcttaaagccatgaatccctattatgcatatctggatttggatcttgcagaacaaacatataggctaagtagtatttgatgcaaatacagtacttgagaaaaaatcaagtattttaaaatgtttataaatatgtatttcttctgtcgtcaattttgatttcctcgaacagatggctccttacgtttaaacactctgcccgactagtgattgcccccacgcaccgggagtcatccaaggcacttcccagacatgcaaatgagtgacatgagttcgtcattaatggaacaaagtttcacggatcagaatttactactcaggtacttttgcaattgtcaagagcagaaaataaattatctgacctctatgcttttgattttttttttcgagtaatacttagcaccttgtgttactcggtctatccaacaagacccgggtgctaggaatcggtccaaaggcaactatccatcgacaaaccaaacggaaagcatagaaagatagaattccataactcgatagacacttttgtacttagattatgtcgcaagcaatcaagataaatattatgaaatttgttgaaaaaatatgatataacatctgtagcccccgactcactagtcaacagtgaaccagttgatgtagtgaggtagaggaaaaggaaaatatcacatagagaataaaattaatgatgagttagctttttcgtattcccttggtgacagtagaagtagccgatgtggaaacgaagtagtccatcaatggtgacgaaaactccagtcagcggtagcggaagcaagcctatggtatagatgatgaggcccattaacggtggcagaatccgtcaacctcataggtgggacacgatgctaatgaaagcgagaccaagctactcctcattgaagccatcaatggctgccgcccgagcctcgagggtctcaccgtcgagcagattaccagcctcggatggatggcaaatgcacgcctcaagattgtcaacgaccgcctcaagaagctccatgaggaaggcctcataccagcatccgtgtcattgttgggcaccgaggtaccaacccagagggagggatggctgatggatgttgcaaggggcattggctcaatggggtacaatcggttcagaggtagtagcggaagcggcactgctggatacaatggtgacctggcttagcctttcagcagtgttgcaggattctcacaagccaatcaggaattttcagtcccacccaagtaatgcaagattcattatcattttcctgcctggccaacatggcaaaggtggactttttctgagatgatattttgccagagaaaccatggtcaactatcgattttggagagtgtcaatcactcctttatttacatcccaatatatcattcctttctattttgtatcccatcatcccatttcctttttttaatcataatatcccttttcccttttttagatacctacaaactattcttggttcatgtatttattgcatctgaattaccagcttaatgcttataaacaatgaaattcctatctagaaaatgagctactagaaaaacaagatctgagtggatcaattgaaaaaagatctatgttcaacacaagaaaaagaaaaatcttaagtgcaaggaaaatgggttttttgtcgattcagcctacagtaccatatgaaatagttgaagcatgaaacatagtaaaactttaattttcccacaggatctcatgccagaagatgaatcttttcccacgatatttgttgtcctaacgaggcagacatgtttttcctatctttctttgcatcgtgttggtttcaggtgacaaaccacatgtgcactattcagtggcagacgcaggattaaaaaagagttggggcggaaatgctcgcttcataaggacaactaaacacaacaaataccatatttatattgtaatcgtataaaaaaatagtataatcaataaattcaggcagacaaaaaaaattgcgccatacataattcattatacaccaaaagataacaataaacatgtcaatttgtaaatatgagtcaattcataaagcatggtggataaaatctttaaataataataaatatatgagaagacataccgctgataaatcactgagcctttctaaggaatctaggaggcttagacaattctattcgttcatggcctaactgatgaagatgaggttggctgcctagccggctagccaccgacaggctgggccactggggtagtgcaggcgcctaggcggcttgtgcgatggcaagctgctgcctgctggcctggccgtgcgtgtggcgccgccgcggggatggtcggagggtcgcggggacgggcggacgaccggaggacggcgtcgcattggcgcgtgcggcaccgtctcgcagagcaggattgagcggcgtcggcgaagtggcagcgaataggcggaagttgaactgtgcgcgtgcggagtggcagagacaacagcgcagagccgatcgaggcctggcagatgaggagtcgtgtgcagcttgtgtcacttgggctttacttatgggctaattgtggataagaagtggtggtaggcagccccaaaggggtggggtggggtggggtggggcggcgcgggctgtagctgggctggccgacctaccctgcccaatgggtggttccgcccctggcgctatatttggaatgcaaccacgcacaacggacctgattaaagcatttatgtggtacgagtgcttcatattgccgatatattttgtgttttttatgaaagaacatacagtttgttggacaaaatattatctcagcgaacatggcaagtgctccctccatgggagacaaggagagagctcaaccttgaagacctgtagggaggaggtgggagcttgaggaaacaagaggtggtagtgtggagaggatgagaatgggtcttccccaccttttgcccacttgagagtttaggctatgaattttagtttggatctcttgcatgtcctttccgctagttgactgttaaattcttatgaaaaaacacattttgccctttgctacgaagaagcatataaattaatagagtgtattattggagcgtaaaaaattgttagatgggactattatatttatgagttagttatgcaccataatatttgcgataaatatacatttagatatgacataaaaaaatacttaattattttttattgcaagttgtttatgtttcatataaatatatttctcttatacaacaatctattgtattattattaaaacacatatgtgttaacagtaaaatttggtaagcccctaagagaataattacgtcgccaatagtcggattcctgctatattcggttaaggaaattaatcgattaaaggaaacttatccaaaagtgtccgagttcgaggaggatgcggtatggcaagttatctattaattaggaatagtttattagtttccttttatctttagaaaagtgtgtttggtgtcctataaggactttatgttttccttttatctttagaaaagtttctttcttgtcctacaaggactagtatctacctatgggtataaatatgcacacccagggtcattgtaatatctccacgatcaatacaattcggtgcatcgccaccttttacctttcctactttattttatttatcatggctcgacgacggtgtggcggcggcacggcgagcaatgcagccgcggccgagccccctcgacgacaatgacagctgacctcgacgacgacaacgacggcacgacagtggtgagctcgtgacaacgattttggccttggaggaaagtagacgctattgtccaattcatcaaatctgaattgattggttgataactctgaactctcagacatgttgattaaatcctggacttgatacttgagaaacctggagtagaccgtggcatcagctgagggccagagttgtcgctcaaaatgttggagttgcctgctctagagcgaggatgaagataatgactcctggagttgactcgttagctgattaattgattgcttcattttgaaataaagcttgtcgaattttgagccttgtatttgtggagctcctgactatgcttagttgaaaaacaacagatcatagagtcaaaaaccgttgcttgagtgaagatatgcgttgaggatgtccgagtagaaatcttgaagaattcagcaccacatgtagtagtagtttaatgcggtgtcgaatctggtagcacatgccaagatatcgatcctgttgaagacatcctggttggtgaagtagtaaagctcgcaatgtagaggcaatagagttttcggatgccgaagacaatgaagatgaagtcgtcccaaaattataacagagttgcacagccgtggtaacgtgaacatgagccggcagcaagagaggtaaaccggtgatgaagacgcgtagtggaagcgaggagatgagtcggcagcggacgagacaactggtggggaagaagataacgcccatcaacgcagccgtggaggtgaagaaacaaatcggtgttagacaaggcggcaagccatgaagtcgaaagtgtcaagcaatgacgacggagttgtgcacccatggcggtgagataattagtcggcaacagaagaagcagccggaagtgaagacgatgatgcgcatcagaagcggtgtatcaggccagtcatgaaggcgaagacactagtcagcggcgatgaaggctagccggtggtgaagacgaaggtgcccatcagcagaggcatagcaggccagtcgtgaagttgaagacaccagtcgacggcgagtaggcggctggtcaatgaagacttagacgcccaacaacgatggtgtgaccatgcaaccgtgaaggcgaggacaccagtcggcgatgatgaaggcaagccggtcggtgaagacgtaggcgcccaacaacgttggtgtgatcaaccaaccgagaaggcgaggacatcagtcgtcagagacaaaggcgagccggtcggtgaagacatagatgcccatcaacggtggtgtgatcatccaaccatcaaggcatgccggtggtaatgttctgactgatacattcccgaagcgtaggagataaacttatagccatgaatccctactatgcacatctggatttggatccaggagaataaacatgtaggatgagtagtatctgatgtaaataccgtacttgaggaaatttcaagtattttagaatatttagaaatatgtatttatcctcgtatcaattttaatttccccgaggagataactccttgcgtttaaacactctgcctgattagtcatagccccctagcaccgggagtcggccaaggcacttcccagacatgcatatgagtgacataaattcgtcattaatggaacaaagtttcacggatcagaatttactactcgggtatttttgcaatttgtaagagtagaaaacaaattatcttatctctatgcttttgatttcttccgagtaatacttagcaccttgcgttatacactccatccaatgagcccctgagtgcaaggaatcggcccaaaagcaactatccattgataaaccaaacggaaaacatagggatatagagctccataactcgataggtatttttaatttgattatttcacaagcaatcaagataaatattatgaaaattgttgaaaaaaaagatataatgtagcccctgactcactacttaatggagaaccaattgatctagtgaggcaaaggaaaagaaaaatatcatataaataataaaataaatgatgacgtagctttttggtattccccttggtgacaacagaagtggccgatgtgggaacaatatcgtccatcaatggtgacgaagataccaaccgtggaagtagctgagatagcggccggtggtgaagataaaatgccatcgacggtgatgaagataggccggtgataaagacgtggatgtccaacaatggtggtgtgaccaaccaaccatgtaggcgaggacaccaatcgacgacggtgaaggcaaaccggtggtgaagaaacttgtcggcggtcgcggcggcggccgtcttggccggtagagaccatggcgaatttggatgtagctccaacagtaattagatgcatccacacaaacagatcattaaaccgatccatgctcttgccatgcgcgcgtacaagtcacagatccgagtccagatcaaatcctagtccgagggaatcgggctcgggcaactatggtacgtgcaaaataataaaccacagatcaaattgagattagtagtaataaaaagtatagatgtacatgtaaacgcatgcttttgcatactcctgatggcatggaggatcatattgacggcgccatgactggttgatgcatgccgacttggatcccggccagaacaaccgatagttgacgcgcgtgtgggtgtgacggcacagtcaaaggctgtcatgaacagccggttgatcttggtcggcatatacgaacatgcaaaagaaagcaattagtagattaatctgttattaaacggagaaacatatagacttgtatatgtaagagtattaaaaaattaaagatgtttccttcgtccgttaaaattaaaaaagtagcgaaaaaacaacagaaaacctagacaacggtatcccgttggaacgggatacccttatatgagacaagacagtacctgatacctgatacctgttgtgttaccagctgcatggtacccgatacctgtgaaacctgttacccggtacctgtgatacctaggacctgatacctgtgatactcgtgcaagacaattgttaatatgtctatcccgttgcaacgggatcccgttt

SEQ ID NO: 61876 - DNA, 1199 bp, Oryza sativa
gcatccggtccaaaaccaagggagaataatatataggacaaaaaacatttttacccattgcaacgcatgggcattttttctagtgtaagagtaaattcactgtgtacccctgaaaactcactcaatcccttttctacccctgaaattaacccgatcgcttctatatactcctgaaatttcaacttgatcccttccatgcctctaccattacattttccatcgcttcactgttatttttgtccttgatactttaggtttgaatataaccttcaaaaaaattaaaatttttgtttaagtgcgcaatatatgtattttatgaaactaatgagactaaataattagtgcagaaaattttgacataaattttagaaataaaacaaatgttataaattaaatttttatttgaaattttaataggacaatggatttttttatcaggagcattcataaaaacattattgtgaacattggtcctatctttgtatgaatgctccttattttttataatttttttaaaactaaatacatattttttatttcattatataaaaataatttttgggataaataatgcttcgcacaacaaactcataactataatagtctcatacgagaagcttttacatttttaatattgtaattcataaatttatatgtttaaccaaagggtaaaatggacatttttatagaaattagacggtcaactgacgggagacgtatcgaaggtgtcaaaatcaaatattgggtgtatacaagtaagtaaaattcacgggtgggtatataagggattagctaaattttcaggggtataaggggattttctcatattttatatatggcccgcatgatcaagtaggtcatgcaacacaagcacgtacgagtgttccttataaccagcaatgctccatgcgtgaagactgtcactgggccatgtgccggcgtgtagatcagcgcaaagcgtgatcaaatttatgtcggtaggattcgcgaggtcgctgactgcttcctcgcaatctcagttggcatataaaaaggcaaaaaatatcagaagatcaaataatgattgaaaattactctactaaaagtttatttggaacgacaaacccgattgaagattagagcggtcgaaataagtgagattgatctcggtgtttcttcagaagttaaacccatcacacttttcgacgagtaattcgacg

SEQ ID NO: 61877 - DNA, 1194 bp, Oryza sativa
tggtcacactaccgttcatgggcgtccacgtcttcaccggccggttttccttcgctgccgcccatggtgtctttactttcacggctggcctattttgccgccgttgaaggacgttgtcacgtcccaaaacgaccctaaaatatatcctttaaattatgcctagaataattaaaatccgtgtgaaagcctccaaaaattaaaatgtgcaaagtaaaagtcaaataaggcttagaggatttttgtatatttcctaaaagcctaaaatgtgtaaataaattttagtggaattttcagagcacaaataataattgttaagaaataaacaaagttgaaaaggttttataaaaagaaaaaaaaccctaaaaccctccctccctctctttggccggctcggcccacttccctcctcctctctcctcttcccccgcggcccactcggcccctccccgcgcgcacgccgctgacgggcgggcccgcccgccaccgtcgctgatgggtggggcccacctgtcatctccttcctcccgccgctcccgccgcctcgcccgcgcctagcgccgctgccgccacgaatcccaccgcctcccgtcgtccccgcgtgaaatcaatagtggggaattactctccgtgatcccttctccctttccccccatttttccctctctctcttgcattcaagcgggcggatttgctcccgcaaatctcgccggcgccattgatggcggccggacctcccggccggtttccttcctctcccggccgccctctcctccttccaaccctatttaaaccctccccgcgcctccctcgcccgtttccgccccttgccacaccgtctcctcactggcatcgagctcgcaccgtcgccctctctctcctccgtcgacgacgaccttcggccggctctctccactcgccgggaccgtttcccgccccggcgtcgcgtcctccggcttcgccgcaccgtcgccgtccccgttgacccccttgtcgagctcgccgaccgccggtgcgccgcggtccccgtcgacccgagcagcgccgccgccttcctccgctccggccgcctttttcgtcgtcgccgtcgacctagggtgagccgtggaccgccgcctcgtttccccctttccctcccctctctcggccgccgctccgccgtgcctatagccgccgccggtgaccataggggagcgg

SEQ ID NO: 61878 - DNA, 894 bp, Oryza sativa
taacagcacaaatcagttgggcagagtttgcgcgaaccttttgatgagccactcagttcgaaattggactcctggagctcagcaatccgatccctcagatcgtgttcattcttcttggcaagttctctggcctcgtgcagttgactcctggtggcttcgagggttccaagatgaggaactagtctctctagggttgcggttttcgcctcgttcctaagatgaatcctctgcggagcagtttaatcagtgctcgagccagacggtaaacaagatggctgaggtcaggcgtcaaggaacttacatttacaatgcgagtcgcttggttgagtgcctttttcagtaggcatacctcttcatcttctttttgccggtttattacaattccttgaggttgcaagttgtcatcccaccacttgaccagaataggagggcacgaatctttggctgcttgtatacgatgaatttctttttcatcaccgatcattggtcctaatgcatccattgacaaaggttagacaatcgatcagagttatttgggtcaacatggtttcagacaaagtgtttacctgtaatgatttttggacaaggacgagtggattcggatacttttaaaggggatccagatctccggtcattgctggcgtcttgtctgcgagggttgtctgcttgggtttcgacttctggaatctcttggcttggccctgcgtccgactggtttccagtcgggggctcctgattaactccggcttcggcttcggccgactggattccagtcgggggttgatcaccggattctacattatcggttgccggttgattgtcactcggatgatcctcagcagttggctcggtttctttggaagaacttgtgtccacgttagtcgggtcagagtc

SEQ ID NO: 61879 - DNA, 1086 bp, Oryza sativa
cacctgacttggaccagggtgcaccttttggctgactcagactaggttgcggcacttgaagatggggcttcagttccagaacttcgcatagttcatatctttggagtcaacctcatacaagttaccacttcatgtcaggcgtcaacactagcttgtcattactaggataccatgcttgtcatcataaggatatcaggcttggcgtttccttccagcttaccaccatacgctttagactatgatatcccgcttactaaggataccatgattgacaacttgccattaactgtctcatattggctttcctggtctccagtgctaggtacttctgctattcgatgccagggtcaaccattctaactataagttatgcttcccaagagaaccaatttatcccgcttgacatgctttgacgtcttcccgaatgactttgctgctggacttgttattgtctgatcgtgatcctgccagatctgaagcttcgttgttagaggtgattttaatctgacctctgtagactatcttcgaacatatcactggttctataactgggaatggctctcacgaacaagcagctcggattcactttctttacattcagtttacttcccattattatcttcaggttgtcctcagttagcattcaacgtattcctttacacctttaaccttgatgtgttctttcccattggatcatctcccaagacatggcattacctggtaaccggtgcttgcacttttcactccgtgtagcatctgataccgagttgaagatttcactccttgccttcatagaaacacttttacctaggtcatcttgcttacttaatgacaaggtgactgttgcggggcaatttacaatcaggggtcttccttgagcgatgcagagcatgtttctgtttatcaatcacctttcggcctacttcttttatgctagagaacatctttgccaatctcttttatcaatcatctttcggcttatctctaacaggtggtattctgaatgtggattgcggacgcttctggggatgatgaggtcctttggcttcctgcctttcagtggaaccttgatgtggtgcgtcaaaa

SEQ ID NO: 61880 - DNA, 2014 bp, Oryza sativa
attgaaggcaaaggcaatggactcaatgataatgacttcatgacagccacacgtgcaaccaattcaatagcaaatttctaacagaatcatgtttacaatatcacaagttgcaagaactatatgtgaccaataaaacctgaataaaacaaatcttaatagaataatgttgtttcggtgaaaatatcctcagcatgaatcaacagtgcaaagaagtaaaatatccccaccaaatatacaagccagcaagatcaaaattacatacaacaataatagatgaaatgatgattatgcattcaatgttcttggaacatgcacctttaacagaaaacgaaacatgagcttcacgggcaggtcgtgcagtagatttattatttggtccctcatcactgaccaaatcaaaaagtgaaatttctgcaaggaaatgcaatagttcattaaatcaaacttcgaataatatataacaagcgcatcaatctcatttatacaagttacgtgttgataaattttacttttacatcaatgtttcatgcaaataattttacctttggttgcaagaaatatttcctgaacagactaagcgttctcgttaaagccaatacatgccatcgatgattgctccccttttatgccatatttacaatgcacatacttcttccgtttcataatgtaagactttctagcattgcccaaattcatatagatgttaatgaatctagacacacatatatatttatattcattaacatctatatggatatgggcaatgctagaagaacttacattatgaaacggagggagtacttcccatttttttaaagcatatttgcaattcatatacttgaacaagtagctctattataaataaccggttgatagtagggaaggaaaataccattattgagttccacatttggattttgtttcttgacactgttgctttttggtgggggtattttgcaaccaagcggttccttgtatgggttagcagaagctgcaccatcgtgatggtcagaggatgatgacaatctgccaatgcacaagatgacatctcacaaaagtacaaaactagatcgattaaccaggtgtgcacttatcatactgcatggagatactgaccttggctgagaacctgcacagtagcaacaaatcagtacatgaattactgaattttatctaaaatgcacattacatgcttcagaaataatatcatatctcattcttctttaggtagctgcgcattcaagagagaaacattaaaaaaatagaactactgaatttctgaactttgtggatggatatgaccatgtcaatgttagtatattgaaataccatgtcataaaacaaaacaagaacgttgtgatgaattcctttgaatcatataaagaaggttgaacccttacatggttccttcagattgctgcacgcagaagtgatcttctttagtccctctataggagaagcacttaaaagagtgcaatccagtggtggaacaacattatctacagctgagataacagtaacaacaattaatgtaacatacaactggaggataaaaggacatgcattcagttttaggataaaaccatgcaacactaatgaaaagagactactccacaaaagcccactctaaccaaaacaaaatgcacagaaagtgcacgatacagtccatctgtcaaataaattccgatgatggttttatgtcttgggtttccaggaaaccatcaccaattgtcataagttagtacaacagcaatgtgttctaagttttttcttcttcagacaactatgtttcaaattgtaatcttgcagaaaaatcacaatcattatttgtctgccccagattttccaaagctcttaaccttccgttacacttgaacaagagtgccattggacaacctacctgatataaacatatccagaaagtgccccggaagaacaagaaatataaagtgcataaaatgcatgcagaacaagttcactactaccagtataacaccgcaaaacatatagagaa

SEQ ID NO: 61881 - DNA, 10142 bp, Oryza sativa
cttttgctcaagagtactgcctctgcctacggagcattgttcaagagtagcacaaattgttctatcaacataaggatgttaactagcagaacaacataacttgatggcgccatcgaaactaagttacctgctctgcgttgatttcctggactgctcccaattcaggaacaaacatgcataacacagacgcccaaacatgaccgaatgttagtttgtcacgacaaatagtgctaaatgcagcgattgctctgatgatttacacgccaaccgtttcactgtttcagtaaaaaatgatggaaaccaagcccaaactaattgcgaggaagcacaacagagagagatggagggagggagatctggggtactcacggcatacaccttcctccgcgaaccacccatccattgcagcatagtgaacaaacgacgagcaatctaacctcgcggctgcgaaatgggcacgatgagtgtaagcgcgtgaagtttcaggaagaggtgggtgaagccgcgggccgcggtccacgcaccgacgagatgagagagcgccgcggcggctcccgaagctgcggagaaggggacggcggcggcgggaggggttagaggtgacggggaggccgcggcgactggcgacgcgcgcggattccgcggcaattccggtggccgccgcccgccgaggtgctggagctcgagctccccgcggatcgagaagctacggcggcctcgatcggtggaggcggaggcggaggcggtggaggaggtggaggcgatggattgcttggaaattggaattcgaaattaggagaagcggagacgacggcgacgcgcaaattgaaattcgaaattggattcgcaaattttttttctccaaacgacggtgacgcgctacactggggcgccctgtttggggaacgaaatgagcaaatcacagaagaggagacgctgggctgctgggccgtggagtatttgggcctcctcctgtactgggccccaaaccatccatctgcgaagcctatattatactaccatatatagggtgtgtttatagtaatttggttgcgcaaagaaaacttttgggtatcacgttggatgtttaactcgatattggaagagattttcggacacaaatgaaaaaactaatttcataactcgactgaaaaccgtgagacgaatcttttgagcctaattaagccgtcattagcacatgtgggttactgtagcacttatggctaataatggactaattaggcttaaaagatttcgtctcacgatttctctacaaactgtgtaattagtttttatttttatctatatttaatgcttcacacatgtgttcaaagatttaatatgacgtttttagggaaaaaagctggggaactaaaccaggccatacattcctccgatttgcctgatactctgctgctttgtcagtttgcaacaattttgtagaaagcagtttggattctcgcaaaatcaaaatcagtttaattcccgtttgtcatgaacaatcagattgacatggccattttgctatcttgataccaaagggaatcatctatggagtactgactgtctgtgctgcaggctgagtgaagcagccgtagtagatgtcggagaccttcttcaggtcggcggcgctcgccgtccacacgtgccccggcgacgcctccgggaggccgtcgccggccgcctcctcgcacctctcctccacctgcgccgcctcccggagcttcccctccctccacaggctcttcaccagcagcgccttggtgggcgcgtcgggggcgaccccggcgccacgcatttcgtcgaacagcttcagcgcgagcgcggcgcgctccttcttgcagtagaccttgatcagcacgctgtacatgtacccgtcgggctgcagctcgcactgccgcaccagcccgagcagccggtgcacgcccttgagctcgccggcgccggcgaggtgctccatcaggccggagaacgtctgcaggtcggggaggacgccgcgcgacatcatctcctcgaggagctccatggcgtccgccgctctccggcatttagccagcgtccgcagcagcgacgagcacaagagcgccaggttgggcctcgacacggcgccgcagatggagtcggcttcccggaacaccctgatcgccgcgtcggccttcttggagaggccgtagaagtcgacgaccagccgcacggtggcgaacgggaggacgatgccgtcggcccgcaccttgcccagcaggcgttccaccagctcgacgtggccggcgcgggcgaggatggcgaccatcctcgccaccgtgtgccggtcgtgcgcgtagccgccggggcggcacgccacccagcagaagaactcccacgccgtctccgccttcttgaacgcgcgcagcagcttgcacaccagccgcggcgtccacacgatcccggcggcctccagctcggccacctccctcggctcccacccttccagcgccctcgcgagctcgcgcgggtccagccatggcttcagtgtcgctctgcctctgcccttgtcacgaccgtccacgccatcgtcgtcgtcgccctcctcctcctcgtcgtcgctatctccctcgccgtcgacgtcgtccacggcgtaaccgattctttcgttgggtgaaagctcctcgacgaaatcctccgtgccctccgcgtgtcccgcttccctcatggcggcgatggcggcgcgcatttgcggaccgggcatgacgccgtcgacggcgaccatctcgcggacgagccaccggagctggtcgaacttccccgccgacgcgagcgcctcggcgagcacgttgtactgccgggtggtccgccgcgcgcgcagcgacgggaggaggcggaacacctcgaccgcctggtccacgaaccccgcggaggcgaggtgctcgatgacgacggtgtaggtgcgggcgttcgggagcgcgccctcgcggaccatggcgcggaaggcccccacggcggcggcatggtcggccgcgcggacgtggagccccatgaggaggttgtgcgcctcggcggggcggtgcggcttggccgggacggaggcgaaggcgtcgagcgcggaggcgtggtcgcccgcggcggcgaggaggcggaggcgcgcgagaggcggcgggggcaagaggaatgaggcgaggtgggagcggaggtcggggagcgcggcgaaggcggcgaggcgggacgcgagggcctggaagagtgggagcggctggggcggcgggagggcgcggaagacggagatcgccgacgccggcgtcggggcggcgcggatggcgtggagcgcgacgacggggtcgtcgggtggcggtggcggcggcggggaggaaggggagcggaggcggaggcggagcgagtcgatgaggcgggcgcggcggaggtagagggccacgcgggcggcggaggggggcgggcgggacatcgccggcgagcgtgttcaggcagacgagagagcgtggcggcggcgagggacgtggacactgaccttgtcaaggaggggttttagacttttaggcatcagagcgtctcatgcaaaagaagaacaaacacagatggttcagaattaatttgtggacacttcaagaagtttaaatttataaatgattatgggcagttcaattcgtttatgatgcataaactttactcctaaatttagaccgattatgacttatgagtagtcttcggtttacctaaagctaaggtttgtttgaaactctgaatacatttcctgacgcaactggtagttcaatgctttcactgacagaataacagaacaaaactccgtttccactcctgctctccattggtaactgaatggatcaggaatgaatgaatgatgatagttttaaccatacatgatgattcagctaaaactgacaatcaccttagctgaaatgctgaatcgtgtatattaaaccaaaggctgctcgctgaacaaagctcaaatgccatctgaacaaagctcatttacaccaggaacaaacatcacccatgtctgggagtgaccatagttcagaatttgaccatgtctgggagtggctttgcattaccatcgacagcaaaatggctgaaataattactgtatagcatgcaagcataaatttcctaatgtcatcctacaactgtctagaagaacaaatttgtcttcaatggtgttcgtcttcaactgtggagggtcatgaaatgataagctggtttgagcaccatgccgttccttcatcccacagcttcttatggtacataaaccgcggggctgtaatttcaagcagaacaagcagataacagtccatgagaaatttaaaatggcttaaccatgaaagaaacaagcagcatggacacgataaaactaaaggaaatgtagagtgattatccagaaagagcagaaaaaccaagctaaataactcaccgtgcaattctcatctcgaacctgatctgcccctcttcctctttccggttgatcttgtttgaactgtcctgtctgcctgtgtgcggcgagtccgtgatcgagatcgcttctcagaaccgaggccagactcagtttcctgatcaggcgccatggaatgatgtatatcttcctctttatccctctgttgctctgcctctggttcagctgcagttgttgcagcagtcgatgagcatggaaccagatccacaatgtcgcaaagtgatgatccaccaagttccccaataacttctacacatgttctggtgacttggtcaacaaaagcacggcatttgcctctagagcaacttttttgagaagctgcctccttcgcaaggacagtgagtttgtcggtctggggcaaacgatgggaatttcagagatatatcaaagtatcctgctggtggtggcgagtctatcatccaaccatcatcaccatagatacatgcatacgtgttcttgttagttgaaaaatcttcacaaaataattatgtaatccgtgcatgcggtttgcaatagaattatttagtgattcatgttcaattgaaaattatatgcagcttttgaagttcagaatttatgatatacttgttctagatcaatgcaacgcatgggtatttggctagtaaatatcaaaagaaggtaacctgaatgaagctcacacgatcacacctgcatggtagtagcatgatttattttacaagtaggatgtcttaccactgagtggatcaaatgagccctgggggtgtaacgaagctgagaagcacgaaaaggatcttcagaatcagaaattgcactcccaccagatgccccacccttgtgaccattacttatcctcttcggtgtgcacaggcgaatacgtgttgatcttctgtaccaccgcaaataatccatataactgctgtggtcatatggccggtcttccatgacaacatcttgctcctttgcttcccacatatccacaaaagacttgtgcttctgtgcccagtcattatgaacccttccacgacggcacctgcaaaacattagaaaattttatgattcggctacctgtagatgattctataatttaccaggacacacagtcatgtacaagaaataataagaataaaaacagcaaagttctgttttgaagataccagtgaagctccgcactagtgtcccgcaatggaggtgggcacacctgatggaggccaaattggcgcatcactctctcaggcatgtagatctccaccataaagaagtaaagtagaggtgctcgggttagccacaaatgagaatcctgggtacaaataggggctagctgtagttccttcatccgttcctccctatatgggcaccaaacaacctggtcatccgttagcaagtcaaactcattcgtgaagtgctcatagcaacgtgcgggagctgctcgacgggcgcacacccccacaacccatcgtaaaccaactgtgggtctatccctctcatcctctagctcctccacatttgggtattttagcttcaccaggtctggcctgccaattggaaaatgctcccatgaccaaaattgaaggagcaaaagacaaccagtcagattacttccatctgactgcctcctgcaagcatcacacattgccctgtagagatatgccagagtagcggaaccccaactgtatgaaccaatattctcaagatcagcaatcagtggaaagggatagaaggtatacaaatcaccagaggcatcaggaaacagcagaccactaatcaggctaaggatgtatgccctggcatgctgcttgatggtctcctcgtcagcatcttctggacaattgttgaactcagctctgacccatgaaaccctcaatccaggacgtggcctatccggcggaggagccttcccaaggtatcgctcaaccaattcattctggggctctgttgggtttacagtgacagcatggccagcgattggcaatccaagaatcattgcaacatcctgtagtgtgattgtgatctcaccacaaggcatgtgaaaagtgtgagtttcaggtctccacctatcaactagtgcagagacgagtgcccgatcaatggagggcagaccagccctacaaatgtttgccagtcccatcaggccagcgggcctaaggtaacgctcatacctcctgtcaaagcgaagaggttcacgggtacgagggttgagctcagtcaaatgctgtaccaaacattggaaattgcaaatcaacagtttgttacacgacaaaagattgtaatataaatgctataggtactctttgatctacctggcctgatgctaaagcacgagcccgatgatcagcatcatactgcccaattaaatcataggaagtggtatcaactgcttctgaagctccattctgatctggacaaccatcatcagagaaggtcctggtgctctttcttggttttcgttgccgtgtgttctgaggatgtccatttagtggactaacattcaccgttgaagggataacaaacgacatgtcctgttctggattctgcggttggccattttgacgttgtgcataaagcggtttgatagccattagtgctctctctgaggatatgccctctgtcaaggaacaaattcttgcttgaacaaaaatctctaggcagttccactcagtcccattgaaaacagctttcacatagctactccatgacatgtcatcatcgataggcaccatgatgaagtgccgatgagcaccaccaccaacgttcaaccttccctgcgcacgaatgctgagcatcgtaggcacccacccgagcttcttgtacacggcatcaatcagttcatcgaatgcaggcttcgccttgaaccataaaccctcctcggcgaggttgccaaactccaccccgtttggacccttcaccagctccccgccactgtaaactcgcacaaatctgtccatctctgcagccaaacatgaatgcaccccaattcaagatcagctcaaagcctcaaatccagtttcagtaatctatagcatgaacaatgagtccatgatgtatgaggagcatacgaacaagttcttgttaaacgaatacgaagcacttagataacaaaatcaacccaagttatccactcaactgaggtaccataccaaccagagaaaacccaagaaatgctcttacaagtagtatcctaggaactgcaacatgtcaattctcaaatgctcaaacctagttttaaacccactccacaccattcgcaatgaaaaaaaaagggtaatatagtgaccaacgcaagctacaccatgcgagtgacaaacagcttagctaaaatttcctctcgatgctcactggcggcgcgggggggcatcacctatactgaactggtggaacaaaggtagatgaactgttcatccaaatggatcttatctccgcgaccgcgagcggtgacggaggcttcgggaggggaggagaggaacgggagtgcggcggggcttaccttaccgcggcggtggcggcgccgaaggaatccgcggcggcagcggcgtcgcggggtggcgcggcggcgagtggggaacgcggctttctttttttcacctggtttttgtttgggggaagagacggagtcgtggttagcgtttttttcctctttccgactttcgttcggcgcacgcagacgcagggagcgcttgcttacctagcgttccgtatccacgctgggctgctcagcgttttgacagatggaaaatacatcacttgagttgagtgtacgacaatattgctacgaagcagtagaaataatataacacatccaatacaacgaatctacatttatgtagattcgttatactagaagaccctcctaaggggttatattccctcttaggctacaaaaattcccaaatgatcgagtatcattttcgtaaaaaaaagtattttcattttcaactactcttgattttagtcatttttttccatttttatcggtgcaagtggttagtaaataattaaattgtcaaatataagaaattcatgaccaatccataaccacttatgtagaaatgatattgtttttgtctgttttcatttccttttggttgattaatgcatgatcattcatgtcatactttcaaacaaaaattcaaaaactttttatcagctattttttaaaaaaacacagtgcggatgatattttatttaactttataatatggtccttttacggtgcccccactagagaaggtagtagtgtagtaaaaatcaaatctaaccattgattgtaatgggtagtttagacttttataacattaacgggaaagggcattttagcctatttcggtgctcccgcgaggtcaacacaggccaggttcgatccgcccaagtcgcgttctgcgcccttcctctcctgagactctacgctaggcagccgccgcccgccgccgtgccgccccatctcgcgcccgacgtcctgcttctcgtcgttccgcctcgcagctcgcgtgaatcggcaaatctactggatgaatctgtacctcccaaatggataaccgacaattgacaagtttggatttgtatctatgtacttcactagcatatgctgatagcctgatatgcatctgttcactgatatgtacttctatattactattacattcttctctttagttaaaattaaaatgatatatttctatatacattttctgttgagtggattaatattgttactctacttgttaagattatggatttttcatcagaacagaactacagtccactagttcagtgatttgtaaattataaatccactgacagcaattacaaaattagtctgagttggatgcaatctccatatacagcagcatcattacttgactgtacgatatttatgtgtgcactaaaagtctaaaactgtgataaactaatgattggatcatctcatctgaaaaatgaaaactaatagattacagactaacctcgcgccaactacaaatctacaacaatgccatgtttctttttttcttaattgcccttttactacgcatactacacctgctatcaaggtgtagtataattagatctcacccatccaatccattctaacggatggctcacatccgctcaagggtactttaaaaaaatccttataatatatcatatttaattaatccatgtattaatttatcagttaatcagctgatgagctaaacagaacagggtattggcttctacggcttataagctgacatgtaactgaataaaaaataatagtataagactttatacttctacttttgtctgtgctaaagcactattcaaacaaccatgatcgcttttgcttgctcatatacaagttacatggatttagaaccattttattgccgagggaaatacgttccgcgcaaaagactcgcaggcaatcagcacatcaccaccatgcatcgcctcagcaaggaaaagaatcagacaggaaaagtacaatgctgatgcatggtaggacttctcaagtgtgtatcatggtgtattagaagaagaaaaaaaagttctaattcgctaaatgcaagctatgattttttctgacggaattccggctattcggggaaaattctccttcctcgctccacgacttgctctaggtcagcaaaccatgatttaagcaacgatttctccttagcaatgctctccagtttggatttcagattttcaatggcctgattcaatg

SEQ ID NO: 61882 - DNA, 727 bp, Oryza sativa
agtttggtaagctaagaacccgaaggttaggagtggacgaggatagagcatcgcaccatgtcatcccgttgtcggacaagtccacagcgccgaggtagagctccctcaattttttatgatttgcgattaaagtttcaaagtttggctctttgagcacgctagattcaactgaatcaaaggacaacacagaatgaccttgtgtgaattcttctacttcaaatcgagtagataggtcgagagatactagatttgttaggcgactgatgctagcggtaggtacctggcccacgaaatcggagctggagaggttgagataggtgagcatggtgagccgctcaaaccctgtctgcgggagttaggatccattgaagctgttgcaagcgaggttgagggaggttagatggaagatcgcaggatcaagaccgccgctctccaatctacgccctcccaggtccagagacgtcacacgcccatccccattcctgcagtggatgccctcccaatggcaacagtctgtgccggccttccatgacccaaaggtggaactggagtttttggtgatggagaaagaacgtttcaaccggagcagcgccgatgcctggtccggcaagcatggaacaaccgccggcggcagggctccggtgtggttggcgtacgtagctgctgatgaagaagggacaataatgagctgggtgtgtaagaggatcagcatcaacggcaacaccaa

SEQ ID NO: 61883 - DNA, 1080 bp, Oryza sativa
tggattcctcgtcagtatatatgccgaggctacatatgaaacaacttctgcttgctgccccctgggcagaggaagatgtatccgttcacgttttgtgcttctaatatattaagttcttagaaaaaaacttcgacggtttatactccctccatactcgtaaaggaagtcgttttggacagcgacacggtctccaaaacagaactttaactttttatttctataaaaatatttattaaaaagtaatatatgtatatttttatgaaagtattttcaagacaaatctattcatataatttttatattttcaaactcaataacttgagagttattcatgatttatattctcaaggtttgatttaaacattgttctaaacgacttcttttattagtatagagggagtatatgtcttggtgtttcttaaatcttgcaaagcggcagatggaaaagtactaccagtagtctacatgcattgattggaagatggttaagctaaaaatgatctgatacttagggctcctttgatttgtaaaaaaagtgtagaaaatttgaaggattttaatcctatggaaaaattttctatgaaaccctttaaaacaaaggactgaatcctatactatcctttaaaatttctatggaatgggtaatcctatagagattttggaggaaagttagcaagaggtccaacctcttggaaaaattcctttgagtctatctctcttatccgattcctgcgtttttcctgtggtccaatcaaacggtcattcctgtgtttttcctgtattttccaatcctctgttttaaaatatatattcctgtcagaatcctgcgtttttttctattcctctgtttttccattcctgcgattcaaagggtcctaatggtggaggagagattaatgatgttgtttaatgggtggggactggggggaatcggaggggactttcgcctaattctgtaaagatttgtcaatccaatggttgaaattattgtgcctgtttgtcgtagatatagatagattcggtccatcgctacatacagacatgcgcaacgttctatgcacggcatgcatgggtacaatg

SEQ ID NO: 61884 - DNA, 7188 bp, Oryza sativa
atatgcacgggatgcatgggtacaatgctaaatccttgcagatggagtagtatcgagtgtcacagggaggacgtccgcttcggaaacaaacatgtctcttcatactgcctagagtaaaacatatgtctattagccatgaatccttactagagatatactccctgcgatctggctaaagacgtcggttatgacaatatttaagtcaaaccttagtaatataaatcatgaataactcttaagttattgagtttaaaaatgtaaaaaatatatgaatagatttgtcttgaaaaatacattcataaaagtatacatatatcacttttcaataaatacttttataaaaacaagaagtcaaagttgtgttttagagaccgtgtcgctgtccaaaacgacttcctttacgagaaaggagggagtatagtttaacaacatgtgaattatatattataaaaatatttataatcactactacacaaatggttttttttttggcggccaaaacacatttttgctggctagtgaagataaagcatcttcactggcggtgaccaaccgccagagaagagatgttttcactggcagacggcttaaggctgccgtcagagaaaattatctttgctggcggcagccatacgaggaccgctgttggtgatatgggcccgggggtacgcaagatggagagaaagagcccttccgtccggccacgtagccgcacggccttcccccccccccctcgggggggaaaacaagcggtcatgaagcggccaaggggcctcgggatgccctgccgcacccctcggggccctcgggcaagctgccccaaggcccccgctcggctgccacatggtggccgagtgggcggagagaggggtgctctcaagcgccttaaataagcatcgccccaaccgtcccccgccgcatttaatgtggcgtgggcggacgtgaggcgccgtccgattgatgtgcgtcaatcgggcttgatcggtctgtgaccggccaacaggcggacgggacggatagcagcgtacccacgtcccgcccggtgtcaggcggagtgggggcagataagacctgtcccatcggcacgtcggtgagcgtgctgctcctgtatggagtccaccaaagtcgccaacgaattaagggcgaatgacgggcgtgtcccccgtgtcaggcgggggacggcgctgggcccacctgaggatgagcaaccaccttgtttctggttgaaggcaaggacaacggcttgacccaagacatgtgggcccccacccaatgatggattgtgtaaggcggtgcatgtggtatccccttgaactataaaaggaggaccttacccaccgagaaaaaaaacgccacttgagaagcttgagccaactcccttgtaacagcacaagtttaattcgacacacaggagtagggtgttacgctccatagcggcccgaacctgtataatgtcttgtctcccattctcttcagaagaatctcaccagctaggtccatagcggaaatacgctcttgatcgacagccgccaacaataagagaattttgctggcagctgtggtaagctagctgccagcgataattgattttgaggcaaaaaagattgaaaataaccacatgcagttgccttctaaccgctagcaaaaaaaaatccacattcaaaaacattgctgcattttcaatttttaaatccacatcaagagatcagattcaaatccaatcctgattcacatcaacatgcaaacatcaatttctcacagcatccaaaagtccaaacatctagattaatttctcacagcattttcaacatacaaacatcaacacatacacattggtcttcgtcatccccgacgaccttggaggttattgtcattgtcaccgaagccacccccttggctactgccgctgtctaggggtgaaaacggagcagattcggacggataatagctataccatagcctaaaccatattttttaagcggatgtggagtgggtgcggatgacgtgtggatgcggatgcggagcggattatttcggacgtcggattcggtgcagactcggttcggaaacggacaaaaagttatcggatgtcaagtttgtattcaatccattcaacaagagggcggcaatataattagccccaatacgatggcaaaacatcattagtttactgcgttcagttcaatagtaatagtatttcaatagttcactagtcaaaataatccaagatacatccatgatccaccaaaaacataatatatatataagtgttcaattcaatagttcaccggtcactacgttgcttaaaatgtaaaaataaaagtcatcggcatgaggcaagccatacaggcatacagcaacagcaagcatagagcagtagagcacccctatgtagtgctacacgcagcatactgcatacaggcatacatcagtagtagtacaggcgtacagcacaaaacacacagcagtgagcggcggtgctagacgaggaggagcggctggcgcgtgttggggaggaggatcggcctggcgcgtgttggggaggagtggccaccgcgtagggtcgccgtcgcgctgtgccgccgtgctactctctccgactcctcaactgacggctgagggacggcacagagagagagagccagagacggatctgggggatgaggagaggattaggttaggccgggttgggctattgggctagctaggtgggcctgaaagttgttgtgtggcctgaaattcgcggattatccgccaaacagtacatcggataatccgattaaaatatcggataatccgcatccgtcggatatcgttcataccacatccgcatccgcatgacaaaatccacatctacatccgcatctggccgaatatctaaaaacccttaccatatcctcacatcggacggattcggagcggatcggatcggataatatccgctccgtttttactcctaagctgccgtctctctacggccagatcagggagaggaaggaggggaggggagcgagggtagggtcaccgcggccctcaggcggcccgatccagcgcttgcgcccctcccgcgaccctgtggcggtcgcatcgtcatcgcggcggcagatctggtcccccacgtcgttgcagcgacagatccggcctaacccgttatcgtagtggcggatccagccaccctcgtcgtcgcggtggcggatccggcctcccccatcgtcgcggcggccggatctagccccgagctcacggcggccagcggcgaagaggagtaggccgcaccctgccgccgctaccgaggccctccctgttggccaatacagcagagatattgggcgggagaggtgacggtagccaatggcggtggtggcgacggtagccggcagcagtggagacgggaggccgaagaaggggggaggagagactgagggagaagggagagaggaagagagattgagagatagatgagtgagagaggcgagtttggtgggcggtaggggcggtggattttatatattcgcctcaattttttttttgcagcggtcctctttaccaaccaccagcaaaaaaatgctggtgaatatttaagaggtctgcctcgaaaaatatagttgtttttttatggaggacaacttagcgtggccaccaacgataatcggttttcgctggcggtccgtagcccctcaccccttgttatgtttttgttggcagttttcgcgtatggtcgccagcaaaaattatagggtaacaccataaaaaattatttttttatagtgaatgttgaatctaaaaatataaatgttatagtgttaaactgtataagtttataaaaaatgatggttaaatatttgaatattttactttgaacaaacctaacctagtaagtgaaataatttgaaacggagagaataataaggaattgaaagagccagatgcttagagccatatcccaatttatcaatcccaagtatagtagctactctcttcgtcccaaaataaaattttggttggatggagagacatgtatgtttcatatgtattggtatatgttatgtctagctaaaaaaatttatattttaggatagagaaaatagatgttcatcatgaaccatgctgcgtcacgtcactcataattcagccttcctcgagagattaagtaacgtgtgtaggagagtaggagacaggtctctgcgttaatttggcatagcacgcatgacttcggccgacggctaacagttgtgtggctcgtgtcacgccttcgtatggagtttccctttctttctctgccatccacgagaaagggatatcattttctttattttttacccacgtattacaacatgatgagatatacgtggcttaatcttttatcttctcccatatttcttgacttaatcttttctattccctcgtacttctccctcagttgatccgttttgtttggtacagcggtttctttaggccccgtcattttctctatacaatatcagctgctgccaaaatttaaattgtaaaacttaattttgaaatcttatatagtacaagctaagcagcaagctttcttgctcaatgatgtgctacatcatcaaaacatattgattgtcagataaagaggtttagataaacaaatgccattagatcaaaagggtacatgcataatgcattaatgaaaaaacacaaacggacaagcatattggaggtttctagtgtcttctgttacacacatgatacaaatagagagagggggcaaagacaatgaagaaaaaaaacaggaggcttaaataaattcacttttgtcttcttgaaagataagttaaactaatacaaaagtttttaaacgggatcaaaagtcgcacaaagcacgactatgtggctagttgattttgaagtttttttcgtcgaagtttatttttcaacattggcatttaagtcgctaagagcacatatgtaaaagttttacccataaataattcttttctaatacacaaacattggtatttatattaaaaaacataaagggtggcagatggcgcggctgcttgcgcgtgccacgtcggataggaacagtgcgcggcgtggaaattttgcaaaaaaaaaaacccttccattttgtgtttaattcagtgtaggtccctcccgaatagtacatttcagccaatagtttacatggaggcccttataaaagccggatatttcatgcgaagaaaaaaaagtgatgtaaaatgtggaagacgagtgtaggattaggatgaaaacgaagagagaaatactgtgctcctgtcacaccatcctccaccaatctctctcgttgggtaaattgggaacgagcaaaggcggagacgcttctcccgccaaaaagcttgttactggctataatggctactgggtgagtctattgggcttagtgggccggctcatttatatacattcagcacgtgcgtggtaatcccgtgtcggcccattatacaaaccagcccatctgtctgtagcgaggtttgttttgggggttgctaatgggcctattttgcggcctttggtttgagggccacattattatccatttggtaaggttgggcacatacgtggccaccgatggttgagccgtcgaagagcggtggccggagtcgctcttgcgatgcgtggtgagtggtgactgtaatgtaatggaaggttcaggtctaacgctactggcattgctattcagcaggagcaggcaagatccctgacccttgtggcctgcgtcctcctcctggaccttctccccttcccatggcgtcgcgatctcttgaagcaagcaatcaagattgttcatctgaaattgcccttgctatttcagttagtactatttctgcaagccatcctactctatttgaagcaaccagatgttgattgttgctagttttgcattgtcttttgctactgagccgatctgacaatgttgatataaaggataacttgtactccattagggttctttatctgaattttggacagcctgaatgtctgaaccaggtaaccatactactgaacagaactttatgaccattttcttgaactgatctttctacagcatatccaattatccattgccattatagcgaaagcagtatattagttgtgtgactgtgacgcctgtcagtgtggactgtgtcatacattagcagccgctgacccctgcattaataaaccagcaccttatcttgctcatctttatttctagtttgaggcagtctcgcgactcagtctaagctcagtcttcttttttcttcttctttgtttgacggaacaaaaatctcaggcatgatatgatattctgatctgttcatgagttcatctgtatctcagtgtacatgcatttgcaaagcaaaaattccattttgttttgactagtaagcacaaagaattgtttctttttgactacgcaagcaaatttcccctataaatctcccatcccaactcattgagattgcaatatcatcaattcatcatcttgtccgaaagttcagaaatcactctacttttgttgtcagtttcgcttccggccatggcgttgaacccgctcttcaccgtgacgttcgacgtgagcagcggcgacaactacggcgacttcatcgccggcatccgcagcagggtggccaacccgaggcacttctcccgcaaccgccccgtcctgccgccggtggagccgccgccgccgccgcgccgctggttccacgtcgtgctccgggcgtcgccgaccgccgcgctcacgctcgccacgcgcgccgacaacctctacctggagggattccggagcagcgacgggaggtggtgggagctcaccccgggcatcctcggcgccgcccccggcggcgccgccgccacctacgtcggcttcggcggctcgtaccgcgacctcctcggcgacacggacaggctcaccgtcgtcacgctcggcccgcagcagatggcgcaggcggtgaacgcgctcgccgcgcgcaggccggccgacctcgccaacggcgcggcgcagcggcgcgccatggacgcggtggcggcgctgctcctgatggtgcacgaggcgacgcggttccagaccgtgtcgaggctggtcgccgggctcatgcaccccaaggcggcgagcaagagcggcgccatcaccaccgcgatgaggaagcaggtgaacgggtggcaggtcctctcggcggccatgct

SEQ ID NO: 61885 - DNA, 1505 bp, Oryza sativa
tggagtgtagaggtaaataatttcctcttcaaagtgagatttcatttactgacagcaccacatggtaagcaaaaagaaaaaaaaaagaccaaaaatggaacagacatcgttcattacactcagggttggcttccttccaaccctagtactatctgcctactaagctgaactctgtatagaaccatacactagtatcatcagagcagtttcttcatgcctttgagtacttggagctccacataggtaccttcagagcctcgtcgtcgcctgcgttgcccccattttcagcagtgctcaaagagtccgagatcaaggggtccgattcgctttcttttacctaaatcacaatccacaacattcatcagattttgatattcgaactatagagaatgttttctgctcaaaacatgacaagaatatccagtgttaagacacaagacaaaactattaaactaggtacctggttgagttgtggggaggcttcagtgggttttggtggagcctcttttgtgcagaagtatgagtacgataccatcccaatcacagcaatgaggattccaagtatatttctccagctaaatggatcgtgaagcaaaacataaccaaaggcaagaaccaagcatgtcttgagatggccaagcacttggtaagttacaggagaggttttcccgatcacaagaaaagtgctgaagttcactgagactgatatcaagcatgacagcacaatgaaaaactgcagataccgtaaagaaccgagtcagatgaagcacagctacgttcaacataagtctccaaaactcagtttactgcttaccacaacttgagatgtgtaatcaaaagcaaagacattttggttagtcaaaaacccatcaaggaaagggccgacgatgaacaaggtcaatgcttggtatgggcatgattggtacagcagctgtgttgaagataccttgaatttcttctgaattgtgtttgtcatctgatagctaattaaggattcaaatcagacaccatagaacaatactatactcaaatgaaatggtgcttcaggatttcagcattgtgcacaagaagtatatatgaataaatatacactataacatctatcctagtaataaaccagctacatgtgcaatacatgtggactgttttctttagatggtgatgtgcagattatttggcaaacatataacgtttcataaacgaaaatatcacttgctgtcaaaaggatacgatttgagcaatgcaggttgtaatgattgcgagcaaagacaggacagatcccacagcattaagctgcaggtcagtcacagttgcaactccaacaccaaaaaggagaacactaagggagagctggatattccgactgcacagtaaagccaaaaataaaaaaaaaatcagaagataatttctcaagctgcataaaggacaagacgtattaaatacaaacttcataattatcaaactgaataaaggacatgaagtattaaatacaaacctaaacttct

SEQ ID NO: 61886 - DNA, 1499 bp, Oryza sativa
aagttaacgaaattgagaaaattagtgttgtatgaatgcaacttttcaggaaaactaccacaaaatatctcaaacttcaccaatctgagcacactcttccttaattcaaacaatcttgtcggtacaatgaaacttgcatcattatggggactacaacacctccgttacttggatatatctgataataatcttgtggtggtggatggaaaagtcgattcttcatcaacacacatccctaaactacaaatattagctttatcgggttgcaacatcactaaattccctgatttcttgaggagtcaagatgaactcctttggctcgacctttcaaaaaaccaaatccatggggctataccatcgtgggcatgggagtcttggaatgattctggcgttgctagtttgattttagcacataataaatttactagtgttggatctaacccttttattcctttacaaattgattggcttgatcttagcaacaacatgtttgaggggactatacctatacctcaaggttctgcaagattgctagattactcaaacaacatgttctcatcgattccttttaatttcactgcccatcttagtcatgtcacacttttcaatgcccctggaaacaacttctccggagaaatcccaccatctttctgtactgcaactgaattacaataccttgatctctctaacaacaactttagtggctcaataccatcttgtttgatcgagaacgttaatggaatacaaatattaaatctaaatgcaaatcaactcgatggggagatcccagatactataaaggaaggctgctcatttcatgcactatattttagtggcaataggattgaaggacagctacccagatccctacttgcttgtcaaaatttggagatccttgatgctgggaacaatcaaataaatgacattttcccatgctggatgagtaaacttcgtagactccaagtgcttgtactgaaatccaataagctatttggacatgtcgttcaatctctcaccgatgaagaaagcacatgtgcatttccaaatgcaataattattgacatatcctcaaataacttctctggtccgttgcccaaagacaagtggtttaagaagttggagtcgatgctacatatagacacaaatacatcattggtcatggatcatgctgtgccaagtgtaggactagtatatagatataaagcctcactcacatacaaaggtcatgacaccacacttgctcaaatactaagaacccttgtattcattgatttctccaataatgcattcaatggtagcatcccagaaattgttggggaacttgttttaactcatgggataaatatgtcacataacttcctcactgggccaattccatctcaacttggtgggctgaagcagctggaagctttggatctatcttcaaatcagctttcaggagtcattccacaagaattagcatccttagacttcctcgaaatgctaaacctatcctacaa

SEQ ID NO: 61887 - DNA, 4325 bp, Oryza sativa
tctacatcagtatgatcagagtcaagagtgttacactgcccctaaacaatggaaacaaaagaagcagaagaatggaatgaaatggaaaacctgaccaactaactaatcaagaattacataagtataactgatgggagaaatgagcagattggatgctcgtctcttctttgaagtctgaacccgttgatttggagcttcttttcagctttatttctgtgagggaatccagttataaacatttgagatgtcaactagcctgtacctgaagtaaattctcggtatgaaggaagaactctggtcagctgtacaaaaagtgctcgcgtcgactatggcagacgctgcaggaaccaatattcatcggttgggctgcaactttcagaaagcactatcacaaaatatctcttaatccctcccttgaaccaaggcattcttggggattagcatagaaatagtcctcttccttgggccggccagggatgacctttctttctgtcggctgacccatgcgatgctggtgtgccttcttcacagcagcagagaattcattccaggacattgcacctccttggaaactatccaaaagttcaacaagtttcaccctgtccaataggatggtcttgcggaagcccgtgtatctaaaatggatgaacaaaaagggctcctcagcatacagaacattgagttaagggcctcatcgtttgccctatggcttataagccaaagccaaaatttgaattttaaaacttgaatttgaatttgattctttttcaacatagttttttttcaactttggcttttcaatcactaagaacatatatacaaaagttttactcacatatcattttttaatcgctaataagacgttatggcttataatatgactagaccaaccgatggggacctaagtagttttaaagtcactgatttttttttcttttttgtagttatttgtaagaattcagaatgcacaggagcccaagcagttctttactaatgtcaaaaacaaaccatgagtgaactctagttggattagattccggagaagcaaacctgcgatggccttcaacaacccttgccatatttccatcataactggggatgaaaacatcgcttgctattgaaaccatgtagtccagtgctgccatctgggttgagtggttctggaatggctgcaattcctcaggagataaaagtttctccttccgtacctaacataagatcaaagtgagctactataaagcatccatgataaatctaaaggggacaccttaaatgggagaacctgctcaccaatctaggatatgcagccttcaaagctgccaaccgcctttcacctccatagatttcaccagaggctatataaatcagtgtatcctttttaaatcctagagctttaagcaccagagtaatttcctcgggtgtaaggggacaaagtccctgaaacctcttaacctcagagtctatctccttttctttccaccatggatatgcatatctacagttcaaagacgattcgttcatatctattaaagtagcaaatcagtacagcaagtcagcgttaactagtaatgcaaatcattacagacaaacctcattctagtgagctcttcggtttcttcatcagaacaaccgtgtgtgcagcccgaaaaggaaagcatatccatttcatatcgtaagtgtagaacaacaaattgcccacttttttgaagggtggagataagttttcgtccaagggcctcaatctgtggggtgaatctcaaagcctcaaagttgacacggcaacgcagcctttggagcttgacaggaagaccgttgtttgcaaggcgggcatctgttttattgaaatggatcactttgtgcttccttgcaagacgtaatacctgcatagggaatctgtcagatgacagtttttttaagtgctgttaaacacagccagaacaaacaaacttttattacccgctttagatagtatgtctcgttggaccagctcacaggtggcattgagtaaagtcttctcttagtttttaacttgagtttcataggaagttccttaacaatcatcagctcatctcttaacgaattaatgaagtgactgacgtcaaagatatctccaaattcactgaaaaaaaattaaaagatacttttgaaatagaaacacaacagaaattactgtggttcggctacattttcacttgcaaaaatcatagttcattctcaaatatggagatgaatgctgtttacaatagcaagggatgataactcatgttcacaacagcaaactaggataaaattgttcatcaaacagacatgctgttgatattacagaaatgaaggttatgtgggaaattataccttgagtcagcccaaaaagacctcttatccagttcaggcaccactaatgttagattcaaatagcgagctatggtcaccatatcacatatctgtaaaacaacattataagaaatttatattcgaatttaaaatgagtggatgagctagctcaagctacaatagctaaggtacaaaccccagctcgcatttgattgagtcctccattgcaagtcaccagtaaatagccattgctcttataaattcctgcaaaaagcaacaagatgccaatcagctctagtaccaacaaaaggactgagacaacaagatatgtgaattgtcttctagttatgtgtttctacaatgaagctgctagcaagctacaagcaaaaaaatcaatttggcaataataaaggagtagaagtttgcatcaatcggagcttgtttgacacatcgttgttgaaaagcttacatcatgaatttatgattcccacttcttttctttttatttgacagaaaacagtaggagaggctcctactgcgctatattactatatgattcccatttctcatggaacacacacgtctaataataaatatataataatcccttttaacttcaaagcaaataagttcatttaccaattcacatcacctattccagagcccatttcatgcccaaagcgctgggctatatgggagttttctataagtaaattaaattaaataaacaactactaattatagcatacgagcaacagaggttgaagatatgaacccacatttgtgtcgaagacccgataagaatctcattcgagctaccaaaggatgacctccgctaaataatccatgatatatcccaacaaatcatcgcaaatttagaaagttctcgcccaattcaaccccccgagatccccaaaatggcacaaaacctggtcaaaaccgccaattcgagcccgagatcgaaccgaaccagcacgaaacgcgcctcctttgaccaccaagcaaccgcatttgactcgccccaaccgcccgaatcagagaagccacgacctcccctctcccacacagatcgcgcaagctcgagtactactcctatttgctaggagcgcgaggggaggagaagcagagaggagcacgaagaggaggaggaggggcactcactcctgggcacgagcgccggcggcgacagcctcgccgcgacgcggtcctcgccggcgagcgcggcgagccccgtggcggcgccgcccccgccgccgcagtcggcgagcacccgcggcctccacagcccggcgatcgacgccagctgcaccaccgccgtccacaccacggcgctcgccgccgccctcatcgcccacctccacgcccgcctccgccgcccgccgtgccccgccgccaccaccatctccaccacctacccaccaacgaagctccccctccgcctcgccactagccgccgcagcagcgactcagcgagattaactagcctcctctttcgattagtttagtgggaaatccgccatgaaaaggattggagaaatggagggaggaggaggagagatggaggagaggtaggcacgacgttagcatttggagaggaggtgggtagtaagtaatagtagcccttaaacacgccggattaaaattaattaggtgattaaactaatccaattagtctctaatgacaggtagcactagctgactagcccccggtttgcagtgcgcacaatttgacagtttttatcattttgtcagtgtctcgtattagaaacgggcttaaaaaccgtagttgttttcatcattggcgtgtcgggtattaggaacggattagaaacgtatttagtggcttgattaaggtagctttctgagccatggctgatgatgcatcatgtgagctgagactgagttcgaaacggaagttggggtgagctattccatcgtgttttccgtgagcacaagcttcttgattagtattttttaaaaaaaaaatattttcg

SEQ ID NO: 61888 - DNA, 1165 bp, Oryza sativa
tttaacactaaccgacggcgatctgcaggtttagtctagactctagagggacgtgccatctctcgagagcgtgtgtgtgatgaaatgttgctttttggatcttgctggcttgatttgggccttaatctaatgaaaaatcatcggtttcttctctgatcgtttaatttcaggataagataatgtgtggtttttgtagctgatgataagttgcaagggcggcgtggtgtggtagcgacggataatgaggcaaaccgatgatggacacggacagccctgctcgtgaccgacgtgaaggatttgattatacgtatcatcagagagacaagtagcaactggtcagatgttcttttcaccggaaattttgtagtggactccacaacagtgtcgtgcacatccatctgatcgacattgatcgagttgttctctgcgagttatgtacgcagatttgatttcattccattgaaaataagcagcttctttgacttcagaacacgcagaggtaaacagtacaaagaaaataatcaagaggggtatcaatgtcaagaaagcaacgtaccatgaatacatggatggacacgttcatgtattgacaattttgagatgaagcagtatcacacaacatgcagatctgagacttgctatatggccttgcagaagtagaactacaatataagctcagatttgtatttcattcttgagcttttatgtcatatatatatatcagtgaaaagttgtgttcatcgaaaggaaagaaaactaaaatcaactagctgcaatttcgacggggggacaaatgcttcagaatgagggtggaagtaggttgcgatcgaacacccagctctccttattccggctacctagaactttgccggcgagaggacggcatttatatacaatggactgagcacaacctttatatatacaagttatcaaggtgatatgatttcgtcacgcagttcagggggccgaggtcctcaggggggtgaggtcagccttgataaaccggaaatattccttctgcagcatctgcccgccattaacctggtcaaagctgcacctgtagaagctgaaaaagccaaggttcgactcaattagttggcgaaaatttcaaccaaatgcagcaggaaaatgcagagatagctatctgctataggaaaatatctaa

SEQ ID NO: 61889 - DNA, 2812 bp, Oryza sativa
aatcagatggttcagctcccttgcacgctcagtttcaacctaatggtttttacttattggcagtttggtagcagagaagtatactctatgatagtattagaagatagcatcatctttggcaggtccagtagtataatgtgacaacgattcctcgatggttcattgtcattgtgcgtgtataatattgtggaatccaatgtgtgttttgtcagtgcaagtttcgcggataaatggatgatggtagaattttgccagtcattttctgccggtgtcaaaaaattctcttgaatgtgaagtgtggaagaatgtcttctctgctagtctgtcctctcttcattagatatgatttgccttagggcaaaagtctgtaactcaatgcttgtactattaaacctctttaatcttaatggaagatacaggtgggaatctctcccctccggtgattatttcaaaagaaaaaaaaaatctcttgttgtttccaaaacttagggagaaacaacgggcatgatgaattcgtaaatataagggcgaaaggatggtgagttttcggtttggtttagagaatttgaaaaaaaaaatcagaagggcatcgaatttgcatttaatctcatggtgaaattcaaaatttttgctggaaaaaaagacagcttatatatagggcccaaccgggttcgaaccggtgacctattgatctgcagtcaattgctctaccactgagctatggacccattttgacatcgaagatctttataaattcttacattgagcgtactccaaaataacttcgcaaagtagctgaaccaaaacaaaacatttcgatgtctctcctctctcgaccatgataaattcaaatgcaaccaattacacaattcgaaatttaagaaacacgaatcaaagatcctgaaccattacacccgagtacccgatggccggaaaagcagatcgcattgtataattgtattagcacacttgattattttgcaccattggcgacggcaggagaaggcagcaagaacttgagcaggatatcgttgaacatcttgggatcctcctggtgcgccaggtgccccgtgttcggtattatcttcaccgtcgccttctccccaagcatccttcaaattcaaattcaaatttaatttcattcgattaattgttaaggcaaataggaaactgacgaaatgatcatatggtaattaagatcaaggcttactctttcactttgtgtgctttctccacagggaaaatctggtcgaactccccccagatgatcaaaatttcctgcaaattcagattacgatcattacatctgaatgttcagtcaatgcagtgtgttatcagttggtgttttcttcttctctgaactgaaaattttacgcacttgagggagaggagaattaagctgcgagtcttgttcctcggtgacgatctctttgatcagccggatcttctcctctcttttgtccgcgaaatatttctgcaccacacgcagtttgcaaatttgcaaatcaaaatttaacgaaaaagttatctctcgtttcttaatttctatctgcatccaatcttctcggtgatatcatacagttgaaacacaatttctgcaaatccgatcgaattgaaagagtcagggcatgaatgcaagatgctgacgtcacgctcacgccatggagacgagtcctaacctttttcgtgtgtaaatgcaactatttatatttggcgggaaaagtgcgatatgccggtgggtgatatgatttgccaccaaatttgtcggtagaaaagattttaattggacgatgtttgtatgattagtcatctactactagtctactagcttttgggacaactcgccaacaaatccaaaaattcctagcttagctaagagtccactacactatcatggcatccactgcagaatacgtaatgagaacggtttaatcattcggtggacgtctacccattcaactaaataattatgaaaaaaattaaaaagaatgataagatagatacaccactctcaaatttaaattcaacttctataaattataatagaaaataataaatttgttattaagttgtagttatatacagaaaacaaatataaaccttcatgcctgtgagatgatatatctcatattaatttatctcattatcttttaaaatttttataaatatatttagtcgacatgcaatgaacgggtgaacattcacccgggttattaaaagagttttcgtatacgtatacggtgaggtacgtatacgtatgtatgtacgtaggtacccggaggaggtcgcggacgaggaagtcggggatgtacttgggcgggcggtggacgcagagcgccatcagccgccggaacgccttcccgtccgccggcgccatcagctccgtcacctccgccacgccgcccttcgccgccagcgccgcgtcgtcctccgcccccttcgccaggtcggcgtcgcacagcaccaccttccccacctccacctggccgtcgccggccgacgtcgacagcgcccgcgccaggtgccgcgccaccagcccgccgtagctggtgcccacgatgtgcagttcccggcgttcgccgccgaggcctgggaggtgcgcgccgccgctggtgaggagcgcggcgatggcggctgcctggaacgcgtcggagcgcggcgcggcgctggtggtggaggcgccgaagaagaggagggtcgggaccaccaggtcgaagtggcgggagagcgggcccacctgcgcgccccacggccacgtcgggtccggcccgaagccatggacgagcacctccaccggcggccgccccgccgc

SEQ ID NO: 61890 - DNA, 2124 bp, Oryza sativa
catgaatatcgaatcgtcgaaatggatttaaaattggatttataatcacctgctagctgtaaatgacttagtggagaataataaattcaaattctacacaatatttttctccccttttttctcaaaaggagtttgaaaattgcagtatattctctttgctggcttgctgcaaccacttcaaagaaaaggagagttcatgcattgctactactacaagtacggtgctctgataagctctcactacctaacaggccccacctgtcagagagcgagactgtctaacagtagtagttagagtgggtgctttagctagctagtgcgatgattagattagctagctaaagcttctagaaggttagtgagttgggccggtgaaagcggaagcccaccagaaatcagttagatttggatcttctggtgttaggcccggcccattatgtaggatggcccaattggagtggtgggttgggcccaaatgctgtcgtctctaggcccggaccaggaagctctgcaacagcttaatcgatcacccaaaaaaatgattcgaatcattttccagcatctccgttgatcaacagcatgttgaattaaagatgcttaaatatttacaaaagttaaggtactaatattagcggtagttgaaatgtggaattaattagccacgtagtcgcagtcaagtataattctgcagtaggtgtgatacactgatacagtgatacaacatgcgtaagcatgctgatcccaacagtacatatatatatccggattatctagctgatgacaattagtagacatattagtcacatttcacgcatgcacggatgtagcagtagggttcattaagcacagttaattaagccactaagcagaatacatggcatgtagatacaacaaattaggtggtgtaattagcatatatatgcacctggggcatgcaggtctctgcaggttaagttcaattgttaatgaccacatgggcagctactttgatttaactagtgtcattctcagctgcacctgggcggctagctagatcaatcgatcaaatcgatcgatcttacgttggaccaaataaagctgtaaagcaaaacgatgatttggagattaattatttaattatatattggctaaaaagttactaaattttctgtagcatgttggtataattatcttgtgctgcatatgcatacatgccctttctgaagaatctatcagctacccatctatgcagtgttgtgtgatgcatgcacaccatgcatgcttgtcgattgcactagctagggggttaaattagcaaatgatcttaagatttgctaatccatggatgtgtgcgagttaattagtggcggaaaaagaattgtttcaatgtttcaaaggagtaattgtgtatgatgatgaagacaacactaattaatcaaatcaaggtgtagaggctgaattagaactctgaataatgaatttgacctcaattctacaggagaggaggattctgtatatcccaaaaatctagcaatttcatacatatttgaacaaatatataagtacagcagaattcaaccgaattacaaaatcaacttaatttgaacatcatcacttaggatggctggctaggtagcttctgattcaggctggctggctgcgagctgagctagtaatcaactagctaatcagtaatcacactcaagatgatcatcaattactcatcgagctctactcgtcgaataatctgcacggtacagctcgcaatcccacgcatcaacgtcgagcaatccggggacatcgacgagcaagtcgaggtcatcgagcgcgaggaggtggaccatgtcgccgtcgccgtcgacgtcgccgccggagaagcagtagtcacgggaggagtcctcgccgccgccgttgccgccgcaggcgctcacctcgctgatatccgatgaaccggcgttcggcggcgactgtgtggtggcggtggcgccgccgctgccgcctccgtcgagcagttggcaggagaacatcgggagccgcgccgggataggaggaggaggaggagatgccgcctccggcgccgccgccacggtggccgcattggccgtcggttctttctccatgaccgtggccggcgccggctcgcct

SEQ ID NO: 61891 - DNA, 1255 bp, Oryza sativa
cggtacactatactgcaaatatatactagcagtatatacaatctaacggtgtaaaagtcctccaactgaattgctacctgttgccgaggagtttctgcagggagaggatggtctccgcctctcgatcggagatgggctccttcttcaggtcaggcctcaggtagttcatccacctcagcctgcagctcttgccactccgcctcaatcctgcacaatggaaggaatgcaatgccaaccttgtcagatcaagaaaccaaatcacctgtctagcaatcagctgcagagaaatcaatcaaattacaagctagacagactatcgaagcatgattaattaagttaggtgtcaaatgaattcttgcctgcgagctgagcgactgagctccaggtggagacgccgcggtgggtgatgtgggtgtagagccgctcgtcctcctccggcgaccacagccccttcctctccttctcctccgccgcgccgccggcggcggcggcggcggccgcctcgccgtttctactactcgtcggcttccgcaccattcttgagcttagctagctagtactactcctgctgatgtctactgtgtgatggagaattcagagagaaagattagcagctggagcttacttagtatgtgatgattggatctgctgaagaatagactgcttacttaagtgagcctatgcacacacacatatatatagtagatgcatatatgtgtataaataatataattaattaattgtatatacaaatatatgtgtagctataggctactgcacattgccctacctgtaggagaagctagggaaggggggcaggagtatctgtacttgcatgcatgtatgaacagacaaaacaaatcctgtgttggcattgtgttaacctgatagtcttattatattctatgtgtttgtacccaagtatggtcaaggtatcccatgaatttgttgtactcctacattaatacatatggaccatgtgtgtgtagttctaggtatatgtattgtgatgatattctgaacatatccatcatgaacaccctgtgcatgagcaagactgcacgcaagtactagtacttggcttgtgtaaaggcattctaggtctttgagctagcatgtgataaattgtttgtatctgatcgagtatttcttttatcatgtatatatagatatgtacacatgcgattagctgctctgaattctgaatataggacttatactgtgtgcatgtgtaggcaggacaagattgtggtgg

SEQ ID NO: 61892 - DNA, 2444 bp, Oryza sativa
tttggtgggcttcatcgatcgtctatttattttttgtggtgggcttcatcgataacgtctacagtgattttgttaatattaagatttgtaaacacccgcgccgtgtgtctaaaaataaaggaataagttcacttcgtgaccctcaaaagtgatcgaaatctaatccgtgaccctaaaccacaaaaccggatatctcgacccccaactcttaaaaccagtgcaatttaactccctcggcggttttggagggtggtttcgctgacgtggcgcctacgtgacattattgactcggtcttctgtccacgtggcgttgacgtggcacttacgtgtcattagaaataaaaaatatgggtgggacccactgacatgtggggcccacataaatcatatcatccccctctctttctcttcgcgagcgttggacgggagccagcggcagtggctaacgcctcctccaaccccatccacagcctcctccccccttcccgcggcggcggtgcggcggcccgcaagcggtggagacccgggagtggcactggagcggcgacagcgacgtgcgcgcaaaggccagagcggcagcggtggcggagatcgaggccgccgtggaaggttggccgtcggaaggaagaaaacaggccacgagaacgaccgcgttctcgccatcctcggcaccgccaccgcactatccaccgctgcgctccacgccctctctgccggccacgatgcacctgcctccgcagttctcccgctgcgcccacgaacacgtaagggccacctgcatctcgccaccgcgactcacgtcggcatcctctcgaagatggcggcatccggcggtggcttcttctgcacctacggcggcggcgttgaaggagggaggagcagcacgggcggggaaggcggtggtaccaccgatgggcgtggttagcatgccgagccagccgacaacggcatgaccacataggagttaggaggcatctgcgtcaagcattctcctgctggttgccgagacaatcggcaaggggcgagatatgagggctacggctagcaagcggtagcaacaagcagtgcatgtgtgtactaacatcaagcgacaagccaacaagcaaagggatgaccgaccgagcaaagctgcagataggcaagcagagcagcagattcgcttggacgatggcgcggccatggaggagggggacgcgagggacgggagcctcgcgcgagcctccagtgctccccaccgccggccctcgagcgctcccctccaccggcgctccagctcccatccctgcagatgtgcgaagggaagggaagagagagaagggagagaaagggaggaggatgaagaggagagaggataatatgtgggccccacatgtcagtgggtcccacccgtacttttggtgaatgacaaataggtcccacccatattttttatttctaatgacacgtaagtgccacgtcaacgctacctggacagaagaccgagtcaatactgccacgtagcgcgccacgtcagcgaaaccgccctccaaacccgccgagggagtcaaattgtaccggttttaagagttagggggtcgagatatccggttttgtggtttagggtcacggattagatttcgatcacttttgagaatcacgaaatgaacttattccaaataaaaataaattcaggtataggatgggccttgaattgagcccgctaattccgggcccatcaaggcccactcagatcaggcccaattaagaggaggcaggcaaacccaaccgactcgcactcgtcgtcgtcgtccccatctggatccctccctcttctcctccaacctcgccatcatttcccagctcgcttcccttcccaagctccaccaaccaaccgccgccccacctcgccgcccgccgccgaggcggagctgcgccgatgaacacgtcgcagttcatggacaagcagatcctcggcctcgcggcctccgcctccacctcctccggcgtcggcgtcggtggcgggggaccggagctcctcgatctgatgagccccaacccgcaggaggagggcgaggaccgcctccgccgccgccacagctcctccaacggcagcgccgacgacgtgctgcccagctacgacttccagcccatccgcaccaccgccccctccgccgccgcctccgcctccgccgcgccggcctcgtgggggtccctcgactccggctccaaggccgcctccgcgtcctacaacttgaaggtatacttaattattgtttcgatcgtggtatggtctccccaccgctagatctgtcgatctatctgcgtttcatgattttgcatcagtaaatctatcgcgaaaacctttttcgtgtagatgagcatctacaactcaaccctacattagtaagaagaagaattttgtttgcgaactgggcttgtgcaccgtgctgagacgcataatcact

SEQ ID NO: 61893 - DNA, 2168 bp, Oryza sativa
ctgtgctcttattgattgccacacgttgtcagtgtctacatcgtctgttcctttatgattgtgctgcttgcttagcctggagtagtactagcatatatacttgctcatgcatatgagcggtcatgattactttataaccagccgcactggaggaaaaaatgcttgtttttaagcttatgtattacgtatatcactctcttatgatactgtgttgaaataattactcattccttcgtttcacaatgtaagactttttagtattgtctactcatttagatgttaataaatttagacacatatatatgtttagattcattaatatctatgtgtatgtgggtaatactagaaagttttacattgtgaaacggagggagtactgcattactatataaccttcgaattctcattaacttcccgttgtaggaagtacctttttctttggttctaatcgaggctaaaacaatgcaaacgttgcattatttaatacttgtataattttaaaatctttggctatgaataacttctaaaatatgtatattagaaatatgtagattgttttattaatgtatagattagttttaaaaagtacattaataagatcatatatttcttaatattttatatatatatatatatagaaaataatggttaaaattttttagattgtgtcattgttcaaaacgacaaatattaggaacctggatggtagtaaagtacgtacgtacatgatgattaaatccgtgagtatatactacgtacgttggtcaatatgcagttagttaggtgtatgttggttgcatagagcgatgtttttttaatatagtttataccttgtatttgtatacatgaactctatgagcacgcgtacgctcgcaggcagctggaactatttgcgaatgatgatgagatgaggaaggcactgtggtagatattcttacgagtagtggcaatgtcaccctcacactttttcttgtactgccattaatcccgatttgtccttatttatctgtttactttctccctcgctctctctctctctccccccatgtcttttttgcaacaccataatattcttcaactctcactccatcattcaatactgggccttgctttttcatattttgttgcctctacatctcacctttcccttgtgctgcagttgtgtatagtaggagaagctgatttctatatctctcttcccctctctcctaaagatcactaccagaaagaagtcatgctctcctgcttgatcgtatgctagctcatcctacagacaattctttgattcgtatccaaacagacaagattattgatcttgtttcattttccgtttctactgtttctcctctattttccattctgcagcttggatatcagtggatcttggaagaaacaagcagcaactaagaaaatctgccacatattgctgttgtctttcttcgtcagatcatcagatctatcctcttcgaccacaaataggtaaggatgagcaggttttgactagctggctagatccacctgagggaaatttgagaaaaaaaagagcatgattcagtctctgtctctcttcccttaggtactaatatatatattaatatctattcgagctctttgagatttgagcaaacatcaggttgttttcgcttcgaaatttgtgcttttcttgttgagagtcgcacacatgtgctcatacagtggatcattgtccaagcatttgtttcaatcggaccattaattctcatcggtacctatttcaaataattctacagcataaaatctacagtttcaatgtccccttgtttttctatagtttttctgtaagaaaagcaaagctaatttccccatttcttgcctccaaagtttttaaaagatcagatcaaaacaccttatgctctgaaaccctatcctccgcccatcttttcagtacaatccttgctgccatgaaaaccctaaccctagaagaagttgcacaaatactcatgcatttgtttgagaaataactgacaatttcagtaccattcttcaatttgcaggtgtagctagctagctcgccggaaatggcatcctcgtcgagcaccagcaactccgccatctcctcggtggtcgcgtcggcggtggccacgacgacgccgggcgccggatcgccgtgcgcggcgtgcaagttcctg

SEQ ID NO: 61894 - DNA, 2061 bp, Oryza sativa
cgctcgcgtacgagaccgaggcccgcgtcaaggaccccgtctacggctgcgtcggcgccatctccgtcctccagcgccaggtccaccgcctccagaaggagctcgacaccgcgcacgccgagctcctccgctacgcctgcggcgaggtcggcatccccaccgcgctccccgtcaccgccgccccgaggctcgccgcggcaatgccggcaccaggccagctcgccgccgccgtcagtgccgggatgtacggcggcggccggaggctcggggtcatcgacggcggcgggatagcgccgccttccccccacacggccgggtgctactacgcccgcaacaacaacgccgggagcatcggcgctgacgtggcgcccgtcctaccttacgcttccgtggctaattggacagtgaacgccattagcaccaccaccaccaactcaggatcagagagcattgggatggatcacaaggaaggaggagacagcagcatgtgaattgaagcgcggcaaatagtaagtaacatttgagtgaatttgttgcattgcaatcatgcacgtatatgcatctgttcgctgtatgtatgtgttatcagtgtgctactactacttcttcttcagatgtggagatctgcgctttggccttgatgagagaggatcggagaggcttcaggaagatggcagcccattcatcccaggttaattaagagttaagaagcaacctatctatctatctatatatagccagcatgaattatatatatcatctccccgtccctttttgcatgttgtgcaaaaccatactttggagttctatatgtaatcgaatcgagatcttgatctctcgtcttttcatgattaattcgcgtttttcgcaggatccatcagtcattagtacgtagcatgctttgtgatcagaaaataaccacctttaggccgattaaacaatgcaccgaacacatctatcgataggtgaaaagatcctgcggcttgcatgcatgcatgagtaccaagctagctaacttggttgggctaattaaaggctacatgatctgcatcttatatcatatgtcataggcaccagtggcctatatgtttgcatatatgctccagatatacaccatcttgagatgcttaatagtcttgggggaaagattaaaacagttgtttattgagagcatcacatcgtttggtttgaagacattcttcgcttctatatatgttatagtaaactgtaaaggtaggaaaaaagcagtattcccgtcactattcttataggccccatctttttatggatctcactgtggtgcattgtacatgtatcatgtatttattctatcatctagaattctcctctttggaattaattgcctttttcactcccttgaagacttagtttggttaattagctattactctatatccccaccaaaaaaaatatattactactatattcttatgtgtgcttgcctgcttatatatatatttgtcatctttttgtggtcaatttactgaattgttgttcataggtattgaattttactcttattgcctttctgttttcttcctaaccatccccagttggaattcctggctgtacatgatgctgtcgttgatctgttttgaccacttgaatctactctcgaatttacctctattattgcaacaccgaagctaagtttcaaacttcctgttctctttcacaaaaaaattgaaacatctcatgggacgacctctctatcttgtatttgaacaaagtggagctccatttggaaaaagaaggtatatatttttcccttgttccaatctctgaacaatttcccttgaaattgttgcatttgttccaaattttactgaaaactatgtcctttcttgatatgtcatcaaaattttgttgccattaatttttgttttgaaagatattcttttgctgtgacatgatctttcattaaactgcatcgcaccacaatctcagctagagactttttttagtaagatggaaaatttagggagacaggtgtggattccatcgtacgttaattggacctcaagtatccagcattcttta

SEQ ID NO: 61895 - DNA, 9488 bp, Oryza sativa
atgcatatatatgcatgcacatagcctggcggattgcaagactgactagctagctatatttcttagtctcctttaaattttgaatatatatatccagttatccttcaactcttaaaactggcgagatttaatctgaattccacattaatttggttgtggtagcaaaaaagaacgaagataggggcgaaacttcacctatcagatagagaaaataagtgtatgctccagcgcttcactgagcaacatctatgacacccaccaccaccttgaatcccagtacttgtacaccatgtggatgccttgcatggtcaaatatattggtggaaggacctgtcctatccaattttgagagttgatgaatgagttttattgagtgttgaaatggatatacggaaattaaactgcaccagaattgagagatggaaagtagatttcttgtaataaattgttatagctttctactatctccattctcaaaaggatgacgtctagatagtgttccttttagattatcgatggatgaaaactcatgaattctgattatagagataaattaaatattatatataaattataaaggtccaaataatgcggtagacgaaagcttttcattttggagaaaatacattttttaaattgtggagtaaataatccgcagcaatagatgaataatctaaaaacaataagtggctttaaataggatgcatgcagttgaacctcaaaatcttgaattattaatagatgcaaaactaccatgatttgaaatgtgaaaaaaaatcatatcagtagatttaccatgaaaaactctttcatagaatattattaatcatttttatgaatatatggtttgagaaattaaattaaagataaacacgcgcattggtcgccgtgtcaatatataaccaggggacatttaattatttgcattatgtgtctatgacatgtgggttcagtgacaaatcgtttagaaccactcataagagtggcaaatagttaattattccatatcctaaacgtcatcctgttgagaacataggtggtagctagctaacaaggaacaagtaatgcgaaaagtcattcgcaaaaaaggtaaccccaataattaaaccaagtatgattgatggtccaggataaaaactattcgttagacttgatagtttacctggccatgcatcgaacgatcgagatcaagcaaatataatacatatgcatgcatatatatactacatgtaattcaaacatatggtcaattggatcaccgtcccagcaaacacattggcttgcaaatcgaaaaaaaaaacgaagatatttagacaagaactcacaccaatgaatctgtttctcgcattgcatgcatccatgaataaagatgagctcgtcatctccgatgattagaatggacgcagctagagacagagctagtggttgttgaggccaaaaaagcttctgctgtgacagcagcaatcacacattcacacttactaatcatgattcattgggcacctttacagccaataatgccagttttaaacctcccaattacaccattaactatatggcacaatcagagatcctctcgagacagctatcaatcaatggcgatcgaattaaacttaattgttggcactccatatatccagcagcagctgtagcagcagccagcagcatgtgatgtgagctactactgatactgatactgagctattgcgatcgcatgcgaagaagattcagtagaagttaattgcaagcttaatcagattcagtagcatttgagctgagctgagctgagatgatcatggggagagcagtggagcagcagcagggtggatgctgctcggagaagaagaagaagctgaggaaagggctatggtcgccggaggaggacgagcggctggcgacgcacatcgcgcggttcggcgtcagctgctggagctcggtgcccgacctcgccgggctgcagcgctgcggcaagagctgccgcctccggtggatgaactacctccgccccgacctcaagcgcggccgcttctcccaccacgaggaggagctcatcttggctctcatgacaagctcggcaacaggtagctagattattgctcgattaattgtttgctggattaatcatgaaacgattgatttgatcaatggagttcgtgttcatcgtccgtgcgtgttgccgtgttgtgcagctggtcacagatcgcggcgaggctgccggggaggtcggacaacgagatcaagaacttctggaacgcgcggctgcgcaagaagctccggcagacggagtcgtcgtcgtcggcgacgacggcggcgggggcggcggcgaccggacaccgccgcggcgaggctgaccggagtcgaccgccgccgcctgcatcgttcaacaccttctctcacgacgaccggacgactcctgctcctgccgcccacattgccgccgccgccgccgtcgaagcacccgcagcgatgacgacgacgggcggcgccgtcggcggcggtgttctcgtggacaacagtggtggtcaccgtgatgcggtggcggaggcggcgcggggacacgtcggcagcggcgacgacgatggcttcttggccgtgctgcttggggagtactacctcgacgccggcggccacggcgacggattcagcttcttgggcggcggcggcggcggccacgtgttcagctaatttgtaattagtttgcttgctttaatttgatcgtgtaatgatccatttcattggtttggggctgacaataattagcacacaagctcttgtttagttgtgtttgtcaaatcaaatgtgcaaaattaatctgaataaaattgttgatgatcgatcgatctctacttattcatttctcgtctctctcttgaaaatctagggagctccctatttcaggctaaatcactccgagagaaattcaaattccaaagagaagttttgaatgttaagctgtttggacacaattaattcaaccaaatttgaagagatgattgacaaaaaaaaaaagccctcgggagtgtcgagatggcgacatctcacaacatatcgcccaagaaactgatcctatatgtaccactttaagaatttaataacacgatttagacgaactaattatgcaataaaagtgtatatcagtatatgatatgctacgtgctaattaagtcattaacaatttgattaacaaattggtattgctactgagaaaggcaataactaaaatttaatttcctgcgcaaccagtttgatggagataccggggaagatactaataattcgagtaatccatggagtacaaaagataaactaattaagcaagcatgtcgagtggttggctactactaatactaatttatattcatgaatctatttacattttgtatatatactcaaataccaaccggacacctaatttcttgaattagtactacttgataccctttttaaaactatcatctagaagcttcttttcttaaactagaaagttcacgtgctaaattagccaaccctctatacacttgtatttgggccgacagcacagctagcttttatctgtagttgggctccacttctattagggccgaatgctagtctgggccttctatctctagcgctcttgggccgaatctgacgggagaatgcttccggcccatttcgaagtttgcactgaggtggtgagttggatatcaagattcgtgcaggtgcagctggttgagctgggtggcgacaaatcgaatcccagtcaaattgcacagatcttggagtggatctccctgcactgcattcgaaatttctagcggctcagggtgcagatctcgaggaaatttaacgtcggtaacagtgctgtcaaatgcatgggatcactctacctgcgacaagcgacgacgacgacagatagaaaacgatttacctgactacataaatttgttcttttttttaaaggatgggggagtattctgctaaacaaactaattaaccaaggaaaccaaggtgaaatccatctcataatattaatcataaggaatttcgatgtacttgtcacctccatcaactttaattcaattttctacctattttaaaccccaattatcgactcactagttagaaccaaatctcatttaatatcggtattctaatcttttcttactatccttaattttacccaaaagaaaataataatttatattatgacacagagagagtataccttcattcatagttttatgatgtgtctcatctagatctacattactatattttaaaacggagtatcatatactgctgcagtaactacaagctactataacaacttattgagaattctttcaagatgataatattgtttatagaagttcagaatgagacttctgtggtcaacgtttatagtaagcttggaataatattgcaagatacagatagtcagctgacacttgtgagatctaactctattataattggtgcactaatacccaagacttctgataactactagttaaactgtgaaatgtgtcagctagctataggttagcagatcgtcaatcaaaagaaaggtaatgattgtgatagtaaatctgccacccttttctagttccattgtaaattttacaaattagcctttgaatttcttattcatataaaaacaatcaataattaaatggcagccacatatttcctatagcaaaaagatatataacacgtttcatgagaaataaacttttatttattttagatattactataattttttttatctgtaacaaaatacaggcatttagctagtttatagagaagacaataatacctaggtatagtttcctagtactttcttggtgctgggctgctggcctccaggcttccaggaatccagttccttcacttgtataaataccctccctttggctacctcccttgatcgccaggcctacacattttcttcatctaattaagcctacacaatcaagtagagtactaacaagtagctccttgatcaattttccatttttttttcagtggcaacaatgtgtggctcatttgctccaaggtcatcgtctctgctgctgctgctaatcactctgctgcttgtcgttgtctcacgcccacaatattccttggatgctagcgcattatcaggtaaatgcacatattgttgtttacaacattgttcttgacattctgaaaatctctgaatatacatacatatgctgatctgttcatgcatatatgtatacgtacatagatcacctcgccgtcggcgatgcgccgccgccgccgccgcagcacggtgctggccggaggctactcagcacgcagaaccaggtgacgccgccaccgccggcgccggtgtcctcgccgccgataggccctgcgcctaccctgctgccgccgccgccgccggcaaaataaacggcggcgacgtatttgcaacctcacgacgaccagatgccacatgcatgtgtaccagaaacagattatgtcaaattgaattgatgcgtgtgtaatcaatgaatttatcttgcgaattgcgatcgatcgaaagaccattttctcgatcagctagcttgatgggatcatattcatatcctagctcaaaatttcatgaatcatttcgaataaaatcccccctcttctcatttgcgaggggctagctggaatcatggagtgaaatgcagttgcgacgactgacaggccgtcactttatgttccatgtacgatgaagagttgaacggcagcatgcgtcagcgtgtgaacagtctctactacgaaaaccatctttatgtacgaggaccctataaactacagacggatcataattagtcgtgtctgcaaaaattgaattacattttcgcatgcagttacaaaaggggaaaaaaatatgtcgtttcgaagatcggttgctagaacacgaaattaaccatgataatattgttataacatgccagataatgtccccgtttcaaaggtagcgaaaattcaactaagggcatgtataaaggtagagtctaatatgagctctctatattaattaatatcactagagactattctcctacaatagtagagacaataagatttctaaacaattaatgcactaaataatttttttattatacttatttccttttctctatcctcatgcaacaaattttccgttaataaatactaagagttgactctgagccgttgtcatgcgtagcaacaatgtttatccttattccctctctttcttccacgttattaaatttacttgcatgacaataaagagagtccgttattagacactattgtacatgcactaattccattgagaatgaggagttactatatacttgtgtgattttaattatggaaaaatcggtccgatttaaactaagagtatcaatacaaaattacatttaaaaattctcttaaataaaactttcaaatgtagttgtattatagtaattgaaatgtaactatattatagtttatttatttctaattcgcaaataactaagtaaaaacatgtccatacagcgatggctagcattattgccagcttgctgctagaaggtcgggctatatatatacggagaattttccacaccagggaaggaattgaacatgcccaacaatgaaatacaccagcgatcgctaatttcgtgattatttgtctgatttttgtgacgaaccggcgacaagtggaatctatagccgtgcccccaagctcgagcgagcgcgaatctcgaggcaattagcccgaccacctaggccggactactgcgccgatcacatggcgaaacctcggctggaacaaacacgtacgtacaacaatctggctggctgtccgatgcagcgtctccatcatcgttcgttcagtctatgctcccttatgagtatttccgcctttctaatataggttaatttttttatccatctcacacgtatcaattgaaaaaacttaaaaaaaacttcatttcttaaaccacaatacaattattctctattttatctactcctgatgcatttatccatttttttaaataatggaatgagtaacatcccggctacagccattattacaatctagcactttagaagagtatagttcaaaataaagcgaatcacaccaaaccaaattaaaggaaaaccaaacaggacaaggagaacattattccaatctattattgaatctccatccgtggttggcaaaaagttacataaccgtcatctcaagcttacgacatgcaacaatcaaaaactctccatcttcatcacacttcttttgtaactgagcccactgccggagccattacttttatatattctagtgtgtaatattagctgaaaaataaatttattttgggatcaatgggagggatgaaaaatgaacccactcagagacggaggaattaataagacaattttctttacacgtgtactagtacttttgcaatgcttatgcattcaacctatataatctgcctaaatgcctaattaacatttcagatgtaactacatactccctccgttaaaaaaaaataataaccaacattgagctatgaatctgaatgagccgaattcatagctaggagtcgttctttttttttttttacttacggagttgtgtattgcggcaagcttgctggctctgaactttttagcttgtctttaatccattctgcatgagtacttgtgcagattgggtagcagcgcgacgggcgtctcatcgtcagcggcaatacagcgcggcggcggcggtggcttcagcagcagctctccagccagcctccctcgtctccggcgaccgtaccgccgccgccgatgtgcctgacacggccggcgtgcagcagcctgaaaatttaaactcaatttgtgtggttagttcgactgttcatgttggagaattagttgggcctgggcctcccaaccagaatgggcctaatgtcgagcggcccaaagctagcccaacaaccagttgcatccgagagtaatgctcttttcagagcagtctctctcgcagaaagaaaatggaagagctagcagagaaatcttccagctgcagcttgcagataatgatgatcaatcaccacccctacagtgatatattgtactactactcatctgcagccaatttggcaacttgatctcattatctcgacttctttagttagtactgatccagagattcccttctactactacctgttgtgatcttttcaactaaccggcagtcagtcatcacaaggaaaaagcctggaagtctacatgaagtgcatcactgcatgatgcttcttctacttgcctgtcgatcaaaagttgacgacggaccagccaagaatgaagaatatatgcatatataaccggataagtttagctttagcctgaaagaagttaagagatgcatggatatgatgagaatgagagaccaataatatgtactctatgtactattactatactcaagcagacagaagaagagacaggctatggctgcttctctgaatgtgttacagtagtgtcaagcacctgaacattggagtaggttccatggctgctttcttcagagttcagggactctcctacctatagcaaagtgtagtagtagtagcacttgatcagactgcatgctttaattatgtcatcagatgctctagcttgatgctagctgtaacctcctaacacttttggaagtgactagaaagatctgacaaaggttactaaactggagtagagctaaacccagtcaaagaaactgttagctggccggcatggccggctttctgctttgctttgccatgccatgccatgccatgtactgtgtgcaccatactactcctactactactctatcaatgctcttatatacgacaagcgatcactaaagctagctagaagaagaagcatgggatctgcaggcccttgttagttttgggcatttgctagctgctatgtacacttgttttacttgtctgcatccatgctttgctttctcgttctttcttgtgactcatgagaattcagattcagggtcagtttggtgttttggttggagggatgaacatggagacggcatctcacttttgctagtgtttcgatctggtcgatgcgcaccgcccattttgatactggccccaaaattaagttaccacttatttgaactaggttttaatgcacattccaatataataatcccatcacttaaacttgattttgaattaggagagatacagatcgtcaaacttggagtcgttgaaatgctatatttataattagacatattattattgataaattaatactgattttattaagagatttgcttcggtccaacaaaaagtacctctaggtaccggtaactcacagtaccaagctagatccaatgatcggaaacgatttgataccgtgaggtaccagtatctcgaggtactttttgttggaccagagcaaatctcttttattaaacccaaaatggaacacaagtatcacccaataacaaaacgctccattat

SEQ ID NO: 61896 - DNA, 5031 bp, Oryza sativa
  unsure (1)..(5031): unsure at all n locations
ggggggagtgggggtgggccctctgatgtttgctgcttgtgtggcggcaaagagcggtgggcaccatacgaagtaggccgggcatgcaagctgtcgtggcacctaggggaggaggagaaaggagggttctttgctgcttgatcttctctttcttttcttattctttacttcgacgacagcatgtggcctcgagagagagggagctagggtttccatggaggagaatggcggtcatggatgcactgcagcggctatgcgaggagctccctcattccttctcgggccaagggggcggtgctttaccaccgcgctggctgttgcctccccattcgcctccctcactggcgccggcctcctcgtggcaaccacatttaaaaatgaggtggagagagatggggaagaaagaagaaggtgtgaaatcattgtcatgattaatatttgtgatgaacaattggctttgcaaaatgatttaatcaatgaagtggtttggaaattatgtgtggatgttggtgtgagtgcgtgtgactaatgtgggtcaggttatgatatctgtgcccagaaacggttgttttgtctgattgtgtgcaggtgacttgaggtcagccttggttaatggtgaggaccgggactatactcagggagaagcagaggtctagtgctgtcggaataccatgtgagaaggtgactagagtcaggattcttagaggtcaacttcgatcaacagtggggatcgggactagactcaggaagaagttgagatccagacggtcaaggataccgggtgacgaagttggatacgagatggcatacggtggatggacaccgtgtgggagagatcttcgcaacgggcttcacgaggtgtgcgtgcaagcgtcggtgttcgcgaaggaaattgagtgataatatttggaggagtatttggttgctacagtacccatggtactgtagcgtggtgcatatgcatgccgttgcatgcatgtgtgtgtgttgcatgtacggtgctgtacatgtgctgatgtgcagcttgctgcttggctcggcctgggaggagaccaagaccgtgtgctatatggagatgtgacgtgttgacgtcggattggagggactagttggagtccggttcagtttggatcttcggcagctgatgatgccggtttcgatggagagaggattacaatttggaaattgtaatttgatttggtaactgaggttagagtcttagtggaactaggcgttatactcctactttgagtaggaggttttttattttataaatagagagggaggggtggcctcccgctatcgctttgagagcaattgagttgatagtttagttagggtttcgagtttagtcgagatttttgtaaggagtgctgttgttgcactttgtaaacacagagagaagcaataaagttgtcatctactttgagcgttcttcgatttgtgtttcttcggattcaggcggcagcaaggtggttcaaccgttggcgtgtgagcaatccgaccggcggcgacaggactacgtcaagatttccatcgatttgagggtaacttttatttccgctaaaagtttttgggtttttagtttccaatttggatttcagctaaaatctcggacatttcagtagaacagaaatttcggtattttttggaccgaaattttctaaaattttgacacaatttaactgaatttgactaaattcacaaaaaaaagagaaaaactggaaattaggcagagatattggcttgcgggaggggggggtccgaaattttggaaatttcgaaacgaaatttcaatccctgtttataagatgacaaaaaaacgtgacgacgatgacacggtttcaattttgtgtgggtacgaatagaagaatagtaatgacatttatctaaattgatactcctacatttgtaatgaacatggatacaattaacccaatatatgagatattcttaggtcaaccatgtagtcgatgttgaaggggaaaggcacgaggattgaccctttcatatatgctgtacaatgcactatatatgttcgcacgcacgcataggtaggcaagaaagagaggagagggaacagtataccaaggcgaagccggccggagttaaggtaaaacgtaccagtagctactcctaggtacgtgtgggagtcgacgcaacgtacagtgggcgtccgtccgatcggtcggtcggctggtcgccgacgtgacacatttacttcgccgcgcggctcgtcgccggccggccgtcgtgtgcgtgattcacctaatcacaaaaggagatactactactctgtagagagctatactatagcctacgctactgttgggtgggtgtatagctagctttgcagttgcagtcgttgcattgcatgccgctgacacgcatgtgcgatatgtgaccagtgcccctagctactcctagacgctactggggcctaccctattaaccgctgtaaaaaaaaaaaccggtttccgtgtccaatgtttgaccgttcgttttatttaaaaaaattatgaaaaaaattaaaaagacaagtattaatcatgttttatcatctaacaacacatcttcttctatattgagttttttttggacggagagagtatgtcgtatatgtatgtacgactcctacatgcgcttgtacaggatacagccgtacgttatactccgtacgagtacggctttgtcgggcacctacgttcgcgcatcttcttaactttatctttcccgccttaacaaaaagaactttttttcctcgcacgtacataagcttgatcgatccatccataccgtccacgtagcagctgctcacctcctccgatccgtgtcttccacaagtctaacgggtatttctttttttaaaaaaaaaacacagtacaaacacaaacgctcacaagacgcacccactcacccctatgaacgtatacacgcaccctttatctttatgagcacttccgaaaaactgaaccaacatatcttaatattgataaagtcaccacgagcgcattgttgtcgatgtcgatgaggacattagtaaaagcacccgtgttaaatttaaaatttaaactcggacatgctgattccatcacaaggaacgatctaacgggtatttaaaggacaccaacacgcttgtgttttgtaatggacctatttaactggtcatgtgtcacatgaatccatacataattagggatggataaaagtgtggattgaattgatcatgaaacatcggagtgttttttggttaactaacttaatacgatagactctctccgtttcaaaatatttgacaccgttgactttttagcacatgtttgaccgttcgtcttattaaaaaaatttgtgaaatatgtaaaactatatgtgtacataaaagtatatttaacaatgaatcaaatgatatgaaaagaataaataattacttaaattttttgaataagacgaatagtcaaacacgtactaaaaaatcaacggtttcaaatattttgaatttgaaacggagggagtatattgttaaatgaataataaaaacaggagaagtacagattaggagcacaaatagggataacacgagtcactccatgcataggtgctcatgcatcacatccttccacaaaggccaatagggtatgatagggtgtgcataggtggacaaatatctcaaccaaagtcgccattgaaaataaagcgtgtggcaatcacgcgcaaccaataatttgttgcacagaccgatgttgtccacgccaaatactccgtaactaaaaacttatattggagctattaatatattctagtgatacctataatgtaacaatccccgactgtccttttattttttttaaaaaaacattctttgcgtgttacactaagataaaccattctccttaatttgatagccacatcacattttttgctgccacagtttgttagacatgtgtttggttcactaccacagttatggcttgccacactttttcaatatcatgtcccacatgtcatagacttaattttcttgcaaactttgccacattttgtggctagcaatttgtccatcatacttttgtggctgtcacaacttgcctaacgttagttgtggcaaagtgtggccagcaaccaaacacactctgcatgttgtgtcaccgtgaatgtgatttacatatgtatgaaaatattcgcacatcttccattatcttaaaaaaaatacgcgatatatttgcgcctttaattaattactaacggtgttaatttttatgtcagaactgggtacaaaatgatgccatggatcagccagcagacatgtaccaataatcatcagcaccaaccggtcggccggcctgtgagctctcctccatccaaaacgatcaatataatggcatgaacagcacacatcacacatatacgaacgtgtaactagcgctagagctacagagaaatctctcttttctctccctttgtggtgggggctataggtagctatagcaagagctagctactacttgatgtgatttttactggtcataataattttcttaatacgggaaacagcccaattattcatctacatggctacacatgaacagtgtgaagaaacagttgccatggactattcagctgaccggtagaggcccacaacatactgcacgtacaggngaggccggccattccatacatgcattgcataaagaacacaatcatatccatgcgtgtacgcacatatatggatatctgccttttttttcacatagatatgtatatatgtataaagatatacgtctgcggtttcatataataaggctttagagcagcgtatacattcatatatatatatatatatatatacacacacacatgtgcctagattcattaacatatatatcaatgtgggcaatgctagaaagtcttgtcacctgaaacgtagggagctcagcatgcatagtctcgaaatataaatatttatagctatgaatctgaacatttgtctttttagattcacagttaaaagttgttatattttcgaatggaggc

SEQ ID NO: 61897 - DNA, 2985 bp, Oryza sativa
  unsure (1)..(2985): unsure at all n locations
cttttatataaacatcaagatgcaaagttttgccaaaagcttatcttttacccattgggatttattagctactttaatttatacccagagcaatcatttggctagtgcgctggttgattattgtatgcccatttaatgagaaaagtgaaattcacctaaaaagctaaccaatatttatatggatcgtactgaaactttttgaagtcatttggagatttgattgatatgtagcgaactttcatcgtccaattctttttttttggggggtggggggggggggggggcntactgcaatcaaaagagtgtatagtgtactagtactagacagacaaaaaaatttttttggacaagatgaaatatgcgttaacaggatgtgctaatataagggtgcttagagagaaaaaaaagagtgtgtagtagacaaaccaaatgaaatatatatgtcgtacataattaaacacatctcttctccagtgcaagcgtcttctcagacaaatataatgtggtgagatttcaacataagctcctactaatcatcgatgcttcatcaaagcatcggtggctcatgacaaggaatttagcaccttcctatcctacaagagaaaacggtaccccctccgtttcataatgtaaatcattctagcatttcccacatttatattaatgttaatgtaaatgggaagtatttggcatgcttcacataagcatgcatctatatgggggcacttgcattggagataacctcggaacgccatgcatccaacaccgtctcaagacttggagatatctactccctccgtctttttaatagattatgtcattgattttcagtcttttcaataaataacaacgataacttttagatatatttttatcattcgtcttatttataaagttatgcatatataaaaaaatctaaattatacttaaaatatcgttaatgataaaacaagtgagataaataataattacataaatttttaataagattatgttgaaaaataaaagttgtagtctatataaaaaaaaagagaggcagtattgattattgggaatatctgcctatgtagtaccggctgcgtattgagttacattgttacatatgtaatgtttataggtatgcacacttggatttcatcactagtatgcgtcgagagcactatcagatagtactatcaactccttgtacggcagagatgtttcctactcaaacggatgtatttatccctcaaatcaatacatgttactcgacttggtttggggtgtgtttagttcacgccaaaattgaaagtttaagtgaaattaaaacgatgtgatgaaaaagttgaaagtttgtgtgtgtaagaaagttttgatgtgatggaaaagttgaaaatttaaagaaaaagttgagaactaaaccagaccttggttgaaccggactgaaccaagcaatctctcctcaatctcctccaagacccctaatgtgttggctacaagtacatttgcaacttttccaaaattttaatttttcctcaaatttttaaactgcacgttgtgcaacattctagctatcatcaccctaagtgcattgccatttgctaccatacatcatactctttcggtcgtaaaataaatatacctattacaggatgtgacatattctagtatcgtgaatttggacagtgtacgagatgcaaacattttggagtttgaaaatgtgaaaaatcattatattagtcttttcggtgatatgcgtgagataagtaaaaattgatatctttcagatgaagatagtagctgagatgacacatgagtcttcaagtctgcgttcgacgggccctctttctatcttccactcattcatttttttaagtacgcttttcgaagtactatattatatttttaataattttttattaaaaaattactttaaaaataaaattaatttattatttacaatatttacgactaattaatcatgtatctttactcccccgtcttataaaaaataaatctagtaggaggtgtgacacatcttgatactacaaatctttatagaagtctattcaggccttgtttaggtccaaagtttttttttccaaacttacaactttccatcacatcaaacctttcgtatacacataacttttcagtcacatcgtctccaatttcaaccaaatttcaaactttgggccgaactaaacatagcctcagattcatagcgatagaatgtgtcgtatcccgagctagttttgttcgaacatacagcctcatcttttcgcatatgttttgcttaccagccaaaatttgaattttcgaccttacatttggagttgattttgggttttttttatcgtagtttatttttcagcctatactcgctaagaacacgtatataaaagttttattcaccgattaattttcgtttgcaaactgaataaaacaaacaatgggcatagtctcaggactcaggagtggtcctggactcgtggtacgagtagtataaatgtgcctgtgaagcctgtagtacactagtacctctgtactagaccattaccccctcctttaattctctcgaactacgactagcttcgagctttcatcactcgtcagcttgagcgcccagcagctatcgtcagcttaaaattagcgccccagcttagcttctgagctgactcgagcttgaagacagattttggtcgcatttcagctaacacaaagcttaacacacgagctcttgtcagctgatcgatccggggttgaagagatattggttggtttctgtgagcttgaaagaaatcacttgctgttccaagcaatctcgttttctttattgtaatccaggatgactgatttttcctttttcagcagaaaaagaagaagaagaagaagaatcaagcttggtgcacggcgtcgccgccatggcggcattgcgcgtgggcacgagggcggtggaagggaggttccaagcgagcaacggcggcggcggcggtggcggcggcg

SEQ ID NO: 61898 - DNA, 8992 bp, Oryza sativa
cggtgacgacggattccgttatcaaccttgaccagtgagttcctcctcctcctttccctcctcttttattcctttcttagctgttctacccatcaaggcatcaatcaactagaaaaagaaaagaaaaggagaagcaaagaaaaaaaatctgcaagttgccatgggtggatgtgtgggcgcgcgcgaggtgttcgtcccaataaagcatgtcattgtcaaggaggaatgaaccaacgaacgccgatctatggcggattttctccagatttacgcgcgattgattcgatgcatgcaccttgttcaaatttcgtctctaaactcgattgaatatcaaatatagatagaaaatggagttctgacattcttgggtgctgcgcagcggcgacccgaccatgttcgaggagttctggagggagaccggcgacgcggcggaggtcgtcatcccggggtggcagacgatgagctacttctccgacgtgaccaacgtctgctggttcctcgagccggagctcgaccgccaggtgcgccgcctccaccgagtcgtcggcaacgccgccgtcgacggctaccacgtcctcgtcggcaccggctccacccagctcttcatggccgcgctctacgccctcgcccccgacgccgccgccgctgccgccggcgagcccatcagcgtcgtctccactgcgccctactactcggtaattaagcgcataaagtattactccctccgtccaaaaatataaaaacccagtaccggtattattaactacgaatctatacagaaaatagacatattgcttagtatcttgaggtaccggtacctaacgatacaaaatcgttttttatcgttggatataataatgtctatcctgtccagttagatctatcaatcagaaacgatttagtaacctgagttaccagtactttaagatactttttatttgattagaacaaatctttaggagtatgaccagactcgtagtactataaaatgtctgatccgttattaggtttatatgttttgggacggagggagtatacaatactaagggtgtgtttgagaaggagaggattgaggagattaggaagatacgcaaaacgaggtgagccattagcacatgattaattgagtattaattattttaaacttcaaaaatggattaatatgacttttaaagcaactttcctataaatttttttgtaaaaaacacaccgtttaatagttcgggaaggacaaaactatctttctctctttctcctgcgcgctaacgcagcctaattcaaccagacagcaacaaacagaggtgacagatgagatgcatcgttgtcgagtgtatcaaaatttttgcatcaaactgcatgaaaaagaaaaatgtttttggcgacaaggatatatagcaaaagcggatttgcctaatgtcacaatcatatcattccccactaaaatgatgtgatagagctgaattaagagagtggggcagcacattgatgctgccccctaattccccctaattctttgcattggtcacctctctctctctctccatctttatcatatgatggttggtgatgattgatgaagcatatgatgtgtcgctaaatgctactagtaaacatctctgaataatctcatagtatcaagcttgggggatcgaatcaaatcatgtttctttgtagggtcggaagctttgatcatagatggtttgctgcgatttgtagggtagccgacatgtttctttaacaaagggcctgttaattaggcttaaccaagtctgaatcttacttctgcttatttagtaccataaaaaatatactgaagctctgcatgtgcagatgtgctgatcactgatgagaatatctgatcataaggtcacacatggccggccggcacgccgccttatgcgatttctgtttgttcaaatcttgttttagtttatattttttgtggtttggttgatcgatctgtagttgattaacctgagaaaacatagaagtagcgtgtcatgaactcatgattccattgtcatgtgccccgcgacatatctagtgatagatcatgtgtgttcagttatggccctcatgggaggtcggtgtgctaacttcttagtttattattcccttttgcattatagttccaaatatatttttttaactgtaccaatgattggtagaaaagaaaaaaaaaacagagcacactctgactttcttcttttgattttctgaagaatttcactctctgacagtgattaagttcagtttcagtttcactgacctgatccgatctgatcttggatgcagtcataccccgccgtgacggacttcctccggtcggggctcttccggtgggccggcgacgccgacgccttcaaaggcgactcctacattgagctggtctgctccccgaacaatcctgacggcgccatccgtgaagctgttcttgatccaaagaccggcaatggcaggacggtccatgacctggcctactactggcctcagtacacccccatcaccaagcgtgcttcccatgacatcatgctcttcaccgtctccaagagcaccggccatgccgggaccaggatcgggtatgtagatagagcttttcggtcgaactggttggtgcatgaaacacggtcgttttgagtagtgtaaactgagttgaatgtttttgtgtgtgtgtgaaggtgggcgttggtgaaggaccgggcgatcgcgaggaagatgacgaagtttgtggagctgaacacgatcggggtgtccaaggactcgcagatgcgggcggccaaggtgctcgccgccgtctccgacggctacgagcggcggccggagcagacgaaagagacgatgaccactcctcttcgcctgttcgactttggtcgacgcaagatggtggagcggtggagcatgctccgcgctgctgccgccgcctccggcatcttcagcctcccggaggagacctccggcttctgcaacttcaccaaggagaccgccgcgaccaaccctggtatgatttgatggataagatttttattcctcaagagggcatcccctattgtttacatgacatctaaatagttattaaaatttttttaaaaaaatgacaatataaattaatatgaaatatatcactctataaacatgtaagattaaattcagcttttaccagatgaaaaaaaaataaattaaactgaaaatagttatcatacatccacatctatatttattatttttgtggatgttacctcgatctcattggctttgctcatcgtatcaatggcggtgtgccggtgtggatgtggtttgcagcgttcgcgtggctgcggtgcgatagggaggatgtggaggattgtgcggggtttctccgtgggcacaagatcctgacgaggagcggggcgcagttcggggcggatgcgaggtacgtgcgggtgagcatgctcgacagggacgacgcgttcgacatcttcatcaaccgcctctcgtcgctcaagtgaaagaagacggcggagagagagaggacgctgcagcgtgttcgtccgtgcgctagcaagcaaagcatgcccatgactcatgagagcatgagtagaaccgttaactgtgtatctgtatcagtatttggagagcctttttggtagagcttcagagcataaccaaacggtttcagctttactcgaaatgggagtgaggttgattgaagtgctatcacagaatgatctagagatgtagagttggatttagactattttacagctacactttagaaccaactcttgaagttaaatttgtaagttgaagtcctgccaaataggttctcagtagtagtagtaggtagaagaagaggagcttgcttttctctagcttttctttttctcttaaatatttgtttctcgatgttgtgttttatggttaagaatggcctgcaatgtagatcagtgcctgcgtgatttcacatacggaaaataaataaataaatgttcttgttcttccttttttggaagatctaatgtttcaacgagtacttcctttgtccaaaaaaagacaaaccctgagttttcatgtccaacgtttgaccgtccgtcttatttgaaaaaaatatgaaaaaaaaataaaaagacaagtcacgcataaagtattaatcatgttttatcatctaacaacaatgaaaatactaattataaaaaaatttcatataagacgacagtcaaacgttggatacgaaaacccagggtatgtctttttttggacggagggagtagttgttttctctgttagatggaaataaattgcgttgatgggtgtaaataaatataacaatttgcaaatcgctaattcatatacaacttgtcgagtccatgcgaacttgggccaaaatgatgaacacaagcaaaattgatctaacatgagtgcactgatatgtaatattattacacaacaaattttagcctggcaaaatgtgtatttttaagttttatatatgacaaaaatgcaaaacgatcaaaaagcccaaccttgaaaataaacttttgatgaaaatggagtatttgaacatgaaaattaaaatgaactatttcaggagttgagttacttgtacaaaggtatgacaaaaaaattgtcttagtgctgatcataaaatgaacattggacattgttttttccaagacataaaatgaatctcctttgtcctgaacatgaaaaatgaacttttgtacaactgatttgtctttttttagattccaaataagatattcaaacattgtcattacgataaaactgccagataagattctcgaaacatggttcgtaagataaaaactgccacatcatcagggtaggccatgtcagaccaattttgcttatgtggattattttgtcatgggttcgtgcggactaaccaattaatttttaccgaaatgaataatttgtaagttgctatacctatttacatcaatcacgtaagttcacgtccagtcttcgatatctttcagtagcacatgaaggaaaatggaaaaaaagaagatgagtgactcgaactcgaagagaaaataaagcccagttttgctagaggccacctcaagagatttggcccatagcctgcggcaaccctaggctctctgaggaataagatcactttgactccctcaactgaccaccgaatctaaatcgtatccctcaactgcaataccagaaatcttgaccccttgaacttgcaaaaccggtgcaatttaacttccttggtggttttggatggtggtttcgctgacgtggcgcacacgtggcagtgttgacctggtttttgttccacgtggcattgacgtggcgcttacgtgcattaaaataaaaaaaatatgtgggcccatttatcattcacacaaaaaaaaattgtgggacccactgacatgtgggtcccacatgtcatcttctctctcactacccttcttcctcctctctcccttatttctctctctctctccccttgacatgagccggcggcaggggctcggtggcggcatcggcgagtgggtgtcggagtggtggctgcgatgggcggtggacctcgggcgacaagcacgggagcagctcctccttgaaatgggcggtggacctcgggcgacgtgcaacgaaatgcgtcgggggagatgggagcacgctcccagctgccgctcctcgtccccactctgtgtcgtgggcagtgaggtgggcggcggccgcagcgtcgacggcaaggtgggcggtgcccgcggtggaaagggagcaatagcttgcgcgccccaacgcgcggcggcggactggccgagcgctccggcgtcgaccaggccatgatgcggagcagcgactggagctcctcctcctcctccgacacgggccccctccccgaccacgtccgccgcgagaccgcccccttttcctcttggacttgccgccggccgcgctcgcggcgacctcgcagagactcgggaagttggcggcaggagcaggaggctcggtggccgccggggcggcaacgttctcgccggggcgccaccatccctatctccccgtggcactagcaccgctccagtcccggacccgctgaagccaaatccttgctactgcggcggcggcggcggaggggacgcgaagaccatcggctgctgctgcatggcaaagcgcggccctagcctcgccgccatcatcccccgcggcgagcgcaccaccgatgccacgaacgcctcggcctccacgaatgccacgccgccgccggcctccacgacgatggacagcgacccctcctcctcctcctcctcctcctccggcgagtagaccagcgcaccggcgaagcggtagaacgccgggagcaacgcctcgagggagtccctgagtgcgtggacaacgtctccgaatggtggtgggggcggacgagcaggagcgcgacccagtacgcgtcgaatggggagagcagcacgcggcagcagccgccgccatctccatgcgtcgggagcgcgacggaggtgacgctcctcgtgcacaccgacggcggcggctgcggcatctcagcgacggcgaactcctccgccgtgttccgaatctcgccaaagcttgtggggtggtttgacccccactatacgccgtcgccgcattgtccgccgtcgccgctccgtccatcgcccgccgtcaccgccgccgttccggacgccgctctcgcatgaagagaaagagggacagatagagaagggaggagagggaggaggaagaagggataagggatgatgatacgtgggaccaataggtcccacgattttttttttgtgaatgacaaatgggcccgcatatatttttttatgttaattccacatcagcgctacgtcaatgccacgtggtacaaagactagttcaacactgccacgtgtgcgctacgtcagcgaaaccaccctccaaaaccaccgagagagtcaaattgcaccggttttgtaagttcgggggtcaagatttctggtattgcggttgagggatacgatttagattcggcggtcagttgagggagtcaaagtgatcttattccgctctctgatgcgtccgaagagaggcccacctgagttgggcctagtgggcttagttgcttgcgagacttagaagtgggccctaaaaggccacgcggaattgaacgctacagaaaccaattccggccacgttctcttcttctccccgcagcccacagtgtccgcgagagagagagagagagagagagagagagtagactagagacgcctccgcctccgcctccggccaccgcatcgccatggcctcctcctcctccgccgccgcggcggcggcgggggcgggggcgggggcggtggcgttggggcgactcgtcgaccgcacccgcgtccccgaccccaccctgcagcggcacgccgtcgcggccctcttccgccacctcctcacctccgtgcccccgccactcccctccgcggcgcacgacgcgctctcctcgctcctcgcgtcgccgcacccggccgtcgcggcgcacgccgcggcgtccgtcgcccgactcgccgcatcccgcgccgacctcctctccccggagctcgccctcccgctcctcatcgcgcccctctccgcctccccgtccccgcgcctcgcctcctgcttcgtcaaggccgtcgccgcgctcgtctcctgcgcgcttcgctccggctccgccgcgtcgcgcttcccgccccacgatcacccgttcgtccaggcgctcgcctcgggggccgatggcgcgcgcgcggagctgcagcggcaggcggccaggttggtcgccgagggggtacacggggttgtagggtttttgaggccattcgttatgtttgctgcggtgaggaagggggacactgcgttcgtgaaggatttgattggcgcactggccgcagcggctgttgcagcggcaaggccggattctgcagtcccggtgctgaaattgcttgcggagtgcttgctgcattttggccgtggggatggtgaggtatgttgtccttgtctgatgtctcagtgcttatgcttaaacagtcctgaactcctggatgttttagtattgtttaatatgagattagtagatagatcatattgtaggaatgttgctgcatcctgtagtgcctaaattgaatttgtgtgtgtttgttagagtattactttactttgttgtcaaagggatcaacagagtttgagcttatttgtgcttacttttcttcaggaagtgcggctctggcttagctccgtggagtgcttggtggatgcttatgtggtattattgaggaagtttgctcatgctcaaatggtacctctctctcccatttgcttgatttctcgaacggaattcttcctggtttatcccatttgcttgatttctcgaacggaattcttcctggtttattgatattctaagatttactcacattggttatttcattatgaattagagtatcgattaatccatgtacttgtccgtgtttcctgaattagcaacaaacattatatctgtgctcttaatagagctttcatctgctaggatttaggagttatgtaatagattaggaactaattttttggacatgattttttactcagtaattcttaccttgcaaagtttatcaccctccaaaaacacaagttattggggattatgtagttgccttatgtacccacccattttgccaggttttgtttgtggatgttatactgcctatatactgatcactattttttatactggagattgtacttgttctatattggcaatacggctagaaggatctgggcgcattggatgcttactttgttatatttacttgatttcaaatgctattatagtatgagtcatagatatgctataacttgcttcttttaacacttaacaggcaacttatgatgcccaagcaaatagtgtggagttgatacaaatgcttctatcacaatgctcacttcatcaccaatttatgggaaatacttctgttgtacttggattatcaaaacatttgtt

SEQ ID NO: 61899 - DNA, 2340 bp, Oryza sativa
aacgtttgaccgttcatcttatttgaaaaacaattatgattagtatttttattgttattagatgataatacatgaatagtactttatgtgtgactaatatttttaattttttttcataaaattttcaaataagacagacggttaaaacgttggacacggatatctatggctgcacttattttgggacggaggtagtatttgctagttgtttgttattggagatatttaaatacattttcttgtactagccatttgtactgtaacaaatcaaatagggaaatatcatcaataatctgtaactaatgatgatactcagtaacaagatatgggtcatacatacacaatgttttcaaccttcttgttgactatgaaatgcataaactattttttgctgcacatcatgctatgatcgtacattggaatactagaaacaaagtggaaagcagcaccataataattatgctgcaaaacaagtggaagctagccaaggaagcaacgtgtctgctaacttgccctaacttagaattaattgggccagctgcaagctacaggcccatacacactagagaagattacttgtcttaatgcgttgattgagcggattaataagacgattaaccattaattgaccaattaattggtccagttggccactttggcgttcactgagcaaaatcctgcactgaattacaagtacatgacgctttccttttcacacatgaataaatggccaattatacaggcgtatcagctgacttttaccacactgcttcacggtaataacttgcctgattttatctggtcatgcattccttaaacatttcacaccatttttattttttttaagaaatcgtcaattaagttattaagttaaaaaagtttacattttcagatgcctttccagcaaaagctaacttgaagattcatcacatcatttcatcaatcatcagaagcgcaaaactttaaaaaaaaagatatggaaaaacagtcaacgtgatatgcagaacagcttcttgaactgacaaggctaatccgtacaggagttgaaaaattacgattcaatctattccagaagttccatgtcctgagcagttactatgaacggtgaaaacagagagatatactaacctttcatgaatgacaatgatgagctagcattggatccagtgttcgtttgaataagaggatctatagaactagaagagttctggtgatccatccgtggaccttcaagactgcgctgttcattactagcatcttcccctgcaactctcactcttaaactgaaaatatgaacagttcctttgtcactggacactgccaaccactgcacattgggtgatagcgcaatgctgtatatgtctgctttgtcaagccctctgcgcacctacaagttattcagattgatcattaaagattcatgccaattgtccacgattacatataccagaaacacttctaaggcaacaactcaggaagcaatggaatagagaagacacccttctgtttgtctacgaaagaaaaaaagaaagaacatgttgttcacctcttgcaggcgagtaccatccattgtgttgaatattcttatcaaagtacccttcatgcttgctgttgccagcaggaggccatccattgtcaatgccatgcaagaaatgtgagaatcatgagctgaaatcatccttgtcaccttcaacccaaaatgctcaacccggacatgcccttgatgcaccccagggcaggccaacactgaagtgttggaatgatgagagaggcagcacaatccttttggattggactgggtctcaatctgatggagcaacttcaaatctgtgaagttataaacgtatatcttgcgctcaagaacaatgacaatgtagtccttccccaattttacagcccggacatcagagcggaaggcaaactctccaatacaatggctccggtgatcatcccagatcattaccttgttcggtggataatgtgcgttggagccaccacctacaagagcaaggatgttgcaacggaacagcatttcaacaatcccaaatccaccactcttcagatccctcctgaaagtctccttaaaagggtcacaattaaagatcctgaagccattgctggttccagcagcgaagcaaccaaagtcctgattccaagaaacagacaacagcctgatatcctggtcatcgctgctaccagcttcagcctggcctgtaggacctgacatttgccatgtgtgaggggactcaaatgtcccaagcttgcttggggagggcaaaccccgtgatgtggagacttgtgagctcatgtgaggggtggacaagccagatcaatcaattg

SEQ ID NO: 61900 - DNA, 4956 bp, Oryza sativa
tacttgtctaatgtcactgatatgtgagccagaaacgacagattgcaatgactttacaaaaggattgcaacgattttacaaaaggacatctttacatttcggatcagaagagaaaaagaagaaaaggcttgatcagaagaggaagaaaaggttcatcaagtgcattcttactgtccactgccctgatagaatcttgtcggggccgaggttttctcactttctttttgtcctcaattccctggaattgtgataatcctcttggcaaagttgccggggttgtttgagattgctggattgaaggtacgatgggattgttcattttgctaccattttcaatcttattttatttagcaatttttttaaaaaaactagctacatttagtttattgctaaattttagtaagtacatatgaaatcttgccaaaatttggcaatcttatcaaaattttgacaaccttaccaaaatttgacaatgccaaaacttggtaaggttgataatagtagcaaagtgaacaagcccgatacctgtcactgtatgtgggcccactacttcttcaccgcgtgcataaaggtttctctgagagagagagagagagaaaaaaaaaagcaagatgctagtgcactgtactgtgccaaattggctagctaattgcagccattgatgaccagaagatggagctgatgatccatgtgtttgtgactttgtggaattgttgtgccaggaatgaggggaacataactatttggatgattgccgtgtttgtacgtacctagaggccatatgttgcttccaggtgtgcttgtcgggagtgcggaccgcggaagcgttctttttttctccctcgatgaaattttaaacaactggaaatttttcacaatgttattatgactggaatttgaattttatgttattgttatatggcaattcataatattgttaagtatacaaacgtatgtagtgtttctaaaatttgttttatctacacatagacaacataggggaacgataatcttactcgatgaatagatgatatgaataaaaaaaagtcacataaggagatactccatacaatacattatgatagcacgtaaccaccaacggatcagaccgtttctatcggtaaattaggaataagagggaggtagtctacgacattgctaccattgtaggagaagaagcaatcagtagcctcagtcgccatcttctcgcgtgacattacagagtggtggcgtgggttagctacgacgcaagtagcaaaggagaaggaagtgcccgcttcgatggctccgctaatagatgaatagagcgaggcggtggaggggaagacaagggctagagagactgacatgtaggtctcgccatcattttagagagtctagataaaaggactcatacagtagatatcaaatatgttaactaaaatatttagagagagagagagagccattttagtatattgagatagctaaatttgctaacgaaggtgcttttaaaggttttttttttatatataaaccaatacatataacacgtctgaatgtggccgtgtttaaaaatggctggctggatgcaacagccagcgcagtcgaatagagccttaaatataaatagaaattataataatttatatatttaatcttatagtgattcaaaagctttacgcgaatggaactaaattaaaaaggataaagagcctcagtagcacatgaggttctgggttcgactccccatggaagcgaattttttaggatttaacggcgttatgcttttagtggtagttgacgtgcccgtcgacagcgaagcgcctatggtgacttcgtcaatctctccagaatttgccggttcagttttcgaagatactcatatgggtaggatttatgtgtgtgtgttcataggggtgagtgtgcgtgtattgtgagtgtctgcgttgtaccgtgtaatttttaaattaaaaaggaaaaatcttgagtttggagtagtttaaaactagaatcggctattcggctacaaccacgactgtataaacaacagtcccttgttgacgtgtatcgtttcgaagaaagcaccaagcgcgaacacacacatcctttgaggtttgtggtaacatatatgccctttgttaattctctacagggaaaaagcaatgatgcgcacgccattccacacgcctcatcaccaccaccaccacgacgctggcccaaggtcacacatgacagtcgtgcgggcgcgtgtgctttcactgtacccggcgtctgcgcccatggctggctggccggacccggacgggagggagggaccatcgatcggagcgagagctgcagcgaggatttataaaaccgcactattatcgtgtttatcattaaaaaaataatatttagaggatgaaacgattctccaacaacttttctttaaaagaaaattataagtgtattaggattaaacacgaaatcttagagttgaaactatacactactgtactatcaagtgcatatctatcacgggtatcatatacaatagctttatcagtttttaaactcgaagaatatctcatgataataacatgatgttcatgataacgttaaagcgtaggtagcgataatcctaccaataccgatttggtaaaccccgacgacccacagcgcacacgcaccggatccgcgcgtatcgatcggcagcagcgtgtcgtcgccatcacggcgacgcggctgtgtccccgtcccccccgtcggctgctcgcacgcagaggcaggcaacgcagcacatggctggcacgctgcctgcctgtttgcgtcgcgtggcgcactgtgtctgcgcaaagtacacacatccgcatcgatccggcttgcagcgtgcagacaggtggtgggtcaggcagacacaaagccggggttttttaagcttttgagctcgagtcggcagaaatgcttataaaccattttctttttcttgatcagaacagtagggtcagaaaccagaaacgacaaggacggccagcttggatggtggtaaagttgggccaccagtcctcgcggcccaactgggagacgggcctgtgcctacattgtggacctagttgggcctgtgcctacattgtggggaggctttgatggattgcaacttgtgtattagtgcatgtcaccctagtatgacaccttggcacagttttgccaccttcaaatttggagatcatatattcatatgttcaggcgacatcttgaaggtgaacagaaatcacatcgtgctgatcaacttgattgataacagttggttgacagtacggatttgaaggacacaaatggggctcagcaatatgctcaagatggttttattgacagaacacaggaaagccatggttatgatttaatataccgtcattacatgtatataatagatttatagaaaagaacaagggtatccagagagacactaccaaactcattaacaacacctgttgactgtagttgcatgttttcaccaagggtaagcaactgagggcaggcagcaaaccaacctataattgcctgttcagttcttccagttccaggccatataaaaatctgaagaattccgaggttgtgcgcaagcaagcatattcaatagtattatacacagactgagaaatgagaacatcgagcaccaatgatgcgcatcacaacttatcgaccgaaccatcctttctggggctgctgtacatcgctgtcgttcatcagcttgtcgagcaccacgttcagatccacattctgcccattctcggtcagcctccgcacagttgccctcacttgctctcttgagaatcccattgttgcaaccttctcaactacatcatcaaccggcaccctgttgccagaggaaccacttgggctggaattgataggcactgcttgtggtagtatttgggctgtggggagcctgccatagttgccacttcccccagatgatggccctgagggagcaaaaggtgagggtgacgacttcatccctgcattgccacggtgtgaaggggatccgctgtaaccatatgattcagagaaaccacttcctccctgtggcccgtacccgccagcaccataggacggtggtgggccagagtttggcctgcccacaggaggttcatacatgctttggttttgcccatagaaaggaggggcaggtccactaggcggtggcatataaggtgaaggagggcggacatttggtggatagctctgtggaggtgcatacgacatggcttcttctggctgctggggtgcagcgggtgggagtggggtcgaagggttaaccattccagactgaggcggttgtgaatattgaggaaattggggtggggtttggtactgctgaggcggcgctgggggtgcctgtggctgtggaactggaggggcctgatactgctggtgcatggtttcagtcggctgagcaggtggagcatagtagggatcccgtggtaaagctggcaccgaaggaactggagcagaaggaggaaccggtggtacttgtgaatgtggcagatggcctggatactgtgatggaggttggctttgaagcgttggaggtggaggaggcgcatttggagcaggaagggcaggaagtgctagtggttgtgaagaggtgagggcttgatgctgtggttgaatggctgcctgctgtggagctactgcatgctggtgcgaatctgtctgagaagatccaacattatctgatgccagggcatcagacttgggtggctggagcttcgcaagatggagctgtgtctcaacaatttcctgtttgtcacgcaaaatctgcacaccagcttggacctgcatgtgatgcaaaaaaataattatagtgcaacagagtaaacctcatagcagtgtggacagaactattacaaaccactgtatataactctatacatcaaataactctgttagtacttatataaaaaaaatacgagtgtcatagtatagccagga

SEQ ID NO: 61901 - DNA, 2309 bp, Oryza sativa
acataagcaaggcaacatcaatcaatagcataatctcacctgggaaacaggggttctttcagaaccggaggtgaggatcctgcaccaaagatctcagcttctgttcatgacgaagaccaaatctgaccattcaaaacaccatacagaggcaggaagaagaagaacaggtcaagaacatgtagctggattggtgcttctcggtcaaagcttgaagcaaacgcgtaggagagtaacagagagattcggaaacatgcaaggcacgagacgacggtggcagcagagatgactacagcccacctactcctactactatgtgtattactactcgaaggatccaagatctactcctgcttttaaagaagaaaacttgaagcagagagagagagagagtatgaacctttttgttaacacatggggaagaaagtacggtgtattgttaccaatctctccaaaaaaaaaggaaaacgagagataaaagcaaaaggatggaaacaaaatagacaagaaataaatagtggcacatggtgtcaccagccatgtgtgatgtgttgtagtacttctcaagatttcctttcttttattttcttaaaaggaaaaaatggacagcatggttgctggagatgggttgtgtatgaaccatgcattgaattcttataccatggaaattaattaatgcttgcataagtaggaggaggagaataaattacaaaactaaggggtaaaaaaagaacataattttctagtaaagaatagaaaattaacacgagattgatgagaaaaaatgagtggaggtgttgcttattgataccttctgaaaacttttccatcatcagagttacggacaagatgttaacatacaaacaaaagaagcaagacctgcaaattccaaaatattctgtcagaaggataacacaaaaaaccaatagccatatgtgctcttatatagactgtagcatccatgggaagaaccatacgcaaagctctaccgttggatctctagtctggatggctgatgcgtgcagctccgaagcaagatgaaactgtaggaagagagagtaagcaagtgttaaataggcatcaatgagggagagttaattacccaactaaataggcaaaaaactgaagcatgaattctgaatgaaacgtgcaactgagttcagttcagttcaggcaaacagtggctgtaaaagggcttcaccatgtgatgtttctgaatccctgatccctatagtattaaagaaatgaccatctgatacgaccgaaggattcatatgatttaatactcagatctttgcacacatctccttgtattttagtagctatgctgtctgcttgtatacacacaaggagtacagtatgaagtgcatcagcggccgtggcaatatttgccatgtttctccactagtaaggatctttttgcaagattcaagaattttatgaactaatccaggagcgaattgtggaaaaaaggtagggtcagctcgaggcatgggcaggtcagagacattgacaacggacaggccattgctgcaacctcccattatttctgccgtaatctctgaaagtctgaaactgaaagtgttcttgggttgctgctagtcatgcatacttccctatgcagacaccttctcaggcttcgggctcaataaaagtgaaattgcaagttggagagttgggtttggggcgttggaatttaggagtaaagatttgctggttgtttcttacagcaatagagaaacatatgtgagaacatggtgtgaatttcagaatttgatcgtggaattgtattgatcatatttgaacaaatgataaaacacaaatcaaaattttaagtttggtcactaaagtaaatgtagaaatccagcttagttacataaaacctgaagcctgaatcatccatcgtttcatgtcaacaacgctttaattgtcagcattaactagtaagctaatcgatacatgagcgactagagttgcacgcggtggctatggaggtaggagacgtacacaaagggtggccgagaatcggcggcgctccggcgagcggcggcggcggcgaggcgaggacagacgtgggaagccgacgagtgtgtccttcaccacctgacccccacacgtgggggtaaaacgccgccggcggcccgaggagagccgcattcatggcgggtcgtcccctcccaggacggagaaggcggcggcactccggcggacggcggcgcagaggcgatgcccttgtgacggaaagagagacttacaggtgggacccactaggccggtgaccccacatgtcatcgaggtgtaattttgcataa

SEQ ID NO: 61902 - DNA, 3438 bp, Oryza sativa
aatatatatccagattcatagcaataggatgtgtcacatccagtactagattggttttttgtgaaacggagagagtatttgtgtcagaagaatctcacagattcatcaccacaaaaatgcatagaggagacagatcatttttcttgacatgctcacagcagaattcgacagattcattaccaggaaatgaaaaaaagaagtttgttcagactcggttcctcgattacaatacacgcaccatagggtaccagcatctgaatgagctacatcatagaacaagaaaaggggagggagatgcaattttgcattgcattgacaggttctttgatgcaattttgctttgcagttgcattgccaagataggttttagaaattctcactctcaattggccatcaccaatggcctcttgtggtgtccctgcaggagctgcctgagctgctggtacccatggcggtagtgctcgagcgagaagcagagctgcctgatcgcctctcgcttcccctccgcgccatcggagaccatcagcttctgctcctccacctcttcctcgagctcgctcacccgtgctcgcagctccgacaccgccttcgtcacggcatctgcctctgcaatcagcttgacatgctccaggtgcagctggtgcaggtggctgtccatctccctgatcttctcatcacgagctgtgacatcggtcagtaagctagccaccttgttatcgactgtagttttctctgaagaaaggagttcaagctttgtttcgagatcggcgatggcttgattcagatcggagatctgcttctcactgctaatggatgcttctgatttctcggcgtggagttgctggagctgtgactctgtggatgtcagcttgccttcaagagaagcattggcttctttcagtttttggatctcggcaccaagtgaggatttctcctgcgagaattcttccaaattacaggcgattgtgtgttccagatcattgatacggctctccagctgtgatttctcttccagagctcttcctaggtcagctttcagattgttgattgtagcttgtagttctgcgacctcagtccttgaaccctccagctccttacgaacttgttcaaattcgatagcacgttcttcgagcatcttcttctcatttgaatcattgtccagccttctttgcagatccttgattatttcttggagcttcataatctgtgctgatgaatcatctaggctgcgagatgcttgttcaagttccttaacctgggccttgagctgcaatttctcttgtgacatttttgctagatcaccttcgaaattcttgacgatgtcttggagctttattatttctgtttcaagagtagatttatcgtgggaatacttctcatgaacgtgttcaagctccttcttgcacttctcaatttcatggtcatgatgagctagttggccttcaagttccttctgaaggctgctgatttctgagtgcgaatccttcaacttctcctcaagtttttcacattggcagcgtgtattcttttcctcaagtgcctcaagtttttcccttgcttcctgaagctcatcttctagctcggcaattcgttcgttcaatgcaaaaggacttccatcaccattgtcttctctcaattcgtcaacctcagaatcagattctgaagaagatgatgatgatccatcgctccccttcttggaaatgtctgaacttccaccagaaccaaggaagacatcaaagccagctgctcttggtttacgcttctgttttggtgttgtctcttccgagtcaggcttaggagttgggggagcagactgtgtctcagaatcagattcagatatgctaagagagccttgtgactggagtgacgatgggatattcttgcgtaattccccagtcacattgtcataacgctcggcaagagcacgatacatgcggtagaagttctcaacatgagttacaagcaaaggccgccgttcgaaatacatctcggccttctttgcaaaagaatcaccttcatcctcgatgagcttcagcatatctttaacttgcttatccatctctgtttgttgagaaaaatgttatagtaagaatcagttgtgctatgcatagttgttttgcaggatgaaatattagtgaaccacataaataaggtcctaaatattgctacttctggcaaataataaagaatcactagtacatcctgcattcccgaaacatgaggctttaccttctaggttctcggctaaccatttggagttcttgggactaatatggctgtcccaccaccatgaatgggacttccttgttggcatcctttgcatgcgcttcatcttgaccaaaaataagatgactcctcaaatgaagccctaatcatgatggaggaaaaaatgagaaggcgatagatacatgtgaagtttgatgatgtcgagcaatctgcaactaagaaataaatattttctaggcagttctgcagaaggaaaatgttaggactagaaccagtgtagttatgcacataaaacagcttaagggcccctttgattttaggaaaaatgcaggaattttggaggatttcaatcctatgaaaaaaaatcctatgaaggcctttgaaacaaaggattgaatcctatccaatcctttaaaattcctatggaatgggtaatcctatgcacattttggaggaaagttagcaagaggtctaacctcttggaacatttcctctgagtctatctctctcatctgattcctgcgtttttcctgtggtccaatcaaacagccattcctgtgtttttcttgtgttttgtaatcctctgttttacaattgtattcctgtcagaatcatgtgttttttctattcctctgttttttcattcctacaattcaaaggggccctaaaagtgtaacacaatactaacaaccaatgtaattcttccattgcataagtgcctatgtaaaggaaacatggcttccacttctcaaggggacaaggaaagggactaagcatggtaacctccataatgcatggaaccaaggaccataacaatcattggctaccaaaaagaggtgcagacagcaaactgctatataattcatgaatgtcttatcagctaatcagcactgacagagctgaatattgataagcatcagctatctaaaggagaagctgatgacacagtctggaagtaaaatataaacctatcaaacagaaaagggatccctgcattcttgaatagtaccttatcttctctcacacaaagctataactacacaatgtttaccacaaaaaagtttatctggaaactggaaatatcattaacccgaacataagcaagcatttatcccaaaatagatatgatacagagtaggaaagcccagaagtaaactttaaaagaaaaaagcttctaacgactaacttaataaatatgggcagagggaaaaa

SEQ ID NO: 61903 - DNA, 5903 bp, Oryza sativa
  unsure (1)..(5903): unsure at all n locations
tctcaggccaagaacaccatccagaaaaagaaaacgaaaaaaaaaaactccagttcctaaatcgcaacacagcgccaggaaacaaacaagcaagcgagcaagggctggagaaggagaagagattaccggagagagcgagatcgaggcaaagcctccttccttccttccttccttccttccttctcccaacctggagaaggagaggagatcaaaacggccttaatgaaaccagtttagtgtcagggaggtgagagagagagagagtggagtgcgctgttattaaagaggaggagatggttgtgagtgaaatgacaagattgccctcggtggggtagatggcgtgactggtgaaacgaggcgccggcgacgatgagctggacgcgtttacgcgacgggagcaggtggattagatcaaaacggttattagataatagaatttagtttattaactttattaataaaactattatatatttgttcgtagcgacttaaaagtaaaaaaattaggttaaaaacattttaaaattaagtttgaaaatttagatttttgacttattagactaaacgatgagataggatttattaggagtgagattattagtggtaagaaaattaatccgcggaatgttgttaggaataatcaattcgaggggtggtgcccacctggcagaggggtgagggacccacacggcgaggacagctaaaggggcccagcggcagaggcttagaggaagaagatttgagtgttttgaattttcaggtcttgttcggtttgctgaaaataaaatgaaatatttttttcagtaccattcaatttgcaaggatgatgaagtaaaaaagaaattcttctcttccctaccaattgtagagggtgagacagtaggaaattttgtattcattaattaaatctgttgtaaaaatcctatatgatttgaattgtataggtatttctatgccttcaccttttcttttttatgattgtaattcctaaaaaccgaacaacccctcagttgggttcacccgatattcccatcatcccatgcatttgtatgctcaaacctgcagtactgtgtatttcatagtatgctaatttttttttatgctccgatattatttttcattggctccacatgatgtgtagtacacctccgtcccaaaataagtatagccatagatatacgtgctcagcgttttgaccatccgtcttatttaaaaaatttataaaaaaatatttaaaaaaattagtcacacatagagtgccattcatgttttatcatttaataacaataaaataaaagtactgatcataatattttttcaaataagacgaacggtcaaacattggatatgaatagtactaaaactgtatttattttgggacggatgaagtattagttagtgtataatactagtgtttgactgagcaaaattgaagccatctgcatgcagcacgcggagcaaacagctcacatcaaccaccaccctgatgcttcacaactcatcacgtttttatttcaactgtttaagtgcgtgataggagggtggcctaccaaaaaattgacagattattattgaattccaacaagataacaagatacggctcgagcgtacacatgggcgtttttagtgtcctaaatcgcttattaatacactatttttcttttacaaagtattccttattttttgcattaggcagttcaggacggcaggtctggctccgtgtgatgacccctcctgggctgccctctctctccctcgtggcagctggctccaggattggtgatcatcctccagggtttgtttacctaagcacctccgtagcggcttcgactccttggtactcctagtttcctggcagctatagaaggaacgaaactttagggttttcgactctgcgctcgcttcagtcgcaatggttctggagtccatccgcttggagggccagttgtggtctttagccggcgttgcttttttggggatttattgggagtgtagcgtggttctgccccctcctgctgtttggagttgcgtttttaacgtcgtagtagttcctatcttcaagttttttttattttgccttttctcccctcccccttaggcataagccagtctggctgattgctttgtatacaaaaacttttttccttctaatatattgacgtgcaatccttttgcgtgttcggaaaaagaaaacattaggcagttcttgggcagatcaggctccaccatttcttatttgtcacggtgcaaccaataacacggtcctgccattaaaaaataacagtcttgaagggtaatgacaaagaaatgattttcctattgagaataactatataccacctcatatatatatatttttatataatgacactcgtggatctgctcgtgatgacgtcatgatatatccgccattattatagtaaattgatatatataatatatatagaatatatagagttaaacgctagaggttttttattacataaatagtcacacacaaaaataataacatttatataattcttttacaagagagatactcaaacaaacattatgttaaaaatcaatgacattatatattaagaaacatagtgctcccgttctaaattatagggtattttttaaagaaaaattaaacttggtaaattttgactaatatatatactaactatatctatactaagtaagtattatgtatgttctatcactagattcatattttaaaatagtttcatgtgatgttaattttatataaattgtaaacgcaatataaaataaattaacaattcaaatatgtcattaaaaaccgtgtgaaaaatatactctttcggaccagatagatggactatatgtccagacacgttatagaaacgtctcattcagttcaattttagatttatattttgagacggagaaagtatgttctataatttgagatgaaggagggagtattaattatcagtattagaaagcgcacgcgaagcttgtggcgttcaaacgaaggaaggagacatgcgcgcgccatgcagtagatgacaaaaagaagagcgtgtccatttgcttcgcgagcttatagctggagaagcaatcaatcaattaacaccaccagcagcaagccgagggcagtttgggaaattcaccttgggctggacactgggaacaaatgagactcctgttgggccgggcacgcgggcccaggtcgtcctctgttggactagtcgtggtgtactggtgtactggtgtgtttcacgaagcctcgttatctctcactggtccgcggggcccacgtccaggaatccatcgccagcgagtggggccccacgagacagccgcgtttgcgagagagcgcgcgcgcgcgcgggagaggagggattcctttttttgttcgaaagtcgaaacccgtggcgggagacgccgcgacgtcgcgccacgccacgccgcgtgcgcgtcgagagagcgcgggcgcggcgcgacgccacgccagagagcgtcgcccatgccgcgcgccgctggatcgccacggttgacaaggcaggcaaactataattactactgtagtactctgtattaataacggtagtgtggtctttgtgctttaatttttattaaagataagacacacagcactatctccgtcccaactcccaaaatactcgtcgctttgagtttttttataacgattgaacattcgtcttattcaaaaatttatagaattgtaggtgctcacaacacgcgtgcatacatccttataaacacacacgtacaccttaccctatgagcctatgagcatcttcagaagactgaatcggtatatcttaagattgtcaaagttaccacgaacacctcgttgttgaggtgtacatcgtctaccactgaaaagtaattagccgtaaacataagtacatttgtcaaatataaaaattaaatcccgatgagttatttttatcataagaaaactaatcagttgagatgtattttcattgaacgtcggggacacttaaagtcgtaaatcccctacggcgtgttgaaagctattagcatccatatagtcgagggcggatccagcacggggccggctgggcaaaatctcgagcccaccactactggcgcaagtactatgggagtccccacagagcccccgctaaatttttttttgctatatgtagatgggaagaggtttagctttatctagtttattcagatctcctctatctctttctagatccgccaccaatatataagttgttctccgtctgtttcgctattaatctttctcaattcccaacgccaatcagaatccattcgtttattttcattcttaacaccacatatatcaatcaaatgatcgatccggctttataacagagcccaaacgacatactccaaaccaaaaaacaaactcaatcctgtctaatggtgcgtgtgaaatcctcgagtaattcaggattagccatcatatcttaatcatccatgacacttgcactgtgcaagctggtcctggctggtgacaagtagggcacgtacaactacatgtcaggagcacagagccacacgtactgtatagtccgatgctgtgatgcattcattggagtggttaattagcggctggccgtgccggcaaggttggctacaagaatgacgacgctctgcatctcaacatgtactgttttatgtgtctctgtatatcattgatggcattagaattctgacgtcttgaagaatttcattggttggctaaaagctgacaaaacattagaagaaaaactgtaagtcaacaaaaaatgattctattgaaggacttttatatttctactactaatggtttaaaagctaaggttgaaaaaaacacctagagtaattcaaagttaagtttgaaaaatcaaagtttggctgcggccggtccttgtgatttcctgaaattcagtgtcatggacccatgaggttcgtcacaaatggttactggccgaccaagcccacatcatatccaaagagcagctgtgcggtgatacattcggcccactcgctaaaaaggcccatcagatactagaatcatgaactccataaatcatggattcatggcagattggtagccattcctggcatttgtcaatattacagtaaaaatatttccctattgttctgtatcagttcacactcaacatacatcggatcactaatcaccagggtaaaatcaggcaataatagtgccaaaatggcatgtcaaaagtgtgattttaacaggagaaaaaaagatactttatacccggggactgtacagtctcatgacggatatacagaaccaagtctgaagaaacacctcagcagaacatacagcctctgatgataattgatatttgctggcaacgtctgaactctgaactgaactttggggttcctgacaataatgtctgattgtcactggcttaatttgcctcaggcgctgtcagcaagcgcggccactttcttctccagctccggcttgttggcgccgacgagcttgtccacctgctccccgttctttaggaagaagaacgtcggtgtcgctcggatgtcccatgatgagctgaagtcctaaagaaaatcggttgaagaacagaacagatgagactgagaagagcattagagactatcacctgttcttatggatataacagaggggggagaggaggaaaaaaaaacattggttttaccattaactcgtcgacatctatagtcaagaacatgaactgggggtatgtctgtgacatctcagcatatacaggtgcaatgacacggcatggnnnnnnnnnnnnnnnnnnnnnnnnnncaatcacctacaaatggtccaccaattctttatttatagtacattgtatgggaacataaagatcacactttcttacttcattaagaagaaaacatat

SEQ ID NO: 61904 - DNA, 3864 bp, Oryza sativa
atatatattataatgaaaaataatggtcaaagttgttttttggagaccgtgcccttgtccaaaacgacaagtattatcaacccggagagagtaggtgttggtttattttgggacagaattctagaagttgatttattttgggctgagaaagggtattacgactagtgagacataacctcatatatatggttttaaagtttcataaaaccttatccctgtacatactgagcacacatttacttaaacttttaaaacatattgtatgtgaaagaattaattattgagcttgtgattaaggttgatagtttaactattcactactttgaaaaatattgttttagatattttaaatttagtcaagattcaaataattgtggtgttttatgaaacatttaaactataaaacttgtgtttatttgtcacaaaattacaatacatgtggttacatgtggttttcttcaactttgatcatataatgtggggtttctgaatttactctttttctagagataggggggagggatgagctttggtcacgattttaattttcttttagagaatgccggatgagctttgatcacgattttaattttcttttagagaatgcctacatacattttttttaaaaaaaaacacaagtacaaacgcatgagctcactgtgttgagactgacaaatgcgagcaaccatgtcaaatctaagatttgaacctgagtggggtggttccaccacaaggaaccaatccagttgagctacgctcacttcgcatacctacatagattcttgtttgtgtataaaaatcaaggagcagaatacatgtctccgtattcgcgaaaattaaggggcaaagattccgagttttgaggaaaaatttggaacaatttgaatgaaatcattcaaaaaaaatatttccacatgaaacaagggaagttcaaattccaggcaatatattattattttatcgtagagcacaatttgaatcttctcccagaaaattccgataatgtggccatgcgggtgataggaaaatgaaggcctccaagacggcaagaacaaaatacagggcaagcctatgatcttgtcggcctccatgggcttgtcgacaagactaccctaagcccaaatcgccgaaggcaagtaactgaaccattcctttcaacagtacaggttacagacaccgggttaaatgtgtaattaggatgcacacggctatcttggttgtgcattcttcctgctcgtttcagttgtacagtctgaaacctgaattactagtcattatgccattgtgcagaagaagaagatggccttgtgccattgctgaatgcagatcaggggcaaatgggcaatggcatattggcattcacatcagcttcttcagtgtagctagatttattcagaatgcagacaagatccttgcagcttgggtacatgacgatttcttctatgaaaaaacgcagcttcttcagacttcagacaacatctttcagtgtagccagaacttttctcttttgagtgtagctagatccttcagaattcagctccttaagtctaccttttttttttcagagttgggcacatgctgatttcttttctgaacaaacacagcttcttgccttcttcagagttcagagcacctctacctgctttccatgtcgccaaggcaatgcaaacacaaggtacaagcgacgcatcaatggcgtcctcatcgatgaagctgtcacgttatagtttggtccccttcgacctgaatttggttggagaaaattggggatggaattaatacgggaatatcatatcaatatatcattgatttaagtcgcaactgcaatgtgttagcaaggtgggaaaaatgtcggacaagtttggttgagcgacggtcactgtcaccacgggtttggttcggttggtccttcaattcgatttaaatttactcaaagatataaatttgccacgtctttaggaacaaactccgtgtgttgcatctaccgacagatggcaagttgcttaatttatttatttctctttctcttactgtctctaatctctagtgcaaagactttggttatatgttgcattgctgcttataacaagatatgaggagataactagaaataaattcttcagggctttgatctttgtaggtcagctttttctaccctgttgtcgatcagtcgatgtaataatctctgtaaccacatttccaggatcttaatgaaatttggttggccttaatgaatgtggatgatagctctgtcaatgttccatgagagctgatcacctgaaacaagtgcagttgagctcccatttctcagtcaccacaggtgggagatgcttttgatgaactttgtgttgtcatctcggcagaagcagaagcagaagcagccaaccaggtgatcatccatggcgggtttaacgtctgcatcaagagattcccgtgggctcacgacatggattaggcttaagccaagtactagaattttatttgtagtatgtgctaaaataatacttccatgctcatgtcaaatcatgctgtttacaagtgttttttagcatgacgcattcgttttggtttatataagctgctgaatgcgtcactaattagagccataacggtgctcctacatgtttttttttatatttgctccaaatatcaacttttttgataaaacacatattaattcgtaacaaagtaatgcctttttattcccagttttactcaggtacgtaattaacttatttatcataaaaacaacacctactttttcactggtgtagaatgtattattttctaataaatggctcctaaatgatgtaatttcgtaaaaactttctacacatgaatttattagaaaataatttaaaacatatttttaactttataataattattttttgtttgcatgtatgctaaaatagtcatggcaaaatcattcagttatttagccatttggctatgtaggtaaagaaaaaaccaaagtcgaaagacgaagttaactcccaaaaattttagacaaactatccaaacctacccatagtaaattacacataactgttaactgttttaagagtaagtttactggcttcacttctgtctatattctttcacatttacattggtaatatagagtattttgggtagtaaattgttgtatgagcagaaacactatcttataaaaaagagtaaacttgtccttgaaaccgacaaatttcacacgctttcaaattaaaagagagaaaacccgtaccgatccaactattaaatgatgcacaaataaataaacgagcgcgcacacacagtgacacaaacctaaccaaccccaaccaaccgcgcgcacgcaacgcaagcaacgagtcgacgacgatatccaaaccccccgaccacgcccgaaaaagaaataataataaacaaaaacattagacccccaaaaaaaaatctgagaaagaagcgaaaatatcctctcgacccccctcaccggaaaagggtattgcgtcgcctcccgccgcgacggcgacgacgacgacgacgacgagcgcgggctccctccaccgccgcctccgccaccgcctcgccgcctgcctccgcgcgcctcccccgcctcctcctcctcctcctcctcctcccacatcggaccccgccgcggtgaggctgcgtcgccgccggctcttctggaagggggcgcatcgtgctccgatggacgcgcaggttcagcagcagcagcaggcggcgccgcagcagcagccgccgcccgcggccgcggcggcggcggggaggaggtacggcgtgcacttctcggcgtcgagcttcatccaggcgccgctctccgcgctgctcgagtactccgggatcctccgcgcggaccccggc

SEQ ID NO: 61905 - DNA, 2554 bp, Oryza sativa
gtaccagaggtacgacatacagcaggtggcgaggtgggtggagcagatactccccttctcccttctgctgctcgtcgtcttcatcaggcagcacttgcaaggtcattccccccccccccccctttaatttacctcatccacaagcacaaattgatatgccatcatgtgttttgctgcatgtatgatttgcattcgtctatctgtgaaatatacgtcaccatgtgtttgctgaatgtagggttgcattaatctatttgtgaaatgttgggctaattttgctttggattgtgtcgtgcaggtttcttcgtgacgatttggattgccgccgtgatgttcaagtctaatgatatcctgcgcaagcaaactgctttgaaggtaaacttaccatcatgtttgttgaacatttggatcaatttacctgtagatttctgctggaatattaagtgacaaatagattaattgtgacacttggatgtctaaagcactcccttagatttagttcgttttaatgaaaatatccggggtgcagatcatctctaaataatgtgatgcagtgatggtaatatgacgttttttggccgctcatagttttattggcattttcatggtaatatggcttacagctttttggccactaagttttatttggcattttcatggattttctatatccgaacacgttctcatttcacgtttgtgtattaccaatcatcaatctgtcactaatgtcatgctgtgcttgtacttatatttgtgctgctgtccaaggatatgacgttgacttgtttactggtttgtaacctctgttatactgtcaagaaatcacaatggttatttacatatacaaatcagatattccttgtttttgagtgtttactgcaccatctaatcgatttttgagatttgttgacaatgctatttatatagagaattgcaagtatctttatattcctggctttcccatcatgatcagaagttacattattatgtggatttaattgctttcaatttgtttatataaacaatgtggtacttacatatgatacattgatatttgtctttttggttcagggggagagaaaaatgtcagtccttgttgggatcacaatattattcgttgttcatgtatttggagtttactggtgttacaagaatggtgacctcgtacgacctctggtggctcttgctccaaaagaaattccaccgttttggcatgcaatattcatcattttggtgaatggtatgttttctcctcatatgatgcttgaacacatttatgttttagatcgcatgttttctcctcatatgatgcttgaacacatttatgttttagagctagaaaggtttgtaaaccctgaaggcctttaagtttttggcacgtgagccctttcattttgtgaactgggctcaaatgtccactctcatacaaataaattatattttttttatgttgtaagtggctatcatgtccttatacctgaagcatggttatttgtatttacaggatgccttaagtcaaatcagtcatgttgtatttagaatttagaaatgatacttaacttcataaggtttttgatcatgtgggttccttccaattttatgcagatacaatggtgcgccaaactgctatgatcatcaagtgcatgttacttatgtactacaagaacagcaaagggcgtagctatcgtaggcaggtatgctgtttatgcatttgaatactatattttctgtgatctatcattgtgtgccgtttcctgatagcttcaggtgcagtgttatttgtttctgacaaccagtaatcaatcattcctttttgctcagggccaaatgttaacagttgtggaatattttctacttctgtaccgagcattattgcctgctcctgtatggtaccgatttttcctgaacaaggagtatggaagcctattttcgtctctaaccactggattataccttactttcaagttgacatcagttgtggaaaaggtactgtaacttcccttatttagtttcgtaagggatacttagtgcctcctaaaactccagctgtttccttgtcaggttcaatcatttttgacagcattgagagcgttatctcataaagacttccattacggttcatacgcaactagtgaacaggtaatctattatatgcttgaagcactaagtagttgttggctatcactgtcactgaatgtctagagtaatgatgacctgtgaaataagattgcatggacattgcatagtggacttttggcacactctattttctatttttcttgacttgactcttgtgtgtctgttcaggttagtgctactggagatatgtgtgctatatgccaggaaaagatgcatactcccattcttttgcgctgtaagcatatcttttgcgaggattgtgtctctgaatggtaagtacatgtatcttgcaccctcttcttctagccactgaaaatttcttaatttcctcgtgcatcttttaccgatctcatgcttaatgctttcaacctcataccaaccttgaacaacaatggcaggttcgagagggagcgga

SEQ ID NO: 61906 - DNA, 1313 bp, Oryza sativa
ccagtttaattaaagtggatcatcactgtagacccgtggctgtctagggctctgggcatagcgaggtgtgcagcttcggcttcagtaatcagtgacccacgacggaaatctatccgtaaatcatgcctgacgagccaagttcaacgggccaataatcgagtagctcccccaattttgttcaccaataaccctgcagaactgtacgtttgtgatcgattttgtttggttcagtggagcattcttgtggagaaaccctatgtagtcccggttcgtaaccccttgtagtcccggtttctaaaccgggactatcaattcgggactaaagatcattatctttagtcccggttggtaacactaaagatcgagctgacctttttttttcatggccctgttgctgcatggtttatatatatatatatatatatatatatatatgtcatgcaaatgcatatgtgtgtgtatatgaccaaattaaaatatatttacattatagaaaatgtgtacacatgcatatagaaacatatgtagtcatgtattaattacaatccattatatgtcctagctagctacgattttgacgtagtagtagtcgctagcttagaagctaaggacttatgaattgtgtttccgtcgtagtagaattcacccttgggatcaaggatttgttcgttgatgaatcccatgagttgttcttgaaccgccgcgataaatttcttgtgtgtggtcaggttatccctcatgcgaataaactatatgaatgtatgaaattgattagtaattaaacaagaaatcgatacgtaatgaaaatttgaatttatttgtacgtacatcgagctctcttgtggtgatgatttggtctgcaaggcagtggcaatactcgcacacgtagtagccgcacaagttagttccctacttttgctttgtgcactacaaataaatgacaaacgacgagagatctaattaatatacacttgtatgtatttgaatcggagaaatataaatgtatagcatgtgtactcacaggaaatttgaacttccgcctaagtctttctctccagttgccgcggaccaaatgacggaaccaataccaagccctatatggagtttaaaactatgattcgtagtagcaattaacataacaagattttcttaattaacagaggaacttatgacagtacctgtctatagacacaaagaccttgtggaacgtgaactctatggtattcattgagtcatatacgttggcagatgcaggccgacaggtttgtacagtatgagcacacaccggaatctacaatgtgcgtgggatgcat

SEQ ID NO: 61907 - DNA, 4109 bp, Oryza sativa
attaattaaaggggacgtagtaagaaatctaactgaacgatatacttacaaaatccagcaactcataatagagatgtcgagggcgtctagctggtatagttcgtagattcccttgaaattgatccagagaatgtcatctccttgcaagaagtctatgtccctgatcctcgctccgatcatctctctaccggtggcgcttatctccatgtacagctgatggaacttgtacatttgtgtgggtagggactgcaccagctcaggcttgacaagcggttaccgagttcgtacatgtatttcacttccgccttttcgattggtgcgactcctagcaattgatccgtagttagaccggtgtcagtaataaattcttctatcgtcatttcttcaccggtcaccaatggctcgatctcctggtttggttgctctccaagctgagggactggtttggactttctagaagatgctttcttcagcgttcgctcatagtccgataacttaatggcctccttggcaggtgcagacatacccctgaagaagtttctgacactcgggtctataggaatattcttttctggacttcgaggcttgaattgtctcttgacttctgatgccacgtaagcgtcaagctcctcttgcgtgcaatcgtaccccgggtccttgttcttggcggcgtcaactttcgccttcttcgttgcccatgtgtgggcaagcggtggagcttggggggcccttgactttgaaggtgccggaagaggagcccgaggaggagttggtgcaggagcctgaagaggagtcggtgcaggagcctgaggtagagacggtgctggagcatgaggaggagacggtgcaggatcctgaggaggagatggcggagccaaaggagatggtgcacgagacgctgcttgtcgcccagggaggatgatgtaccgcctatgccatagaataatggcatggcttgtgtctcgtagatgcgtctcaccgtctcctccagggtaatccaactcgaggtcctcgtacgcgccttcgaccaactcaacttcgaccttggagtatcctgctggaatcggcctgcagtggtaagtacctgaagggtccgttgggatggccatgcccgacgccaccttcatgtggtgagaggttatttattagtaatcaacatatataagcagcaactagcagaatggccaaatctaaaatatataaactacgagcttacctttattgataagttcttgaaaggaatatgcagctcacatggtgtccgctgagtgatgtcatcaacggggcaggtggattcgtcctgggtttgcatggcgtccatgctctgtgatcctacttgccccgttgaggcgcagctgctacggtttcctgacgggctcaccattgtaggaggaatggtcggctggggatcatgggaccgatgtgcggccatacgttcatcaaccttccttgccacctcctcttgcatgctgcactcgtagctcgataccctgaactctagatctgcaatcttcgcctcggtatctctcttgctcctcatctgactcctgtatgtgtggatgtcctccttgaacccaatcttccaaggaatcacccctttccctcgtgttcgtcctggatgctctggagtctgcagggcgagtgacagctcgtccctctctctgtccggtcggaacgtgccctgagaagaggcttccacttcgtctgttagtcgacgcgcagcctctcatatctgatcgccgaagaccagtaagccatcagctgggttgagcattccaccgtgagcatagtaccagaacttcgatcgttccggccaattagcggtggccggttcgatacccctctcaagcaagctagcctccatctcctcccacttcggcatcgcgacgctatagccgcctgaccccaagtggtgatggtacttcttcttggcggcattttctttgtttctttctatcatcgcctgcccttgttcacctgtcttatatgcaacgaactcgtcccagtgatcccttagctttgggaatgtgtcgaagttcggtgtctgcccattcaggatatatttctggtacagatctcccttgaagctctgaaactgttctgccattttcttcagagtccacctttgcactttgtcctctgtacccgcgggaagggttaatgtctcgagcattgtggttcacagcatctctttctccgaatctgggacaaagctctcatgatctccgcgtgcccttgttcttcgccagtacaccgtactgacaggcacgttatcccgcacaacccaaccgctgtgacgtacatagttcttggcggcttctgccggggcactaggtcgtccatcttcttccacttccgttatgatgtgccgaccctcaagcttcttcggggcacctcgttgcccgcgtgccctcttctgtccaatggagggttgacttccactaacctccttctcctggttcccctccacatccctttccacgtgcccctcctggttcccctctgcatccctctccacgttcccttcctcgttcaaatactggtttggatcctcgttcccctcttcttcattccagtactggctgcttccctccgcgattatatcgtacaatatctgttcctcatcgcgatcagccatttgttcatacaggaaacatctgctaagtcatgagacatttatgttttaacaatcttatattaaaactcaaataatcttatatgctaagactaaaatagtcatgtatgctaagtgtaactgtcgtatattagaaccctacacaatcttacatgctaagtctaattacaaatctaataatcttatactaaaactcaaatagtgatatatgctaagtctaggtgacgtatattataggactctagctagtcaataattatatactaagtctaattacaaatataataatcttatattaaaactcaaataatcttatatgctaagactaaaatagtcatgtatgctaagtgtagctgtcagtatattagaaccacacacaatattacaagctaagtctaattacaaatctaataatcttaattgcattacaaatataacaataatatatataattacgtctcttgcctgcgcgaattccttcgagggctagctctaccactccggcttgagggacgactccgacaacgtcttttctgcaagatacaaaaagatgtattaggataaacgcgaagtaacatatattgcatttgacgttcacgtttcgttcacgatatcgttcacgttcgcgttctcgttaaggtcacgtttcattcacctacgtttgttcgttcacgttcattcacctgcctataattgcatttcacgttcacgttcattcacgttcgttcgctcgttcacgttatcgttcacgttctttcgctcgttctcattcacattcgttggcttgttcacgttcgttcgctcattctcattcacgttcattcaccttgttctcgttcacattcgttcgctcgttcacgttctcggtgtggcggcagcgggacgacggagtggcggcagcggagcggcggcggggcgccgcgcgcggcatcgggccggcgcgtggcgcggcggcgtggcgccgcgcgtggcatcggcgtggcgcggcggcggcgtgcggcgcgcggcgcgatgccgtcgtggcgctacgcccggtggcggcgtttcgcggcagcggcgttgcgcggcggcggcgtggcggcgcgccgccggtggcgcgtggcggcggcgtggcggcgcggcgccggtgccgtggcgcggcgtcgtcgtggcgcggcgtcgtgtcgtgatgaggtaggcgtcagcgtctgaaactcagcggccggcggcaaccgagagggagagagagagatcgagatcggagagagagatcgagggaggcggcggcggctctcaccccagagatgcggcggtggcggaggaggcggaggcggcggcgacgacgacgagcgcgagacgacggcgagatacggcggcggcgtcggcgcggggatgccctaggcagtggcggcgaaggagaagccgagagagattgatcgggcaaaaacttctaagtgtttgtggagaagacgagggcgcgcattgggaatatata

SEQ ID NO: 61908 - DNA, 1411 bp, Oryza sativa
ttacttgagtccagccagctacactcttagcaaggcagagaaggaaagtatgtttgaatgcttggagagcagaaaggtaccgtctggatactccacgaatatcaagcgaataataagcacgaaggagaagaagttcacaaacctaaactctcatgactgtcacgtgttgatgacacaactgctaccagttgtaataaggggtatccttccagacaatgtctgggcaacaataacaaagctatgtgcattcatgaacgcaatttcgcagaaggtcatcgatccggatagattagaagcccttcagaatgatgtggtgcaatgtctcgtcagttttgagttgatatttccacctttatttttcaatataatgacgcatctgctttgtcaccttgtgaaagagatcagtattctcgggcctgtgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagatcttcacccaatcggggtacctgaatcacgccatgaagggagactacggggaaagggaactctcggaaggaaagcaataatgacagtagacaacaatttattccgtaaagcccatttcacggttctgcaaaaatcttcattcgtagctccttacatcgaggagcacttggctctagttcgcgccaggaacatcggtaagtccgatgcatggattacatggcatgacattgatactttccccgcgtggctacgacaacatctcatgggtaacgagtcaatcaaccaacaacttgccttcctggcgaggggaccgtctgggtcgatcgcgacattccagggatatgagatcaatgggtacacattctacacgagagcccaagacatgaagagcatgaaccaaaacagcgttgttcgtgtcgatgccatgggacacgatggaacaactggcacgtattacggtaccatcgaggacatatgggaacttgactatggtcctctcaaggtccctctgttccggtgccaatgggttaggttgactggtggaggcgtaatgattgatgacagtgggatgacaacggttgaccttaacaaggttggatactcggacgaaccttttgtccttgccaatgatgtaacgcaagtctttttcgtgaaggacatgtctagcaaaggaaagaagggcagagggcctgacgagcctaagcgtcacgtggttctcccaggcaaaagaaaaatcgtcggagttgaggacaagactgatgaggattacgatcagttggatgggcaaccccctttcacggtgacgattgaccctagcattctcctatcaaatgaagacaccccttac

SEQ ID NO: 61909 - DNA, 5421 bp, Oryza sativa
atgtgactttttgtttgatacagcaataagatttgtataacaagtctgcaagaatgattcggagaagtaattgaaaatatgaaactgaattcaaaccaaaccttggatggttttacgttatgaaataaataatacaagttaatcaacaaaccccaaggtggagagtgacttattgatattggtagcttccttcaagcgttccccttcagcacctgagctcttttgcctgcaaggcatatatatcattcatgctgaataggagactcgaaactgtatgaaaagcaaggagacaaactacctctctgagcctgcaaggtcaactaggttaagccgagaaaaccggtgatggttgataccttgagattcccactgtatggtcaaaaaaattatttataatagcatgtgtatacatatgcaagcattaggttagccacaaatataaaccagtatatccatcaacatcaccatccttgaaactaatgacaggtaatatcactcttattacacaaaaaatacataaacaagttgaagcagttcagttcatataccttactctcgataaggcaagtgaaaacactatgagagcgactgcttgctctattcatattggtagccgccacctttctgtttgctgccccctgaaaagaaacatgtagtgtttggctaaagagatctagctagtgaaactagcattttatatgtgagagatcctttaataaatcaacttttccaagcataatgggcaactaaaaaagtacaatgtggcaacaatcacaagtaaaggcaaagtttggttttactgtttaaaactaaaatgctgaatttgatcgatttagcattactcaaggttataagaatcagtaaatggtattcgtttggtgaaccaccttgtcctatatttctgtataaaactgccttttaagttttaaccattttcctataaaaaatttcagactatatatattagatagcatgtgaacactatcgagtactgtgttttatctatattgccttgtgaacttcgcagtcatcaaaatagttgctagaagggcaaaacagaagtacctaaagtcaaagattggagattcagtcaacataattatattgttacatacctaataaatggccattgtatattggagtattggactacttatctacacattcttggaaagtatggaataattctcttttcatatatatatagtgttacgaatttgcaatgaacaatagcagcagagcatcaccacaacaggttttctttatgacagggacacagtgcatcaaataactgatcttgtaaccagttattgcctggctaaacatgtttccttattctttttgcaatggaacagtcctagtcattttgttcagaaaaatagcagtcctcttaagccagtcttaaagcacaaacctcaacaagttgttgcattgcttctcgagcattggaaacctcatgttctgtcaagttctcaacatggacaccctttttagcatcctctcttatctgcaaatatagctaataatatcactttttgaaacattgagatgtcaaaactgtgaacatctcctaacagcttcttaaaacacaactagcaaacatccgaggacacacaaataagccatgctttttagtactctacctgcaaatttactgaattcggatttagcaaatcaaggatctgctcattgtatatctccaaaaaagagcatttgcaagtaaacctgagtttttcttctttccttatttccttttcctggaacagcaatgttaaaatattttggctgagaagagtacaccactgtaccgcacaagaatcaacaaataatcaaaacttgccttctggattcttaaaaacagatgttcaaacacccgaggcgtcataccacaattcacattgtttcttcgtgtgccattttctatatcaccaagcattgtgtgtgtcttgccactgccggtctaccaaaattggacacccttgtaagcactaagcacagacattgaaatgcaaatttacaacagtatgcagactgctaccctggaaacctaagtatcttgaaatgtcaagtagaatcagtagcttacctgaccataagcaaacatacagctgttatagccagccatgcagttgtccaccatgggcaccccagcaaccttgaacagattctcctatacatccagatgaacatcattcacacatctcgcaagacaagtagataaacagatcgaaatgacacggagaaacaagggcgtgaagagtgtacctgcgtgacatactcgtccgcaacgagatcgaacttgaaccgcgactccgggtggcccgtccaggtgatgctctggcagctatcctgcctgacgcatctcttctgtccctgcaccgatatctcgccgctgctcagcggccgaacacggatcacaacctgttgttgcacccgcggaacaattagtggagctcgaacaaggctaactaggtgctcggcgaaatgctccgatgggcacatcgcgggcggcttgggcctgagctacctagatcgagaggcactactcgaaggataagcttgcgactaggcgagagagggaggcgaaccgaaccctaacctgcacgttggtgtccttccagaaggagggatcctcctggagctcgaaccccgcgggggcggagccgccgccgtggtcgtcgtcgccgcagtcggatggcatcgcggcgacgggatcccggtggaggcggcgatggcgcggcggcggcggcggcggtggaggtggaggtggaggtggaggtggatggggagacgagatgggggggatttgaaatggggagcggagacgaggagagacgctgctcgatttcgaattttggggttcagtccgcgcagcgcggggcacccaaaagcgaagcaatttgcggctggtgagtgggacccctttccaggtcaccaaattgaagtatcgtgacagttggatattcgtgaaagacttgcctcgagtttcaaatttcaccaaaaacagcgtaagaacagcagtttgaatttcagcgagtactgttggagctgaaatttccagacagacatggattttttttttacacgaacaagaaataccacgcattaccaaaaaaaaaagctgaaaaaatctacgagacatatcaaggtgagcatgcatgttcttttcaaatgcatggagcattggattaacgggcacgcttcgctaactcctaatgctgtggttttttaaaaaagtttctatataagaattttcttacagagttgttttaaaatcattttaaactctacggtatggaaatcatacattttttagtctcgaacaattttcacagatcaattcactattcagtcatctagtttttgtttaccctccctgtttcataaattagctcttatattgaattttatgtttactccctctgtttcaatatattttcccaatttaattaataatggtttttgtttcactactggtatctttaaaagggttgatatatttatattcactgtgtaatgtacttactagattatatggtatatttttagtccttataagtttattaacaaaacacgagtggtcaaactagaatcataacaagtaaaaatgccaagtgttagttttgaagctgcattaccttccatcatctgccttttgcttacaagtcattgccgatattttaattttataatttaattctaaagcttttcatcatagtttatttccaccattacttttaaatcactaagttcactataaaagttttgctatctttacaagccattttacggcctatcagttgtgaccaaatgatggggctggttatattggagtttggtcgcatggagttcaatcgccccatgctaaccatccgcatgcaaaatctgagcctcatcggtaagtaatatgtttggctgataagctagcctcggttatagttaagatggctataaaatttatacatcatgggtgatgataaaaattgcaccctagttagagtagtattgatgtccagtcaacttagaaattagtgcccagtatttctaaacaagcgattctcgatacactgttgacgaaaaaaatcgaacacaccgacctatgagatctgcttagcttctgtgcaggtccaaatcttgatgagatgcgggcgtaccagtcagtttaattcggtaactgacaatatatgcaaatagtatatcaaaacagccgatcggctgataagccgatggagtagttccagccgatagccgatgccgatagcgatagggtttaagtaatcggctatatgtccaatgtagatgatgatataaaggcaatcgactgttggtaataaagtataacaataatatagtccagtagaaaccaatcggctataaacaatatataataagcattgatccgaagattaaagcacacatcggctggaggtccgatatcatgaaatccacaagattagattaaacagtgaaacctttgttgtcatcggctaaatccaacttatatgtatatgcaatccttatgagccgatgcaacatccagataactcaccggctgaaactccgatgaaacccttattggcaatcaaaaagcaggctaaagattatggttctaagcacgacttagtagatcaaacttaactgatgcagcactaagtatgaaaagaaacataatatctaaacaatcaagccgttgactgagttttcagggtggtggatgtttaagctaatctaatctagcaatgcgatttagccaataccggcagaaaccctaaaacgagaagcagccgatagagctaaattgatatgctaagactagattaacagagacatatgataaataggtaggcaaatatatcatccaaaccagagcaatccaagaggtcgaatgtactgatgcagccttgaacgacgccgacgtaaacgatacaattgcctgggatggcggaacattggacttaccccttagtcggagatcgaacatcgatgcagcctcacgtcaggtgccaagtcccgccggacgataaaataaagtagaaaaggtaaaaggtggcgatgcgccaaattgtattgatcgtgaagataaattacatagaccctgggtgtacatatttatacccatgggttgatacaagtccttgtcggacaagaaagaaactttcctaaagataaaaggcaagataaagtccttataggacactaaacacacgttcctaaagataaaaggaaactaataaattattcctaattaatagataacttgtcatgccgtattctctttgaactcggtctcttctggataagcttcctttagtagatcaatttccttaaccgaatatatcaagaatccgacaactgacgacttgacaactctcatcggctaatcttaggacttcgaagccgatgctgactctaagccgatga

SEQ ID NO: 61910 - DNA, 7469 bp, Oryza sativa
  unsure (1)..(7469): unsure at all n locations
tattaataatgataatcaagcatgattcgttggtttggagtaccaaaaccttgccaagttttagcactagctaattaattagaatttgaattagtgtgagaaaaaaataatagcaaaccaaacatctatttatactatcattaaagttttcgaaattttgatacggcaaaaaaatcagcttcaatgatcattccaaacatacccgcaatctttcaagatcaaattaaccagatttaagagtaaattacatcagcggtacacaaactggctagataagtgtaatctagtgtatgaacttgtaaaatgctcgttttgatgcatgaacttatttggtgcgtgcgtacaagaccaaaaccgtacgacaatgttaatcttgctgattttgttattgattttaatgctatgtaaacaaatatcacgtagataaagatcaatttagcaaaacatataataatgcatattgattgcatgaagaaaaagataaaaaattgagtaacgatgcaagcgatagtaacaaaggaagataaagtagaaaccaaatttatacatataacctttctactatatgtgcaccacgcatgtcatgtaataatttataatgttcaacttgaaaaatcagccttgtcatgccattttggctttgggatgtacgcactaaacaagttcgtacaacaaaataagtgttttacaaatttatgcactagtagactgcatccactaagttgtgtatcgttgatgcaatttactccagatttaatctacagatatgagatatccaccaaggcccagcccattttgggcgctgaagcgagcactttccactacggcccagcccgctttgggatagcgaaagcgagaaccccagaagcccgtggaagcttcggaagcggcgcggcgcggcgctgggcgggggagaagaccagagcggcgaggaaggaggcggcgcccagcggggagagcgagcggctcgacgccgacggccatggcgctgctgatggatcccggggcgggaggccccctgacggagagcgagaaggccgacctggacgccatcgccgccatcaaggagtcggcggcggcagagtacaaggagaagggcaaccggctcgtcaagatgggccggagccactacgccgacgccgtcgactgctacaccaaggccattgcccagatggagccgctgccgccgccgccggtgccatcccccgacgcctccgtcctcttcgccaaccgcgcccacgtcaacctcctcctcggcaaccaccgccgcgccctcgacgacgccgcccgtgccgtccagctctctccctccaacgtcaaggtgccctccttgttctttgttggattcggcaaagaaaccttcgccttcgcgtgatgtgtgagattcttgtagctaggcgtactaccgggcggcgaaagcggcgattgctctcggcttgctgccggaggcggcggccttctgccggcgggggatcgagcaggaccctgctaatgaggagctcaagaaattgctcgcacaagtggacgcccaacagagtgagcaagatcgtcatagggccaaggttgcgcaggccgtgtccgctgcgaaggtctctcctgctccaaatttgggatttcgacattgctgtaattggtttccgatatgtggaattaaccagtgttatatgtatgtaggatattgttgccgctatagagaagagggggttgaagcttgggaaggcagcatatcaagagcttaccggtgtaaagaagccgaagttggatgagcagggtgtgcttcactggccagttcttctgctctacccggaggtcatgtcgagtgacttcatcgaggattttccggagacagatactttcgtgccccaccttgatgtcatatcctttctaaactatataatgttattatcttaagattaagtgcataataagtataggctatgtgatggaatcactgaatttgtgttgaacccttaagtactgtcaaacatgttctcagaaagttctccaccattaccatgggatgataaacacgcttacacacgggatgctgttgagttatattatcaggttcgtgtgtatgaattgaatttccttgaaaccaattacctgcctgctttctaattgttaaaagttggaaaatatgtctaaataacttgggctagacacttcattgttcatatagcattgtaacaatacattaatggcacaatggtgtgattaaacaactattaatgtgttaatttgtatttttggctaccaacagttccctgtgaattcaggtaaacaagtacgtctgtttgtcagcatataggacattatagttaacttgtaaaagctgcacatgtaagttgtctccatatttagccaatacagtttaacacatggtgcgtgattgtggattacacaccgagatggtttgatccctgtttttatatgtaaggtagagttattgtcaatatttcgaaaatcttagcctcacattatttttccaaatttggagtcaaatttggagataacaacgtctgattagaaagggaggcatggacaacacatattttgatgctagcaagttaatcatcattgtcatcatctggttcagtttgtgaagttcagtattgttgtggattgcttgtttttacagcttgctatacacagttgtttggcagattatctttaggatgtatgaatttcctatatcgatcgtccatcttctgtttgttgttgtgtaactgattctttactttgtgacattaggctggcgttggcacagttctgtccaaaagtgaaatattgaaaattcttttggaaggcactatggactcaaagtcacttcctgaaagcctgcttgatgaggaagatggagaaaatgatgatggcaagagcagcacaattacatcatcaggtttgtcgatgaacatattctttagcttgtcatactaaaagaaggcaatgtggtggtgatatatcttccacctgcacacccactccatctacattacatttttgttaattgtcttcttattatttgttcttctaaaatataaatttagattcgaaaggtgtaagacagccaaattgtcagatacatgtgtacatgctaatttccaattaaaactgtatcaacaatgccaagtgcgctgtaacaaaaatgcaaagggtggtgttcaatgcaaaataagtatcaacaatgccaagtgcgctgtaacaaaaatgcaaagggtggtattcaatgcaaaataaaaagttttgaacatgtatgattcatttttattggtagcaaatgtgcggttatttagcaagtaaaagaaatcaacatgttattataaccagccttcttgtacagctaggcaactcatgtacccttctcaaataaatactgttactgttcaacttttaggaagctgcttcggagctctccagtcttttgcacgaatcacatgtattacagtaaatggcattcattactatagtatttttctttaatgtgtagataagggttctgtgaagtggatcaatgtaaaagagggaaaaactcttcaagaagtgctgcagcataaagacttcatcatccctgcaattcctggtctggttcctctctccttgaacgatttcacatattacatataaatccggagtatttaatgaccccatctctttgcttgcagtgttctttgttgtttcaagaaaatccaccttttacagaaagttcaaggcaggaaactggtctttgccgtaatgcttagcgtgattcagtttggcacatttggaagatgattagtgcggtacgcgtatgatcagagaagaaaagctggccacctagtcattcttgtatggttttatatgttgctttatagaatgatgaggtgtgttctttcctgtatttggtacaattctcaagtattttcctatcctttgcttgagatgctcagtatgccgtttctggagaaacacactgagaatgtacttatgtatggacagctttgggcctgatttagcgcttggcacagtgatggtatcttgtacgccatatctaccaaccaattttagcaccaaacttttcttgtcaaataccttgtgtgaactgtaagattcaacctccaattccttggtgtgaaatccggcaacgttgatgtgttttctcactgcggtgatattcggattggaaccatcgacgatgttctcagttgacttgtgtgggagtgaaatctctcattcaggccgatcgagtttagtttcaaaatttttcttcaaacttccaatttttctttcacatcaaaactttcttacacacacaaactttcaactttttcgtcgcatcgtttcaattttaactaaactttcaatttcaattttggtgtgaactatacacaccctcgctgccttgtaaatcctttattcagcactatctcctccttggatacagctacaagcacgcatcatgcatgcagattggagtgccaagaactcaaacctgtgccacggtgatctgaacaaacgcaacacacatccagaaaactaaatcagcaggtagccttgtcccttaccagctcaacgcaacaactgatgcagagatgctgccggtgcggtggcaactggcaagatgtatatgtgtttgtacgccctggcacgcatgcggcacgcatggcgccggtgcagcgaaaccgggggcagctgtccggatcgcacatcctgggagggagggatagggatgaatgcttaccatgcggggggaagccagatgagacgaacgcaaaggtgcaaacgcgcgcaggagaaggggagaaagcgagaaacgtgtcgccccaagtagcgaacaaaaacggccgcccccgcgcgtggcggtgggtgggttccggccggtcatctctatcccgcgccgtccacgcgacaaaacaggggacgacgcaaccccggcgccttctgtggctgtgcgcgtatatatatagagcacgggacacgggagtgtgtgtgtgatcgatcatctggtggtagtgaaccgtgaacacacggcgcgacaggtaaactagtgagagagcgactgcgagatggaggagaagggcgcgtctcccgcggcggcggcggcgacgagcggggagccgggagcggcggcggggacgatgaaggtggtggtggccgtggacgcgagcgaggagagcctgaacgcgctgtcgtgggcgctggacaacgtcatcgggcgccgcgccggcgccgtttcggtcgtcgtcgtccacgcgcagcacggccccgaccacttcgtctaccccgtcgccgcgcacggtatcggatgtcagcacaccggctagaccatatatacaaactagtgttaacttttaccagttcacttcgcatttcacgagactgacacggcgtgtacatgtgcgtgtgtcacggaagcagccatagcctacgcccccgcctcggcgatcgagtccatgaggaaggcgcaggaggagatctccaggaaggtcgtgtcgcgcgcgctcgacgtctgcaagcagagagaggcaagcacgcctagccagcgctagtgttcacgtatagcgatctgaaaattctaaccgatagcgatgcatgcaggtgagcgcgacgggcgccatcgtggagggcgacgccaaggaggccatctgccaggccgtggaggagatgcacgccgacatgctcgtcctgggaagccgcggcctaggcaagatcaagaggtaaaaactgcgctcaaatcaatccacatgtacacacgcccacgccgcgaaatcgaacgaacggttgtgacattttttgctttcttcgttgtgcagggcgttcttgggcagcgtcagcgactacctcgtccatcacgcgtgctgccccgtgctggtcgtgaagcccaccaaggcgcacgacaagtgaactcgatctgctgctcctttgctgcctgatggatgtcctgtgaagtgaagacttggctatcttttgctactgattactcatggagccggtggctgctgttattacttgtgttgaaaataaaaggatatgttaagcttctgaggctggcagttcttatgtagatgcaacgtgcaaactgaaactaatacatggaactgccgttgaagcttctgagctcctgtgtagatgtaatgtgcaaaactgcaaactgaagcaaatacatgagtagtacttgtggatatagaactgcaatgtttccttcttgttcagtgtgaaaccactcattcagaaaagacgccctcaaaatattcggttcttgtgatgaagttgttaccctaaacacggcttacatgccccaaatcactgctttcgaaggccgaacattgcaagaaaccacaaatcctttaagcacaatcatgaaactaaaaggggtacattgtgtaaagtttaatccaacaaacacatcacaacggacagattcagggattcagtaaaacattgccgagattcctactgatgctattgcttcagtgacctacaaacaaaaatgcaggaactgtgaaagcatgaatccatccctaggcatcaagacttgaacatttgaaacagctaaacggtagcgccatcattttgctcccaaccgccaagtctatcttcgggatcataatttgtgaacaagcggaattcatttcctagcttgtttgaatgctgaggcttgaatccacagggacgcacatttaggagctcaaatgccctgtccctctgaacttcccctggcaaaacacgagaaacttgttacagaaaaataacttgatttgaactatgcatttcagagtttaaaaccagaaataccagaagacaaggcatgtgatccaccatatcacaatactgaacataaaaacagggatactaaatttacgtaaactagtgcacatcagatgacaatgatatgcagactaagctactgtagtacagtacgttgatttcatacaagaagagcagacgatgttttgctttgaaaacaacaagaaggtcatgatgttatagagaataccccagtagctactacaagccttcaactgaatatgccactctcgcgccctagtttacacacacttatagcctaatcagtagtgcatatcaaatcatttcaagcagttccagttaatgggcacttaacctcccggcaacaatttgctctagtttgatacacttgattgcagaaacatgatccaatcatcaagactaatcaatttacaatcatcacgaaagaaatcttggagaccaatggcattaaccagacacgaaattatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 61911 - DNA, 1185 bp, Oryza sativa
ctgaaattttgtaaaaaaaaaatagtgcaagtactaaccgagcaagaatttaatatactagagattattgctttgttagtggtcaagccacatattatcctatatatttatatagttcatccctagttaatgatatttcctttcttctttcattaagccacatcaccctgattatttatatcctttggatgatagatctatgattcaaattgtctcttctttattctctcataaaaccatgtaatcttattttttttagtcttaaaattgtactatcagtttgctttagttttgataatcatattacatcttatttgtacatattatgcaaattaattttccatagcaatgcagtggagtattcatctagtccccacttagtttttgtttggtttgatcccacacttttaatacgccacgaaagtaaaggctccatcttttaccctatatggaattagctttactaaaatttaaattttaaaactaatttttaaagttgattttaagatttttcaacgaagattttttttaacatttgcttttaaaatcgctatagacttatatatagaaatttcaccaacaaattatcattatctgctaatacttcatatggcttagtggttatgcctcagtagcacctttggtcttgggttcgactccccgtgggagcgaattttccaggatttaacggtttgtgctttcagtaatagacgacgtatctatcgacagcgagacgcctatagtaacttcgtcaatctcaaggatttaccggcccagtctttaaaaatactcataggggtaggttttgcgtgcgtgcgtacgttcataggagtaagtgtgtgtattacgagtgtccgtgttgtaccgtgtaattcttaaaaaaaatgaccaacggatggaaaattgggtgcgtatgctaagaggacaaattgagaaggaatcttttgtttttggcttacatgtttcccgaattactaacagtttgtttttgaaaaaaaaaggaggaaagtttctttaaaagttcatatcaattcattttttaatttaaaataattaatacgattcacattgttttacatatcttcataaaaattttctttccccttcttccaagcacacgcttagtattgtagtatagcgagtcaactattatgagcacgatgtattactgggttttgtataaca

SEQ ID NO: 61912 - DNA, 9954 bp, Oryza sativa
aaaccccttggctcgatagctacaaacttcaacgccttaatttggaaggcttgggcaccacgaaaatataaaatttttgcttggctaatcatctaaaatagagtctggacctccgaccggctacaaacgagaggctggccaaacggctccatttaccccttatgtcgtcaaacccaggagatggcaattcacctacttgcagagtgtcggtacacaagaaggatttggaagacccttgcgggctaggttgcgtgcgatcaactgcaccccaatcaatggcaacaagcacggacggtgcatgaatgatggaaaaataccatgaccttaagaggcgttccctcgaaggctctccgcacccttacattgcttgtggcattagagatctagaatgaaagaaatcacagaaccttccagcaaaaggagctctcgacgatcagcccgatggccaaaatcaaagaggaggccaaaacttgggctttggtgggcgcgaaaaacctagaagttggcttattctatagttagctagggccaaaggcctttgctttttctttctcttctggcttaggcctttgtacagtttactcctcttttattcaatgaaattagcgattctctgattcgttaaaaaaatattctaaaattaatagaaccatctaaaacgctggatatacattatgggcccctaaggtatgctactagagcaaagtgaggcttacatatcggcacctaatgcgcatacagtattgtgaaggaaaggattccctacattcaaaacattactatgaaaaaaaagctcaattgcatgtttatatataacaagtttagtgcaaaattttagggctcatttggttgtaaccaacgttgtcaagcctaatcttaaccttaataagatgtggctagtaatatagaagtgtgggcattaagctacttacttagaaaatcatcgccaaacgtaggaaccaaaacctgacaagtgacaagggcatacatgacgctgctcgtttaaaaaaaaaaaacaaaactaacaatggcatagctgcaaacctgcaaaaatcacttgggcctccacactgaggcctcccatggcccaactatcccaacccagcccaaccactgcaccgatccgggcgtccggccggccgaaacggcgagaaatccgtccgtgtcgtcgaaaccttttgaactcctcctcctcctcctcggcgcgcctgtccgtgcccgtgcccggcgtgcagcgcgccgcgcagcaaaaaaaaaaaagttcccgacaccagcactggcagcaacgcagcgtgaaaagacagaaaaagcaaccgaaccgaccacaccgcgcggcccaaatcatcccaaatcaatcccaatcaaccaatcgaccaaaccaaacccccattttgaatttcaaacgccattccagtatcccaccacctcctcctcctcccggcgagcagcgaaggcgagatagagcgagcgagcgagcgagtgcgagagatgaggaaggcgaccgccgcggcgtcgcgctacgcctcctacgactcgccgtcgccgtccccgtctccgcgacgcgccggcgcggcggcgacgccggggtacgggagccgcgcgctggtgccggccagatccggccgcgacctgcgtgccccggcggcgcagcacgggaacctcgggtccgtgctccgtaggctcatctccatggacaagaagccggcgaagaacctccccgtacctcccgccgccgccgccgccgccgccgcgaagaacggaagtggtgggaagctgccggggctgtcgcggaagctgttccagaaagggtcgtcggagcccaagaagaaggcgctgacggaggtcaagaacggcgggaacacgcggacgctcgccatggtgctgcgcagcgagcgggagctcctcacccagagcaaggagcaggaggacgagatcgccgcgctccgcctccagctcgagcagaaggacacggaggtacacgctgacacatccacacctccttccctctcctccccgcccaccgtcaatgccattgtgggcttactgccattgcgtcgagcaggttgagcgcctcaaggacctgtgcctgcggcagcgggaggagatcaggacgctcaaggacgccgtgctcttcccggacacgcagccggaccgccacctccgggatgagatctccacgctcacgggacagatccaatgccttgccgaagagctcgcgcaggcatgttcttgacgattttgcaatgccgtcacttcactaattctaattacccacctaactaaatctttcgcctgcaatggcttcactatgtacaggttaaggccgataaacacacgccaaggtcatgttttgatgatgaatactgctcttccccaagaacaccggtgcttaatgaggagactgctttctctctggtaattttcgcttgctctaccattcgtctgctacaattataatgtgtatgtatgttaagaaatactgaaaaagtttccagatgctccaccatttgattgctactatcatctggtttacttgtacttcataagttgccttcaaattataaagttagttccaactggtttgtactcgaaattgacaatctgcaatgcaaaggtagtgccttggctcatttgttaataacataattgaaagtcccatactagcattcttgtccagttctttacattagataggttaattcaaattgatcggcgggctgtcgcctgtgtagcgaaaaggatagggtaattccttttcacaaggtactcaacgagtactcctatgtgacaacaaagaaaccaataggctttttgttctttatagttaacacaaaagctctcctttttcacaagcacttgtatcacttaaccagaaggcacctataaatcccagtggagatgtagaagacaaatcacagatagcgaaaaatgccggtttgtactctacactatctcacgttttgacatatattctgtcatgggggcaatgcaacatatattgacacacacattcttgacctcactttgcttattatttagttatttctgattttcaatacatgctcttcacctaagtgatagtttgcaaacaaaatttgcagaagctagtcgttaccattttttatggttaaataatttggccatagattaagtcttatccttcctacaaactatcattttggtcttccttttcttttaaaaagttcctctaacaacataaagcctacatggcaatggactactatagtgctacttgtaatagaaactagaaagtaccataaaggcgcccctgtgcatgccagttattattgcgcctatcaaaagtttactaatgctgtttgctgcaacgcaggaatgtagcattggagaagatgacacaccaaactacggtagtccagatgaaatgttcagcaaggatcttaatccttgcctaactccatgcatctccaagagtaaatccgaggtattcaggccggtcttggtacaacttttactcttctactaatcctgtccatttacaccatgaagaattgccttctcctatgatcttatttctatccgcaagccaaagcaaagtgtggattctttttctcattcaaatcatgaacttgaacaggagtacgagcaaccgatcaattctcatcgcagcggcacgaaggccggacaggacagcctctcctgcggttcccgtagcaggccaatgtcgaagagctctgatcatcacaagcctacctcaggcaccaacagcaagcgacgagtatacagatccgaccaagacaagttccatcagaacctgttctagctttgccgtttaccacggccttttccccggcctcaatcacgcttccagcagtctcccctgtgaaatattcacaagcgtgtggactcgtttggtccattgatacatgtctcgagttgttgtaatggcgtcttggtttgtgctttgctgctttgcagtgtatgcttgcccctgctgtttcgaatgcttgtccaagtcatgtggataaactgtcttgagaagaggaaatagcagatgatgttttgcttggattaaggcgatacctctttttctaatttttgcacttaaggccagaatatggcaattttaactatgaagcgcaaaatgcagtagttgatgtgtggtgtgtgtcagataaatctgatggttgagttgttattcggagaaatttgattctgggagtatatgtttgttgaacatatttcagaattatgatgaaaatgattgaatcgctcaatttcggaatacacttcaggctgtcggaactgagacaagtcagagttcaaatcttggtatcagatctctctaggcgtttgcgggcattaatcgcaagtgaaaaaaaccagagccgtcagatctggaacggacggtccagatcccaggatgccgaatactagtactagtacaatctctctctctctctctcctcccccgctttcctctccgtgtcgcgatctgcgatggtcgtctcgtccgcgacaccccggccccaattccaacacgcgtgcccagcagccgcagatctctctccaaattccccaatccaaatccgccctcgcctcgccccgatcgatcccctcgattcgattcgatcccgcccgatgcgagtggaggcggcggcggcggcggcggaggccgtggcggcgtgcgcgcgagcttagggtttctagggtttgcgctagggtttgggggcgcgcccgcgatgggccggtctcgcggggtgcccaattccggcgacgatgaaacgaaccacaggtttgtttctagcagctgcttccccccgctttgcatttttcgctctggttgatgtggaggggagtgatccattcgttgtctggttggggtttgctgcaggtcgaagcggaggagggtcgcgtcgagcggcgatgcgccggactcgctctcggcggcctgcgggggagccggagagggtggtgggaagaaggcgctgtaccactgcaactactgcaataaggatatttccgggaagatccggatcaagtgctccaagtgccccgacttcgacctctgcgtcgagtgcttctcggtcggcgccgaggtcaccccgcaccgcagcaaccatccttacagggtcatggtcagtgcagcttcagttcacttcacttctagctccaagtcttaatgcaacgatgtagatatactttacttccttttttgttagcttcaggtgtctttgcttgggtgttatcctttattactatactaatcagctagtgctctgtaattcttacataattggatagcctaaaatagtagtgaagcttacagttgaaatatttttcactttggtgcttgccattcctgatgcatggtttatgttgtatgtgattttgcaccaggacaacctgtctttccctcttatttgtccagattggaatgcagacgaggaaatccttcttctagaggtacatttttctttcatttgctttatttactttctggctgttgggttttgactgtttacttgttataattaataaaagggaattgaaatgtatggtctgggaaattgggctgaagttgcggagcatgttggcaccaagaccaaggcacaatgcattgatcattatacaactgcatacatgaactcaccttgttatccccttccggtaattattttctcaaactgttaatttgtttagttcaactggtagtcgtctggtactccttaattcaatatactgtctcgtgatctcatcattgtaggatatgtctcatgttaacggtaagaacaggaaggaattgcttgctatggctaaagtacaaggcgagagtaaaaaaggtgagttgctatcatacttttcagttaatgtaaacagtcttttaacctgcaagttgtcaaatattctactttttgtttaacatttgaagatttcacactgatgggataacaaaaaacacatggtgttgtgtggtttagttttcttaacatgctaacatactacttgctaatcgccatacataatgtggttcagtggtttagccttttgtttagtatttgattgcgcacctatggtcctcatggatatatcagtatgttcggtaccctgatttttcaacatttaatatccaaaatatgaagggcaatattaaaacataaaatatagggtgctagttagtgaatgtagggtgctagttagtgagtgatctatgtcatgttctttacctggtgaattggcagcagcacaatactttcaattggatgtaagatccatttgggcttttgtttggatgtaagatctcacatccaaacaaaagctcggatctgatatctgtggatccaacagacacatagatcctaccctacatgcttttggcctatccacctgcatgacatacttccttcactgatttattgctattcccatcagaagcagctgggctgccaccacagcgtaccacagcgtgtaactgtagtactgtatacaaagaaacaaagactaggtatagatgtacaggttaataatcaaagggataagtccattttacccccctcaacttttcatgtagtctaaaacacacccactaacttgaaaaccgggtacataaccccctctaacttttaaaaccatgcaaaggaacccctcatgcaaacttaagtggatttcatctgatgtggcagtccaatcaacccaagaaaacaaataaaaaatcgatcagtgctcttgctctctctgtccatacgggattaccacgatgagcggcggagtgaggcagtgagctagagcgagggccatgagatagtgctgacggtgctggatgccgatagtgccgaggccgagctccgcgtccttccacctccgtcctccgctggtcgccagcacacggcgctgccccgagacagatctgggcacgcatggagcaggcgacgacgaggcagagctcaacctcgacatcaccggagctcgagcttgcgcttgcggcgcatggatgagaaggcgcttggggaggcggcagagggaaggagggaggttgaactagctgacggatggaggaggcgctccgggagccagagcttgagcttccctgtaagatcggcatcagcggtgagctcgatctccccctccccgtcacccttgcgagaaccggcgaggtcgagctccctttcaccctttcaagagccggtaagctccatacccccttcctcatcgtcgccccctcatccgcccctcctacaccgaccgccaacgagcacaagctcaagatccgcctcctctgctgcctctagagctcgatcttctccatgaaatcgtaccagcgagctcgagctcaagctcccccttcccgagcgactcctcttcagagccgacgcgtcacaccagcttgctggtggacctcgagctacttggggacgccgagttcatcaaaggcgacgaggcttggggatgaggaactcgagctcgacgaggtgccagcgcttgccgtagcatctccctagcatgcgtgcacatgaggagggagctcgtcggccatggctagagggaggatgccggggatggagggagggagctcatcgctgcttccgctccttagggagctcatccaaagagaggaggaagaagaagaggactggtgggaccctatgttgacgtggcgtccaaaatcgtccaaaaccagtctaaaaccgctatatgatgtaaaatgtacggttttactagttggagggtgtattatggccggttttgtagttcgaggtgtattttagacaaacataagagttcgagggtgtaaaatggacttttcccataatcaaataacagaaccttgcactgtatgatgactccaaactgtagggggaatccatcatttgtcactgcaaagattgccacacttggattagtccctgcttgtgtcatcatagtgttccaatcttagcaagggcacccctgtgacatcctggcccaattaggatgaggcctgtgtggcccatgtgaactgtgtgcgcatgtttagtaccaccttgctagtctagcaagggtggaaccaacttataaggcctcatccctccaaccatacgactcccgggttaacccttttacacaaagcgaggacggaagtgtaagtggggtggtatgtgtaagtgggcccgcccgtcggttgggctggctacgcggttatggagggagggctgttactacccccctctgaatatggatttctaattggtaattgctgccttgtgtaataattcaaatatgaaaagcagaaaaggagataatatttcactatattggctagtatttatacatgaccttttattatttgtataggaacttcagtgttaccaggggatttgacccctaaggacgagtctccattttctcccccaagggtcaagtatgctgttcttgctttacacttgctggcattactctgaaatttgcaataggttgtttaccaactttttaacttgcatagggtggaagatgcacttggagaaggtttagctggtcgatcaccttcacacatagctgggggtacgtctcaatagcacgcccaccttgaaccactaaactttcaatcaatatctccttatatttgtatgttttatgaaaatgcgttatcacattatgatgatgctgttgaatctgtccaggtgcaaataagaaagcatcaaatgttggccaattcaaagatggtgctaatgtagcaaaagttgaaggtataatcctaactgaacacaacagtcttattttgcattctacacatatcattcagcgttgcactggtgtctataaaacattacttacatttatcgttaattcgttataaccagtcatgggtgaccagatcaaacttaaacggaacaattcttggcatggactccgaagctctcaaatttcaacctttaggatatgtctaatcatgcttgtcacattcttaggaatggaactacaaaaaataacagcaccaaaattatgtttgccagaattttatactggcagcaaaatgaactaaagttacttttttatttatttatgtggggtgtgaagtgtttgtgggaaactcattttctttactgtgtttgtgggaaactcattttctttaccgtatcgaagtatacaccacgcatcctgaacttttcatgtttatgtacatctgtttactttaatattgccttgtttaacttgcatgtcgcagatggtcatgtggatagaagtataggtgtgaaaaaaccccgatattctgcagatgaagggccttctttgactgaactgagtggatacaattcaaagagacatgaatttgacccagagtatgataacgatgctgaacaggcactcgctgagatggagtttaaagaaactgattcggaaactgatcgtgaactgaagctaagggtattgcgtatttacttgtcaaggttggttaacagtgctgatgcaattattttaactgtattattgcagtaacttcattatggagattaagaagatcagcatctttttctgttcatcttagttattatgatgaaagccttttccattgctttagtttctaactaaatcagtacatatcttcgctttttttggtgatttgctaaatgcctgtcactgaattttctgataatccaaatatcctacttgaagttatgtctatctcacacagccatattatgcgttttggtccataaagagaattcatttctttgttgcatttgtaggcttgatgaaagaaaaaggagaaaagagttcatactggaaagaaacttactatttcctaatcctttggagaaggatctcacaaatgaagacaaggaagtttaccatcgctataaggtgttcatgcgtttcctttctaaggaggaacatgaagcacttgttaggagtgttcttgaggaacggaaaattcgaaggaggattcaagagcttcaggtatttatttattttattacatgtcaggtatttaatttg

SEQ ID NO: 61913 - DNA, 3793 bp, Oryza sativa
caagagtactccatagtcatatacttgtgtagttgtgccatccaagatgcgcgctgctgtgctctagcttttggacagattcatgttcactctaatgaataagtcacaaatcactgttgttggtagataaatgagagaatatgtcaaccacaatcgtgtctctgatttctgtttgcttgctactccagttgctaatgcacaacaaagtacaaatttcagctgctggcacatccaaatcaactcttcattccagactttcagtgaaaaaccagaccaagcattgcatttggtggtcaccgaaatcagatggatttctctccgacctggcactcttggaagtcctttcaccagaaaacgcttgtgagttgtttttgaaagaataaaggttataagttgtttttgaaagacaaaagggttatatgttgttcttgaaagaagtaaaacttgtattaggtcccgttctaaacagatttgggatgcatttttttattggttatgtttataattataatatttaatactttctcataaataaattgattatttaggagcattcatcagcaccatccatctatctatctattatcatgttcgttttgaaggccggaaactaccacattaatcaggatgcgcctacggattgggcgacccgatctagggctggggaaatcgggcgctgacgtcagcgcctgacgtcagctcctgatttacgtgtaaaactactttaaactgttttttctcttaaattacttatccaaatcataattcgattgcaccattaaattcgttgcaattaaatcttcaaaacaagaccacacatagatatattccgacgaaaaaatagcttattattgacttatttttaaatattacacaatgttctaccaggtatatcggaattgtttcactaagtaaatcgaaaatgtttcattcctttaaatcgggtgttgtttcaccttatataaaatcaatgttttagcaaatagtaaaagaatatttcagttcactgcaatattacaactatacattgtgaaacattgtgaatacactaggtgaaacatttttgatggaacaaaaaataaaccaaatttccttaatagagagttttcaaaatatgtaggttttttgttgcaaaagattattttaattcactgcaacattagatctataaatagtgaaacattgtaagtatactaagtgaaacatttttttgtgaaaaaaggatggagaagtgggtgggcccaataggtagcacatgagggaggggcgcgcggggggagcgcccgatccggctcccccacgccggtcacccggggacaagtattatcgtattaatcaggaataaagaaatatttaggttgttagattgtggtataatggtatagatttaagtatttaacatagaaaacaaaggctggagaccaaatcctgggatctgctatcaccccgactaaaaaaatagttgttttccgttttcttttcccttgctgatatatcatatatgctttccgatcaaagagattgatgtatatagggccctcgtctgtatacatgctttccacctgattatttcgttaattgaagattgtgtcttcacgatttggttcatgttttagggactatttgaatcgcatgatcgaatagaggattagaaaaaacgtaagtttctgaaatgaatgtaagtataaaatagagaattgcaaaactcagaagacacacacaagaatgatcatttgattgatccgcaaataaacgtaggaataagatgagagagatagacaaaaaattttctaagaggttgaaactcttgctaatctcctccaaaatcacatgcaatgagttattccataagaatttcatatgattttaaaagcttcaatcttttgaattaaattgctaaataggaaaatttctatttaaatccgatgaaatttctatataaatcctttcatggccttagatgttttcaaataaaacaaagtagctagacgccacaatcaaaccaaaagcttgcttgactatgtatttgattctagccacctggtagccagaatattacgattagtttgttaattaattgaagattttgtctccacaatacgattcttgattttaggcgactaagttcgacttttctaaaaaataaagaaagatagacgcctcaataaaatcaaacgtttgcttgaccacgtgtatttgattctaactacactttctgacgtatttgttagcattggtatttggtggtaacccatatcagatggctttcttgaaatatccccgtcaccagaaaaaaaaaagcttgtaggttatttttgaataaataaaagcttttatgtttttttaaagaaaagcttgtaggttttctaagctcatggagtagtattttaccaacttgcactttaaagttttgtaagctcaacgtaacttccaattatatgcacgagtaagttttttatgctcgcggtaatttactagctgcacttgtatgttttataagctcacaataatttactaactatgcactggtaattttctaaagtcaaaaataatttaataactgcactggtaagttttgtaagctcacgatattttactaataactatgcaggttgttttgtaagctcaaggcaacttgctaactgtgcgcatgttaccccactgatttcccctatttgtgcttggatagcttctagaacattgggaattatttccactatatactactccagtagtacacctttgctgagtaattatattactccccccatattttagtacatgatactgctaatttttatccggtaaaaattttaaaactttaaccatccgtagctctcaaaatattgggtttgaaaacatagaaacttttttttatttataagaacttttgcaataatattttttgaaaaaggaattttataacattataagtatgttagcaaaaaaatcagttagagcatactccctctgcctcataaaaaacaacatattaccggatgtgacatatttatagtataaagatgtgtcacatcctatcttatatttattttttaggggacggaggaagtacttttttcatccttgaaaaagaaaatcgatgaatataaaaaaattttctagttgtatgtgttaacggtggcaaattattatcccttcgcgttcacttttcactcaccctacacatacttttactatttcaaataccaatgcaattaccccactttatctaaccctaatacatttaatcgtacttttataatattttgatgtaataattgttcataaagataaatttattttatgataaataagaggttaaatataaacagaggcgagtagtactttatttatggaggcaatgcactgaggacctgtttggtacaactctaaggtcccatttgaatcgtaggtagaaaaaacgaaggaatagaaaaaacatatgattctgataggaattgaagtgtaaaacagagaattgtaaaacacaggaatggtcgtttgattagagcgcaggaaaaacataggaatcggataagagagatagactcaaaggaaattttccaagaggttggagctcttgctaaatttcctccaaaatccatatgcaatgtgccattccataggaatttcataggatttggaaagcttcaatcctttgaatcaaatggccaaataggaaaatttcctataggatttgaatcctataaaattcctacataaatcctttgattcaaaggagccctaactccgaaatttagctccaggagttaggtctagagtagagttgtgg

SEQ ID NO: 61914 - DNA, 2036 bp, Oryza sativa
acaaccccacgccgcctcgccctcgcccaccgcggcgacacctacaaagcccgcgacgagggccaatgccattggcgtgacaaggcggggagcgcgacgcgacgcgagggcggagagagcgagggaggggagaggaggaggaggaggttgatggcgtcgccggcggtggtggcgttcgcggtggcggtgacggtggcggcgctggcggcgttctgcgggacggacccgctgcggacggggagcatggtggacttcccgggcttcgtcccccacgtcgtcgagctccccgacgcgtcggagatgccgccccacgcggacacccgcgagcgcctccgcggcgcggagatccggttccgcggcgaggtgcagggccccgagagcgtcgcgttcgacccgctcggccggggaccctacaccggcgtcgccgacggccgcgtcgtgcgctgggacggcgcccgctgggtctacttcgcgcactcctccccgaactggaccgccgagctctgcggccacaaggcgtcgccgctcgactacctcaaggacgagcacatctgcggccgcgcgctcggcctccgattcgaccggaggacgggggacctctacatcgccgacgcctacttcggcctcctcaaggtcggccccgacggcggcctcgccaccccgctcgccaccgaggccgagggcgttcgcttcaacttcaccaacgacctcgacctcgacgacgacggcaacgtctacttcactgacagcagcatccactaccagagacggtccgtcgtgcaattcctcctcccaatcccctgctgctttctctgcttcactgtatccattgccttgcctgttacagtattagtttagtgctctttactccataaacactcatgcttagttgcttaattactgcggaattgtcaatgaaaaacttaggatccttgaatggtaaggttaggttggaatggttccttgtctgaactttaattgtcgtcgtagtcaccatcatgccaagacttttggacttcaattgcacaagtcttctagatattataatgttctttaaaccagtgagtacgactgaagaagaaatgcagagacatgactgtgttaaatcaattgcataaatccaagtacctggtaaccaattatgctctcttagtacacctccatatgcttcccactgaaagacaatatgctgatttcaaaacaataaagtggcttgtttccatacattttatgaccttcagtaacttcagctgatcttggggcttttgttttccgattgggaaagtataggagctttaccttttcttttcttcacgatcaattttgtgcaaagaaatgtctagttagtacgtcctgatcagttggatgtgctatcattatccatagtgtgtcaagtaatcctgagttgtggctgctggtatgcaggcatttcatgcaattggttttctctggagatccctcagggaggcttctgaaatacgacccgaacacaaagaaagcaacagttctccaccgcaacattcagtttccgaatggggtgtccatgagcaaggatggcttgttcttcgtcttctgcgaaggatcccgtggcaggtctgtacttctccatttcgttcagtgttctcctatttcaacttcataccacacattcgttgatacatccttgttgagacagattgagccgatactggctgaaaggggagaaggctggaaccgtggatcttttcgccatcctgcctgggtttccagacaatgtgaggaccaacgacaagggtgaattctgggtagcaatccattgcaggcgcagcatatacgcccgaatggtcagtcgcaatgtcaggctgaggaagttcttgctcagcctcccaatccctgccaagtaccactacctgatgcagatcggcggcaagctccacgctctgatcatcaagtacaaccccgaaggcgaggtgcttgacatcttggaggataccacagggcaggtggtaagagccgttagtgaagttgaggagaaggatgggaagctctggatagga

SEQ ID NO: 61915 - DNA, 4278 bp, Oryza sativa
ttgttgagacagattgagctgatattgggtgaaaggggagaaggctggaaccgtggatcttttagccatcctgagtgggtttccagacaatgtgaggaccaaggataagggtgaattgtgggtagcaatccattgcaggcgcagcatatacgcccgaatggtcagtcgcaatgtcaggctgaggaagttcttgctcagcctcccaatccctgccaagtaccactacctgatgcagatcggcggcaagctccacgctctgatcatcaagtacaaccccgaaggcgaggtgcttgacatcttggaggataccacagggcaggtggtaagagccgttagtgaagttgaggagaaggatgggaagctctggataggatccgttctgatgcccttcattgccgtcttcgattacgccaatgcatcttagcaaactttatgcctggatacaagggttaaaatgtggaatcccagaatgacgtttgcacaccatttaccactatcccgggtgacatttcataaatgccgctttcaagtaacaacctaagttgtttcatgtttcagttttttcgaagcagatgtagcttgcttacatttttagttcattttcacagtccatgactccatgttcgtttggtgccttcttattgcgctcgataataatttgtgaaattgccggattctctgatccggtgcagtctgttcactgttggatcctattgggccggtacaagccacttgtctctgatgcccttcttgtttttcatcttactctaacctctgatggggcatgtacagtttctctctacttttatcaatactccctccgtcccataataggtgacgtttttgactttttatttgcaatatttgaccattcgttttatttgaaaaattagtgcaaatataaaaaaagataagtcatatgtaaagtactttcgataataaagcaattgacaaacaaaataaataataattccaaaattctttgaataagacgatgatcaaacattgacaaacaaaaactcaaaaggacaagtaatataggatggaggtagtacaaaaccagcaatatggatctctcgaataagagaaaaaaagtgttcaggataaagtagcaattgtagtggcatggaacattattcatgctactgtaccttgagtgttatagatgtaaatttggacagtacatcattggaaattttgaaattttttagataatagattaatacccggcctctacatcccgcgggatacacgcagccccattggaaatttcgaatagacggtcaagagtacaattgtgacggcaggggatccagaatcacatataacatcctctgcttcctcagctccacctcttcatgtaagacatgcacgcacacacatcgctacacacacgtacactgcccatcgcaagtgtgctcctttcacatgctcagagaaatggaggctagcgataatttcaaatatctatgttatgaaggttctatcgttaacagagattcagtgttggaaccaatcatcgatcaggtgtggctgttttgttcatttgcaggcattttatgcagttgtcattcattctccgcggatccatctgggagagactgggaggctcttgaaataggatgcacactgcacacgggaatgaatgcactctccaccgcaatcttcagttccccaatggcgtgtccttgagcaaagatggcgctgtcttcgtcttctcgatggaaatcgcggcaggtccgtatgctgatcaatcatcttatccccattcgattcaacaactcttcacttggcttctgcttcatgtcagacactgatagttgcatctttgtcgagacttgagacaggttgagcagattctagtagaaaggggagaatgcagcggggcattttactatttatcacttttagatttgacatttaacaatataccgcttatatgtctatgacgtatggattctcgtgtgtctacgatatatgggtctagatgataaatcatcatatgtgaaagtagcaaattgttaaatatcacgaatacggcaagtggatcttttcggcttttcgccgtccctgcaacggtttctagattatacatgaggaccaacgacaagagtgaattctgggcggcaaatccaactgcaggcacaacatgtatgtcaggttgctgagtcgcaatctcaggctgaaccgctgaagaagttcttccctaccaacttaccaagttctccgagcttataggatgctggccaattcatcgccttaactgccatttttgccaggatgaaataggtgaaaatagggaacccgccgatgtctgttgcacctttgcacgctgctgtcccggacgatgaacaatctgaataaatttataaaattttggtcttgaagcaacgtggaattgcttccgtcttatagagttacagtagtgcatgtggcttgcggacatgtttaattgagttggatttgctattcacagcttcacacaattgaaaattcaggatcaatcgcactcaccatcaaaacgtgatctattagctaaagaaagattcgccacgtgatcttgtgctccggagatagcaactccgcactcaaaaagtgctatagcagtacgagttcccttccaccactacttaaaaaaaggtctttgcatacgggcgggagagattttcacatgcggttggcgcaaccgcatgcgggaaatcgtctttgaaaatcaccaactttgcatgcggccacggcacccacatgcgaaaatcggattttcgcatgcgggcgcttaagccgaccgcatgcaaagagaaaaaatcgccaaaaaaaaataaaattccaaaacaaaaaaaaaacctagcccgcaggcggcggcgccgccgcccgagctcgccagccgctcccgtgccacctacccccgctcccaccgccgcccgccccggtcccgccgccgcctgctcccgctcccgctcccaccgccggccacccccgctctcgccggatccgagcaggacgaggcccgccaccaccggatttggacaggacgaggcccgccgccgccggatccgggagggacgaggcccgcgtcgccgccccgtcgccgcccaatcgtcgttgtcgtcgggatcgtcgttggggtcgtcgtcgcgccgttctcggtcgcctccgcccaccggatccgggcgcccactcgtcgtcggggttgtcatcgtcatcgcagggtcggcggagacgtcgagccgctctctgctgcctccgcccgccagatccgggcgccctattgtcgtcaccgcccagtagtcattgtcgtcgtagtcggggttgtccgcatcggggtcgtcgtagtcgtcgcgcagctttcggccgcctccacgcaccacgccgctcccgccagacgccaccgagcgccttcagctgccgctcaccgtgcgccacgccgctgtcggccgccggcgccgccgctcgccatgcgcctccgcccgctcccggcgccgccgctcgccaggcgcctccgaaaggttgagagagaggagagaaagagtgagtgagagagaggaagagaaagagatgaggggaaaatatcagagaggggagagagagaggagagaggagaagagatgaaaaattttgaagtggtgaggagggaaaaaattaatctaaaattatgagaactttgaatcaaattttatgatattaaatgaactcatatgaaaaaattaccaaaaacaaagttgtagaactcgttgagatctaccaattttcttttggtcatttctccatccgagtttgattgaactatataaaatttgaactttataatataagaaattcaaataattttttcacgcagtaaatgatttcaaatagaaaagttgtcaacaataaagttgtataacttatcaagatcttcaacttttgtattggtcatttttctatacgactctgtttggaccgtttgaatttgaatttcaaaatatgacaactttaaataacattttcaaatacaaaatgatttcaattgaaaaagccatcaataacaaagttgtataactcatcaagatctataacttctattttggtcattttttcatccaacaaagtgatttgtaagattgttcacaaaatgcacatctcttatataggttgtataactcatcaagattctattttggtcatttcttcatccaacaaagtgatttgtaagattgttcacaaaatgcacatctcttatataagtttttatataagagatgtgcattctcttatataagtttttatataagagatgtg

SEQ ID NO: 61916 - DNA, 2059 bp, Oryza sativa
ctagagaataacaaaaggcacggtaaatcacttccttgaattcaaaaccttgttgaaccagtagctgaattgcactttcaagtgcaaactaaaagaaatacatagcttacataagggcctgttgctgttgatgacttggcacaaccaccagagataggtggtcgcacaaaacagttttgagcgcatcctgattcacgacttcttccatcatgtagaagcgaattgacagaaagagacgcctgatcccttgtgttgtggtgaaaacaaggatgtgcacagatgaggcttggacagactagcctgtcggttattgcatcagtgaaggaaagctggttctagttgagcaggctcacggatttgtttggttctcaccctggacaagcaagagctgcacagcttcagcaacatgaagcgccattgcatcaagatcccccttaaccttgtcagaaacatgcaacatggatgcatccaaatcgcaaggggttctgtctcgcagatgctcacccagatcacgcatcgcttgatttagcttcgagttcatgtcatccagggaccttgtttgatgctgcaaggactcctcacatgccctgatcttctcctccttcaagttgactttaaaaacgcactcttggtaatcaaccagcaggcaatccatgtctttctgctcttccttccaaatctctgtcaaggtattatcacgtacaaacttctcgacgtcagcttccagcagggtcaggcagcaattttctacttctgattcaagagatgcaatcttacaatcgatatcatcgtgtctgttcatgcttttaatttctttctgcaccatgataagctgttcacgggacttcttaagttcagataaaagctttgttcgctcctcctcagatctcagcagctcagatgccttaccaaaattcacaggcttcgacaatgtaggagtggaagtgtcgatattatcaatagcaaaaaggaccctttctgcctcctttctctgagcttcgaaagagcggagttttactttaagaccgtcgattttgcttctcaacgcggtttcagattcacgtgcttttgtagatgcaacagaaaattcttttttgagagtttggaggtgactcagttgttccttcttttgattcaataattccaagctgacatcaaacttggacccaacaagggctttggttttcaagtccaagttccagcatgatgccacaggcgagaaatacttgctttccaaagcttctttactctcctgtgattgtgacagttcagccttaagggcattcatgtcttcctggtcgtgcttcagttctaggcaatggtgctgaatgcttgctgaaagttcttctgccttagtactagccatttcaagaagtttaaaatactctactgcatcctgggtagttacaagcttgtcgtggacattcttcagtttgacacgaacaagccgcaggatttctttaaacgttgatattgcagagtcatgtacatgttttacttctagatcttcatcatctgttgcatcacgcatttcaacatcttcatattgagtatctactgtagttaaagaattgctaccctcaaaaaatttccttttgaattcatctctttcctgcatagctttctcatacagacccataagtttatcattttcttcatgcatctcgtccagttgaagttgcaaatctgtcaattcacttcttgaaaaattatccttgtgattgcactgtccatccattatcttggagtccgatacctcactggatgagttgtctgctggcaaaattgttgcactctctggcttgtcatctggcagcaccccattcgcagcagcccctccataagaatggctgctttgctgctcattcacaccttcaatttgaggaatggcaggatggcccccatcttgattcacctcaccattggcgatagcatgttcatagagctcaactaatctcttattatcctcaatcaaaactgtaagccttgttcttagttcctcattcgctttggccaacccaatagcagtttcatgagcttctgcttctctttgacttgc

SEQ ID NO: 61917 - DNA, 7786 bp, Oryza sativa
  unsure (1)..(7786): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaggatcttgaccagatatcactgtgttcattaatatgctaagtttggtcagagtaccatggtctttcaccctacagccatactcatggtgggtgaaaacttccccgattagcaatttatctactgcatcttccctctttataccagtaattttttgcatagcttcattccactctaagcaggaaccaagatcattgatcataaatataggggggatgagctccgaagggttctttactatagcaacatagtccccttgtatccgagtgtacttatccatgataatgttctgccctgtcatatcttgtgctacaaagcaaacccccacaactttctctgaaaggtcacgactgcagcaggcgttaaccatcaaaattacaggtccattattttcctggtgattaaatgttttaagcttaatttgcagattttgctcttctattcctgaaatacaagaaagaagacctaagttagtcacccaaaaaataatggacacattatgattaagttggatggtacaaaaaggccaagttcaacatagagccaaccttgtaaagctgaatttaaaatttgcttaaccacttcaacagaatcatcgatgacgagatcgaccagaggcttccctatggcttccatgacaggtaatccagtgagttctgcagccttattattccatccgtttatgctcccagtgatgtcaacagccaagataggcgcagttgctgtctcaattaggcgcaccatctcgtttgtaacggttctcagttcaaggagcccctgaatcttcttcatatcatcagatggagctgtaacaatggactttgcattgttgttcttgttggcatcttcatcttgcaaggagccacgtaatattagctgcagagaatggatagcatccatttcaacatcctcccaaggaacactcctccatttaactacctccaagaaggctttgaatgaagatcgtggatgcatcttcctaccattgtcatctgcatcaattggttcatgcttagctcctccccatttaatctcctttgccgtgtgggatcggaaccagaagatgaaatcttttgaagagatctttatagctgccatgccacacacaacatcaccaagtgcagcagcgccaggataacctgcttcaactaagctgtcggtactcaatccagtagaaccgtcatggtactcctgcaaccaagcaacaatgttttttatctctgcttcagagggcgttgatcctagcacccaaagctggttttggtaatacaatgctgcaccatcacatttcactagatccattacgttaggtgattgggtaaatatcccaacaggagcatctcgaaggagcatatcacagagaagagtctgcgtgcggaggatgtgcctctcctttgcctgagcagccagttccacctccttgttgatctgtatcccaaatacttgcaagagaaactcgcaagcatacctaagcgggaaagggacaaacctcgggcttgtgtgatggcagaccatcaacccccacagcttcctccctttcggctgctggtcactcccagtgtctccatcatcatcctcatcctcatttatagtgaccgacatcacaagtgatgcaacggagcccatgcttgccatgtactgtgcatggcaaccatggggtgccctgagagtagatccgcatatgcttataggttgtgttaggctgtcatcttggatgatcttcacaggcgttgcggagcaatcgcatatcatccgcactttgttcttcatgaacaaaaacctggatgcctgaggaatgtcagtggctgggtagtgcaggccaagatacggctccaaatcagatctcttgcactcagcaatcacctcaccatgctcatcctcatggaacttgtacgccatcaccctgtcatagccagtgagctcgctcacctcgcggaccagcacgtcgcacagcagggagaggttcccactgggcagggactgcagcctggcgatggccctggcagcgagcttgtacgacttgatcgcgcctgtggcggtgacgggcaggtcgacggggttgaccggctcgaggtcgatgacgaggccgacgtcgatgcggtgcatgatggcgtagaagggcttcccggaggtcctggcgtggacgaggatggggttgagcaggttgacgtccccgaaggtggcggccttctgcagcgcgacgaagctgtgcgagcggaagagcgtgcgcacgtcggtgccgacggcgagcgcctcgcgctggtcaatggtgggcacggcgtgcggcgtgaggtcgagcatctcggcggcgttctcgctgtaggcgagcagcgcgaacgtctccgggtggacggcgagcaggcacccgaagggctggacgaagcggccgcgctgcatgttctggaggtaggcggagacgttgctggtggtggcgcccgaccgattggccgcgcccactgacgacgagtagtcgaagtggcgctgcgacccctcgaactccgcgtgcagctgcgcgtccatcggcgtntgcgccaccacccgcgcgctgtgcttggaccgcgccgagctgctccgcgagcacgtcgcccggttgttcgcccgcgccgacgacatctccacaaccccctcctccccctcgcccccaaccaaatcccctcctcctcctcctcaactagaaccaccggctgcgaagggggattcggcgaggaggaaccaaatgggcgcgcggaggtatcagcggggaatcatggccgcggcagcgagcgaaataggcgagaaggcggagcgcttttggagaaaagccgcgagggggattggattctgccggggataagcacggattggaatagcgccgcacctgagtgggacagcgagccacactgcacggcaaggcagcccaagataatatctccctctctctctccctctcttcgtcttcctcctcccacctcccaaccaaagggaaaccgaagcaacagcgattactacctcaccaccacgcagaggcggcgaggcgagggggcgacggcgacgacgacggcgaggcgaggcgggggttggtgcgtggggtgggtgagcgggatgcggggcttaggcggggaagaggggacgcgcgcggccgaggcggggcggcgcggcgcggcgaggtgaggagaggcggcgatggcggcggaggcggtcgcgtcgggaaaccgagagaggaaagccgtacaacgtcatccggttcttcttcctcgcgcagaagtccgtccttttccactcgtggtaagtgctaaaaaaatggggaaatgcttcccaaaggccagaactttggtagagtaggccctgtattgattggattcgatggtttgatcagacctaaaaatatttaaaaacttttttatactgtaccacgttgtcggtcgacgtttgatgtcgcggttccggtatttacatagtatggggatcgttggtactaagatgtatacgagacttaggtaaaagagataacgacgaggatttttatacaggttcgggcccctgaattgtcaggtaataaccctacatcctgttggccgaagccggtattgctcttattcaccataatcataccagtataatatttggggtagcctatctaactgttgtcgacctggcggtctgtagtattgactcgtagtcgacaacatggtaaccttcctcctcgaatccgcatagatcagagacaactctatatctctcctgacggtagccataggcatcgtaggggactagtcatgcctatctctgaagtcgatacctagcgtcttgtcttggcgtatgttggcttgtatattgatcttatgtcttgatctattgttccgtgtcccctctcctcttagagggtcttgtatttatacccataagtgtccctttgtccaagtaaaactagggaaaccaatatgaatacaatccgagtagttcttgtcgtttccatatagaactctggttgtctttccttatccggaacttcatccatatccgaggtcagtgtcagtataagacatagtatatggtgggtcctgccgagatttaatcaactactattaggtattaggtaggtatgtggtatccataaccctgacacacgtgagtttgagctatgaggcagatgatgaaatccagtgctattcgatttacgctaaagaataatcaatttcctaaagttttaataaaggccccgtttagttcaccaaaagtttttcttaaaaacatcatatcgaatctttagacacatgcgtaaagcattaaatatagataaaaataaaaattaattgcacagttagggaggaaatctcgagatgaatcttctgaacctaattagtctatgattagtcattagtgctacaataacccatatgtactaataatggattaattaggctcaaaagattcgtctcgtggtttccatgcgagttatgaaattagtttttttattcatgcccgaaaaccccttccgacatccagtcaaacgtccgatctaacaccaaaaattttttttttcgcaaactaaacagagcctaactatcgtaggagtaaataagttgaatgttttattattggggttgttcggaagagcttgttgcagcagccagccaacaatagtacaacagctacaactagttataccaacaacgagcagccgctacatcctacatgtagcggcctcaagccctcaagtctgtccactgttgtaggctgtagccaagcgacgaggttacgcagcgtagcaaagatgctgcaacaagtcccgccaaacaaccccattaaaaattgttgtcatagatctatccttattttagtagtacttcaagttagcctttgactccaatacatgacccacaattctacacctccatattgttagcttatttggtatatgtttggaatactttttttttaaattctaacaaacataaactatcatcttcccctttaaaatatatggactatattaacttttagatatgatatttgtatcgttagtcttacttagagaaaactaaaactatgtaagcatgtgtgtcttatttttatcactaaatatattttaagcatgacttacaactttacattttacactaaacttttaatcaaaacatagtcaaacgatataatctctctatcccaatttgatcatcatccaagatttttaagtttttttcaaaataatcatcatttaacaaagcttctctttgtttctttgtgcaaatagtacatgtgcaccgtggagtgccctgcatgtatataactgtatacgtgcaactaaccaagactaatttttattggtttaatctatgcaacatttaaagtatgaattaatttttgttggacatgattcgcacgaaccgacataccacattaatcgatgaggattaattttactatgataaatgttttagtgaccttggttttagtgcctttttcttaggtagtgatcaaactgggatggaaataatatcagaagtcatcagtgtaatactatattttaaagtgaagaaaatatttgctgtgtgaaagatatttcactatcctttcctttgttgacttatgcgacaaaacatatatggagttgtagtgcacccttcgatgttgatagcttgtaccttgacatatgcatctagacaagtcaaagccttatatatactccttttcttcaaaataccatacaagttttcatggtctccaacataaaactttcacttttaatttctttcgtaatagtattaacagttactccatgtgtctgacaatatgaggcgtattatgtttctatacggtctccaacattatactgtgaccaatactatttttataatatgttatcagcaactaaaaaactaacgttgtatgaatatattttaaaatataaatcaagtgatactacatgcatgagactaacattcatatttttagtttaattattagtcaaaaaaataaattttgactttgcagaaaacaagaaatacaccttatatttcgaaacaggtggagtataaaattgaacatcatatgaatgcaatttcaaatactattggctcctttggaacaaaatattccttgaggaattttagaagaaaaaaaaaatcaattctataaaaaactttcatacgtggtcatttggataaaaggaaagtatcctatgaaattcctttagattggctcgagacgtagagattttgaaggaattctaacgtgaacttcaacctattggaaaagatcatttgtgtccatctatcttctagttactgtacatttttctatgctccatctaaacaataattcgtgagaattttctctgtttttttttcaatccacaagacttaaggtactagaatacttcaattctgtatttttttaagtatattgagaatactgcgtttcaaaggaaccctaattaatgatatcatattcatgatactcaacatatatagtattgttactttagttattagttaaaatttacaataatttttagaaatatggtccttatattttacaacaaagggaatacccattattttgcttatgtggatatacgaaaagggagaagagagacaaataagagatgtctcgaccacaagatatactagaaaaaagaggtagagatgaatggtattacatgatatatcggtctcttttttcgcttatgcttatatttatcagccaaaatttgaattttcaaccttaaatttggagctgattttgaggtttttcagcaaagtttattttttcagcctttacttttagatcgctaagaacacatatataaaagttttattcacagattacttttcatttataaatatgtcatttcgcttatttcacgaataagcgaaacgatggctccctattgttcttcttgcctatgcccttcgtgtacagggaaaatttgagcaatatcttaatgatgtgaatagctagagccagtacattgtttcatggtcgaacgtgcctagcaaggtacgcacgtatacattgtttcattaatcgatagggttgtaaatgataaagcaacagagacacacatgtatactttcaaaaccttttctttttcatcgaatatgcctttctcccttttggcaaagcaaaattgtaatatgcaaaaggcataaatatatgtccccgttagccctgagcccggcatgctgctttcatgtgcgagaccacaaacccacgacaccacgaggcacgagctactgtagaaaaccatgagaaaaattaccatcgatcccgacgaataatcacccggctcactgctcaccagtcaccacggcaccacgcacgatatatcgttactccaattgtacacctagcaagactgcaatcggtatggtcgtacagtgctccgttgggtgttccaacgaaactgctcgtacggcacaatgaaaatttactccacgaatggaactgcaccacatggcaatgagagagtgggagaaacacccactccgaggcgactttctatttacacggacagacacatactacataaaagcgtttagtgcacactataattgaaagttgacttgatattaaaacgatatgacagaaaagttggaa

SEQ ID NO: 61918 - DNA, 15027 bp, Oryza sativa
ccgccagtgtcctcctcctccttcgccgccgcatagacggcgtgccccgctgctccctcccggccgcttccgcggcatcgtccctacgagtgcaagcagagagcgagaggaaggaaagagaaacagagaaagagaaagggggaagagagaggctgacgtggccggctgacatatggggcccacgtgggtcccaactgactcagccgccacgtcggacaaaaccgggttgaaaaccgccgagggacctccggtgtccggttttgtaaagttaggggacctcgggtgtctggtattacggttcaaggacgttttcgtatctcggtgacaagttcatggacctctggtgtacttttccgcttggcttgggtgatccggttaccggctggaattcattattccctagacgagccgaactttctcagcaaggaatttcccagctgcaacgcaaatgaaaagatttctgtgcattcgttcatcccgattactcacgtaccaaaaattgaggaagtcttgtttcaagaaaaaacaatttgagatgccgatgatccatagaaggaagttcagttaactggagactcatctttcttttctccgcgtgcaaaaaaacacgaagaaacaccagttcaacatggtcccaggctcccagcccatcgttccatttgagtttttcttcttgggcttcccggagaggtctgaaatcctcgtgggcttcctcaaattaggcctagagaatcacacgctcgtctcaactatctctactcagggtttacgattccgagatggccttccgtttcaggctctatcggaataacggttttcataaaatcaagtggaaagccgatagattccgaacaaattttataaactaattttttttgtggggttataaactaaaatttgaatataaattccctgagtttaccaataagttcgtgaaaaactggtcggccttaacaaaattccgagcgaaatcatcgaaatgtcaatcggtaacttgaaaagaggtaaactgaaagtgttttcctttttttaatttgttattcttttctttcctactgtaaattttagtaaatacacgaaatacattattttttttgaaaatttatatcccaatagattctatgagtatcatactatttataatattttatttatttattttccttttttatcaattcaaatttgaatttggatgaaactcgtcgaaatatcatacgggttctattttcgagcctcgttgaaacctcgaaatttcgtggaattcaaccagttttcgtcggaattatgaaccccgtctctactactccctccatctcaatttgatcatatatttacgaacaacatcaacatcaagactagaaaacatcattacttctgaaaatacaccttatcgatttaaggtgttgtattatacatgcaaatgggcatgcaaatatgcaattgaatacatacgaggcatgcagcaatcggggtagttaaagattggggcgatctgctcgcaccagagaattttggacggcgtggacgcacgcgcgtctatccacgtcccccgcgcgttggaaggctggtgtttttcgggcgctctccttactcgtccgcagcgtcgtccgatcagcatctcgcgaccagagagcgctggagctggtaagtttgcaaaaaaaaaaaaaccctcccttaccttaataatctttcttaagtccctcaatgtaagttcgttgtcttatgtattcttatgtaaaggccctcgggcgctctccttactcgtccgcagcgccgtccgatcagcatctcgcgaccagagagcgctggagctggtaagtttgcaaaaaaaaaccctcccttaccttgataatctttcttaagttcctcaatgtaagttcgttgtcttatgtattattatgtaaaggccctcaagatatatcttacgtgaaagagacaacatttcaagtataggacagcgctctgaaaaagagaaaataagggagttttctgaaaaaaaaaaagaacacccaatcccccgaaaccctagccactactgttccccaatcccttctcttcctttcccttgtccttgcgccgccgccgctttttcttccctcccccgcttctcctcgccggcgacgacgacttgcccctcgagctctcccctatcctgcccatctcctggcgctccctccctcccttcgcttgcatcctcacgccatcgtcggccccgccttccccttctcatctgttcccagcgatggcatggggatcaatctgctgacccaggcccttctcttctagcagggggagtggaccatgcggagctagctttgggggcactgtgatagagatcgatggtgtggctgtgtggggatcgatctgttggcccatcgcctgattttgggtaggtgcactcaagctcaacatgaagttctcaatccagtgcgttgcgctcgaggtcggcatagccgccgccgccgcctctctccctcctagctctcccttacgtacgactcttgggctcccttcctccccttgcattctcacgctaccgttgactcatctatcttcttctctgggtgatgatgcatcaggagaaggtgagggactgagtggagaccagagacagcgcaaccactcgatccggtgggatggagcctgacctcgactttggttcaagttggtggcgtgcggctctgcaatttgaattgcgttcgatgttctacctccagcgttgatggtaatcccaggcaccttgagggcttgaggtcgatatggcacaattttgctactggggaagaagatgtgttgttgcaatggccaaataatcacctcctttatgctcgatccactcatgatcttcctcccattctctgtctgcgcctgcagtgctgctttttccatgagagtacagcctcttcattcttctcagcgacttgctctggtcagcacctggtactaattgtttgccaccatgtcagattgctagcatctaaagatgcagttttgcatccatattgcaattacaagggatttcatacacaagtactgctttgctgaaggattctgcgtttcagtgcagtagtgggatgaatcagtggaaagtgaattaattgttgtttactcttttacttattacacagttattttgtgagtttacatgatgcttctttgaaatgaaaaatctccaagaatctgacaaagctagaaactcaggtaagtttgacaaatgtcactatattgttttgattttgcacatgattgtgtgatgaagttcgctttgtcagttaatttgtacccaccgaaggttccatatcagatcccacatgtctgaatgctcatttctactataaccttccattcccaaattctttgtttctttacatacatgagcactccttaatttgttgacaaatcaagtttgcttcataaatgtaatattggtatcggcaagtaacaacaaatctgaaactattatttgctttggaggtaaacatgttctatacatataattgggttgcgtgcttttttttatagggcattgttagcaacttaccatataacaggactgtcagattttttatgtgttgcttgttcttcgctttgtacatgtccattttggtaaatggtgtacgattttttttctggacttatgttcttcaagcattgtagagttgcagtcttattagtcatctactactgtagccttatctataatgtgcattttggaagtgacgtttcagattttggtattaactataaagactgagaacccatgccacatactttgtagaactcccatgtgtattggagtaatgtgattagttatccaaaacattattgttcatcagaaatgatttcagtaatgtattacttgggcatatgacttttctaaagagtgtcttatctaaccaactagcttttctgttgcctcataaaaaacatttagttaatcagagactattttaggggggagctgtcctacaaatgaatttctgcttcattaacataagcagatgtttcttgatatctatgcttttaggtgcatggtctgcaacatataatatatcattgccacataatggtacttaattagctcttttttacaaaaccgaatgattaggtccatttgtatatagacttatatatatatatatatatatatatatatatatatatatatattttgttgcttgctcttttaagtaggataagttaacatggattttggactaacttattaggtgattttatcttgcagaattcaagctctatttttgatcctcacgtgatggcagggttcgagttgtatagcggtttctgttagaatgaatacattaagaacatgtttactaagataaatccattgttaaagttgtaacatttcttaccgacaatatgtaatttaaagtgattatagaatctatcgattgtgcttatggctatctgtgtacttgatctaagtctaaatgggatattaaaaaaaaatgatgatttgatataatttttttcaatatttgaatgacagtgaagttatatacaattacagatatgatgacatgctttaaataatcccagtagaactttgcaaagcctacttgcccgttgtaatgtgattttcgttgtccataatactggtctcagcagttctcgcatagtcctattatttgctctgatttgagtactattcaatgtttttgtaaatgctcctaagctacatagctcttaacgaacattagggcgctgcgaagcgcgcctaaagtcctagtgccatttactcctgcacagataaaagaacaaacatgcaacgatgacattaactttgcacaaatacttttacgcgaataaacgaatagataacacttagataatgatcaatttaggaaaacctcaaaaataatctagggatgatcaatttgggatggaaggaccgagggagtaccttaaaagagaagtcatcctcctttccaccgctcccctcgcgtgcatcgtatgtcgaagtaaagtagtgagagaaaaaggagaaaatcacaggaaaccaaaattagtggttgcacattgaaaaaaaaccacaatgctctgaaaaaaaaaagagagagaaaatacgctagagtaaaactaaaaagacagtagttgattaaaaaggtattgctttataatgtatgggcttgtttcaatgcaaggtatattataatacaaatcagaattgttaaccttcattcgatataaatttaagtaagattttcatcaaattttggaccgtcaaaatcactttgagatttgtgacggcatccctctcctccagctctagtgcggctaggacgggcccaactaattagggttcaaggttacagtcatggtaaaggaggggttgggctgggaaaaatgaacggtttttcctgagcttaaaatgatgactgtgagtaatgaagggcgtgtcttaggtgaggagggagaagagagcagagggacggtcagtaggaatgcaagtgggacgggcgagcgggtttttttagcatgtttatttcacttctagtttattttttcttctaaattttatactatcatatgaaaaataaactaacaaacaggtttgtatgcgggtagtgggactatccacttgcatctctaacggttagtgggtctcgccggcattagcgaggttgagaagcggcgcgtgggggtggtgcgggaaggatggtgtgctggcgaacttggtctgctcgagcaagttacggtggagaagaagaaagagggagatggtttaatgtttacacacgaatctaaatgttcttctaaccgtcaaaaaataactgaaatcaaaatgggcttttttttttcaagttttacgtaggctctcctaataaaaatcgtgtgctaatcaaacactgaaaacacgaggcactgcaagatgcaaactatgcaagtgcaatcacgcacgtatgtccaatggattatggatacatacaggtcaggaatcatgataggtgggaggctgcggttggatgcgtacagatcagtcggctaaaggacgaaagatttgctaatgggacagtgtcaagcaaagcagcggtgctccacacgtaagcaccctggccacctgataggacgtctgaacggccgcctcgtgggtacccgttggctggggagtcctaaactcaaaactgttgttatggtaaggataaggggataacgagtctagaacactgcaatccagatatcacaaatgttcagaaacagtaaacacagaggaggctgtctggtctgtgtggtggctgcctacctttatgctcatctgattatagattcttttttgtttctcaagttgttagtcctaggcctacaaggccacaagggccatctaaccaaagaggctgcgtttgattggctccagggatgatcacctgccactgatgagtaacaaatcttcgatggaacctgggtatgttctgtcagttcaggggcagtttcagtagttcccatgctgcattccaacaaagatatccatgcatacataccccaaatactactatcaaaacaaaccccacatggtaataccaccaattctcccgcggtccacacaatgcaacgcaacaccaaaaggacaaaactccagttccgcagcgttgccaaactccggaaaaaataaaggcccatgagccgaaacaccggcacgcacgtgaacccgaaacggaacgcagccgatgcggcaaggcccacgcgacgctagctgcagcgacaaagcggtggtggcgcaccgctgccggtggcacgtccgcatcggacgccgacgtgcgtgcgcgccccaagccgcgggatctcgcggtctcgtgctcacctcaccgatcgagccgtgccgaggcgcacgcgaccgcgacgccaccacgtcgcccgtctcgcctcgccgtcgtctcgtccagatcgcctcggcgcgcgttgccgtctcgcggtctcgcggggcgcgggtgattcgtgcgtaccagcagctatcggccgcgtcttttcgcaccgatctggctacacggctggggcgggatggactacgacgtgtgcgaaaaagcgagctgttgcattatctaatctgtgattttccatcaccacacggtgacaaatggaggcaagggagcaaagcaaagctggtggcgacagtgagatgtccccgagtgcaacgtaaataaagcaaagcaaagcaaagcagtcgtggtgcagacgaaacgatcattccatcaaaggcccagactgaacagctctctcttcctccttttttttttctctctaaaatgcattcaaatgcttgtacatgaatttacttgggactgtttattaatgacgatatatacttacttatttttcacctctaaatgggacgtaaggaaatcaacagttacagagggagtgtataagagtagataaagaggagtacgtgtaggatgtgtagtatatatgtgcgtgtctgtacggtgcgtgcttaattatacaggaggagagatcggagaaggtaattaaggagaagataacgatgatcattaggtcacatgatggcgcaggcgtaggaggggtcctcctcgcagacgatcctgtagccgccgcaagggtagggctgctgcggcgggtagcaggggatgtactgcggcggcggaggcgccggcgccggcgccggctccggcgccttcccgcaggagcagcagtggcagccgccgtggccatggtggcagcagcagtcggacggccacgacgggaacgggtaggggtagggccaggggtaagggacctcgacgaccttgggcggcggcgggcatggctcctgcttgggaggcggcggcggcggcggctctttcttcggcggctcgggctccggctcgggcgccggcgccggtggctccacgataatcaccgccggcggcggctcgggcttctcctcctccttaggaggcggtggctggggctcttctttcttgggtggctccggctccggctccggcgccggcggcggaggcggcggcgggaggtcgacgatctcgatctccttgatgatcttgcacgccttgcagcagagcttgtctgcgagcttgtccgggtcgaagggccccgacacgatcaccttgttgtgcttcacgtcgaactcgatgtcgtcgatgacgaactcacccttgtctgcgcacgcaagaactctcaaagattcatctttgttgtcacgattaacccagctcaaaagctgccagaaacaccatttgatcctagaaactgcaaaccgtgcgacgagagcacctacctctgatcctggtgagcaccctgtcgatcttggcatagcagcgctcgcattccaagtccactttgacgatgatggtccgcttcatctgcaacgcaaagctcccactgatcagaactcagaatcctacctgaatattctttttcttcaaaagcagagcagggttgagaaactaaacctctactacagaagactaaagacggagaagaattgagaccaaagtattgatctgattgcaactgatttatgactacataatcgactaccagtaccaaactagatacaaaaagaagagaggaactaagcacacgaaggaagaaaaagcaaaggactagttcgaagagtgaaacacactccaaaaaatcaaaagctgaaattaatccttggaaggacagtcaccttcctgcaatcatcaagaacgccagctagcaccatcaaaattaatacccaatcctaccacataaactcattaagtcttttaactccgactgatgaacagagttacagagaggaaggcacacaacacacaccactcaccttgattcagtcggcagccgcctgcaatgcgaggaggaggaagagctgcgaacaagcgcgcggcggtggagtgagtggtgatgccgcgggaggtggagatgtgtagatgacgatgcggtgtggcgtgaatatgtagctatacacccaccatctttttcgtgtctctcggcggcgagagaagaaagggaggaggaagtcaggaagaagtacctagaagatttaaagggagaagaaaggaaagaagaaaaaaaaaaagcggcggcagtaggcagcattcggctcgcacacacaatcaaccacacgtccgcacccgaaagggaacaggtcgcgcgcccgtcgcgtcacggctgttgttacctggcgttcttccccaggatgatcaccagtggcctacagctacagtgccagctccaccaagaaaaaaaaagtttgctgcacacgatgcaccgggataaaaagggtcaaaacggtaatatcccttcgaaaataatttctatgattttatctatcaatctaactatttaacgtcatatttaaaacgttgaggtatttttagaaaagaaataagaattatactacctccgtctcaaaataagtgcagccgtggatatccgtgcccaatatttaattatccgttttatttgaaaaaattgtgaaaaatttaaaaatatttagtcatgcataaaatactattcatgttttatcatctaatagcaatgaaaatactaatcataacaaaatttttaaataagacgaacggtgaaacgttgaacatgaatagtgtaaaactgcacttattttatgacggagggagtatcatttacccagaaaagatgttcagttgttcgataattttctagacagttttcatctagtgcgcgtactcacctgacgtgacggtgagtttggtgttctcatctcactttgtacatacacacggctggatgagtcactcacccaaccgatgaaagtgaaactagcggtgcgtaatcatgctcagcctttttttgtgacgtcgacccggggacaaaaaatgggtcaagtagggagaatgacagtaaacacctggcagtaattaatgaggtgattataatgtcaaacctaatctgctaatcatagttcagagatttcggagcagcctttcagagttggggggtcgttgcacggatgggcgaagcaggcaggctgcggttggaaacctggaccatgcatgccgtgcgcccacaagccgcaagtctcgtgcaccagcacgttctctcgtgcagtacgtatatatcctagttataggttgtgtttcagcgtaaagttttaattttgattgaaattagagatgatatgactgaaaagttatctgtgtatgacaggttgatgtgatggaaaaggactgaagtttggatccaaactatgaatctaaacacagccataatgtggcttgtacctgtggatgggtcccagctgcagctgccgatccatgcggccaatgagaataatgggatcagcttgcggttgacgagagtccaatgttcgaacacgtcatctacacagtagtgtgcatgcaattactctcacagtgctaacgaagaacatcatgtgacctttttgatacgcacagaaaaccctaataattggttccatggccttttgataggcacaactaacattaaataattgattagcagtacagctttacaagtgatgtttctaaaattttcaatgttgtgtagtacaatgcattagccaatttaccaataacttaagttgacagagataaaacagatgatgacataaagaaaagaagcgttttggcacgtatatgcatgttggtatacatgccgcacaggcgacccaagcactaagagcatcaccaacaggctacctatatgattcctaaaactaattgagggattttagtctaaatcagttccaacagatcccctaccctcctactcgagttttggagttctcttcccccggttgctcgctccgtttatatgcgggcgcgaaagtcgctcccaatcatgcaatcccgcctctctccttcattcccgcgcgtgggagatagcgatctttctgcgcgtgaaagaaaaaaaaacagaattttctcttggtagtttaatagaagggcccacttttaagttttgaggattgaatttaggctatctgttagacggaagaattttttcacttcttattttcagtttagaaaaccaaaaacaattttttaggagaaaattatacataatttgttggtgatgctctaaattggttgagtttgaaagcgtacatttatctgggcaatgcgtaaggttcaatggttcaagaatcatgagccattttatctctttttcacatgttgttattgagaaccatggtccatggctaccattcaactcacagttccattggtcgtcttcccaataacaaatgccgtggtgtaagactcgtgcgtccaaaaccaggacaaaaacaaactatgggaaatggaataccgtagcacgtcacaagccccatagaagcgtcccgttcggagaaagggatcctacgcctttcacccccttcttttctcactttccgctcgccctttcctatccgaaaccgaaaggacccgcaaaaaacacagataaaataagacaacaaagcaaaaactacagcgaaaaacgtcgagccatccgtctttgatccgacggccagacgacgggcggaatgaatccgacgcggggggccacgtacggacgggacgggatggatccgaagttgtgaactggcggcgcaacggagccatgagccaaagccaaaacaccgccaacaaccgggagcccatccccaccgcccggcacggcgcacatggcattctcatcggacgacgtactcatcggggctatccatcccatccccacggccgcccagccagccaccgtgcccggtggttgcgcagaaaacggcggtgtccgcgcgcgcgcgcgctcgcaacaaccgagcccccgtacgttgccgcaacgcgccgagccccgccaccgtgtcgctcgcgctacttgcgttgcccgcggccaatccaccaccccacctcgcgatatacaggcgatagccacggcgcgcgcttttgcgatcgattggcctgttgcatgatagctggcgaccgatcgagtagagatgagaaaattctcgagctcccaaccgggcgtgacctaatcctgtcccgcccgaacagtgctgcgattgccgctcccatctcgcgcggtcgcgttactggttcgccttttttttcgccaacccggccgcgcggtcgttgtcgcctcgtggaacctaccattcatcgatcggtggccgatggatggatcggtcattcgatcgcgcgaggcagaccgggcatctccacgaggcgtgcgaaaggaagggaggatggcggccggtgtcggtggccgtcgtaatcgctacctcctctctctcctactactgcttggttaccgctacagcaaagtgactgaatcaaaagatgcaagccattgcgtttacagtaagattccaaaattttcagttaagcttagatgctcgatcaacgtgccaatgtatatatacgcgtctccgtgtgcactgacacgtggatttgggcggagatctcatcgaccgaccggctttcgcgacgccgaaagtggccggtgcatgcttctgtttaagtgagattaggagcaaaggaatcggcatgatatgttggctgccgacgtgccgtgcctgagctacgatgcaaccagattgcttgctggcttcacaaaaagtagcttgtttttattcgaacgagaagttaacaatatattcctttcttttgggttagttggtgagttaggactgctctgtttggttgtataatgcttttcttcattcgtgttcctgcgcatgtgatgtgaagaaaaaaagggctcactagcttataaagaaatgcagctagtattagctccgacttgcgtagcaaacagcctcaggcaactaactaacatcgtgcaaataagctgattgcaaatatattactaattataaagtatacttacactgggttgaatatgtggtagattctagatgcagccaagtaggtcaacaccgccttccactttgagaaatggcacctactcaacacaaagaagggaatcagtgatactacttaattagcagatcgaattaattgatgctgatcaggatttcaggtagatcacctgccgattgcgagagaaggggaacatgatgacacgaaagggagaattttccaagtagctggcggttgttgcactactcaattctggagtaggcgtccaatttttatatcgacttaagtggcgatcgagcgaggctgagagcacagagaagatcaaaagtgccacacacaccgcagctagtagggcaagtttaatagtacagtcagctgctaggttcaaatcatctatagttacttaatagccaatttatacaatagttacatataaatatatactacacttttaatatctggtcccacgtatcatatatacattgcgttttagagtccgtgttgcagctggctacaaatctatagcacgccgcttttctctctcttcttttatctttttaaaatgtgtttataagttagtataactgacttagagcaagttcaatagtatagccaactactaactccaattcatttatagctaatctaatagttcattaatacaatagttacatactacactattaatacataatcccacctgtcatagatacactgcgtcttggcgtccgtgctacagctagctataaatctgtagcccgttgcttttctctctcttgatttatctacttgaaatgggtttaagtggataaatcaagagaatggtattatagaatggtattggacctgatcgtagagcactgcagtagtccagtccagcctggtttgtgactttgtgtaggtcagaggtttggacgatcatcgctgcctcgattggcgtgcatgcgccgccgctgattcttctgttcagcgcgcgatgatgaagacgagatcgacgagtccagccggcccacgcaaaaaagcaggtgctacgagcagtagatagcggcaaaagggcgtgtttttatggaggttttttggtgcgctggtggtgtgcacacgcgtgctacggtgctagcgcttcgatcaccggtcagctgctcggttcggttcggggcgtagtgcgccgcggccgtgtccggcgagatcgctttcgttgcgttgcgttgcgcgtcagctttgcgtgcgctcgcgcgtcgcggtattggaaccgggaatatcagaggcggaccacgtgatggctgatgcgcggccgcgtcggattttctcagggcccttaaatggcgtggcgactgcttacagacttccaggttgtttaccactgttttgtcaaacttgggtttctgaaagtctggttcctttggactccagtgcagcaacaacgtgaaggttaatcaaccagccttagtttaattcagtagtatttcggtgtgactctgcaagggcaaaacatgggctgatggaaacagtagtgactctacagtgtgactccactattttgagtcctatatctcgacaagccgtgagagattacatgattcaaaaagcttgttctctttgttcgtaaaagatggattacacttacacatggggaaaaatcaaaaccaaaaggaagtatatataataccagccgaacgaaacgatgatgaagcagaagagcttttctacttctttttcccagctttaccctcctttcttctgacaacctcatcggcgtatcggattcccttccccttgtacggctcaggtggcctccacttctttatggaggcagcaaactggccaatctcactcttgtcgtagccactcacgatgatcctggtgttctcttccaccttaaccttcaggccttcaggaacagccatccgaacaggatgcgagaatcccaaattcatcacgagatctttgccttctacagctgcacggtacccgaccccaactaactgaagcttcttgtcaaacccttttgatacccctacgatgatgttgtccgtcagggtcctgcattgaatagttgcaaccctttgtttttagagggataaatagtaaagatgaaggcttgacaagatcattcagctgaccacgctatgattagtaagcaaaagcaaaacattcttctgtacaaggttcttcagcataaggaaaagacaaactagattct

SEQ ID NO: 61919 - DNA, 1650 bp, Oryza sativa
catgattatgaaattaccattcctcgtgactgcaaggagtagtacttacagagtaatagcgttcgcaaaagagaagcaacaagtatataagtgacttatgacggaaagtgggggattaagtcagtaaataaatttcgtaataccagggaatcttatggaaaacaaacaataaaatagtgaaacactgacatataatgataagtgaaccagagacaaacgaaatagaaaatacttatcttacctgaaaagtccatgcatctggtttgcccttttggtttccactgttttggagactctcagcttaccagattcttctttcaccacttttacttcacctggatagtttagtgataactctcccaatggacccttagcttttataaattgctcctctaatgtaagagtaacatttgatggaacttctatcggtttctttccaattctagattccttgcactcaattgtttttctgacaaaaccaactctgccagcagggataacatgaagacaaatcccttgtctctttccaaggaagcctgttcttgaattgctgattcatatcaaagaaaaatccatcaaaactctcatataacattggtaaaaaaaactcccatataatacccaaaggaaaaaaccattacattaaaaatgcattaatttagttttatacagtaagcgaaaaaaatatgaaaagaatagcataaccaacacaaaacagtttacaaaggccagccggcgaaactgcataatagtaaacttggattataacatgccatgctcaccttgaacatttcaggcaacatatcaaccatgtagttcggagccgctttactcttagtaataacaaggtaaaatcatcagaaaaactaagtttttacaaaggcatataaaattctgcctgaaattaggataacatgtcatgatggatcaatgtactaattcactcaaaactgttgccaagttagatctttagatctgatttttcacacaatttagaggtatggttccccataaaaaaaaagaggtatcgatatttttatcatggccattattttgttcacaaaggcaatcataattaacaagatcaacttcatgattcattattaccatcatgttatgtgaatttataaggttccagatatgaaataataaacacattagcaacctattggaagtaaattatcaaatacggtagcttcttcttttccttttttttttttgccgaggtggccaaaggaataggccgtcccaattttattaggatgagagatggtgttacaaattttacaagatcgacattaaactgttgaggctgggccgagacccaagagcagaggggaggggagaacaactttttttttttgacatgaggggagaacaacttagaaaaagaaaccgccttatggcaggcactcagccgacttctctaaagatgctggcttccctccaaatcaggatctcttctctaatatctctgtaaaatatggtagcactgcattcaaggtattggtgtattgtgctaactgattggacaactatccatgcttccctggaacttagcattcctgtaagatagggcaccacacacacccacacacacacacaaaaaaaaaaaaaaatgatcccttcatcgacagaacaatcccggtt

SEQ ID NO: 61920 - DNA, 1632 bp, Oryza sativa
gaatgcagaaacccaaccaaatcgctgccgccacaaaagcaattccatccttatgaacaatgcagccctagcaattcagtccacgggaaagggaaaatgcaagctgcaaggactgtgctttccagatggccgggtatcaacaggaggaggaggaggaggaggaggaggaggaggaaacataccacgggtggtggagggaaagggagagggacgccatggacgcctcgccgtcgcaggaggagccgcccccgctcgatcgctggctcgcttgtgcctgtgccgttttcttatcttgcgttatcctgtccaccgaggaagctagacgaagcccaataaggaacgggctggatccgtcaaggcgtcgacgatggccgggcctacaaaaaaagcccgcgtacaaactgtgcatttctctgggccctgacaaaattttgtatttttaaacagaaattttggaaccacctatacatttgttgacaaattttcttctaaaaatttgacagatataattatagtacaattatagtgtaattacactgtaacttgtatgtaattacactgtaacttgtatgtaattacactgtaacttgcatgtaactacagtgtaatttgtatataagtttcacgtaattttgaatcgttagatctattaaaaaatttgttctagtgaggaagaaaaaaatcacatcacacacatatgtgaaagaatttgttatggagagatttttgaaagttacatacatgttacattataattacagtgtaattacactacgattgtactgtaattacatctgtcaaatttttggtgaaaaatttgttgacaaatatatagcaaatttgagaaattttatattttaccactaataacaatcaacgtcgttctatgaattgttgcagagagtgcgagttctaagcaagcatttttcttccgtttttactattgtcgttagtctcacctctaacaccttaaaaacactattttgttgacacccctatttcatattacaggtgggtcactaaaccatctgtaaaaaatgattgttcacaaacgatatcctaagggaaatcatttgcgaaaattagtattaaaagaggtggttactacttgtgaaaaatatcatcgtgtgatcaattagctaagtaacaaaataaatttgcatctccccctcctctcactccatcaaccgcccgaactgcggatccaacagaggcaggttatggaagcagcggaacatggaggcagcatgcctcatgagctatggatccagcatcggtgggccttgagacagtagcggacctgatcacctgacaccggcagtcctaaggaagaactacatgcgcttgaactcgccgaggaggtcgttcgaggatgagaacagggggtggatacagcgtaggggcggcggggtctcgagccctcactactaacggtgaagactatgagagccctcgtgaagactctactaaaattttttaccatatgtagatgggaagagtactataactctatttagtttgcttagaccccactgctatttctttctggatccgtcactagatgagaccactgcttggcgacggcaacggctacatccgtcgatgtcgatggggtgactgtatatgccacct

SEQ ID NO: 61921 - DNA, 1429 bp, Oryza sativa
agtttcggccactctcaaaaaatagtgcacgccgtcaataaactctttggaccgccggtcagcgtacatccattgccgatccatctacatgagtcgaaaaaaaatcgtacgcaaataattattcttacaataatgacagtcatacaataattataagataattacaaactgtttcaacagtcatacaataatgacatatctttattcatacaaaaatcataaaatattacaccaaataattcttatttactatttctaaagttttaaactaattttaatgtgttttacttcttttaattttcattttagtttgttttctagtattcaagattaactttcactataattttccttctcaactattttataaaaccttctttagcaaatcaactaaatttctatatattctttcttccccacacaaattttttttctcatcaacttacaattaaattttggagacaaaaaagtgtgcaaaacatagctgcaaatgtaatatgacaaaaaaaaacattggaggatgaagttgcaaaccttttaggcacctccgatttgtatgtaatcaccaaaataaattcactagaaattttggcatgacctcacctcttttttgaagaaattttgaagcttgctcgggcagctggaggaggaagaagacatatatataggggtgggactttagtcccgattggtgttaccaaccggggctaaagatccgggatcttaccaactgggactaaaagttacgatctttagtcctggttggtgttactaaccgggactaaagatcccgaggggcctgataggccctgacagcatttgaaccgggactaaagatgttaccaaccgggactaaagatcaaatatgcccgttacctttttgaaccgggactaaagatcatctttagccccggtttttattgcatccgggactattgtggaattcggcctaccgatgaaagatgatttctccaccagtgattgtcccagttgttagtagccactgcttgctctgtaagcaagactgtaaatcacagtggcctccacgatcacgttcgttacatgcaagccactcgtttgggcgtattaatttagcaacgcgaaagtggagtagagtagcgatagctttcgatggataacggtggttgtcgcacactaaccacgcctcgcaatggcccggctccccggtgcggggaggcacgtggggatcgcgaggcgcgcccgccgccgccacatgcccgcgcacgctgccgcacgggccccgcgcgcgccacctcgtcaccgccgtggccgcgtccacgcgggctgcacggcgagcgagcgcgattagtggggaaatcatgaggctaattttttagcgcgcatatgctgcacttttgcttcatcgagtgctcctctgtggacagtggacacatcacacatcaactgt

SEQ ID NO: 61922 - DNA, 8233 bp, Oryza sativa
aaatgcatgtgttggaggatcaagtcgggtgcgatctgattcaggtagataaccgggcagtgcaatccttgctgccttacatgagcaagttcatgaaactgttgacttttgctctgaagatcggggcgcatttcattgtcgggatgggggagatgatacctgacctgagcagggaggtagtgcacttgctggactcgtcagtcatgtatggtgcaaccacatcagccttatcattgggggcattaggcgcagcggcaatgtatggaaaagcgaggaataacggcagccagagtggcacaaatgacatggaggatgatatgaaaacggccagacagtggcttgttgatttcttgaaaggtcaagggattttgacagggatggacatagcacagagatttggtctgtggcgcgttaggtacagagatgacggccacattgcatggatctgcaggaagcacattgttgcgagagcagacgagatctttgaactgccactctgaaccatccagggtgcagttggtttcacggccacaaggtgcctatctgatgtccctgtccttctgtactgatgatgacaactgacgagcttgcaattgtaagggatggtgccattgctgattacaaggatcgcatatggtaggtacctatcatatgctctgttccagtttctatcactctgcttctgtcaatggtgtgtttttacatttttcctctttacttcgttgttgtggattcacgctagtagaaatattaagtttctgacggcatattgtttcctgttcaattgctgatttgaggagttcgtttatctttcttcaattataatactacagtactgcttcatctctgatgattaactactagcagaattctgtttcagcatattcagattgacatgatcttatataaactacctatagtatttccttgcagaaaaaaaatgccacattattacactaaagacacaggaggtgacactataatgactgtatcagttatctgatgccagtatgaattcatggtttttcccaaccctaacccaaatgcttgctacctgagtgcaacttcagtttctatcactctgcttctgtcaatggtgtgcttttacatttttcatctttgctccgtaattgcggattctctgatgattaactaccatcacatctctgtttcagcatattccagaatggcatgatcttatatgaactactagctactatatcatttccttgcaggaagccaatttgttacactcatcacacgggaggtaacagctgacaactattaggactgtatcagttaactgacaccaggctgaattcatggtttttccccaatccaaacccaaattcttgctacctacatacaccaccgtgtgcagctccggccggcgagctcagaacaccgggcatcccttgacggcgatccccggcgcggtggggcaggaggcgagcgggcagtggtcgaccgccgtgccccaccacttgagctcatggtgggcgttctgcagggcgaagaagatgagcacccccatgaaggccgtgccggcgtcgagcgccgccgacagcacgtagttgtacttctgccaccaccccttgcggtacttgaacacgaagtagttgaagatggtgcccgtgacgagccagctcgcgatgttggtcggcgtcgccggcggcatcccggcgaacccgtaggagatgacggggacgttgatgagcgcgatccacttcttctccgggaacgccctgctgagcagccacaccggcacgggcagcacggcgccggcgaggaacagccacaccaggttgcggtacaggccgtggcggccgaacagccgggcggggccgatgagcccccagatcaccgacgcgtcgaacgtgacccggtacttggggcacgtccacgggctgtccgggtgcagcgcctccacgtcgcagatgttgtcgatgctgcccagcatccaccacgccaccgccaggttcaccacgccggcgaccaccgtgcccaccagctgcgccgtgtacatgcaccgcggcgggatcttcatgtagtgccccagcttgaggtccgcgaggaacgacagcgcgtgcaccgtgctgatcctcccgtagatcttgaacagcaggttcgcgatcggcttccccggcagcgcgtacccgatcatgaactgcgcgatgatgtcgtaccccggttgctgcaaccacaacaagtttttttctaacacaatcagagatggacaacgacgaatcgacgatgattcatggtgagatcgatggatggatggatgcgtgcctggttggtggtggcctggatgacgccgatggggagggtgacgacgaaggcgagggcgaaggcgaagagcatcccccaccacggcagctgcacctcctccctgtacacgaacgacatgaccagcgacacggcgacgctgccgacgagcagcacgaggaaccaccactgcggcacctgcttgtaccgccgcatcagcttcgcgtgcacgtccatcttcgccgccgcggagctcatcgccgacctgctctgcctccagatgtccccgccgtggaacagcgccacgtgcacgatcgtcgccgtgaacctcaggaacccggacccgatggagatggcgaacagcgggctcaggtacagcttcccgtagctctcgtacgccgccacgttgaggtcgaactccctcgtgagcaccttggtggtgtcgtacttctgcccggacgccgtgaacagctggttggagaagattgggaacttcctcgcgtcgaacgtgtcgaacttccagtagcagagcggcacgatgaggtagatgaacatgacgaagcccgcggcggtgttggcgatggacgaccacggcgccaccagcgggctcccgtggtacgccgagatgccggcccagtccagtgtgaaggcgccgacgccgaggccgtggtagccggagcccacctgctgcgccgtgatgctgtgcggccacgcccagcacgcccacgagaagaaggtcaggatggggagcaggtagcccggcagcgcgtagtaggcgaagctcgcgaagaagaagatgaggaagaagcgcatccgtgtaggccccctcgacgacgaccccttcccgccatcgccgccctccttctcgtgcaacgcccttcatgtactcacagagatcattagttagcctgcatagttaactggctgatcttgcttaattgagagatttacgacgtgattaattaattacctgaagagtgagacctgggctaaattcgatggccaccacatgtcagccgggtcaaccaggtacctcctcagcatcccggcccaaccatagcccagtatctgcatgcagcaagccaagcatgacgtcacttagctgtgctactacacttatactatctaccacgatatgaattttcatgtctcattgtttgtatatcgtctaaatagttattaaaaaattaataaatatagtttttctagattcatagcgcactcagattaaattgcgtgagaataactcctgttcatgattagttaactatattgttttctttttttactttgggatggattagttaaacgactagtctaatcatgatgcaagaataatctcatactcctatttatgactagtagtagtactgcttagttttgactcgtgcacggaccatccgtcaccatatacccaatcttttttgcatcttagtgccagcaatccgacaggaatgctaaagttgcccactaatacgaaaatttgcaagaggcacatgcagccgcatgctagacgaacaaaatcacgccaattatttgtagggcctcctagtacatggatggattcacggtgacgttatatgccaacatgaggttttctttcaatttcaacttcaacgctgcatgattggtggcaactcgtacgcgagataaagcaacgcaagaacgtctgattggttcagtatttgtcacatcttttggaggaaaacatacaagtcgcaatcgcgcgacaaattcgccaaaaaaaagaagacacgagtcaattcttatttcttagtaccagtcagaaccagtcagaagcaagcaatcgaactgagggaaaaagatatggttgaagtggttttgttgattgtttctttgtgattaattaactaattaagcattcaattaaggtgctacgtaaaatcatggttcaaaattccggaacgtcatttcggacccaatatgatgttatttcgaccgaatttttaaatttaaattttatctttttaaatttggcaatattttatttaaatttgactaaattttgttcaaaacttcggcaatttcggatcaaaatttcagtatatcggcaccctcggaaagaaccgtggaaaccgaaagattaaacccagcgtaaaaccggagtaggtgtggagggagacctgtgtggtgaggacgatgaggagggcgcagaggaagctgagggactgcttgtagtaggccttcatgacggtgatggcgccgatggagtaggcgtcgccgccgccataggagacgccgcagttggcgaagatggtgatgatgacgtgctccttgatgttgaagggccccgggttgaggttgaagctgccgaggcggccgccgaggaggcgcacctcgcggctgggcagcacggcggccatgaactgccccgcggggagcaccaggatctgggccaggatccccgagatggtgagcggctgcgtgcggtaggtgaagaaggtgttgaggaagatgagcacgacgcaggacgcgagccccagcgtccacgcccggaatgtcatcaccggcgtcgtcgggtcgtcggtctccggcaccaccagcgccacctcctccaccgggcacctctccccttcccccttcgccgccgccgccgccgccgtcgccgcctgctcctccgccgccaccggcgacttcaacgacgccatctccctagcctcgatctccttcctcctccgcctcacaagtcgccactacaagcaaagcgagctaagctagctgcgaatgatttgtaaagaaaataatttgccagtatctggagaggaaggtagtaacgctttcggggattcgatttggatggtagcacttgaccgcggcgcgcctctatttatattccaattcgcgtctccattttttttcccacctcgtacttatagttattagctggggttttagtggcttgattactcggtacatctcggctaggggaatcgtggccgtccgtgggtgggatcggacggtggaggagagtgccagctgggcacccggcgggcacgcgtcggcttaacccccgcacgcgcgcggcgcgcgtgggcacatgttacgcagccgcttaatctaatcagcgcttttaatttccttccaaattgtgaattcatccttggtctcagtggaaaaagacgcattgcttggcaaagcgagtggtcagtggtggctttgtgggtgccctctctctgacaaaacacactagtactacatgagcatgcgcattagtcagttgactcaaattaacatggcttatttgtgatcttgtccaaactatgctactaccagaagtgtccaaacacatggcttgtccagaagaaaaatattggaggaaaaaccttggatggagcttcgatgggaatctggtggtcatggtgtccgtctaattaaagaagatcagagcttgatggatgtgttttcatatagactgattcctcatccggattggattggcatatttgtaggtttgctcggccagaaaaagcagtgctcccccgttgccctcacagataacccaagcaaaatcttcttatctgtttatcgtaacgcgtggtaatatattcgtcatccgcgtcactgttcgaaaagatttcgtacttgtgctcgcgcccaacggctggctggctggcttgccggctgccgcgcatccggttcttttttttttaacggaaaaacggcacaagatagtgccttttcattgaatagagtgggagaaaatacaacccctgaggataaaaagaaaagctgttacagtacactatagaaggtatggggcgaactctcgtagacgcttagcccctgctagaacccataggccaacctcatctttgatttttgttagcaggaagctcgttgccatctctttatggtcaaaaatcctccgattcctctctttccaaatctcccaaaccactaacaggatgagggatctaagtcccttctttggaacaccgcgcgtgtttgccatgttttcccaccactactgcactgagtgggcttcctcccaattcaccggatccagcagcagatggcccacccaagtggcgacaaggtgccaaattctcttggtgtatctacaagtggctacaaggtgcaaggccatctcattctcacagcggcatagggggcaatgttcgttgttttgccaacccctggtcgcaagccgatcagatgtccaaactctgttctagataatgagctaagcatggaatttacatttctcgggtgcccacactttccatatcaaggagttgaaatttgtgttaggtgtcccatagcactgcgcttggtaggctgaagatgacgcgtatcgcccgttgctggtgaatttccaagcgatctgatccggttcgccattggctaattgcacattccgaactgcttcccacagggcgactagctgctcaatgaggctgactgtgatcgttgactgcgtatgtatggtcagatcttttatccaagcgtcaccctcttttccttgtcgcagagttttctttctgtttttggaaatcgcatagactagtggcatgaggtctttagggcgacgcccatctatccaggcagagctccagaagcgtgccgtgtttccatcacccactgttatttctgttgaggcggcgaacaggtctctgtcaatttcgtcacaaggtgtatcgagaccaacccatggtttggtcgggtctttccacttgtgccagagccacctcaacctcaaggccctcgtgaacttgtccaaatttagaactccaagtccaccctggctggttggcaagcatgtctttgtccaattgacctaacattttccccggtaataccttccgtgccggcccatagaaagcgtcttcgctgtttgtctatctgctccagagattccttcgtaatttttagagcagttaggaggtaaatcggctgcgacgtaagcacagatttaacgagcgtagttcttccagccgccgccatgtgttttcctctccaggtagctaccttccccgagattttgtcaaagaccggttgcaagtcccccttcctctttttttcctatcaatatatcacctagccactacgagttaatgggtctcgtttgtcatcctctccctacgtgtttactctacattgtaatcattgtggttgtattgcgacatccttttctatctaaacgttctcaggttacatgtccgactcgaactcttatctcttactccctccgtttcaggttataagatattttgattttggtcaaaatcaaactgtttcaaatttaaccaagtttatagaaaaaaatagtaatattttcgatccaagataaatttattataaaaatatatttaattattaatttaataaaattaatttgataatgtaaatattactgtacttatctacaaatttagttaaacttagagtattttgattttaactacctgaaacggagggagtaccatgtattccaaatttaagttcaactataacaaaaataaaactcgatgtttcacacctattttacacacgaagatcggtggtcgcggctgtgtttctcggcgtcggcgcgtggcttcgagatggcagcgttgggagcagcatgcagcgtgtcatgctgccatgtacagttgcagacaacagtattgccattgcagtacactgaggcatgcaggtggtggtgccaaatcacttttgggcatggggatcgggcgatcggttcggtaagccggcagtcagctttatacggtggtggtgtggtggactggtggctcgttggaaatgttctccgatcacgattggctgatgattgacgaatcgaaccatgattaattgccgagttttctgacaaagaaaattcccaacttcgtacgtgtctcagatattcagacgtgcactcgataatatgtaaagaaatgcgcccttcacagttcacagcgaacttacatcggcatcggcacggcatgaatgggggccatctgaa

SEQ ID NO: 61923 - DNA, 702 bp, Oryza sativa
cgaggcaatttcattgaattcatgcagtgctttatggagctacacaaagtgcttttacctgcaggatcattaaaaagcaagcaaaataaatcaacggttcgtatgctagagctgtggtaaaggtacaacattatatagcaccaagcaagaaatcaactaaatttaggtcgacagaagggtaggtttcatttgaatgccatccagactccagcagaacaaattgaaatagtttaaactttaaacagcaaattgacaagttaaaacaaagaagagctgaacacgacaaaactatagatatagttgccttatttctatctatagattacaaagagtagtgaacagtggacaacgccaagggtacctgataattcttgaccacagagaaaaacttggcaacaagtaggtgcacttagtggcaaatcgagcaaatcatttggtacaaccgaactcccattctgaccaagtttctcataaatttctctggtcttaccagcaacatgcagaggcgtttcatgcaggtcaatttcttcaatccaaggattgacctgcaacatgcccataatggtctgcaagactagttccccctcgactcccctgcaacctttcaatgataggtttcggagagtagtattcctttctaagcttgtaaagattctgacaacatcatttggcctcaagcttacatcatcgcatatggccaac

SEQ ID NO: 61924 - DNA, 5039 bp, Oryza sativa
  unsure (1)..(5039): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacttacctgattttgcagcaagcagatgtaatttttaaccattcaatgatgttttgaggtgggccatcatctgaagtatcaaataataaataggaaaagcttaattttcagaatgtccaaactactgggtactaattcagaaataacgaaataaacatgaatttttcatgaatgctcataatcacgaggctgaaaattagtgaattaaaaattgagtaaactgtaaataaaggaagaacaatttggatggaaccaacctgcaatcacactttcagaggtggaaacttcagtgcaattatcaaatatatatccatagttgagtatggcactctttagaacagagtacctgggaaagtgtccaatgtcaactgagagtttgtcagcctgtaacgaataaaaatttacatgcagaatcttcaaagtataacacaaaccatacatttgcttataaatacgttacctcatttagggaaagaacactgtcccaaaagtcagatgcagcaactcgaaacttcttattacacgagtacaacactggtagctagtggtgttaagcatacagtacagtttaatcaaacaataataactggaaaaacacacatatatcaattcttacatttggttagtgcccaagatcgctatagaatcttcaacagagccatgcaagaggaccaacttcaaaagccatccatccaccaacaagccttctagaaacccttctcctacacaaatagcaatagagaaatgttgaagtgactgataaaagaatattatgccatagtggtacagtcgagaagaagaaaagctcaagtagaaacaaagacaagtcaaataatatcatctttttttgcaagtcagatacttagacactcgtaacagaactaaccttgttcaatgtttagatcaaaacctaaatgctcatttgcacagaatgatttcagaagttgacaattttcaactcctgtgacagtaagaacagaaggggatttctgcaggcacagtacataaggatatttagttttaaaaaatagaaaaaatcacttagctgtcgcactcaacattaactgaataaatgtagggccatttaacctggcaaccaaaaactctctgaccccattggggcacatcatcaccagcatccaactctttcgactgtaaattcaataatatcttagagacaggaatatacatagaaaatgtaaaagttttatgaacagatgtttgtttgaaaactacctgctcctcatactcctcaacaaatttgcgaaacttaatctccttctccttcactttcttgtcttcatcatctgaattatatcctttggatccatgcttggactcaataccataagctttaaggtcatccttaccacttgcaaagaaatcctctaaaagatcgtccaacccaataaccttcttcctgaaaagaaaatgggcagtggtaaattaaatatgtctctaaaatggtcgtactacctacaccaaactgttattaacacatttacacaccttgagggcaaacgattccaatggtaactaacaatatatatcatcactacacatcttgtcagctaaccagtgaccactcatcaaacgaatcttctgcaaacaccacggattcatcgactgagtgctactgctactacttcaatcctactaccaaacataaaccagccaaagcaacgacattgcagtttcactttatcccctaaaaccctagaaaaatcataagaagggaaccccatcaaccagcgaattcacacccaccccgattactcgagacccgaccatacgcgccagaaatataattgcccaaaaatggaactcaaaacctgacatccactccaacccctcaaatcaatcggcacccaaaaaaaaagaaagcggagtataatggggacggattgccacctcttggcggggcgcgccttagggaggagcggatcctccttctcgaagtcgaggggctcgtccagcagcatctctccccccggcgagctcgcgcgaaggcggggaggatttgtggctccggggtgcctcgcagtcgcagcaaaccttggcgacgccggccgagaggtggaaaaggatgaagcggaggcgccgtgctcgccaatttttctcccgttttgtaactgctcgcagcgagcccactgagcccattctagggacaggcccaataggcaattggtgtgtatttttatttagaaaaaagtccactttaactcccttaaaatgtaaccataaaatcgggatggaagactcaaattattaaaaccggtacagattgacttctataacagtattgtagacggtatttgatgacgtggcaacaatgcttaggtagggtagttaggaaatatttagctgacaacaatgctcgagcttcaaccgttcagaaggagcacagggatggtcatgcccggcagtggcagcagtccagtagaatgggatcggcggcgcccaatgctgctgagctccctcgtttctgccgccatagcccaagaagacatgaatggaactggagcattgtcgctggcaccgctctaagctcacgtgtccttgcacgttccgtgtcctcattgatgcaaaacacgatgctctgaaaaaattgcttaactttaatgcaggtctaaaactactggtttaaaggcgtgccggttggtgtgatcctgcaattaataagatagacaatagcaaaaattagtaaatgatagccaatcagccgataggccgatgttgtatcgcgtaaactattgtacaaatgaattggctataaatatgaaggatacttgttcataagctagatctagattacatataattataaataactttttcttagaaaaatcaataatatatgtcaaacacaatttatatagcataaaattaataaagttaaagtcaatcatagaataattttataactgaaataactagtcgatgaacatatgtttgtggattagacctaaattacttgcaatcggcggtagaggtaattatcatgcaattactaattcgatctttgccttaaatacgagcaatcgagatagatcggacctaaccgagacaatattagttgcttgtactcaagaggaaataaattaatatatgaatttatatcatagctgatgaagtaacttaggttcttagagataacatatcagctagaactctgatacaacagatatcatgtttccagttaaatatactaaacaagtcttaatcccaacatatcggacttaactgatatgttgcgggaccaattacaagcttaatagatttgaatgtttgatagtcttagataagatgatagatataatatattaagcaaagacagtaaatcagaatagttatatcaggtaagaccgaatgaaaccccggtgaccctatcgacaatcaaagagcaaattagttcttacaatttcaagtacaacttagtaggtcaaaactaactgatgcagcaccaagctgtgatagaaatcgtaagatctaaaaaaaccttacaagagtaatttagacaatagaaggtggccctgagttgaactacctgatatgggtaaataacattgtttaatttagattgaacaatgtatatgataaattagcgcttgtatcgactgatttagagtatcgaacttaatcgatggaagccctagcctcgccgatacaagcaaactattgacggaactcacctcttgtcggagatcggactaagccgatacagttcaactcgaatataagaactcgttgagatgaaaaccttgtaaactagggtaggaatgcgccgaaaagtgattattgaactgttgttttttacaaagactctgtatgtatatatttataccataagtaaatactagttattatcggatataactcaaattttcctaaggataaagtaaaaaatttacaagcccaatcgaactataaaacaaactttcctaaaacataaaaggaaataactaactcaatctatttaataaataagttaagatgttgtatccttatcgagaactcgacctccccttggtaacgtcaccaaatcttcccataccgagtccgacaaggggtcgattcctggttatcgtccatgtcctatcggcaactttcataactctgccgccgatacgctttagctgatgcaatcttctaactttggatcccaaaatcacgccatcaataccgctctgcgctttctccttactcaatagaatatgccaaattttaccgttagtagtcctctatcctcccttttcaccgcgacctctttctcccttcctccactgcactaccgctgtgtcaatttagcccttgaagccggtggcttccatcctggcaatagcaaccagggcagagaggcgtccgatgacggtgctcccctccctacatgtgccgccgcctttcctcgacctcgctgccatagttcgccgataagacaagcggctgcacccgagatgtttatggtttgttttcattttcagcaaaatttggtcgcaatttgcattaaatacttttagaagttactttatacagatgtttgtgatttgcaatcgttttcagcaaaaacttattctaatttgcattaaataataaaaaaaacttcatacagatgtttatgatttgcatttattttcagcaaaaaaatgcatttaacaatattatgatttgcatttattttcagcaaaaattgcatttaacaatattctttcctcgacctcgctgccatagttcgccgaagaggcaagcagctacacccgagatgtttatggtttgt

SEQ ID NO: 61925 - DNA, 6630 bp, Oryza sativa
aaattttggagaacccttttctacgttctaacatggcactctgtatagagatactggttttattggaccagcaataacaaaagttgagagaaaaacgatggaggcaaacaagccaaaaccaatgtatatgtaggcgtacgcaaaaccaacgggcacactgaaatactgaatgacaacaccatcacccacaccccaacgtacatcagctcatgagcttcactgaaaattcgccagcaacgacgacagggccgaattgttggaccggactccttttctccaggagtccaggtggggatccaagaattaacagcacattctgtccggcaaattaaaacagagcagatgatcaaatccaaccaaagcaacaaaatttccatacggggccccttaattcggtccttcgcttgcatgctgcctcttaaccatcgatgccgaccgtccgcaagtcgctccccatgtgtgcactgcacgcatgtatgcatcctgcaggctccagcctacagctcgatcgatcgatccccatcgatggccgcttcattcttcgccagcgccgcgcctatgtgtacagataaagacccgacgccagcctacgcgccacatgcgagatgcacacacgcacacaccgtacgccagcgaccgacgacgacgtacgtaggtagccacatatgcgtacgaaacacacggtagctaggtaggtgagcgctcgccatcgtcggcgcgcaccctgcactctgcatcacgctgcatcgatcatccgggccctgacgacgtgcggcgcgccgcgcatcacgcgcgcttcctcgtcatcgtcgtcgtcctccagctgcatgcatgccacattgccagtttgccacagacgcgcacattgactgagacctgtggcggagttagaaaaacttttgaaacggggcaaatttcactatagctacatttgctatagaaatttcctgatcagtttattcaaaagtattagtaatatttaatggaattttcaccggtgagccggggcgattgtctgggctagccggacgatagctccatccctattgagacgtgtacaccccgcggaacgcgcaataggcgaactacaccaccctgctcttggccgcttttgcacgaccaacacatttattcagtctcgtataattagagattgactgaagagatgaatcgagaataaagcactgtattttgcattggctgtcacatgctgctgcggacatcattacctcgaatacacacaacaatcctccaacggtcattcaagaaccgataacaagagctcgtgcgcgacaattgaatttagagacgagctcgctcctatgttcttctttgtatgaattcgagaatagattgttacctaatgattatattgtgcttagaaataatggaggagacaagaagacacttggagaaggacttagagccatggaggatcatcaaggacgtctaagtcaaggtggaggcccaaaccaagtcgacgtcgagtgcaattcggagtccaggactagtctgcactaaaacggacgctcaggtcgcatacatgctcggattggggcgttctttatatggatggaaagctaagaagataacctttccaatggttttggtcccacgtccaaattctctccgggtcaatgggaattgaccgaacaagttgacgtccagaatctgtcctggtgctgcgtcaccgtatttgggcctttggcccgtgtatcgtgttggaacccattagggttgcgtcgagaggggattgcacgaccctaaactctatatatcagtacccgccgccatctttaggtttttgggttttgcttagattattctgtcgagaacagtttcgtcgctagatcggtttgtaagaccccaactcgtgagcttaatcattcatctgcaattttggttgttttctatctcgttcttgtttgtgttcttcgattggcaaacagggattagccttctcagcgaggtcatccgcgtttcgacacgggtgataaccagaggagacgtggtgctacgattgcgaggctcaagagcgtgcgcattcaagaagctggatcgatttttgttacgactccgcccaaatcgttgtttatcagaaccttttgaaagatcggaaaccctagtgcacatcacatgccaaggaccagacgaccttagggcatctccaacagtctctccagccaaattttggccattcaagcacaaaaaagagatccaacagactgaccaaccggatggccaaactcgctcgctggctagctagatttggccagccaaaacacctcgcggcggcggcctctagatctggcaacccgaggggagctcaacggcgctcagctgcggggagtggtcggcggggagagggggaccacctcggcagcgtcggcgttggtgaaccgccgtccgcctcccagcgccgcctcccacttccccgcgccgccttctgccttccacctcccgcgtcgctgcaccaccatgcgccatgcgtcggccgtcgtcggcaacaatgtgatcgacgggaaggaaggaaaggggaaaagaaggaaacataaggaagaatgggagagagaggaagaagagtagaggctgacatgtgggtccgttgttattttggagagcattgatctgttggagtgagtatctagtttgactagctaaatcagatggggagttagctatatgagtgtttggagagtctgatttgaaaatgctattgaagatgttgttatgcgcacgttgggagggaacgaaatttaagaacgacttcgctaccaaactagctactccctctattaaaaaaaaatcaacttctagctatgcaaggaaatgtgtaattgctcattagttgccacgacccaaactcggaaaaaaaaagattgacttgccaaacattttacatgcgtttattgtaccatagcttgaactggccggtatgggtttgagagagaaaaaaagtactaattatgtactcaggtttggaagtagagtctacgtattgatctacgtggtcctgctgatctgtactttgggtctagtggagtcaagacgacatgttcgtcattaagtacgagatggatcggaacgcatcactgatgacgaaacgaatggactagtagtacataattacgcacatgtgacacacaccacacatactgtacatggatatcaccgaggcaagccgagcgaagacgagtagacgacgaggagttttcaactgatgatgatggcagtgacgattgctaacaccctggtgctcggtggcaacagttttgctgaccttgcatatgtagtacaactaggcaattccatttgtttttgaaccaagtagcacctgaccatcgtagtatcgacttgtacaattgaatctcacattcttttttttttaaaaaaaagaaagaaaatgcattcatatttgacccaaatacaaaacctcctgtgtgataatgtccatcaatctagcaaatcattctcacaacgtgatatctttttctttaatgactttccgtgttttcaacgtttaatggccggatttccagataatagcatatattccaaaaaaaatttccaatgaagcagatcgagcagaaattaaggagtaaacaaatgatttccatgttttatgtgcattggtgcataccaagacaaggaggctgacctaaccaagttaaccatccgtggctccatatctgagcggtcgcttcggtccacgacgcgttcacacctcgacaagtagaccaccgccctgatcactcgccgccccgcgcgcgcgcgatcgatcccctcctcgctcccaaatgcaaggagcaaggtcggcggcggcgatggcggcggcggcggccgacgaggagagggaggtgcggagggcggtggaggagaagccggttgtggtggtggggcggcgcgggtgctgcatggcgcacgtcgcgcggcgcctgctgctggggcagggcgcgaacccggcggtgctcgaggtcggcgacgacgccgacccggcggcgctcgtcgacgccgcgctgcaggcccgccggcgcaaggacggcggcgacaaggctgcggcgggcgacggaggcggcggagcggcggtggcattcccggcggtgttcatcggcgggaggctggtgggcgggctcgatcggctcatggccatgcacatggccggcgagctcgtgccggtcttgaagcaggcaggagccctgtggctctgagttgatcttcgtcattagcgatgagagagagagagtcattaggcttaaaacatatgcatgtcccttttgatcttttttaactgtaacctgcatgtgagtcgttctcagatcacatctatctttcagtgtgtcgatcatatgcagacttgtgaacttcagagaaacatagttgatcaatcaagagatgttcgcaaggtcatcatgcatttgagtggattagatcagtcccagatcgtactttggtttatccctaccatgccacaggatataagaacgtattttccatgttgatgttgatctatgcaactctgatcggcacatcaaaatgtgtttacatggatgtttcattcaccagtctaggtcgtcagagagcagaggtatgcacgggacgatccaagctacttcttggaatttcgagctcttccaaacaaaacctatacatgttggctcgtcattatccagtcatgttgatggacaactgggtttattatccgtggagagagttggatacttggatttatatagttgactcgactttcaacatgcaacgattgagtggttatcagtcttatcgatcttgttcttgttcagaattaggaagaagttaaactagaaattttgacaaatttatttgagtttcggtggttttcatcggtgatcggttgtcaattttattgacaaaacatatggggtgtggttttttctgagcaggttggggcggttttcgatgggcaaaatgatcccttttgtaaaaccctctcaacctgtccaatggttttagtttatatattgggcggggcttcactggccagtgatcgcatattaactctcaggttcacccctctaatttagtgtggtctctcgagtgtcaatggcatgaggtctttcgtttgaatttcaggctaatattagttgaactggcgtgttatttagtttaattctcgacccgcaatcataatttcgcttagtatgtaccttttgttgtgcgtattgttgtttcatttagatctccgtcgatcactatctggaagctctttactattatgaatatcccttgtaagccgctcgaagaccacgctgctcaaagacatattaagcagatgcattagcatatatcagactatgagcacaagtacggagatatgttacctatcacgagtaaaaaaaatgctgttaagtgttccattttttcattgatgagtgatgacgaacctcaacccacgctcgggagatagccccattcaccataaggaatatatgaattcacgataagagaggaccccatttatcctctgagaagtttgtttggttttaaacttggattttcaaaaaagaaaaaaagaagaagtattccatgctttctagtttgaacctggctaaagcagttccacacttttagggcccctttgaatcaaaggaaattttataggattaaaattctataggaaatttttctatgtagccctttgattcaaaagattgaagttttctaattcctacaaaattcctatggaatggcttattgtatatagtttttggaggaaacttagcaagaggttcaaccttgtagtaaaaatcctttgagtatatctctctcatccgatttctacgttttttctgtggcccaatcaaacattcattgctgcgttttcctgtgttttgcaatcctctgttttacacttacattcctgtcagaattctatgttttttctattcctccgtttttttattcctacgattcaaaggggcccttatgggttaaattattccaccctcttctcagtattcccctacactatcgcacaatcctctaggaatgatagtcgggctactcttctagattgaactgctatgaatggagtatttgagtaaaagttatgggctataagttgtaggtggctctcggagcataagttagtgatgaaatggttgatgtcgcgtatatgatgaaagtgaaaagaaactaatagattaataatctactatagagttagaagctacttagggcctgtttgtttcagcttaagattattataatctagattattaaatcatattactctaagctggattataataagctaacataaaataagctgtgagttgtttgtttctctggattattgaaggcatctaagggtagtgggtctttagccacctaataatctggaaaaagctcatccataggagattattagattatagtaatctggcttatagattataataatctatcgtaataatctacttgtttatttcagcttactcctaataatccagattataataatcctaagctaaatcaaacagggccagtgacagacggctgtgaaccggtgtcatggccagatattgctttggtgcccaacactgcattgtgtatatagtcagttagataggatagtaatatacatgagagctg

SEQ ID NO: 61926 - DNA, 1735 bp, Oryza sativa
tgcctgacgtatcagttgataagacatgctttagtactatgcctcctgctgtcttgcagtcgttttcagctgtcgcagccacagcggctgctgcagtaagcagagttgaacatgtcccaaataatatggatttatgtctaaatttatggaatgcacatgcagaaatgtttttagtgaactgctaggtgttcttcaaccacaccttgaatgccaccctttagaaacattttgaagtgtgaaatcaccatttacctggtgaaactttgcatgtggaatgaggatacctatttactactcactgttgaccaaaaaatctcttattaactattaatttaaaatcttagttcctgccagaatattattagaatatgtaaagtatgtcattcttgatgtgaaatgttataagaagttaatcaccggtctacttgacaatatatcatttaagttatcttcatagtaaaagttagcaatatgcgtaggttcagagagatgtttgttttcatttccaggttccttattgataatgccaaaatatagcttaacggttgtttttattgatctcaaggaattgaaacaacgggaagagagtttatctaaagatttggaggatcttaaactgaggcttgctgaaattgagcacctcgctaaaggacgaggcctttcaggaatcttgaacttcaaaggtgttcatggagcagaaagcagcaaggcagcaacacctgcttgatcaatcaaattaacttgggtcaggcgaaacaggatgatattttgttaagttgatgcgcaaaacacctcaaaatttcactgatctgttttgtgattcttgtgtggcagttcattgccatgcccattcttttggtgtatggatcaaaatatatgccggatgatccatagacaccctaaaataatagaggccaaggatagaaaaaggcactgtatcatgtagattacttctgggtaagtaactatagaacaagttcgaaagagtaaaagtgaatgtgatattgtactttgctaacacatcacgcacatagctacggctgaactgaatgcctccttttactctgtctagtgatatttgttgagattgattgcatatcagaagtaaatgatttcaacagattctatctgttgctaaactaatctgtgccaggaaccatggttcaaaaataaccaatcgttatgttctgctgcacagttggaaatgacctttccactatctgaaaaaaagacactcagtaaatataactgaatgtaagcacacatgtcctttgtgccgctgcattctggaatgaaattttttattcggagacaacatacataccacttcttacaatatcacttgaagttgatatagcacatttttctactgcatatacatttttctgtcctacattactcggttgatactagatactagtacatttttctactacattccacttatacatttactcatttgtccccaaactcctcacatggtacatgagctactatacatcttgcatatattgggagtgtcgctgcatgcagctacacagatgtcagataagaagtttccatgcccctatttctgcggggaaatcttcctgtgagcaacctacaaaaccgtaaaccctactttcaaccttaccatcttgtgagtgtatatatacgtgtacatgcatgtacacgcaatctctctctctccttgctgactcgcattctgccatcgcatgcatatatatgctaatgc

SEQ ID NO: 61927 - DNA, 2076 bp, Oryza sativa
atcaccattgctaataaagattcacaaaaatgaataaaatcagccatgtccttatgagcatgagcacgcaaatttaggaaagctcaccttgactgagcaggattttgcaatgaggatgagtcaacttgcattgttacagggccatcgttcactaaagaaacctgcaaaagtattgaatttacatcttaaagggtaatagagcacaaaaaggcaattacagcatatgtttattcagaggtaccttcatcattgctccaaaaatgccatctgccaagacgagttaaaagtatagacatgttagaaatagctcatctgacaatggcttacaataaataaattttgttctctgagcaaatacttaatataaatgttcatggtaatatatcagggaaagtgaaaggaaaaataataaaagagttgaacaattataatatattgatagcagaagttactatggtgaagtacaataccagcaatacatcttagaatgtgctttataaaataatcttgagtgtaggaaccatgagaaacatggaaaaaaatcacttaaatccgcaacacaccaacatagccatatttgtgtggattacaaaagaacaaattgtaataagaacaacaattagataaccaggaactcaggactgctagttacatagtgcaaaaagaaatgatagatatgcattatatattacctttcactgcatcagctgagtatgatttctggaacttctcgactaaagaagcatagaatggctttgctttagcaggtggcatagccacatgaaaatctggcttgttacccttcaggattccatataaggtaaattgactgactgaatagtatatcagcttagtaacggtgtcaataacaacaaagctactacagcttaagaattttcaaatctgggactagaaatgctgtattatattactcctacctaatagaacttcaaatttccgctgcaaaacctgcaagaaggaaaaagttatttaggttcatcttcaaacctcaaatgaagtacaggagatatatgtgacatgcttgaataggttgtttttgtcatattgataccaagatgagtcaggacttacactttgatcccatgccttttcagtcttctcattaggaaatagcctcatgttcagaaccttccgacaactgcgtaaggtcatgttagtatgagagtgacaatataacacaaggatacatcatacatttactgaagatctgagcataaacaaaattgcaggaaacgcaaagatggaacttttgtaattgaactagaactaagaagctctttccaaactatacagtatacacgtttccagatcaaacatggcaacaagtactagtatcattgatttatcaacaaccatcatttcttctcccattctacattacgaattcatgatatctccctccactaaagaagctaagtagctaataaacacgtaaaaaataacagattccagattcagtgagatgcgagaacgaaatagtaagagcaggtaagctgggcacacacatgtagtcagcgtcggcgtcggtgtcggcctcgtggacgccgacaaggacgaggaggccggggccaatcgccgacaccacccgcccctccacctgcaaccaaaaaacccacgggaaccaaccaatcaggaatcagccgctcgcctcctcctcctagctagcgagtgggagaggggaacccgctcacctcgacgcttgccgagaggacacgctgcaccacggccctcatctccctcttccttctcgcctccgccgcagccggatctccgggcttcgcgtgcggcgccgggcgagtcgccggagacacccttgggcggcggaggagcacggagacggtgagagagacggatggcacgatgggccgaggaaagtggccacggttctagtgggccaatatgggccgggctttaccagaactggttgaattttctcttggtttactgactagaaacctgaaattgttcaaaacctgacagaatatataacagcacgctaatcatatgttcaactagctgggtgacccgcgcaattgcacggctagcacctatata

SEQ ID NO: 61928 - DNA, 9497 bp, Oryza sativa
ttttctccatcaccttggctacatcttctgtcaagttctctgcatctcccgcactccttgtcggtttcgcatcttcatcgactactatctttatcgatgtccgtttttcaccggcctccttaaggtttggacgtggagtttgtgggatcttcggatcaagctctgttgcactctgaggccctggcgttgtaggaataccgggatcaatatcatggaaacttcccttcttcaagctcttccggaaaaaggagccaaaaaaacccccttgtccactgctttttggggtaggcgcatcctttgatttgtcaacttctttgtaaatctccgtgtcaggattacgtgctcgccctttccgtgattcccatgtcttgggaactccagtgccagggcgatgcacatataatcctccaggttgttcttgcccatcaatgttaatgtgctccacttcatctactaagacttgcttttcatcaggcagttcatcagcattaaacttgttgacggatgttgatattggtagttcagcatcaactttccttgatgattcttccaaccccttctcctgaaaatacaattgtgaatgagtttaggtaggggcgaacttcaacagtttaaatacgtacttgcagtttccttttaaaagctttcaatgcataatgtatagtttagctcaacagttgttttactagataatattctgatgaagaggatgtgtctagtgctatcaatcattttgctgcaacttccctaccttcatgaaatgactacttacatgttccaaaaatatacggaaaaaaaaattaaaaatgttatcaccaacctctgatatatcttcaactgttattgccaagtgaatccttcctttcttgacattcttgagtgatatccatttgtcatgtctctgaccacccctcagctcatggatatctatagtacatgttctgtaaacaaaatgaagtgtaatgtactttcactttttttctagtataaaataccaaataggtcaattcaatataaaacatcagaaaggctaactctgaggctgagataaaataagtgccaagttgtcatcttttacaaagttaaactgaatacagcaatgagttgatgccaaatatagctgaccatttagcaacacgagttcagtaaacaggacatacccaagcgagtcatcaaacatgtggtccttatcacacacttccatggcaagttcatttaatgactcccacgatgtaatgggtattttgaattcttcaaaccacttaggggatagtgtattcttctgtatctgagtttggaatttaaaaggaccaagacgacctttcacataagggtcggagagccctatataatggaatgtaaggtgagtcaaaatcaaacagcgggcaacatgaacattaatgcaggtaattctcaccattcatatcagatggtttcatgtcggatccttctaaaatctcaagtttcacatatgcaacaggaggtctctcctcaatgctgaaccagtcattgtctgcagaatgtgaagaagttaatgcaaagtaaacagcaataatggttatcatattttttcttgaaacaagactggaagtctgtcatcagagaaagttagaaagagaaatactctttttctaaaaaaaggtaggttaaaaaacacaaggcaatgacagggtttgaaggggcgtatcctattagcatttgctagaacacttggctaaagcaagtggtctaaagaggccgattcatatgataatagactaaccctacaattgttggaagctaacacaaatataggaggattgaaaggaaaacaacaggaatgaaaggatgattccttaaacacaagcagaaagcaaagcttcctcctacctgagggagtcgatacaaatttttccacatcgataacaagcatattgggctggaagaagaaaagttgcatcagcaaggaaaaaatatacaatgaacagccttcaccctaagttcataaaaatctaacctcaactaatgtctgcccaaatgcagtatgcatcaacttatcctggaaaaattccaaggggccgagtgatcagtaaaaaacaaattcactaacattgcagagacgaccatgctggtacaggagaatctcctgccatcctgaaattgctggaaactcaacgacatcaagcccatgaccaatgagtggctttacagtcatcgtgagataatagaggctccacaaaacatattctcacacggccaataaatggccaactccggacaaacttcacaccgactacaatctgcttgatgaacatatgcatgttctgagtacaatgtgggggaagaaactgcttaatgaacgaatatatgcgaatactctataactctttatcctgatatgctgaggagggcatattacaatactatttagttaaacaaacagttcagtgcctctcttacatttttagatgatgatctccctttactatcatactttcttataactgagaagaatatgtatctcctttcttgactatgaagtccccatttccttggttagcatcacaatcaacctacacaagcaacaatggtgcttgcctagaatttctttgcctccattaagataacgaaggattttttttctgttcctttcgctgggtcaacaatgtccttatctgtttttttcaagcaaggttagtagagagcattgaccattttttagcaagaggttaataaaaaaattatgtcatcaatttttttttgggagaattatgttactcatgtagttttgagttaacatgttaatttgagtataatgaacacggaagatcaagagacttctgcaatatgtgtatcttgttaatctgtatagtttgttcacatactatttggatatcagaggcaacatcatcataacataaatttcaatccacttaggatgaaaggagctttcttatgttagagggaaatacaccatacttgtctcagcaccaaatatctgtctgctttcgttagaaccacaaacaaatagcttggatgatttcaagatcaaaatagactgaaaaaaaacctgaaaaagttaagtgtgcctaatgaagcagactgtaaaagatacaaataaatctagtgattggacttagtgtagtatctccgaaatcaaacttaccattagatataaacaacacagaacttgaaaatccatgtgctgtaacggctttaaaagttgattatttctaatagtatgttaagttgatcttgttagtgacagaataatgaagctaagtagataaattgcatccccttaaaaacgtagaacttgcctttccctcaacatgcatgctagtcagatgcatgtttgcagtcattccaagtccgacactcttatgcagctgcatagaaagtacagcactcatatcttcagcagatagaaaattcatccctatctccagaacctggccatcagatggcacaaaaatcattacaatttttaccatggacgaaaaagaaatactcaaatcagaagacattagtacccaccaaatggtcatcatctgatgtctcaggtaaaactctcattgaagtaaacagtggtgaattcctgcccatataaagctcctgaactcctgctttactctgcgggataactacaacagttgagctattgagggcaatgcctacttaaagaaataaaaataaatttatagaacttcatggcaaaactagaacttcaaggtacaattcatatagtggaatctcatcaattgcaaaagcaagaggcaagaaggaaaccgtacaactgtccaaggtttgaacttatccaagaaccatggtattatgggtcgtagaagttgtgagacgatcttctccatacagataggccacatcttttttattgcataatttaaccagcgtactgattctgcatcagatagcagctgatacataaaacaaaatgagctaaatctactcaagcgttctcagacgtctcagtagaaatagaaaagtagcaaaagaatgtgggagcctagttaaccaggttcatccttgcaaaatataaaagaagaacaaatcatagatcatagaaaggagcatactcttcgttggtaggcagatttcatttcttcatgttgtattctcttccgcaatttcattgcacagcgagcatttacctacaatgaaaaggtaacacaatatttactttagttctggaacgaaagagtaacatatttttgtttcatttcgattatctgatgtgtaagacatgccgattcatctatattggaagtatgaaactatgaattccactctatctcttttatttaaaagagaaataaattctattccataacatgaactttagtacatatccaattgtgaccaaataattccataaaaaagggccaaaatacaaaaattatggaatacataagattaatagggcagtattgatgtccctaccattgtaccagctgatatatacatatggatagagaactatcaattagcaccatgtcccagtggtaatcaaccaaccatagtccatagcacacaagcaaccatatagcatgttcaaccattccaaagcatgtcgatatacatcattttctcccatacacactaagaattatacactcaagtttaaagaaagcgcaaccggaatcagatattaaatcagtcacatcgcagaaaggaaagaaatttgcaaccggaatcagatacaaaatcagtcgcatcgcagaaaggaaaggaaaggaaattttctgatagaaacaaaaggcaaaaaaaaaaacctcccagagagcgatgcatccatcacaactgtcacctaagcatatgccgtaaaggagctcaaaaaagataaaaaaaaaagtcgcatcaacttatcagcgagaggcgcgggcggcagcggcagaagagcaccgtaccatgtagaggtagaggaaggcgaggaggaagaggacggagtggcggaaccgagggagcccgcggcccacagcgcggccagcacgatgccgatgtggtacacgatgggcagctcgccggcgtccatctcccctccccagccgacggctgctccgccgcggaagcggaacccccgcgctccgggccggccggcgagccggcgatctcttttgccgcgaagagctagtcggaagtggcgggcgcgaatctgggtggaaacggtggcgcacgcgcggacaaggcgacgagccgacgagagtgaggcgtggtctggtccggaaaagttattttgggaaatggtaggggcctaagtgagaaactgttgccagaaaggcacccaacgtcgaccaacagaaaaaggtgctcgcgcacgcgcacccaactcaactccggctcggtcaggttcatgtcatcatgtgccaatgggcacaacctctttcgtgactggttgttgctaacactatcaagttttaggggctgtttggttcccagccacactttaccattacttgccaacaaaagttgccacaccttgtctaaggtgaagtgatcaaattgttagccacaacttactaagcctaagggaatcttgccacacttttttgagccattgacacgtgggacccaatttgttggaggggaatcttgccacaactgtggctacaaccaaacacctgtcaaatttgcctaaccttaggcgtggcaaactgtggcaaagtgtggcttgcaaccaaacacacccttagtaatatgaaaaaaataaattgctaaattttggtaatgtagggtaggggtatattttggtggtagtaggctgtgttcgttagagagggttgcgaacctatcatctatgcacggaaaacggagcggtatattagagcgtaattaattgattattagctattttttttaaaaaaggattaatttaacttttttaagcaatttttatatagaaacttttttaaaaaacgtgcacgcggaacactgccttaagagtggaaacttcgagggaaggaaactgtgtcagggtagaaatagttattattatacatgttctgtttgttgctttatcaattttaagtacggttgagtcgataacaaaccaaataaataaaaagcttttatttatggttggttttacatcatattagaaggctaatattactagtcctatctaacataaaaaaatagtttttctaactccattattacgtatacacaatctttacacggccagtggtctgtaagtgtagtggactgaaaatttgatgaggcgtgaaggaccaaaatgtttataagatctatatcaagttagaaacaaacaagaaaagcatattaattgaattccacaccatgatatcagtcagatactaaccctacacaccatgacatcagtgaaatactaacctgcacggttttccccggtatgtcaaaagtaaatcaactaaaatactctacagtcgtgaagtagtgactagttttgtcgactaacactctgcaacttgacccctccacaaatatcagatcatctcttgacttatattcataattattcatattatttattaataactaaaatataaaatatacttctatatactagtaatgtccttagctatttaattaaaaataaatactgtaaaataaactacaatagaaaactatataatcaacctcaaaccagccacacatcaacacctaacatcagcttgtaatactagtactaactttgtactaaataaataaccagagacgcggacttgtttatcttgccgacacggatattcccgggcgatggcttcacctcacctgccagctcacgtcgtcctcacgtgccgacgctaatctcaaaccccgtgcccaccgtgcgatctggagcacgttaattggtgctttggtgaccatgccatatcttaaccgcaagaaacctatcttaaggcttaagctaaacaagtgtccactccacagtacgtaattatttctccttagctcatcatcaagcagaacaattattgtcgacgatataatccatttggatattgggaatttgggattacccgggaccagagacgatgccgtgggtccaccgtccacgtacgattgttgctgtagttaattaggctggagatattgtcaggattcagaaagcgatggcccgtggaattcgtgcatatatggagtacgtgccatgttgagccagccagcagcgtgcagggtcccctggtccggtcgttctcttgtgagtgagtagtgatggtgcaccagagagcattctatctgtgacatctggcgttaattctactgtgtgattgagcagattaaaagggaataagctaaacgatatacctatctctatctctatctctatctctactattataaaaattaaagatgtttttaccggtactttggtacgtcatctgttgatgagttggtttttaagttcgttcgcttttagaaatacagatctatatttccgtatttgagtcaagttttaagtttgttcgctttcagaaatacatgagcaatcgtataagaaatatctttaaaaaaacttatatgttaacttaagatgatcggactcctaattacagcttatgattttctagaaaaaaaataatatatctaagcgaattatcacgatgaatttcactttaactaaaccgtataacaataataaaattaaaatagcctttacccgttgcaacgcacgtgcattttttctagtagataaaaaataatttataagtaaaacgtttatatacgtgtttataatgatttaaaagcaaatgaagaaaataaactacgtacaatgaaatagctttaaaatcaactctaaatttaatgttcaaaatttaatttttggcttgtggtaatgggctatctgagaatccaatcctaatgagacgatcatacgagacaccgtgcttaaattttcttccaagagccagattcttcgaaatgtccgaatggtcggcgcccagatctctctccttctttatttatcctgataagctagtgattactaattagggtacgtgaagatagtaccggcctcatcttttcacttattattattattattattattattattattattattattattattattattattattaggaaaaagtacgaattacctctcgaactatcgcggtcgtccgaattaccccctgaaccacaaaaccagtcatttttcacccccaactatataaaccggacgaattagccccgaaaatgcttcgtatcgagcgtccgatacgagacaaactccggacggtcgatggggcccacctttccccatcttatcctcttccttctcatccccaacctctcgttcaacttcttctcaacgtctccacgctgcatacgcggctacggcgtcatcagccggcgccggtgccgccaccgccgctgtagacggcggggctgccgtcgcggatggccggattctggtgtcgccggcgacgttcatcagcggcgtcgtgtggcagacgcggtggccgtgttcctggtggcactggcaatggaggcgtcgggcggcgtcgaacggcgacgaccgcgcgccgctgttcttcagcttctccccgacgacagatggaaaaggaagcgtagggtggtgctcgtcgccggcgaggactaccatgcgctcgagtggtggccggtgcagcagttccgacagcgggatgcggtgagcgccggcaaccacattggcggcaacggggcagcacgacggaaatgcttgagacgccattacctgagagggttctgagctcggcgacgaaggtgaggaggctgcacactacatgttttttgttgcacatagtgtgttcctgatgttgcaatccattttttctggatgtttcttaaatcggtagtggatgttgcatttggtttcttcggatgttgcatatattggttttttttgttgcagacaacattatcgagtgttgcattcgattgaaacatcttcgataaagcggtgaaacacggtgaaacattcaatgaaagatgaaacatcaagaaacaatttttgttaaaacatttttttttcgagcggtgaaacattgcaacattcattcaacataatgtgaaacatcgtctggagattttatgttgaaacattttttttttcgagcgatggaacattgcaacattcattcaacatacagtggaacatcgtccggagatttgcaaatctccagacgtccgatgcgtagctttctccatttacccccctcgacccaatccgcagtagttttagtccatgtagcgtacgcgtggcagcccagtcagcattctatatatataaaaaattgtgggacccacctgtcatatggtcttctcttcaaaatctctctctctctctctctgcgatgcagggcgacggggcgagcaggaacggcgggcgcggctggcggcgagcggcggcgggcgcgggcggtggcgggcgcggttggcggcgagcagcggtgcgcgggggtggacgggcggcggcggtgcgcgggggcggacggtcggtgggcggcggtggctgaagtgggggctga

SEQ ID NO: 61929 - DNA, 16269 bp, Oryza sativa
  unsure (1)..(16269): unsure at all n locations
tcctcgactcctcgccctcccgcacgagttttccccccaccaagcagaaccggatgcggcgcgcaggcctccccggcggcaccctgcaggtgctcctgcaggcacggtcgaggttggcgaacgcgcggcgcacgcaccggagctcctcccggtccacctcgctcatccggcgtaccgccgctccgccgcccggggatcgtcgtcaccgttggtcatagcggcggtgatggcgtcgtctaggccgagcggcgacgcggcggcaacaccaccaccggcggcacctccaccgccctcagccgccgcctccgcgccgccgccctcagcccccacctccgccaccgccgcccaccgaccgtcagcccccgcgcacccgcgccgcccgtccgcccccgcacaccgccgctcgccgccacccgcgcccgccgttcctgctcgccccgtagccgtgcatcgccccgagagagagagattgaagagaaccgtatgacaggtgggtcccacaattttatatatatatatagaatgctgactgaattgccacgtgtacgccacgtagaccaaaaccaccgcggattagatcgaggggggtaattcgtccggtttgtatagttgggggtgaagaatgtccagttttgtggttcaaggggtaattcggacgaccgcgatagttcagggggtaattcgtactttttccttattattattattattatgtttcctccgtcctaaaaaaaattaacggatttaacccaatccccttccagtataatcaatatgaactacaataaatctagttttttttttacggatggagtacttattagtcaaaatttgaattttgaaccttaaatatgaatttaagctgattttaggatttttttttaccgaagtttatttttcagcctttgattttagattgataagaacatgtatataaaagttttgtttagaaattttcttttcatttgcaaatatgccgtttggcttactcaacgatgggagcctacctttctcctctttttttttttttagttttggctgttcttctctcatcatcaattctatagtttaggaaaaagtacgaattagccccccgaacttttgcggtcgtccgaattaccctccgaactacaaaaccgggcattttttacccccaactatgtaaaccggacaaattacccccctcgacccaatccgcggtggttttgatccacgtggcgtacgcgtggcagtccagtcagcactctatttataaaaaaaaattgtgggacccacctgtcatctcctcatcctctcttcctctctcttctctctcacggggcggcagtgggctggaggaggcgcggtggcgcacctgcgggcggtggagggcgccgccgcggaggctcgcgcctggacgaagtccgcctccgccgccggccgcccggacgaggttcggcctccgccaccggccgcccggaggaggtccgccttcgccgccggccgccgaccggacgaggtccgcctccgccgcctgccgccgaccgggcgaggaccgcctccgccgccgactgcccggatgaggtccgcccgccgctggctgccattccgagagcatgcgcaagagagagcaggggggatccttggcgccgcccgccgccgccgcgtcctcccgccgcagccgtccgagctgcgggcgcctcctccgccgcccgagcttcgcctccgcctatcgccatcaccggcccgagctctgcccgccgccgtcatctgcttgctctgcgagcgccccctccaccgcctcgacgagccgtgcaccggcagttgcgggcttctcgagcttcgccgccccgagcgccggcagctacaggctcctcctctgccacccgagctccgcctccgcacattgtcgtcgccgcccctctccgccgttgcctctcggtgacagagagatggaggtccgccgcgggcgcccgttcttggcgagaagagagagaagaggggacaaactgacaagtgggcccacgcgtacgccacatgtactgccacgtgtactaactggactgccacatgtacgccacgtggaccaaaaccaccgcggattgagtcgaggggggtaatttatccggtttgcatagttgggggtgaagaatgcccggttttgtggttcggggggaggggtaattcggacgaccacggtagttcggggggtaattcgtacttttccctatggttttaattgcattagtagtcgatgtatacaacttttaacataataccaaagcgaaatgtttcgagttccaatcccacattctcatcttttagcttacgcttatgcttatcagccaaaatttaaattttcaaccttaaatttgaagttgattttaggggttttcattgaagtttatttttcggtttttttatatcgttaagaacacatatataaaacttttttctcaaattatttctcatttgtaaatatgttatttggtttattcctccatttgtaaatattgcttggtttattcctccaacaagtgaaacgatgggatatctaatagagaaaattgatatttagccattctcgggttggggtttcgccagaatgccatcgccgaatgtggcttcgttataatgccatcttcaaatgaccccatcttgccacactgccattttaaccaattttgattatttgcaaatgttttccaccattttgcttatttggtttgacccaaatgcccttgcctcagccgtggggcctgcttggcaggagcgtcttccaccttcgtccaccaccatccttctctcttcgatgaactcatgccccaaattgatctccctccttggttgctcttgcccaaatttgaatgcaaaaatcagttcctctcgtcctcctcatcaattcccccgacaaatcccactcaaatcggcttaactccgtggtggattttaaagtccctcttcaatggcgagctccaccatggccggcgtcgatctctctccccgatgaggttgaagggcccgctcaagcgactggacgttgcgggtggagctggctgcggctgcgcgcgcgagcaggtcccctcgacaaggagctccgccgtgagcaggtcgctgcccacatcgaggagctcatcggagaaggggatgacaccgtggcgcgcggtcaggtcgagtgcttggtgcgccgcgccgccgagccgaactgtcgtccccgtccacgccggcgccttcctcgtcccaaggcgcgctgccttccccgttcccggtcgccgtcgccaccgccggcaacttgtgcgtgaacccggtgagcttcgccgtcaagctggtgagggcggtgaagggcggcgtcggcaccatccccgacgtggccagctttctcatctcgtagcggtacggcgatggtctcgagctgcgccagcgccacccaccatctgcaacgaagagaggatgaggtaagagaagagagatgagataggatccaagggtatttttatcatctcagcaagaaaaaatcattaaattgagaagaaatggatgaaatggcattgcaacatgttgcccctgtttgagagtgatattttaacgaaatcatttttaaaagtgttattctagcaaaacatgtttgacaatggcaaaatgtcaattttctcgaccgatttatcgagggcccgacacggtcgtagtaataagatggcacggtcccgttcgtcgatcagcgtcacgagccattaattcctttctcgcgacaggaacagtagaatggatcccccaggtacgatctggaccgtcggtcacgcatcggacggaccacgcgcgctcgaggccccccgaccccgtcgctgtacatccaagctgtctaaacgcccctcgcctgggctctcgtcaccagtgtgaacgcggcaaggaggaagagaggacgagatgggcggcggcggcggcgacgagcgcgagaaggccaagggcggcggcggcggaggaggaggaggaggtggaggaggagagtacgggacgttccagggcccgcccagctacccgcccccgcgcccgccggtcgtcgggtacccgcagcccgcgccgccgccggggctctacggccagggcgatccatactaccgcccccgcggcgggtaccagggcattcccggtaatgttctggcctgcctggtttgggggatcacgagggatgcgggttaggttaggtctggactggatcactggaatttcggtggtgcgtgatcgggctcaaatcgtggaggggttctgcttgatctgaaccatctagaaccggttgatgagtgattggtcgaaattgaggtgaattggaggattagagggcgttttcttacagatctttggcatgatcacgcgatccgggatctatctgcttgaaatttaccgtgctttgtggaattgaagtttttatttactgccattatgcaatttttttcgtgttgttggtccaagatatgcaaaatcttaggtggtctgcttgaaacttacgtgatgtccagttgtaggcgagtagtgtgctcctgttgtttaaaactcattgctccattactccataaacctgggcagctagtgtagtgactactggggtggtgcttaatggcaaaattaacacctctttagtaccttagtttgattggagttttgtatgtaatcaacggtgaaatattttggcacatggagttcgatttttctgacataaaaagcagtcctttacagaattgagttagtccagtctttatgtatttattatattccaaattaactagtacttattcagataagttttgttacaaaattaccagtacattgtaacctcgttgctcttctttcagctcgagattatgaagcaggtgctcgtggacatggtcatgaccgccttccttgctgtgggattggcattggctggtttttgtaagcgagcattgctttgttcttctatttcttattgtagcaacatcatctttgaaatctggaaaaagtaccccaaaagttttaggtgcatcatgccatttcttgaactgtacctgcttatcctcatgacaaacccttgttttttagattcatagtcggtttcttcctcggtgctattccttggtatgtcggagcattcctactgtggtgttctagagtggactacagggagaaaccaggatatgtagcatgcgctatagcggtaagtaacataatttattcttgagttcatccgatactataacattatttgttttgattcttactgcagtgcattgtaccatttctgctgcctattccatctgttctttttcggtgtgtgtgatcaaacagatcagtactagtcatttacaaggaatacataattccatttgtcatacttgtgtgttgaaacttgaaaatatatttctcatgacatgctgatgtaaatattagttcacctcaggattgtacatgaagtttgtgcgcgcttgttttgggttcctcgtatagctgtttacatgaataatcttcatgaaacaaaaacgaatggtcaagcacatcggctatttgtccatcttgctcttgtaaggcgtgaagtttggtttctaaaaacaaagcaactatcagactttgttgtgcaaatactgaataatgcatcaggagcaagtagggaactaggaattggactgatgactttatagatgttagcctcagcattccagcaaaaaaagtactgcaaaaataggttacaggtacaataatgaacttgttgtgtctgatctttttttcaatgtttttttcaatgttggttcagaaaaaaacaatagagttaacttcgttcaatcatatacagtgcataccttaggttactgtttttcatgtttgaagcatctctgctcttcaccagttgcacgcttgcttgagccaataccattataatccacacgagttttggacatgtatgtagccagagcatatatatacatgaaggatcaagtccagagaacattgtcgtactttaacataattcgttcattgatgcatattctcttggtaacaccaacagctaatgtaatgataagtggaaatggctttgatgaaattctagattgatcagttatctagtttcagtcgtaccttgtattttttaaaaaaattccagtcactctaatggcatttttatgatgtaacaggctgtccttgccaccattgctataataatcggagctaccgctggagctgcttaattacattttacattgtgtcgttattgtacatactgtatatctcatggatgcacaaacatttagtatgtcgtctgcgatgtaccttattcagcttttcttttccgtttgattttttaatgtttaacaaggagaacggatgcccttgttcatggtcataaataaatcaggttgagacgatttcgccttttgaatacctacatctaatgtgacaggaaaatagaagttgtggcttggttttcaacttttgtcactgtcaactggtgatctagtagtagtcacttgctcgatctgacaagaagtgtctgatgaagtctggatttgttatcccatcgcagagcttaaagtagtaatgtactccttccgtcccattttaagtccagtagggtttatgaaaagtttgtgaaaaaaataaaaaaaagtcacgcataaagtactattcaagttttatcatctaataacaataaaaatattaatcataaaaaatttcaaataaaacggacgattaaacattggacacataatcccacaactatactcaataaggtagctgtttgggttaccaaaaaaaaaaagtcatattcacattcacagttagttgtttgggttggagatcactgcaaaaccttgagtctctgtgtgcccaggtccgaagagcaaaatacttcccacaggggaacatcttgcaggcaaagcaaacagcaagcatgtcctacacttggaggagtatctgtcgaggccttggggtactgaagaatgggatgatatggagagttggtaatggttcacacataaatatttggtctgacccgtattggtcagtggccaaacaaggaaaccaattacgccgagaggcaacaatattataacggaggtggaggaactaattgatctaagtactaggagttgggatcttgagttgctaaggcaaactttctgggagtaggatattgacacaattcgcttgatcccagtgcacattgagatggatgatgtactggcatggcattatgacgagaaggggttgtttttggtgaaatcggcatataaagtgcaccgagactgggagagacagagacaaaggagaggaaatgcagctacatccaatgagagtaacaagcctgatctttttctggaagaaggtatggaatatgcaggttccgagaaaggtgaaacacttcatatggaggctttgtcataacagtttggccctgagaacaaacctgggtcactgaggaatggatatagataccaggcgcgtctctgtgcaatcaaatgaatgaaatgaataattttgtaaattccagctctagttcttttgctattaagtattgccctcgggattgtaataaaatagcgcatgctataacggcactgggttgtaatgatcagcttcacaacattctcagctgggatgatgtaccccctgaggtggtgaagttggtgaccagcgatctcactgggattgtttttccaggtcaaaaaaaaaaagccaatgtacgaggcttgtgccatgcgccattcaaaacaaaaattcacattttcttggcttgagaagcaaaagaaccccaggcctttgcaaaattcagtttcctatgattcattcacatacagcgacttaaggtgcctatacatgagcttgctatcatgaacggccaactggagttcataatcatctgaccaccattgctgcaacccatgagcttcaaggaacttctttggtcctttggcaatcacaaacagcttggaatgagtcccagaatggccatcatgcttctcggcagtaacagtggcgacaccgctgcgatcagcataaaagcagcaaatgtagtcacagctgtttatgtacaggtttggcacccatctctttacctccttgatcagcttttcttctccaatttcagaagctgctcctccatcctctgttgggtgagaaagttctgtagcatttgaagaacttccactgacatatctcttcaagaccttgccggctttctcctgaagtttcctcagccccatgccaagtgagactgatggtggattgaacagatggcattctacaaagatcccatcttgagccaaagtcttgccaacctgcagagcaaagcctgcccccagggaatgcccagcaatgcacacattgttgctgccacgcttgtcgatcgccgacttgagcgcctcgagagcaccggtgaacctgacagagcccctcaagctctccatggtgaagaaccggaagtcgtcttcgaggtctctcacaactgtcgactgcttaagtactgttccccttatcgcgaggacaaccttcggggcgccattaggtctcaacactatcaagtctgatagggcagcaagctggtcccattctagcagcacaccatatatggatccatctctagaatcaattagaggacgcaccagcttgtacttgaatggcttccaccagttaggagcaagggcgctttcaccgtttctcttctcctgcctgtctagctccagtagatacgcagcctgcacgaagcatgaaaccgcaattcttcggtagttgggatctgtcctgaagaagcataaataatgctgttaaatcagtgctacccacattactagtttggttatcaaacattacaaaaaggcatgatctccagaaatggaaacaaaacagggaactcatatccctaggacaagaatgtggactaaatttcatttacatttaagcaaaattatggacacgacactgcacatagagagtagtatatatatatatattttgttcaatgcaccatgttaaagccataaaatttgacatgttcctttacctgaaaattatttccactacacgaccagcattctacaagctggagtatgacaagcggtcaactaacatattgccaacaatcctagttactacttcattcaatttgtttacagccttgactggtgattaaaaaaaacatgatattggcatggtactatctagttgccatcatactgaaatatgacgaacacacgttacctcggcaattggttgcaacagctgtttgcaccacattcctctgctttttcagttatgtacttatgtatgacttctcaatgggcaactgtattttatacataatatcttttaggactagctctgtaggtttcataaagaaacaccaggaatccttaagctccatgcacacgactgacacgaggttcgatcaaatagcacgaaaaatccctgaactccacgcagagttaaccatttctcaggcaggcaggtaaaaatcccgtaacaattcacagttctagacaagtgacccaagcacgcgtaaggccattcctagaatggtgtctatagcattaaataagctgccacataggatgaaaaataatatgataaatgaataaatgaggaaagagaatgacatcgtttctacacaacatccaagacatcatgtgagataagtagcattaaatttaaatatggaatagtggtgtttgcattggaagattagtgtctagtactaatttctcgatgacgtagagtttatggaaactatgtctagtgttttgggttgggaatggccttaacactccaaacatctcagacatgtagtaatgatgtaaacaaaaaccgtacgcgagtgaccaagaatgggagcacatgtgcatgttcatggacgatccaacagcggaaggaggagggagggagaagggatgggtcgcgaaccaccaaccagctcgagcggatgaggtccctccagctggggttggagatgttgcggggccccgtcgcgtggaactcccacagcacctgcttcccgccacctccgccgccgccgttgctccccatcgtcgatcccctccgcccgtcgctctcgctctcgcaccaccggttgattagcggagaaggaaagggaaggcgggagaggggggcggcgcgccggtgccgccgatcgaggaggcgctcgtcaacgtcggagagaaggaagggggtggatggatccgtggcccgtgcgggcggggaagaatatacggggcgccaacgcggcggcgggtgggaaatctcgcgcgcgctgatgcacgcaacggcctcgccaggtcgtttttttactgtacttttgcgtgttcggttgcgaggtcaaacggtcaaggcgccacgctgctgctgttgcctgttggtggtggtcatctgtagctaggaaacaaacggaatctaacagaaataaccttttcattaggtgttactaggtcacttatttaaaggcagaagacgtaagttcgagaatttgattagcaaattttaatatgggcacgaatattgtgttgttttttttttcggtttcttatgccgagtatggtgtatatatattttaatatgttcagtgcaatattctaataggatgctccggtgtgagacaaaaaccgacgcgggcagaaaaaaccgaaccaaatacattgtagaagccggctactatgtgtcaggccgaaaatcgatgtcccaaaacaagtcaaactcagttgactaaataagtatttgtcacggagagaaagaacaagtggctgatagatgggaaaatacagtccagccacctctctcgttcccctccagttggatgctggccttgtcttaactccagaagtcaccgctagacgtcgccgccatcgagcgggtgcaggtgggcgatcaaaatttggcatatcaaaatttggctccaaactaaataaacactaaacactattgaaattgccaaatattggtaaggtcaatttagatctcaaaccaaattagcccaaaatttagagctctacgtgcttttaatcttttcagccatagctagcgaaaatttaaattttaaaaacttaattttagagttgattttttttgttatcgtagtttacttttcagcattacctttttaagttattaggaacacatatccaacgtttggccatccgtcttatttgaaaattttaaaaaaaatagtcactcataaattactatttatattttatcatctaataataataaaaatactagtcattttttttaaataaggcggacgatcaaacgttgaacatgaaaacccaaaactacacttatttgggatggagggcgtgatattcagtagaaacaatttctcctagggggctgcaatataacggtatcccgtttttcgaacgggatgatcccgagtaagtatcaggtgttgtcggagatatggacccgggggtatgtgtgtgaagtagaggggaattactttccctccggccacgtgactctgcaagttagccccattcgtgcgtcacgcgagtcgtgaaagcgccgggggggggggggggggctcggggcatggcgtcaccccctcgggctatcccgcggcttcgccccgaggccttcacccggctgccacgcggcggagggagagagcgagagcacaggctgaacagccataaatgtgcgatgccccaactgtccctcaccgcatttaatgcggtaagggcagacgtgcggcgcgcctagctaacctctgtccaacggatgtgaccgatctgtgaccggcctgacaccgtcacatccgacggatagggcaatcatgtcctcacgtcgctcttgtacccggcggagtgggggtgggtatgacccgtcacgtccgagcgtcactcgaggaagggctgtcacaggtcatcgttcatttatgagggaatgacagggctgtccaccgtgtcaggcgggggccggcacctggttccactcgagaaccggttgttgcttagcttccgggagaaggcacgatttaaagcccaggaaaagtggagtgggatccccctccgagagagggtaggtagaggcggcgcatgtggtatccccttgagctataaaaggaggaccctgcccactgagacgggggggacgccgagaaaacctgaactccagaagagaggaagcgagtgcgctttctagagtgaagaaatctttgtaaaacacatccataatcccaaacacaggagtagggtgttacgctccatagcggcccgaacctgtataatccgactgcgtgcaagcttgccggtaatcctagggacgagcgagtgatttccaagagatgagcctccgccccaggccgaactcacaaatggggggtctcacgattccccgctattgaggatctctcctcgacaggtgtgatacctatcaggtatcagacgattctacacaacaggatgatcccgagtaggtatcaggtgtgatacctatcagatatcagacgattctacacacgtttcaagtgatacctacaagtatcatgtgatacttatcaggtatcatgcgattttctaccacgtatcgcgtgatactcgcgaggtatcatgtgaaacctgtcaggtatcagatgatttcaaccacgtatcgcgtgatactcacgaggtatcatgcgatacctgtcatgtatcagacgatttctaccacgtatcacatgatactcgcgaggtatcagacgatttctatcatgtatcacgtgatacttgcgaggtatcggatgatacctaccaggtatcaggtgattcctactaaatatggttggacatcccgttgggggaggagcaccccgacacgcgcggtcgcccccaacagccgtcccttgtagacgaggacggcgacggcagcggtagcgggggacgggcgcgacggcggtgggggatgggcgtggcggcggcggcggcgggggacaacaacggcggcagtgggggatgggcgtagcggcggcgtcgacgggggatgggcgcggcggcagcggcggcgacgggggacgggcgcggcagcggcgggggacgacgacggcgacaagtgagtgtatggataaaaatcacgtgtggataggagctatcctgttgggggacggnntnncntncnctancnttttnntttttncttnttttccnnntcnnnnnctnanctnntctcctctgttcacttccttctgagcttccctttcctccgcctttcgtcggtatatagagctgttaagccgtgcctatgcagtcgcgacggagcacctgacgctgtcggccctgcttcgtgcagcagccgatgacaactgggccccaccacccgcgggccccacgtgtaagcgtgagcctcgagctccccacccgccgcgccgcaccgcacgcgcaccgaccacccacccagcggggcgagcgtgtccgtccgatccgtgtcgagatctcggaccgcctcggagaccgggcccaccccactacccaccccacatttcgaattcaaaccaatccccttccccgtctcgcttccctctcctcctcctcccaatcgaagcttccagaagccccagggcgtcgcgagggcgccgcggcggcggctcgtggcgaacgagggcgggggttgagagcgcgggagagggggaggcatggcggcggagccgcggagggtgtcgttccgcgacggccgcctcgcgtcgcggaaggcggaggaggctggtaagatctcttctcccacgggcccgataccgatcgagggggttcttcgatcggtggatcgatcgctctcatggcgttctcgtcgagggttccatggtttgcttgcttgcttgcgggttgctctgctgcttggggtttagagtttaggcgggtttgtgggggggcaaaagctcttggtctttttttggtgggggcatttctgctaacttaggtggagtgcttgcgagaatctcgcgctggggttccacttcgtgatcgtttttgggcgcttctatgcggaggccccgaatcaatcttacgcgatatgatgcatagcttttgcttctattgattaaatcgcgatagtcttgctattatgagagctagttcttctgcttggaccgtggtttctgcaaggaatgcgtttagagagctagttctcagtgattctccaagctgtctcgtgctgtttcaatcccaatgatccgtagataaatttctataagcaatagccacatggatcccatccttgtctccagaataatatagtactgtaaataatgttaatagaatgtagcacgcaaaatttctttgctgttctaatgctggctggtttagttttcgttaaattcgttggctgattgtagtttctttgatttctgcaagcattgagacggcaccaggctgcaacctggcttgagagcgtgatagggcccttcggcctctcccggtgcccatcggagcaagaatttgttgccgctgtaaggaatggcattgtcctatgcaaggcaattaacaaaatacaaccaggcgctgtgccaaaggtcgtggctaatgcctcctgtgatagccagccatcgacggctttccagtattttgagaacatccggaacttcttggttgctgttcaagagctgaagcttccatgctttgaggcctctgatttggaaaaggttgctacttaactatgcttagcaatttaatcctgatggtgggatgtgtaatcacccagaaaattgtgttgcttctgcaggacaatattgatgctgggtcagtaggcaagattgtcgattgtgtcatttccttgaagtcttatcatgagtggaggcaacggggaggaagttatgggcacctcaagcacttgaaatcacctcttgcaacacgttctgcaagtcatgttcagtctgaatatgtttgttccggatcttcttccaccccaaaacgtctagatttggtagagactgataccgagagacaaccaaatcaaaatgtgggtcctaattgtcaaggtttgtgatgcatttctcttggaacacatgatacagtttatgtataacttttattgcctgcttttttttacatgtacataataacttctttgcattgatatcatcatcaacaatgtaaccagctatctattgtgcattttcagaggcaatggaaagacttcagaaggttattttggactgcatgataagttgtaaagaaaatttggacaatgattctctgaaaaaggttattagtaaaaaatgatatgaggattccagttacatgtattgtactgtttaaatcatgatccatgtttttgacatgttttgatcactattccaggatccatataagttggttggaactattttatcacgtcaactggaaaaggaacaggtacactgtaatgccatctactttttatgtttaaaacactacttcatccatggtttcgttttgcttagactgtttttcaacatgtataagttatcctattggcagcatttatctccactgttatgtgagtcaaataatttgacctattgaaacatggaatattggtatatgatgataacataggatatttgagaaatacaagttatagctatccacccgcaaaaatggtaatgctacacaatgattgcaacgatgaagcttgatgtcgtttgtcacctaaagtatagtattatgtcattctcattgcacctttgcaaatagcatctagtttggagcagaaattcatgggggtgattaatcatggaactcttttgaggcatcttcaggcactttttggtattaatttgagtacattctgcttcaaacagaaaaaaaataagcacatctttgcagtgctttcaaccatccttgtgtcatatatgcaagctaagcgattgatcaaatgatttttagcaattttcagctgtggtcctaccctattagttgaagtgctattatttgcaacagagcattggaaactttttttgtcaatcataagtccatgtctattcagatggttgttgtaccaaatatttttctattccctaatcaccatctcaattaaatctgtaccatcctatttgtttccatgcatcttgtattcttcttcatcaagtgtacagtttcacatatatgtgatgtgtaaccctgccttccatagatgatcaattatattgcataatttaatcataacttgtttatatctctaattatcactgtgttgttcctctatactaccactaacagatatcccactttactttgtattctgtacatgcatggatgcaatacaccctttagagataataactagggtcaccttgttgtgctgttcaatatgttgaccactaaa

SEQ ID NO: 61930 - DNA, 1080 bp, Oryza sativa
tttacatgacaaattttcagaacccaaactgctgtcatgagttataacatcttcctatggacatcaaatttaaattactctggctacagcataagggcttatagattagagttttgtatgttcattcttacgtgcaagattaaatagtgaatacgggatatatggctgttaagtgttgtagcatatttatgttcgttcaaactccaggagaaaaatatagaaatgagtcaatgctagaccgaaccacgttagaaagtccacctcaagttcctgtttacgagcttcctccttcctagcctctgaccttgcatttctttgcacctcaaaaattaaagcagcaacagcaacctaaaaccaaaaagatgcaggtttcatttcctgatatttcaattattttctttattttttcacataacagagcaaggttacttcagcccagcaaatatattcctgtggctactataaatctattggcatacaaggttcattgtaggttaagtgaagtaccgaaaaaataaagccttctccaatgagatccgtagcagcttgtacagctttctcctcatttaaaggtgtgatttccacatctgttgcatgcccataaatgcgcctttgtatccttgtagtaacacgatggttaatctgtaacaattgttatagttacaatcggttagttatatgtcagacctcataagggcacaaaggatacggccacagcccacaacacgtaaatacatttgagagggctctatcttagaaaaagccagatgtacaaatttccaaaagcataaatcctaaggacaaggataaatctcctcaaggttcatgctccctgtattcctcaatccttatttctctaattaaaagaatatatgatgtgtattctaagtcagatatgtgaaatatgaagctccatatatggcagacagctcacatcatagacagaaacctatcatagatcagtgtccagccatttctgacaagccagaatcgaacaacctcaaatgggatgaaacgcttattgatgaatctatcagctgatgatcaagaccaactgacctacaattaaactacaaaatg

SEQ ID NO: 61931 - DNA, 7182 bp, Oryza sativa
ttaagataagatatgttggctcacattatggctgattattcttacagtgacacacttgttataactttgtcaatctcaagatatgccggcccagtctttcgaatgtgctcatatagatagatgtgcatgtatgcatttatagaggtgattgtgcatatgttgtgagcgtctgcgtttgtactatgtttctaaaaaaatattctaattgtttgaactaagttaaagaaatgaaagaactatcatttaccaagaaaataaaacaataacgggaaattattgaccttgtttcgtggttccaatgattttattgatttacttagttacttttgccggtttaagacatgaagggattttttcccacttttatgggataaatcgtttctgaaatgccatactaatagttattacctccgtcccaaactatactatatagataaaatctcttatatttgtgaacaagatagtatattttttaaaataaaataaaataaaataaatatgtgatatatcactcaaagtattccataacatttagggtctatttagatggttgatattttcagctctaccaaagtcggtaatgtaacaaattaactaaatatgtttcttccaatactacctaccaagatttagtaattctgaaaaatactatcaaattttggtaaagcttaactctactaaaatttgatacaccaaaatacgttaaaatttaacagtactaaatattggtatggttgatgtaggtaataattatttcgtcacttcctagatgggcatcagcccgttggtcatttggactaacgaaaatgcatgaacttaattatccttcaagaaattaagcacagaaaagtcagaacacagtataatctataatctagagtcatcgaaaaagaataactatatttgttcgggtagttttgttcttcttgtgtgataaggtgtttcaattggctttaggcatgcaccgttagctttcggcattaataacttgacaaaactaggcaataatgcatggatttctcgtaacatttaaccctatctcacctaggtaaaaaaaaaaggacatttttaccacatataccttctgttaacagcttctcaaattaaccatgctcaactacacatgctatgccctagccaattccatacattagctttttggctctttaacaaaagtgatagctagcaagtcagtgctagcttatgaacagttcaaagttgatactgactaactgtaagaagttccctcacgtatagccattttcttttgcaagtgtaaacagttacctctccgatcaagggtagatttagaaaatttgtgatactggtaagtgtcataatacactgctcatatatatttaattcatagtatcatcttctatatataaacatttgaaccatagctttcaccgaaaattgttgcggtcatctaacctacgcatatagtatccattatccaatatgtaagtatgtaactctaccaccacacttcatatttacacccttttgctattttttgacccaatacaatgtgcagtcatgtactaaggatcacttaatttttttgaaaattagatcaagcaaagctctttcatgctttccatgaacactagcccctgaagtctttaacaaaataattagtgaaaacatcttcatagaagatcctgtatcagcacaccttccattacaactaaaatgcactaagcatacagacaaataggcaattaagttaagcagcaagcactagcctatgtgtgtggatgtgcatcactaatcaaatgcaaatttctggaagggcgccaaaaccagtggcatcctcaactggataaccacctccccttgttggtaggttattgggcaccccattgctatgttgcaagctcccctttagcttaattcaaccttagaccatttgacatttggctaagcacagcaagacagctacttaaaaattgtttattattaggggcaaagatcatcctttatatatatggcactaaggctagaaataaaaatgcacatatgttaaaaacaggatcaagctagctgcattgaaaaggtaatttggtttgtgcaataatagagttgtaaagtgacatccccaattgcctttttttcttaagaacaaagtagtactagtagtaaacaaaggggagagatactctttgattaatggttcttgagaatatgcatagatctcttgccacctttttgcttgccagttaccattgcttctcttcttgctcaatgtcttcttccatgaacccatatagagcatttgcacaaaaaaaaaaaaacaactccgttgaatagttagtgcagccctatcaccatggctcaagttccatcaacttcaagtagcacgatcaagagcatggtttgtgaaaacaagaaatgaaattttagtaaattaaattgggtgctcttcttgagcccttttgtgagcttgcatgcatgcttcactccactgtagcttacttgcttacatagcttcaaaattagcactaactaatctcttcatggctacagaattagcatgcaaattaaggtttaaatccacccatgtatcgacgacgagcacagtgcttgcacgccaacgcccaagaaatccctagtttcctctctcccgacgccgccggcgtccttcaggccggcatggtggcgcaccgccgacaagacgtcgtaaggcacgttgccggcggcccccgtgagctcgctcattgcgccgccgaggttggcattgtgatggctcgcggcggcgaatagggctgcaccgtcgaacttgccgcactcgtcggccggtgaggcggtggcgccgccgggcttggtcggctcgaacggggacactaggggcatcgcggcggtggatgtcacggcgccgatctgcgcggccttctgcagcagagccgtcgcggacatgtcggtgggcgccgcgggcttcgcgtgctgctggttgctgaacacggacggcacgctctccgcctccttcgccgccgccgtggcgctcgtcagctcgctggcattcgacgacgagagcttgccgttcccgtacagccagctcagctgcgccgcgtcgaactgcggcggcggcgcgccggagctcggcgcgaagagatccacgtacagctgcggcggcactgtcgccgcgccaccgctggccaggacgccaatgtggcccatggacggcaacgcctcgccaccccacagcgacagcccgccgtgccgcgccacgccgccgtcgcacaggtccccaccgacgccccccgccgccggaccgagcatctgacccgccctgagctgccctccagccgccgccgccgccggcggcatcatcatgtttggccgcatgcccgccatccccggcccacccgacccggcgaacaggtagctctgcccgcacagcgacgtggccgtggccgccgccgccgccgcggcggccccggacgccgcgttcagcctcccgtctcctccgccagcgcgtcgcagaacgcgcggtgcgtgatgaagctgtccctcctgcatccaatatccaaccatgcatggatcgcgttaagctatcgccaccatcgtcgacgatcatatcaaagcctggagctaacaagccatataaaactaataaactatagtcccctcttctaatgaatgtatgctaaaattttagtgggggcttttatagttgtaacgccggtagtaggggctcgagatcctcccgtggccgtggccgtggccatggcggggcggcgggtgtacctggagaagagggtgccgcagtcgcagcgatactcgcgggtgccgcaggtcttggagtgggccttccagtcggactggacggcatagcgcttggagcacttgtcgcacttccacttcttctcgccgtgcttgcggcagaagtgcttcttgatcccggtgaggtcgccgagcgcgcgcgacgggttgtggtggacgcagctcttctccgggcacacgtacacccgcttcctcggctccttcccgctccgctgccgcagcttccacggcaggttgtgccctcgccggtgcagctgcaggttctggtctcgctggaaccccttcccgcatatctcgcacacgaacctgttcgtcgccatcagcgtcctcggcgacagcgcgatcacctccgcctccggatctgcacccaccgacatcgccgttgatcagtcgagtcaaacacagcaaaatggggaagattttgaggttaattgtgttgtgcacttgcctggtgtgccggggagattgcgcttcttcttggcgggaggaggaggaggaggagggtgttcttgctgatggttggtgagaggagcgaaagggttggagatggctgcggcttcactagtcgccattgttatcaaattgctaagcttgtcgttggcttgttgctaattaatcgatcgatctctcttgggatcaaactatgctagttgctgatcgatctcctcttctgcttgactagttccctttggagacaaaagggcaacttttgttcttaggtatgggtcattacccccaagcataaataagctttgctagctagtggcaacaacaaaaccatcaaggcaggataaatatagagctttgctagtgagagtgagatcgatggagagagattgtttgtgtgtgtatgtgtgagaataaaatatttgaagtggtaaaaaggtgaaagttgaaaggtgtgtctttaggtgtttgtgcaagcatagcaagggttagctagtgtagctagtgtgtgtgggtgtgcaatgcatcatgacacatatgatgaggagaaagatagggaaagggggaaggagggggtggtaaaaagctgtggcttggtgcctttgcatttggcatgattagcccataatgtgatgcttcctgcatctgcatatccccccttctcatcaaatctcagccttcctccctctcccactgcaaaggtaagctactgcagctgctgcctctggagcctgcactgcaacagtgcaatgcatgggctgctactttctttggcctggacccacatgcaggcacacaccttcttaagtttttgaaaactagcttgttagttgttaaatagtactccctccgtttttaaatatttgacgccgttgacttttttaaatatgtttgaccgttcgtcttattcaaaaaatttaagtaattattaattatttttctatcatttgattcattgttaactatacttatatgtatacatatagttttacatatttcataaaagtttttgaataagacgaacagtcaaacatgtgctaaaaagtcaacggtgtcaaatatttagaaacggagggagtactagattgattggatcaaaatcaagaaaagggatttgctacaattgtcaattgatgttgtttgagccgtcatctcaagcggggtcccttgataggattagaatcacttgatcctgacttgacctggatttgaggctgataaaaagggtgttatatagtggggatcatgtggtcgaatttgttatcgtcttattgatcgttttgactagctaattgctatggttaaaattattatgttcttgctgactagacggaagagatcgatggattagtaatttaatttctatgataggaggagagtgatctcagcttgcgtcaataccaaaaaaaaaatatctgatcgatcgttggcgtttctttttcattatctgcaccagtgtaaaaatgacataatagtgtaagatagatggagtattaaatgcatagggccgagcaaatcaatccatttctctcaaaatttagtatgttcaaataacacgattcatggtagacacattgtctaaaaaggagttatagacaacaaaagtgctgctttttttccttgattaagttctgccttttcaaaacggaagctttcatgtgaagaatcctgtcatcttagatttgttaatttggaaagaatatacatagcttcgcttaaaagttagtaccgttttgattttaaaggaactggcgagatcaatcaaaaatagacagaatggtgcatcaaaacataaattaacaacgaaatatgtttctttctcttttcttgcacgccaacttccttgagaattgaaggaaaacaatacaagaacggttggcccgagaactactagcacacaataccacagattcactatagcactcgtgtactccttccgatccgttccaaaataattctatgttgaaaaggaaccgtcaagattcgttgtactattctattttaatctaggttgatctattttgaaattgatggagtactcccatatatggagaatttgctacattttacagtcgatctgcttctctttttttttgagagagtctctgcttaattctgatcgtgaatcaacaggtagctagtgtgaacgaggtaattaataatttctccattagcccgctacagctagctataaactatactttttcctcccttaaaagttaccaatatatattttcactccatattacgcacgcataggctagctaactatgcatccgatgatccgaaggtcaaaccattagtatacgcagctagcctttctactcgccttggatgccattctacgtatgtagtagtagcaatgtagcatagcacacgagacgacggtgacacagtagtgtctagctaccactgcactgggagctaagctagcgcacgcacgagagacaaccccagcatcgtcatcccccacgcgcagaacgagacacctccgtggattaggggacaaattacaatgcaaatcctcttatatattctaccaatgcaaatttcattgctatagcaaactagtaaaattgattaattactctgtacgtgcgtgctaatttgattaatcatctaggagaacctacgccggcgacgtagccatgatcgagctgggcgcgcgtgcgacgacgacggtgaggtgagccccagctacacgtacgcgggcggcgcggcgggcacgtgcggtggcggggcgggcggcgcgggaagcgaagagggagagaggccacggccagggggaaggcgacggcggaagcgacagcggctggaatatttgtcgctggatggcgccagcctgcttgcgtctgctcgctcgttgtattggaagactagttaaaagagaggagatcgagatggtggtggtgagattattaacagagaggtcaaaggagctagctagca

SEQ ID NO: 61932 - DNA, 1282 bp, Oryza sativa
gtaacgtatatgccggcatgcaacacagcatgtatagtacgtacgttacgtacgcactatatattgccatgcatggatggacttctcatgtttgtcttttgcaaatgcaaatcctttctcaacccatctgtaaattaattaacaattagtcacccttttaaaaaagaaaaaacaacatgcatacatatgcatgccaagacgaacagcagtttaccattccatgactttctggagtatagatccagcgtacgtacgtcaagctgattttttgtacgtatgcaacaagtgcaaatgctcaaggacgattctcaaattcaaaccaacatgcgtccacaactacattacatgcataacaatacaggttaagctctgcgtcatttagaaatgattagtttggatcgatgctgctggagtgctggtcagtacagtgtggtcacacaaacattggcgtaattaataaaggattcagattacatcaacttgcatgaacatacatacctaacacgtactgtaacatgcaatgcctagtcagctgatgtgtctgatggtcacatgcttgtctcacttagaattagattcctctttagctccatggaagcagtgtatgtcagggataggagatggtgaccaactacactgtttaaaatctctgactagatgagtataaaactatggatgtctagctatctgcgaggagctggtaattaattaactatattagttggctacagggtttaattatctatgtagttatgataattaaccgcaaaatttgcagagttaagtacttgcattgtactgtcgtgtctcgcttgtcacacactgatggaagctttcacctggtctctcgtagaactagaacggcgtagctaggataactagtagagactagagagagggtgtgatttttacttttaccttccaaacattttaaatttgagttctgtacttgcttccaacattgcggtaattaaggagatagagtcatagagggatcattcattaatacgatcgaatcgatccttaattagtttagctggctatatttcatttgaggtttatcatttcaatttctgaatatacatcttaaaaagcgcctttaatttgaagcaaaagatggtaatttaaccaagccactcaaaaagtaatcccacacatatatgtcgtcgatgctaattaataagaagattcagtcatgcatgactcaaaaaaaaaacaaatgctaattaaatgcatgcatgggtagtgtcatgaacatgtcatgtcagtcagatcagtcagc

SEQ ID NO: 61933 - DNA, 3345 bp, Oryza sativa
atgcgcgtaaccacctctcctccccattcccttgcttccatccttacggagagcaagtttaattgtaaagtcaactgctagctataaacttatattagagctaacatgtgtaatagattagcaataaaattgtttctatttttcttcttacatatttactttagagcatgtgtagagctagctcttacatgagagctagcaatcatcatttttcaatttatctctctttcacataagtttatagttagcttatagctcactattaattaaacctgtgaggaatgaggagcctcgccaacaccccgtggttctcaaatgtacatgcaaaggcagagatatcttatgcctaccttctgcagcccgtcctcctccattagtccatccctttctactaataatcaatatatagtatataatataataagtagagataaatgtaatagtttttttaggaagataaatatattggttcacatgatcgtatgatttggagttttggacacgattgtgtggttccggcttagggtgggtaattcacgagtatgcaagttgtggcgctacaatccagccgtatgtatggtagttgtgtcgtcgtctactcaggggctcagggcccatgggctgcaacccgccgcttctcgcactgtgtggctgttcgcggccaaaaatagcaaggaacatgtgccaaactggcaacaagagtctttttgtcatgtccacatagggcctgtttagatccatttagaatgacaaataacaaataataaaagttttggttagcgttgtaaaagtactagtcggtgtttaaatgcatcttaaagttttaccattttagcactaaagaaagagaaagagagagggtgtggtcccgaagcactttttggcaaaatttgctactatggactaccaaatgccaaatgccaaatgctaaattgccaacttttgctactagtgtttagatctaaaatagcaaaaagtgctttaaaatggcaaaacttttgttattttggagggccctgtgtgtacagtggcgggggcatgggacgaccagtggcctggccccctttaataatttttatacataattatctaattacaatcaattagataatcaacttaagaaatagtgcattagctctcttcaatactgttagccccctcccattttaaatcctggcttcgtcgctactacttgcttgcgtgtgtgccgcccatcggtccatgtactaaagcaacggactcttaaattcaaacatgtacttctacacctcatttcctattatccaaacataccctgagtgacctaagaccctgcataacttgtgccaaatgaaagtaagtcagatgatggctagggatggcaacgggccaggtcaggcacgggtagagcaaaaccatgcctgacctggcaccgacaatgtcacggttacgggttagacataccctttacccttcgatatacgtcacatatcggtttggtatacctacacgcatacagatgtttcccgcgtactgtaaggaaatccttcacagagtctatggatgggaagaatcctactcggataagattgggtcgttaatgtatcgtacagggtctgacatctccgagttctacttggagacctctagatctgcaatataaaagggactacgatctcgccggatccgacaagttcccttgttctctttgtaacctgtgttttctaccatataatcccacatcaactggattagggctattacctatcaaggggcctgaatcagtataattcttgtcttttgtttgcttgatggcgtactacgtagatccttgtaccaacgtaccccaataccctctatatccggtctacgggtatcacccgttgacagtggcgcgccaggtagaggccttggtactcaaggttctactactatgtcatccagcttcgtcgacaacaacgtcagcaccagcctcagccaagtactccctgcttcaacaatgctggtatggactcaagtcggcgaaatcgtcttcccggtttacaccacgacgccgatctcaaccggtcctccaatgaccggagacgagaacgtagtggctacgaaccagggcgattccatgtcgaaaaatccccccgtcgagacggagaacggaatatcgacgacatccaagctcaagaaggattttgatacggccaaaccttgtccttccgacatgaaccacgagctgacaaagatgacttccgaagccacaaggtcttggtgtcttatccacaaaaccaagaaacacaccctgcaagattgctgggttttcctcaacgtccgtgctaaaattcgggcctgcaaagaacgtggaattcagcgtacttctccaactcgggatgtctattgtcctatttacaagacaaagaatcacgacctcttgagctgcaaagtctttctcggcgccatgaaagctcagtctcctaagtcatatatccccatcagggataacggcaaggaacaaggagcgactccaacttcagatcgattcattggggtaatcgatatcgaccctcacgaaccatcggtcttacatctccttgaggactatgggtcatcgacaacgagcgcgccgcgggaggtattggctatcgatgacgttggcacgtcagcgcacgccaacacagaagcggggaaccaatcgactactccagtccagcacatcagggccgttcaagcgatactgagggaaactccttacgatcccgttctgaaccttgaccttgagcgttggacagaacgactacgggaatcggtgactaacctcagcaacgcatttaaagaagctgctaccgcagcacaccaggagcagccaccaactggagaggccaatggtgtaacaccctgaaaattcgaccgacaaaaatctaaactctaaaaatatgggcattcaaaaactttttaaataaattgcatcatgccgattttctccgcttatttcattggaatttagtttcgaagtttatcaataacgaataaggaataattaactaggaataaaacctaaaattaaattggcaaaagaaataattaagatataatttaaaataaagatgaggtgaggatagaaatgaataaaatattatcgcgaccatatttgtatcaattaaatttaaatgcgattgaataggaatttactctaattaaattcaagtaaattatataaaaataaaatatcagtaaaataaatctagagtggatccattggttggaataacacaaatattgaataaaccatatttatgcaaaatttaggatttatagaatcaaatttaaataataaataggctaaaatcgggttaaataagaaaaaacactgttcct

SEQ ID NO: 61934 - DNA, 6563 bp, Oryza sativa
aagaaaagagagaaagagaaagaaaaagaaaagaaaagagagagagaaagaggggaaaatagaaaagaagaaaaggagaaaatagaagggaagttaggggagagattaggaggatataggaaataaaaatggtcggggttaatcatagattatttttggaaattcctagagtgtaatagtatttcgatcgaaattttgggttaattataggaatatgtttcttgatcggattagattaaaaattggtagtaatttagatgtaattaataactaaacaattagatgaattcttatagattattatagattatttttggtaatctctataagtcatcgattcacggtaggaattcggatttaatttttaggaattttagccgtgtattatatttaatcatttagtcatagactaaattaaatcgtacaatattataagataattttaggattttgtccgatatttagcttgcgatagaaatttctaacctattatatggatataatgcccgggtagattaaattaaaaacttatggtaacaaaatatttatacccgcaaaactagtttaggatgtataaatcgaaattgggtttgccctagttcgcgaatagtaaagttaatataaaagaatcaatttttgcattcgacttccatttggatttacttggatttttatttgaattctaaccgaatttaaatcaattttctcacgtaactataaagcccgagaagcccgagggagttgcggatccaagtgaaggccaagacccgcaagactttgagcaaggcaagtcatcactattccttgaacatgttgatcccatttacaaaattattttgtttacaaataaaattacatgcaatgatagacatcctacttgtgattatgccatgccttgattattgtttacccttaaatccttgtaaccgtgatttatgtataagtccctagtcaactatgacaaatgcttagaaatgctactctagatttatgcatactcatatttatcaaaagctatatgcttgggcaattacctttgggaagggaattgagatgcggcatgtggagacatgagcgccacattgccatgatgttgatgacatgatttgtgaaaggagaaataaaattaaataactgttttcgactggggcggacggaggatttgggtggtatccggaaaaggctagtaccgtccccggtcaattaaggaccgagccatgaagttaagcatgaaacgacgcccgtacaaccgcacttctcgtatgggtatagacctagcggaatatatagctgagcggaggcagtatccatgcatagtggtttcttgatgtgtgaggcaggggctctacggtggggcagccattggtagaaccgcgaggcgggtgtctacagtggtgtcgccatcggtaggactgccatgtgagaatttaaacataattataaattaattaatgcatgtgtgagtcttttcttcccgggtgcgccagaactcctctcactgctagaaaccgtgtacgcctagagtgcatgaggatgtgaagttcatggagcgggtactgccaatgcgaggttatcgaaaagctttgccatgacacgtctcatgtgttgggacgaggctcatgtgttgggcagtcgcggagtacgggtaaagtgtacatccactgcagtgtgagtaaatcaaaactattcgaatagccgtgctcgcggttattgagcaccgggacgtgtattacacttggctagactctaaattcttaatttgtgtgggatgggatattgcatgatgatttctttgctgatggagccacttcctgagagacgggaatgtggacgtcctcagaaaaccatgacgactcaatggcgggaagctatccttgggatcaccatggatggtggacagaaccgtcattgtttaatatgaacactggtactaaaatttgatcagtctgtgctaggtcttaggcttgtgaaaagaattacaaaacttgctttgcgcaaaagaaccatagccatcctttgaatacccttgtcatatgcattgttgctgtggtggcttgctgagtacggttggtactcacccttgcaatatacaaacttaatcaaaggtcggagatgaagcttcggaggatccctacgcttactaccaggagggtgatgaagacgatggcgctcagtaggtcttagttacagtcgttgcctatggcaatggcgtgccgctgccttgactccgctgccttacctacttctgtttttggaatgtattccggaccgcttggtccgatgatttaagactatgcctgcgggcttatgatgtaataattcgtattagacactcgtgtatgtgcacttggtatttcagctatgaattcatgtgtaccaaactacttgatccagggaaatggtacagtttacatgattgattcctgttataaaaacgggggtctacaaatggtgaggatctggaacggagggaatcacctcaacaagctacccctctacctcgcggcactggcgatcttcgagatcaaatcaacggccgccgggaagcacgacgcacacgagacaacgtgaatcgctctcggagtcatgtctcttcacggcgccatgataacggaaatcgaggagatcgctcaaacgaggaccgggaccacgacaaccaccacgatcacaacgatcgcgaacgacgggtgccagacaatactggtcatggtcgccgccgtatcgacgacgacgatggagatcggcgccgagacaacagcggaagacgacgacaggattcccgggatccaggccgtcatcctcgtaatcgtacaccggaaccaagcgacctatcgtcatcgtcatcatccgcgtcctcctcatcgtcagacagacatccacgaaggacacacgaccgccggcaacccactgcccccaacgctgggtgtagggctttcggtcgttccctacgtgatgtccgatggcctgagagattccgacccggagcaatagaaaaatatgatgggagcaccgacccaaaggagttccttcaagtctactccacagtactctatgctgccggagcagacgacaatgcgttagcaaactatttaccaaccgcgttgaagggttctacacgttcatggctgatgcatcttcctccctactcaatctcttcgtgggcagacctgtggcaacaattcatcgccaatttccaaggaacatacaagcgccacacgatcgaagacgacctacacgcgttgacacagaacttgggtgaatcattgagggaatacgttcgacgttttaacgagtgcagaaacacaattcctgaaatcaatgcttctgtaattcacgccttcaaatccggtgtcagagatcgctacactacccaggagttggcgacaagatgcatcacaaccactcggagattattcaagatcgttgagcgatgcgcccacgctgatgatgcgctaagacgcaagaacgataggccaaagaccgggggagagaagaaaccagccacggacacatctgagtcaagcaagaagaaaaatcgcaaaaacggaaaaggaaagctcaagcggaagtcctcgcagtagaatacgcgaaccctcccaaacgcccagacccacaaagcagcgacataaagaaatcatggtgctccatacacaagacggacagacattctctggaagattgccttgttttcaaaaagtcgctcgagaagcacatggcatttgaaaaaggcaagcgagtacgcgttgtcgagacgaacgaagagacggctcctcacgaaccggactcagcgtatccagactccgacctccacgtctcacacatcttcggcagttccacaacgtactcctccaagcgagaatacaagaaagtggaacgtgaaatctgtttgacgtggcagggggctgcacccaagatgaagtggtctgagcagaagatagagttctcggaagaagaccaccccaagaccgccgttatcccaggacgatatccgatcgtggtcgaacccgctattcggaacatcaaggtagcgcgagttctcattgacgatggcagcttaatcaatcttcttttcgccagcactttggacgcgaggggaattccgcaaaacgagttgacaccaactaatcaacccttccatggaattactccccaatcatcgtccagacctttgggcaagattacgttgcccgtgactttcggccaagccaacaacttccgaacagaacagatcacctttgatgttgctgaattcgatacagcttacaacgccatcattgggagaactgcacttgcgaagttcatggctgcatctcactacgcatatcaagtgcttaagatgccgggaccgaagggaacaatcactattcaggggaacgcaaagctagcagtggaatgcgacaagcggagcctcgacatggtcgagcaaacgcccagcccacacgccacgactgagccacccaagaaagtgaccaagacaaacaagacgccgaaaccagatggcgtcatcaagattgttccactctctagtgccaaccccgataagaccgtcaagatcggggcgacactaaatgagaaataggaactcacgctcatcaccttcctccgcgacaatgccgatgtgttcgcttggcagccatccgacatgccgggggtccctagggaggtgattgagcacaaactcatggtgcgacctgatgccaagccaataaagcaaagactgcggagatttgcaccagaccgaaaacaagccatacgagaagagctcgacaaacttctcaaagctggcttcatcagagaagtacttcatccagagtggctagccaatccagtcatggtacggaaggccaacggaaaatggagaatgtgtgtcgacttcaccgacctcaacaaggcgtgccccaaggatcactttccacttcctcgaatagaccaattggtggattcaacagccggttgcgaattattgagcttcctcgacgctgactctggctaccaccaaatcaggatggcaaaagaagacgaagagaagacaacattcatcacgccgatcggggtattctgctatgacaaaatgccattcggactgataacagatgggaatactttccagcgcacggtccacggcgcacttagcaaccagtttggcaacaatgtccaggcttacgtcgacgacatcgtggtcaaaaccaatacaggcgactcattgattgacgatctgcaagaaatgttcgacaacctccgacgatatcggctcatgctcaatcctgagaagtgcacgttcggagtaccgttgggcatgctgctcagattccttgtctctggcagagggatataagcccaccctgtgaagatcatggctatcgacaatatgaagtcgcttacgagactcatggacgtacaaaagctaaccggatgcatggcagcactaagcagattcgtcgctaggatgggagaacgaggactgcctttcttcgctctgttgaagaaacaagacaaatttgtatggacacgggaagccgaagaggcattcattgcactcaagcgctacctatcaaacccccctgtacttgttgctccccaaactaatgaagaattattcctctatattgccgccacgccacactccgttagcactgtcattgttgtcgagagagagaaagtacagcgaccagtttattacgtcagcgaagctctccacgacgcaaagacaagatacccacagatccaaaagctgctttacgcaatcatcatgacatcaaggaagctacgccactattttcaagcccacagagtcatagttgtctcctcttcccctctcggtgaagttgtgagaaacaaagacgttgtcggccgcattgcgagatgggtaatcgagctgagccagtttgatgtccactttgtgccacgaacagccatcaagtcccaggtactcgctgacttcgttgccaattggactatgccagataacaaatcagacaaccaaggcgacaatgaaacatggacaatggcgttcgatgaggcactcaacagccaaggaactagggcaggatttatcttgacgtctccctccgaagatcaattcaagcacgcaatccacctcaacttcagggcgaccaataacactgcagaatacgaaggactactcgccgggatacgagctgcaaccacacttggggccaagcgactaatcgtcaaaggggactctgaactagtcgcgaaccaggtacacaaagattataaatgctctaattccgagttatctaagtatctcacagaagtcaggaagctagagaaaaagttcgatgggatcgaggtccgacacgtctacagtaaggacaacatcgagccagacgacctagcacgacgtgcatccagacgaaaatcgctcgagcccggcacttttctcgatatcttgatgaagccatcggtgaaagaggttagcggcgaagtcagcccgaacacccccgacattagctcggaggtcaccgaggcagaacgcgccgttgccgacatcgaaaccacagacgactggcgcgtcccactaatcaaattcatcagcagcg

SEQ ID NO: 61935 - DNA, 1741 bp, Oryza sativa
ttccacagtaaacacacaaagctacctgcgcaagcgctccagactatccctctgacttggccattctcgtgctaggggctagatatacttggccattcccatgaggacagggcggctacagattcctattcgtggcgatcgataaattcaccaaatggatcgaagcagtacccacgggggaaatcaaggccgacaacgccatcaaattcatcaaagggatattttgcagatacggactaccacaccgcatcataactgataacggctcccagttcatcagcgctgatttccaggactactatatcgggctgggggtcaaagtatgcttcgcctcggtctctcaccctcaaagcaacggacaaatcgagagggcaaacggcatagtactacaagggatgaaaaccagcatctacgacatactcatgtcacacaacaaaaggtgggttgaagaactcccgtcagtactatgggccgtacgcaccacaccgacaacgtctaataaggaaacacccttcttcctcgtgtacggctctgaggccatgctcccaggcgagctacaacatcagagtacacgagtacagaagtactccgacgagaaccaggaggagcagcgagatatcgatgtaaatcttctcgaggagcatcgggaacgagttgccgtctgagcagccagctatcaacagaccctccgctgttatcacgagaagcgcatccgtgcacgcatactttcgatcggcgactatgtcctccgatgagttcaaagccaagcagggcgaaacaaactctcacctaaatgggaaggaacttacacgatcacacaagtcttgcggccaagcgcattcaaaatcgcagacggcgacggtcgtgaattagcaaattcttggaacattgaccaactacgtaaattctatgtatgagtcaatatcatccatacatgtaagcacccttacagtatcaataaaggctatttctaggcccatatcacaatcaacgtgtttcgcccgatgatcccccactctgatgacacctagcgttgaaacctgtccttatgtccctttacgccgtctcgacaaggcctccgaggaacctaagggatctttggctggggacgcccaaagccgataaggccttgtcagatcctgtagagacgaaagaccatgtaagatcttgtcgtgtaagagttctcgccgtgcgtattaaccaagccgtgaaatcggaaatcaactttccaacttcacggctgggggctaggatcagagcttattcaaccaaggcaggtcaaaggtccaagagccttatcctccgagaaaattcctccgacgacaaggctgggggctagggagagtgtacgactcaaacggctgactaaagtcgttaactgagaacgcactcttacacatgacatccagagtaagaggcatttgtcaaagatagatttctttattcacaaaatactccttacagttttttcacaaatcttttgctacattacatctttttcctaagatatttgtcacaaggtacgagtactaccaagagggccaacgccagtccatagactggaagatcttttcggccaacggcgacattgaccttgccagatggtctatctccgccgaagtcctccgagaacgagcaaaacactcacgaaggtgttcgagctccaggtgcgggcgataatctattaggcaagccaacacatgccccccggcataccagctcgatcgacgacgctcctgct

SEQ ID NO: 61936 - DNA, 2732 bp, Oryza sativa
atcctcgtcatcagtatctctacaagaggacaaaagttcccgaggtcagcatactaaagtaagccgggatagtaatcgcatgcacaaagacggtcagagttcgagttttacacattatctaggaaatacaagaagtcctactcttcaaaaagggggagaacagactctcccagatcaccgatttcttccatcacctccttacgcgtgtcgctggccgccccctggtccaagatctcgcgcagatcaagttcaggacgcgacagccttacacacgcgaggacatgacacgccccggtgtagattccgtttgacgtctcctccgcaatcctagctgcatgcttggaggggatttcccccattgccgtcgccagttccgcgagagaggaggtcagcgaaaactcatcgggattcgccgggatcgtggacgtgacgccgcataccccggcgagctggtgaaggccggtgtaggtgaccctcaacgagccccggatctcagataggttgttcccgagttctgacattcggtcctcgagccccttccgttgtcgctcgttgccggtcgccaactccctcatcttcgtgaggtcttcacgggctttagccaactcgcgcacaagtctgtcagcgcgttcgccgtcgccgcttccgacctcgcctccgcaatctcgcagccaatgccgcgagcaccggcttcgaggaggcgccccatctcgacttggagctcctcccaggtgaggactgcagctggcagatcacgacctgccgcggggtcgctgactgggccactaggcgtcgcctcccagctcccggctgcgggcatgacatccgtcgaggccacaaggggcgacgcactagaagctcttccggacttggctcgcgcagcctttgctcgcgcctccctacgggacgaccacgagtcagacaataagcgaataagaagcgcggggattcaagaattcatctacttacttctcgccaatcgtcacaatgcgttgtcgtcgtggaggtgggggagatgcatccgaggcctggaatacaatcaacgcaaagtaaggaaaaatccttcttgctgcatgatttaacgacaaaataaattaccgagggggtcgacaccatgcgacgttgtccgcttacagacgagaatttcctcggctttatcggaacattgccaccactagtggtggcagcatcagatacctccttgacggccttcactttcaaagatgacgccacctgatggtccgcgagcggtccgatgatatcagtcaaaggaagggcctacgctcaatcaagtcataaagtgatttcgaaaggagaatgcgggatgttcaccaaatatacttacgttgatggcttcatcacgttccgctgcccccttttcacaaaggggcacagggatgtcactcgccgtagtcgggccgctgatcatcacttggccgacgcggcgctccacgttttcgccgctcagacctgttaatcgagaaccaaccttcgataagtcaagaggaatgcggacacaagtatgtcaagatgaatgcgagaaagataccccgaggagaaacccgggtcgcgtcctctggcccggaatagttataagctggatgggcccgagcctgaagcggctagatccgcctaccaacgaagtctgcaacgacttcatatcccgacaaaccctgtactcagagatcgtcgatgatgtcgagaaacgactgaagagagggggtcaaggggggcttggcggtccaagacggaatcttgtccggttgatcttcgggaaccacgaagacagggttcgagtccttgatctcaagataaaaccacctattcctccacttgctgcgagaagaagggcactggaagggaatgtaacgcaacttcaggccatcccgaagtcggaacccaacgcaaccagataccctgttggattccatccaacgcagttcgtagtaaaagcaaaaaagatcaaggaaaggctctaccccgatgtaggcctcgcaaagatgcacaaagatgctaaggaaggcgatggaattggggttcaaatggagaagagaaagaccatagaaattcaaaaccaggagaagaaattcagaaggaggagggagaaaaccgcagagaacataatcttcgatcgcaaccatgcgacccaagatgggctgaggattagtacctcctacttccctctccatggttccacagccaggaagagcgccatcctcctatagtttctttaacgttgcactggtggaagccgatttgccgaggtccattgctgatcgaaggtcgccggaaaacgagcctagattgatgaactagggtttcttgcggcggcggagaaggcaaagagtgcttgcagtggggtgtgtttaacaggtttggcggacttcaaaatggactcccaaaattcctttaaataggcgcactaccgacggtgcgaattccagggaatagagagagatgcccgccggaaatttctggtcccattacacgcggcggttttttggacttcagtttaaaattcgttcgtgaccgttgggcttcaaatggcgtgctcgactacggtctatctccgcggtcctcgcaccgggaatgacaacagtctcgacacccgaagtcgcaaatggttgcacgagttcattttaagcagaagttgggggctactgtcagggttacaggttaggcataccctttacccttcgatatacgtcacatatcggtatggtatacctaca

SEQ ID NO: 61937 - DNA, 1155 bp, Oryza sativa
gtcattgactccgctggtaccgccgcttgctcccgccacttgctcgtgctaccactgccctgagagccgccattgttcccacttgctcgtgcattgccttcagccgccatcgtcgttgcttgcccccgcgctaccttgagccaccgccatcgtcgcttgccggcgctgcctccacatgttcctttgctaaatgtgctgtcgtcgccactgcgttgaagtgaggtgggatgaaaattaggttatggtttgatgttgttggctaatgggccaagagagagatgagaatgaagatatgggccaaaatcaataatacatatatcgggtcgggtatgggttatccgcgagtaaaaaggtaagatccggctgctgcccactacattatcgggtctcgggcgtgcatgcctaagggtaaaatattgcacccatgcctgtgcccatctggtcgggtaaccgcggatacctgaacccgtgagcaaaattgacatccctaattttattctctagctgcttttcctagctttcgtattcatgtgaccatgcggggtctcagtcagccaaaaaaatccaccgtgaaaaacagtcctgggggtgtaaaataaattaggtacatcatgtacggaaactgctatttcgcggctagtcgcgcgcgccctccccagcgtgactggacacagcgcgcacggggaggagggtggcagacagccgctcttttccttttttttttccttttcccgtttctattgtttcttcccctcttttccgtttctttttcgctttttcggttgtttttttcctttctttcgtttctttttcttttttcggctgttatacaaactatgtatacacatatactaagtctgtatgtatgcgtgtacaaactttatatacacatatattttttcgttttttaaacatacatatataaaatatacaaagtttgtatagtttgtatacatatatatatatatatatatatatatatatatatatatatatatatattgtacatcaagagcatatgcgaatgcatataaaaaatgatatagattatatataccatatttacacatatactttatcgtccatatacgtgtgtgtatatatatgtatatatatatatatatatgaacatgtatagatatgtatatgtatata

SEQ ID NO: 61938 - DNA, 826 bp, Oryza sativa
ggatatgttcatgcatattattgcttgagcttttagctggtacctagaccttaattagaacttgagcaccatattattgctagagcttttctggcaacgctgctactatcatgaaactcatctctgaagctgatgaacgtacaagaactcaagaaggtgtgttatattctaatttgacccactcctggccatttgctgccagcatcacctgcagttgcaaaacacaacgcagacgaagccaatacatccacccgtacaaaccctgaaccgtcaacaaaagaaagagagaagctctttcagcttacctcgcggcgtcgctgatcttgtccctgtagtcaccctgacctctcacagctgcgccggacctcggcacggcggcggcgttcgccgccggcgggcagacagacacggcgcggtatccggtcgtcctgcgcgtgcgcgacgaagccggtcacggtctgcgtcgccggagcttgcacgtgatgaggcggcggccgcacggacgacatggctccattgccgttggcaccgcggacgccggcggcggcggcgacgaagccgcccggcacgacggtggcgttgtgcggcacaacattgccaggcctggcggcggtggcgccgttgtacgccgagaccagcagcagctggtgctgcagcgtcgtcggcgacgaggcgtgcctgacgccggcggcgccggcgcagcacgcgcactggtcggcctggcggcggagcgcggcgttctcggcgcgcagggcggcgttgtcgcggcggaggcaggagacctcgcggtagcacccctcggaggggtcgcgctcccgccaccgcg

SEQ ID NO: 61939 - DNA, 7710 bp, Oryza sativa
aaggccaggcgtgaaatagtacaacaccaaagcagccgcgcgcactcaaccgcgacagcgcctcgcctgccctctgcctaccgcgaggcgcgactcatacctcgctcgtctcacctcaccgccaaattccacaccaaaccgaacgatcaaaaggcgaggcgaacaccaccaccaccaccaccacctcaccacgacaccactccccatgtctaatccactccgctaatcaccaccaccccccgcaccaaataagtacacccaaccccaactacgccacaaaagaaaagcttacctctctctctctctctctctctctctctcttctcctttccctctcctcctcttcccaccaccaccaccgccgccgccgcctgattggtggtaatcggaggtggaggtgggcgtgatgatctctacaggcagcggctcgtcgtcggcggcgtcgtcttctgcgtcgtcgtcgggggtgagggtggcgggcatggcgaaggtgcgggggaaggcgggtgcgggtgcgggcgccgcggcggcggcggcgacgaggaccaagtggaggagcggcgcgcaggagaggatctacgggcggcgcctgctcgacgcgctgcgggccacgcgggacggggctgcaggcgggggcgggggcgcgccgccgcagccgcgggcggtgaaggccgcggcggactcggcgctggcgctcaccgcgcgggggcagtcgaggtggagccgcgccatcctgctggccggcgcggcgtcgtccaggcgccgcgtgctcgtcaaggccggcgggaagatccgccgcggcggcggtggcaacagctgccgccgcccgcaggcgcgcgccgcggcggcggcggcggctaaggcggccgcggccgcctcctccgccggcgagcccccgatgctgaaggagaggaaggtgaaggagcgcctccgcgtgctgggccgcctcgtccccggatgccggaagctccccgcgccggcgctgctcgaggagacggccgactacgtggccgcgctggagatgcaggtcaaggccatgcgcgccctcgccgacgcgctcgccgccgcgcagctctcctcgtcaactccgcagcaggcggaggccgccgccgacgagaccgagatggagaggtgagggtttcgtggtcaatcgtgagttcatcacacgatcgatgatgctggattcgattcgatggctcggaaattggaacggctcggggaaaaaataagggcgattaattagtggattattattgcgagagggtttgggatttgaggagggtaattgcgatgattgatgctgctgataatgctgctgctgctgctgctgctgatgatgatgatgatgacgatgatgatttgtaaattcttgatacttgtataagtaatgctgctctgctcctctcttgtttttttctccttgattcttgaaatgtttttctcctcctgatttccaaatcatgttggggattcctgatttcctgtttcatcttgattagtagtattatgctgtgattggggattagtgtgttttgccctgtgttaatcagggattatatgttctctctttttttttttttgcttgcgaagaattggagagaaaaaaatgtgaattctctcaaaataggtattatctcccaatctcccatactatccacttgtcaggacgatttcttcgtaagataaggtacaaaaacatgcaaattgattgacagaatctgaaaaagaaatgcctatgtagctatagcaccagcaattcgagactcgattaaataccaaatcgatgtatgaacagttcgtactttgcttatcgcaaatctggatgaccaagaacaaagaagcaatccatgatagccaatttggtcattgcggggaaagaatcgcacagtgctaaccacactgcagctactgcactttcgcaaaatggatttactgttattaaatttctaacgattttgctagatatttgtcatcaaatttctccccctaatatttgtcagatgtaattacagtacaatcgtagtgtaattatactgtaacttgcatgtaattacactgtaactataatgtaacttgtatgtaactttcaagaatctctcggtaacatgttatttcagtaaaatagaggtcgtgggaacaaattctttcatatatgtgtgtgatgtgatttttttcttcctccatagaacaaatcttgtaatagatctaacgattcaaaattacgtgaaacttacatacaagttacactgtagttacatgcaagttacagtgtaattacatacaagttacattgtaattacactacgattgtactataattacatctgtcaaatttttagtagaaaatttgtcgacaaatgtataggtggtcccaatttctaatgccgtcaagacacggcaatagtgtgcggattgaactaataattgggtaattaaacaagaacgcgtaaggcgaaagcttcctctgattcctctctggtctcccctgagtcctgacccttctgctaccggatcagattcagaccgccctgacactcgttggattaccagaaagttgccgcatttgctgacaagaagatctctgaaatgccttttttgctggtaaaaatgttctctgcacgagcgatcgacagcacggtgatgtgcaccctgcatctccttatcatcgtcgacttttcatttttgttcttcaggttatagcatcctgcatcctgcatcctgctcttttcgatttgaagaatgggaaatggggcttgtcttgagcttttgttgcttgttcatctaaacaaacttcccgtcaaaatcacatcatcttagcagacttgtggttgaactaaagaaaatatgatttggtatgcacgtgaaaatcctgaaaaaaaaggtaggactagttgcttggataggaaattacaatcggttaaaaaaaagaaaataagattgacaaacattactctgggtttgctaattagcgcacgtgtattatcagtgcacatttattttcctttccaatagcactttcatacgaaactttcttctcaaatcatttttaaggcctcaaaacttttatcttggattacaaaattttcaacttaaaatttgaaaacttttattaaaaagtgcatgtgcaaacgcacctgcacaaaatagcaatttcggcattactctcaacctgaacagtacaaatatacaatgatcatcccatttaccagaaggaaaggaaaaagattgtactgtctcgtcactagatagttataaatgagtgggtatcttaatgattctgtgatcactgtttcatatatataagtttttttgttaaattaggagtaaaaaatgtgaccattcattgttccattccttaaaaatgagattgcttaggacacttaaatttgtgtaatttgcttgtaaacattaaaaaagtatcatagctaaaaagacaccttacaaattaccaatttgctggaagatactttcggctcaattaaagtaaaaaaattcttcagacgataatacccattgagccataggcttcttacatggtattggagtgaaaacttagaaattatacaagtctaaagtatcctaagtacattgctagcatatatcatattccaactttactctagcctcatgtttgaaacttttggctcttagagcattcttatctttttaaaaaaattcttcaattgagtctcaagtgtcatatagcaaaatttgtaaaaaaaaaaaaaccctaaacactaccagtgctcttgcaacgcggcaattcttaccgaagaggaaaaaataaaagaaaaagagtaatttttactttgggccactttttattaccggtgtttcgctttggaccacccttcaacaaatgttttcaaattggaccggttaagtttaccattgtatcactttggactaccctcaactctcttattcatctacatccaatttttcatatgttaaagaaacggtctaaatacagctaaagaggtttattgacaaataggatctggcatactcgaggtcgttcatatacttgagaagagaatcggggtggtccaaagtgaaacaaatgtaagattacccagtctaatgtgaaaatgttagttgaaaggtgacccaaagtgaaataccggtaataaaaggtgacccaaagtgaaatttcctcaaagaaaaataaccatttctaattgaacggtcaattcttacccattcatggttcgattaaccatgaatcggttaaccgaacggtccaaaacactgagccaactgccaaccaaggcaaaacgggccagtcaacggacacgtcacccggtcagcgccatcgagctcacgccgcgtgtctcctctcctcctcatgccgaggagacgacgagcacgagatctctctctctctctctctctctagcttccacctcctgatccacccgaaccctagaatccactgcgacgagcagctgaggaagaggaggaggaggaggaggcgttctcctgggaggggaccccgtcccgcccgtttccgccatggcggcggcggcggcttcgtcctcctcctcgccgtgggcggggcggatggcggcggcgttcggggcgccgttcctgtggctcgtctgcctgatctacttcatccaggttccgcttccccctccccctctccgcgcccaccatttcctgcgacgcgattgatccccgattcttttggaacgctctccgttcgttcgatcgttcgttagataagagttacgcggcttcctgggaggagtgacgacagctgtccgaaaacctcgcgtttggatccatcagcaaacgcggagcggaggcgagatgccagacgagtttgagatcgacatgtggtagtgtggtacatccgtgtgcaagaggccgaactggtcgctgtctgtatagagatcgaggagtgcttataggaatttgggttcggatgattacatggtccttttgcttccttcgcttttgtaaggcaatcttggattgtttttgccaggtcaaatcgtgctctctgtgtaggatgatattatggattgcttcttgtgtcttgggtttgcctaaataagtaattatgtcattcattttaagaattggaggtctgatggctgcatgaacacatttttcttttaaatatgaaatcgaaggtagttcatttgtgatccgttgtaaggattggaactcatttagggcattaggagggtagagttatttctatgatagatgactcaatatgtttcatactagatttaactggttggttggtgtgcagacttaggtagtgaaagtttctctaaaaagagcttaatgttgatggagaatctcagatttgtgaaactatggaatgctatacgagttcagcttcggactgtaatgtctgaaaacagcctagtgtgataatttcacaattatagcaaggattggtggtatgtcatatgtcttagcatgacatgcaatgggatggggaccaaatttgtttatttgtgttgtgagctcatgtgccatgctttggtgatatgtcaaatgttagcatgttcaattagttgtaaattccttgtctcaatcagactcttcaagataaactgtattttgtagtagagctaactaaatataaagaaggcagttttggtttaccgaagcttattttcgccattagttgaaagcttaacaaagcactacaccttttactttgatagattttaatatttattctgcaattctttagggtttcaggtcttttgtctggacagctgtctcgtaccaaatgaaggacatgatgaaactgtcaccatcaacatcacagtttttggtctcagttgcatatttcccttggagtataaagcctgtatatgggtaatgttacttctgtttgcttctgctgtgaactgaaatttaatcatgttccctacaacctaattatgttttttttgctacagagtagtttttgtaatgtactgtttcaaacatcatgtgccttacacagttacaccttagtttcagaaatcttacatgtaattatacttcttacaacaacagagtttccctgacatgtttactgtggcttatctctattgcaagtgattaaagtgtagttgcttacaaacagatgggtgctcaatatttcctgagcaagcaacaattattacttactgccttcggacaatttgtcaattatgacaattataaatattcttttgtagcataagagctaaacaatttgtcaattttatatttactgccttcacacagattaacacgattaattctaaaggatgtttctgaatagggtatatatcaactaattttggaaattattttactttagtggaaaatggattaatatgtgcactgcatttgagacccgacagtaaatgtgaaaaggcaaaaggaagtgctgcaagcactccaacatcgatgggtatttttttctgttggatcgcttagttttcctcatgcatttatacccactcaaatgtttgctgcatacttgctgtggagctgtgcattatggcattatgtaacagatagtcctgtgtaacattaaaatcacaggtcttagaaatttcttctatgttgaattgcacggcttgtcggcttctgagcactggctgcccattactgtaaaacatctatatgcgtttgtgtataactataatgagtttcagattgtactgtacaaaatccagatactcgttacttccggatgagtctcctctgactacgtcagagggactttgtcactgacatgtgggacccacaaaggttgggcccacacatcagtgacccacgtccctctaactttacgtcagaggagcgcgatccgttacttacacatgcatctttgtgcctgcaggattttgtcagactgtattcccatcaagcagaggaagcgtacgccctatttgatcatttctagctgtctatctctatttccgtggctaatccttgggatgtcagaacctttgaggagctcaagcaattttcttactgctttgctgatagtacagaacttgggatctgccatggcagatgttgttatagatgcaatgattgcagaagcagttcgatcagctgggtgagtatcttagtgtaatattttcactggttagcaactactatatgattacagattatctgaactcaaaacttgactatatttttccaggccagaatttgctggtgatctccagtcactatcttggtcatcaatggcagtaggggggatttttgggagcttattggggggatatgcactgtccaatctccctatacatgttatatatattattttctcggcgcttccattgtttcaactaatttcctgcatatttgttgaggaatctccaaaaggatttgagagtagaatggataatgctgcacctaaacatgtcgaggatcaaactattgatgcttctcccggaaaaagctctagtgaatcatataaatatgaagatactagaaggcgaaaaggagctaggagaaataataaaaggaaatcattgtccaaacgacctgaggaccatgacaagaacaagtcaactaacttaaggccatacttgtctctgaaatcagcattcttcagtttatgcacagcattcaaacaaccaactattttacggtaactaatcatgttatgatttcatttcctcttatgtttacccctgtcactgaagagactaattgatatcttctttttacctgccagacctatggcgt

SEQ ID NO: 61940 - DNA, 1482 bp, Oryza sativa
aggaagaggagcaatgtatatactttgggaaatgaaaactaacaaagaggtttggaaaaaagagaagccttgtcactatgagtatgtttgcttccttggattgaccttgggcaatggtcagtgtatagtttcaccgtcacaagggctggtggctagctaggctgctagtactagctaattgttgtttcttaattgaactatataggcaaattaatcaatctgatttggcaggaaactatatcgatcttgctagcagctattatattgaatgcattattgttgtatatattcaattattgttatatatagtatatagtatcatgttagttttcctttttttttacggggaatcatgttagttttcctgatgtatgcatatttacgtactgaaaatcaagacattatatatgtcatttgtatgctgagatgggtttaattggccgatcagatgaatcaaacaagcgtgtataaaaaaaaaatccctaattagctatagcattctcagatcgatagtatataatcaaaataacatatccttgatcgatcagttcatcacctaagcataaatttcttaattagtttttgtagagacattaattaattagagtgaagagctaggcgactttctcaaaatgaagagcagaacgtgcgggtgtgcaagctaggctagctgtagctaaaaactctactttggaaaagaaaattaaagtgcacagacatataggatagctagctaggctcctttttttcccccttttttctctcgtgtacatgctgcctcgctttcgttctttctgagtggagtaggggaggcgttgcgaatgcagaagccacgtatgccaaaaaataaaagggagaaaattaaccaaagctggcgacgtcgatcgaccgcttgtaattaattttaaacggatatagaaaccagaattaaggcttcgcatataaatgggttgggattttcggtggcacgtaaaataagccattaacacataaataattatgtaattattataaacttaaaaattgattatttatttgtttatgaaatttctgttaaaaacacttttgcataaaactcactgtttagcaatttaggaagtatgctcaccaagaacaaggaagtagtcgtttcgaagtagttaagtagaactcacccttaagagcaagtttaatagctaactactagctacaaatctacattagagttaacatgtataataggttagctccattttttccctccttttttctctcaatcaaaaaaaagtttttagacatgctatggatagaacggaatgcgaaagagatggggacacagattacccgatgatggttgcaggggagacctcattttccacggccgacaaaaggagaagtggaggaagggagcaagggtggtctctcactcgacttggctgacaataaggtgaatggtgagattaggcagtgctatggagccatggagggagtggtgggaggaca

SEQ ID NO: 61941 - DNA, 1328 bp, Oryza sativa
tttataccccttaattggtggacttgacccccctaaactttttttgcaaggaaactgcccatggcttcaccgcctccttcatctaatccttatgagcataccttgcaccctcaattacctcattctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccttgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttttctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatacaattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctctcctctctctctctttcgttttttttggatttttagtgaatataatgaaatttcagagaggggagactgggctttatagggggaggcaaaaatcgccctcccccagggcggcaagggggcccgctgcaaaattccatgccccctcgccgcccatttgcaggcggccccccgcacagtacaaaattcgccctatc

SEQ ID NO: 61942 - DNA, 10757 bp, Oryza sativa
aggtcctactccgacggtaggcgcgcgaggccgtggttgtaccagaccagctggaggtacgacgtccacggcgctgcgtaaactcaaacacgaagtccgggtaatctcgtctcacctgacgtgagcgtaacgacgttggaataaacatgatcggaattagacatgttatgtgatgataaaaaaagaagacgactgataaacttataacgcagcaaagttccactaaccccacgtcgacaccagtaagtccccattgtgggaccgtcctctagccacttcgcgctgcgaccaaccccgtagggtgcgctgtccaccactggtcgacctatggcaaacctcttggctacccaaagctgaagcaacataggacaaccagcgaagatcgctcccgcgtcggtcttcgtgcatgcctcacagagggcacggtacgtggctgttagcacggcagaaccccagctccactgcggcacgtcctgtggctgagcatccgcgatggaccgtgcgtagtggaccagccagcagtccatagcgtgcccgtgggtgctagtgaacatcacccacccgaacaaccacagcaggtacgtctcaagggagcgtcggaccgagtaatcatcagcgtcagggtggagatggtccgcctacaattaataatgaaatgttactacaaaacaatttgttgatcacaaactaagcatgtatgataataacaagttatttacttatagtgaactgaagcaaccaagccttgctaggcccgatggtagagtacgggggaagggtgttgggcggtcctaggtgtggaaggcgcatcacgtgctcgaagcacgcggtgatatcctccttccagccaaaaacaccgtccatgggaccaactggggctcttgccagtggtagcccgagcaggtacgacacgtcctgcagtgtcggagccatctctccacagggaaggtggaacgtgtgcatctcaggtctccagcggtctaccagagcggcaaggagtgaccggtctgcatcccactgcttcgatgggtcacggtcgtccgccgccgcctcaacaagcctacaaagtggtagaaggcctgccgcacgcaacctgcatagagcaaactttaaacataagtacaagacaaagcacagttgagttgaaatgtgcttacgtaaaattgaacatacgcgtactaaggaacgtgacgggggtcgacacgcaaccactcgcgtgacgtgcgtggacggaaagtgccgagctgtgcaccctagactactgacaggaacgagcggtggttcctgtcaatcccacggttgaacagcgccggtgtgtcgtacaacatacctgtatccaatagattgatcagaaacataaaaataattagttcaacataactaacaaatgttcataagtgaattactaacacatattaaacaagagtaaaaacaaacaaaagggtcacaatacagaatatttctgattacaacaatagctgcagttacacgatatgagtacttagtccgaacactcatcacgataacattatgatacaacaccgaatagttcgcaatactactagtacaacaatagtcggaggtactcattacaacaacattcaattgaaattacacgatagaagtatttagtccgaacacacatcacatcacaacagcgttttatttcctaaatcgatagcattgttacaccatggaattgcctgctgcacgacgacgcttggccttgcgcgcctgcttgttgttccttcaccatgtggtcgccttccatcacatgcctgtccagatggaccagcatctgcgccacttggaacttctgcattcttcgggcatttcttgtaagtatggccgcgcagatcacacttgctgcagcataaagtcctcccacctgcttctgactcatccatatcatttctgatgcgtctagtttggcgtcgaccctttttcacccttaacttagatggatctggaatataaaaaactttggcacttagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgacgaagcttcggcttcatacaactgcaggtacatccaccatccgccttcaagacacattcctgcacggcttgcttgcgatagataccacgcctgctcctatcaacacacattatttcatacttatgcacttgtgtgccttgagcaacaactctatgtctccgtgcctttttgattttatcttccatgtactttgtcactacgttgccaaacactatgttgttatcggccatggacggaccaattttcttgtgtcgatccctaaagtaggcttgcgtgccgtgaaggatgaattcaacaatagcaaccaatggaagtacccgaactcctcgcattacccagttgtacacccccgccaaattggttgtcattatgccataccgagatccatcagtgtcgaacaatagagaccacttctccttaggatcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaagccacttagctggaagtcccttctcatcccaaccgttctgcaagtagtcaatagcccgcaacatacccgcatgacgatcatgtataaggcaaacgttgggcctcatacgcatcactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttctatctatgcatagaacagatcgacaatgcacaaaagcattgatgcaggcacccaatgagaaaaaggctcttgcagcacactctttgttcgatcatcagccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttatgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcattctccttatactcccagggtacatgatcaccctctgatataacaagtccagagaagtcctcatttgcccaatcagtggccattacatcaccttcctcatcggatgatgcgtcgtcgtccgcttgctcattatctgaatcttccctctccatttcatcaacaattataccgactatctccccctcatccgccatgcccatggcctgctcctcccttgtttgattttcctcattttgcatcgatggtccaacaacatcccctgcattgctagaaccctccacatcttcggtttgcattgaaacatttgtatctttctcttgtaccgacacaaatataacgaggggccatgaccattcaaaagccatttccacataccgtctccaagcagcagtgctgtccatcggcattagttcccaaaaataaccttctgttgcacgactcactacaatagagatactgacattgtgtagacttcttggtctattctaaatcctctcaacaaccaactataaattgactgaaatgttctctccgcaggcctatcgatgcccttagatgtcattacaaaatccgacagatcagcaccatctggaccaaatctaagatttccttcaccgtgaactatatgaaatgtgaccttatttgatattgtgcctgatgaaaacaataactacgttaacctcgcatttctgtactacgcactaagttacattctctacaatattgttctccaaaattctaaaagtaggttacgttttccagatcaaactaaagtacatcttacaattaacactactgtctatgtctcaattcatactattatattctgtgctctagatctacacatatgtgctgtgtgctacagatatgctaaaatatatggaactaaaactaaaacgcaacatatagtactcaaacataatatattagtacaaatgcaaaagaagtatgggagcaaacctgtgatgaagtgagcaaaccagtagggcttcgccgctccccttctgctgccatcccctctctctctttcctttttttttggatttttacagattataatgaaattttagagaggggggacggggttatataggagagaggcaaaaatcgccctcccccagggcggcaagggggccgcctgcaaaattccaggccccctcgccgcccatttgcaggtggccccccgcacagtgtaaaatcgccctcccccagggcagcaagggggccgcctgcaaaattccatgccccctcgccgcccatttgcaggcggccccccgcacagtacaaaatcgccctagcggagggcggcaagggggccgcctgcaaatttcgttgacggccgtcgcccgaaagcgaacggccgtctgccacgtcattttcgccgccctctgggatggcgatttttaaaaatcgccctcccagagagcggtaggcgactacttccgtcaattttcaaaatggaaaattatttttgtaaaacttttaataaaaaaaattaaaaataaaaaaaattccagttgctggtaggtttgatgcggagtggaaaaatggaacgacaggattggaattttttttcattcgccagctactcacaatgctctttgcaggcagaattggtggcggtccagttagctaaggaggcggccaaatttttgaattttgccatttgcagggattattttcctccctgacagcggggcgaatcactacttaaaaaactatttttccatgcggtcaaattgatttttccatacggaggtttcccccgtctagagccatgcatctggaaaaataaatattttcgcgtgcggacgacccacccgcacgggataattatttttctgtgcggtcgggttaagtggaccgcacgggataatcgattatcacgtgcagtcaaataatgccgcccgcacggaaccaaaaataccaaaaataaaaaaaaaatcgaaaatcgccgcccacccgcatccggccgtcgccaccgcaagctcatcggcgacggatccgcttctactacgcccacgtcaacggatccgtctcccccgagcccgtcaacgttgtcgcgagctcgccgaggtcagccatacgtcgaggtcgtcgtcatcgaggcgggcctcccgaggcagcggcgagggcgagcagccgctgagccaagctaccgccgcgcctctcgaggtagcagcgacgaacggcggggatggcttgcggtggtggtgggcggtatcgtcgaggccattgactctatggatccgcttctttgtcgcctcgcccggccgtcgcctcacccggccaccgcctcgcccgctcgccgccgcgcccagctgtcgccgcgaccagccgccgcctcgcccgctcgccgcaccggtctgccgcctagctccgtttgtcgcctcgccggcctgacagaggggaaggggaggaggagagggggaggaggagtggaaggtgtggagggagttgactggggaagagataaggtagagaaaggaagagataaagtagagagagagggggtagtttagagataataggggataaagtaagagagagaggatgtgaaaattttgaagtggatgggtgggaaggagggaggtattttcctgtgcggtccacttaaaaagcttgtacggaaaaatcgattttgtcgtgcggtccacttaaatcgaccgcatgagataatgatgattatcccgtgcggtcagattaggaggcccgcctgagaaaatcgattttcctgtgcgggtgacagccccgcgccggtccccttatttttccgtgctgttccacttacgaaccgcttggaaacaaaaggggtggcgtacaggaaaatctatcatgtagtagtgaatgcagacacagccaagaagagaaactttggtcctgtttcgttcccaaaacttttttccaaaaacatcacatcgaatctttgaacacatgcatggagtattaaatatagataaatttgaaaactaattacacagttagtggggaaatcacgagacgaatcttttgagtctaattaattcatgattagccgtaagtgctatagtaacccacatgtactaatgacagattaattaggctcaaaagattcgtctcgcggtttccaggcgagttatgaaattagttttttcattcatgtccgaaaatcccttccgacatctggtcaaacgtctgatgtgacacctaaaaattctcttttagcgaactaaacaggcccatttgatgaggatccaggccattggagtcaaacaaatattctagaaggttccatggaggtcatgtggattccaagggagatcaatagggtggcagacaagctagttaagtaaaatcttatcagccgcccatacctcttcatgatcgacacaacatatctcacatcacttatcctaatagaagttgtcatgcaagaaatcttagatattatttctctactgcaatctatatcatccatcatgtactctgtttctgaataaccaaagttgttcctgaatattttttttaataaaaaagagctggatttttaatacgagcaacaacctgcacggatcttgaagcgatcacggccgtccaacctggcccaagggttggccatcatcattcctaacaggccgaaatagacccgccgtcagcgaaaaccggagaaaatatggtttaaactattaagcatggtgaacacttaaggagttgacatgtctggtaacggggattaagaacgccatgcatacggggggtgctgatacgcgatcagccgcgcgcgcggtcagtcaccccccccccccccagctactgtatacatcttatgtatatacgtcttatgtatatacgtatgtatatactatatatatatatataatatatatatatatatatatatatatacgaatatattttaatgcataaagaatatatacacacatacacaaagtttgtatacgtactaaaaaataaaaaaaatagaaaatacataacgtatagaaagtttgtatacgcgtatataaactttgtatacacgtataaaaagtttgtatacatgtatagaaagtttgtatacgcctatagaaagtttgtatacacctatagaaagtttatatgcgtgtataaaaagtttatatgcgcatatagaaagtttgtatatgcgtatagaaagtttgtatgcgcgtatagaaagttctatacgtacgaatacaaacttggtatatatacgaatacaaactttatatttatacatcttaaaaaaagaaaaaaccaaaagaagataaactgggaaaaaacaaaccgaccagaaaaaaccagagaaaaaaatccaaacagaaaaataaaaaccggagaaaaaaacaaaacaaacagaaacgaaaaaaaaggaaaaaacgaaaaactcgctcgcggcgcgtcgccgccccctctcatctccagtcgcgcggggagggaggcgcgcgactgatcgcccaatagcattctcgcatgcggactcgacgtaaagttgaggaaaggccggtggacttatttcggccgcagatggcaacggcccacgaagcacaagcggcccggcccatccaccgaccaagccagatgtatgggcttgtttctcacgaaaaaaacaaaagaagagaaaggaaaaaagaaaaaagaaaaaactctcctgtccccccggcagccgcggccgctgttcccttctcgatgccctagcatcctcgccgccgggaaccgcgaaccctagccctctcctccgcccttctccgggaagggaatcgattcatctccgccctccctacccgctgctgcctcctcacgcggcggcgcaatctccgtcaccggcggcggcggcggcggcgggaggtggggtgtccacgaacgaacgccgtgcgggctatggagtgatgatgccttcttctcctcccgacatgtatgaggtacggtcgaagacgcgcgcaactcgcgatttccactctgttctccgcaacttcccgtgcgaggtagtagatgctgtgctgtgaggggggtttttgattgatttcgtctcctcccaaatccaatccagaaacaggcacttgttcatggtggagatgatgagctgctggcacgggccggccctcctcccatggaggacgtgctgatgcacatccttccagttgattccgaacaggtgagatcgctatcacatatatatagccaatgtatgtaccctcgccattgcatcttttgcagagaattgcagagaattggaatcggttaagtgctttcggtgaaattgacctttttaagagatctgttctccaggtttttgctcgtgtaaacaatctggggaatgaaatttctcctgtacaagcctggtgccaaccagagctgcgcggcgaaaaggtttaacttgaacattatctgtttacctaccgcgttcatccatcagacaatgacatacataaatttggcaaaatgcagctataggtagtaacaaagacttggctaattgctttgtctcacatacatgtattacagaccagtaacaatgatgggcaaacggtgataactccagtcgagttgatcaaggtatttagaatcactttgactttttagaatcactttgtgcctggcattaactgcgaaacgaaatgcagaaacctgttgagaagcaagtgataacagaaggaagactgcagctcgctggtgatggctatcaggtatgaaaaccagacaatgcttatggagaggtttaatatggacatttgaatatggcagtgaatagctaccttaacaagaaatattcaattgcatgcgtgcagctgctatcttcaaatggcatagacaaaactgcagaacaactatacgtggatcaattagggagacaaaccaactcaatggaccaatcactgcagcatactgatggacaaaaccaatcacatgataatatggaaagcaatgaagtgtcaagcgatgatagaaacagtgatggcgattctgacagaagcctaggaaatgaatcagataaagggcttggagcacactatagtcctagtttaatggaattggataatgcaagaccaccagaacttggaatgaaatttgcaacacttgaagatgcacagagattctatgagacacatgctcttaaaactggctttgttgcaaagcgggggacgaactacaggagaaaaaagtttaccatagagtgccacaagactggcacatcaaagctaactccgaacccacagaggaagaggaagaaaaatattatagagaggactcaatgccaggcaaaggtggtagtgaagctcaataagggacaatgggagtatgcagcagtccggaatgaacacaaccatccattgtgtcctagctattcgcttagattctcaaagcgcaaacgcaggcgaaatcctccaagccagaaacagctggatgttcagagaaatagtgaccaactgacacaggcagataatcttgaggaacggttgtcgcaacctcttatttcagctgattcaaatgaagtaagcttgctaacaaaggttccccagatatttttgttttgtatacatgtgatggaagtgattttttaatgatctgttatcctggttgtacctcaggtaaacaacaaaaggatgcctagacatgcagagattagtatatctactgtagagaaggaacctgttgacaaactacagcgagctggtgattatcaggtatgaaaaggtgaaatctaacaagagtaccaataataaggtatcaaatagtagcttaacgtaagttattctcttgcatgcaggagcaatcttcaaatggcatagacaaaaatacagaacgaccaattgtagataaattgggagaccaaacaagctcgatagaccattcacttcagcatactgaagagcataacagatcacatgataatgtggaaagcagtgaagcgccaagcgaggatacaagcagtgaaagcaattcaaacagcagctcaggtgatgagtcggataaggagcttgggaagtacttctatcctagtttcgacgaact

SEQ ID NO: 61943 - DNA, 1674 bp, Oryza sativa
cccattagcacgctcattgttataaaatttccttacgttcataaagtgttgcagaagcttaaatggtcattctgtattaaatcaccatgttgcacatgagcaaaatttaaaagacgactatcctagagagagagagagagagtaacaattacaaaaatgaagtaatgtgtaatttgattggattactaccctgaccctgttatggcttgatcattcatcgcccaatcagtggatcggtatatgcacttgctctaagcttgctggaaacaacaaaaagaaaagagcacttatattacaaaaatgaatgtggagtaaatcaaacggaaagggaacctaatgttgttcatgaacacgcagaagccttcgtatcttgtgctcttcccataggtggagaccaaatgttggctaaatcagccggctgttgtcgcataggaaagcggcttcgacttgtgagaggcttatgcaagtgagggaatcaaattggctcagtgactcagtgtagacggtgcaggaaaacgggcagtgttgcacacttatataggaggaattgagagttataaagagaatcaatgagatttatcatgacaccagataatggcagtttctggtttacaattgttgaagaggaaacaaaccatgatggagacgattagcatggtttgcatgaggaattgcaaaagacttatcaaaagagtaaattgaattaactatggtgtctttcccaattcatggcagaaggccgacgggaagatgatggggttcgactggactgaaacatccaattgggccttgttttcatatatggaaaaagtacaccgaaggtccctcaacttggcaacgggataaaaatcatccttgaaccacaaaaccagatatgctgggtcccttaactatataaaaccggttaacaggggctcttcgacggttttgatcccggttttgatctacgtggcggctgagtcagcgtgggaccacatgggccccacatatcagctggccacgtcatcaccctctccctatctcctctctctctcactctactgttatcttctggcgactaggcaagccggccggaggcgacggcgcagggcggcccaaggggcacctcttcaaccgggcaccgtcgccgctggggaaggagccgtcgccgcaccagaatggtggccagagcaggcgaagcggcgacggtggcgggcgagcacggttgcggagaggcggcgtcggcgggcgagagcggtgcggcgtcgacgggctggaacggtgcgacgtcggcagacgagagcggtggcggcggagggagcgtgcctgctcattggcggcgtcatgggcgcgcagctcccggatctcgtcctcccacctctccaccctctcctctccttgtggatcctgtacacgccaaattcacaaacaaaccagattgcatcgattgattatgctgctcgtcatcaagcaaccaaccaaaccaattattttattagcgggtgtgtgtgtccatggccatggctatggatggtggtcttacgagcagaggcggtcctcgaagtcggcggcgaggttcttgaacagcgcatgccccgcctccagcatctccgacacctgcattggcattgcaatctcatcgatcgatgaaaaattcagaatgacaaatagcgaaattaatgaatggagagaggt

SEQ ID NO: 61944 - DNA, 8296 bp, Oryza sativa
aatgaatggagagaggtggacctggcgagtgaaggcgtcgatggcgaggaggattcgctgcacgtgctcctccgtctccgccgacgccgccaccacctcctcctcctcgccgacggccatgtcgtcctccgtctccgtcatgggcccggtggtgatgttgacgacgaccccggaggaggccgccactccccctcccgcgctcccctggctcaccatctcctcctctccctgtcctccgttgctctgcacgcatccatccattcatcccaaaactcagatcagattgagccatcaaattttcgacccaaatcaaaaatcaaatgcgcctcaacaactgaactgattgagacagtagatgaaatggaacaagtcgatcagaacggaatcgcgtggccttggttccatcaaagcaacgaacgcagctgacgaccgaatccaatcccccacaacgaacgcagctgcctggactcgcgggccacgaccgcggccgcctctgccccatcgattcccgggtgcgctcgccgccaacacctcacccgccgccaaccacgaccgcgcggccagccagccccgcgtgagcgccgcatccacgaccgcctgccgctggtctcccgccggtccgccgcctgcgccaccccttccccatgccggagagtgagatcggggagggcgagcccgccaccgtgttcgcccgccgccgccctccccttctcccgtgctgcatcgtcggccgtaggagagaagagtgtgtgtgagagagaaacagcagaaaagggagaggagggaaaagagatactgacatatggggcccacgtgggtcccacgctgactcagccgccacgtagatcaaaaccgggatcaaaaccgccgaaggacctctggtgattggttttgtatagttaaaaggaccccgtatatctggttttgctgtttaaggatgtttttgtatcctgttgacaagttgagggacctttggtgtactttttccttcatatataggcctggtagtgaaatgaagatctaacggtggaataagttcatctgaggtgccttaacttgtcaacggatccaattttcgtccttcaactagaaaaccagatacaacgggtctctcaattatcaaaaccagtgcagatgaagtccctcggcagtttggaagacggttttggctgacgtgacgcctaagtggctaatttgactcggtctccatttgacgtggcatcgacgtggcgcttacgtggcaattcgattcggtaaaaacaataaaccccgtgggacccgtttcacacacaaattaataaaaaaatggtggggcccacatgtcattctcacccgttctcttcttcctcctctctacccatctcccctctcttcccctctcctctctctaggcgcgccgagagggagaagcgcggcggctgccggtcggcggggagaagggcggggcacgacaaaaatcgatcggggaggccagccggcggggagaagcgcagggggcgacagccgggccgctgatgccagaggagctgtgcgcggcggcagacgggagatgggagaggagggagcggcggccggagctgcgggccgtcgtcagactgcgggtagacgatcacggcgctggcggggtgcctgacgtacatcacgccggggagccccaaggcgagaccggccaaggactgctgtgccggcgtgaagagcacgctgggtagcccggccgccgtcgcctgcctctgcggcgcgctcggcctggacttcggcatcaagatcaactacacccgtgtcgccgccctccctgccgcctgcggcggcaacttctccgccctgagcaagtgcaacagtcagtacaaccaactcactccgatttgtttcttcgtctctgtttttcttcaaaaattttttcgctttgttcttctttttgggtgactatggttagtaaaccttttacatttccctttatatagtagtacctagttatagatcaattttatagtttgtctatgtatataattcgatctctttttccttggcagagaaatttcccggcgcctctcctacgggaggtaaagcaaaatcctgaatccttgtctgattgttcttgtcgatctgatttgaattttgatgtaaatgatcaaataaaggattcaatgcctaattatcctcagtttggatcccactaactgaaatttgtccccgagcaccgtcgcagcctgacctcgtaccacgccgccgccgccgctgccgctctcgccaccggtggcagcgcctccatcagcggctgcacccccgccaccctcctcctcccccaacgacaccgccgcgcacaccaccccccaccctcctcctcctcctcccccgtagcgacgaggcggaggacacggacgacgatgccgtggtggcggcggcgcgaggcgagggcttcgcggaggcaagcgagagctccctgatgactactttgctccgccggcgccggcaacacgcctcgcggagctcgaggaggaccacgcccgggacgcgctcgcggcggaggcaggttcccagcggcggcgtgttgctggaagaagggaggaggaaggatgagaaagaagagaaaggagagaggggatagagagaagaggaagaagtgaggatgacatgtggggccccaccaatttttatttcctgtgtagctgacatgtgggtcccatggttttatttattttttgggatcaaattaccacataagcgctacgtcaatgccatgtgggacaatgacctagtcaaaggagccacgtatgcggccacatcagccaaaaccggatacaatactgtctaggaccttatttgcacggttttgtaagttgagggatgcgttgtatctggttttgcgctcaagggatgaatttcgaactcggcgaaaaatcgagggacctcaagtgaacttattcctctaacggttgatctttgtggcacaatgttgatccaatgactgaaataacatggtgacgtggctcactgtgaggcttgctttatagcaattaatgcatgctagtgggtaccacaccaaactcatgcgagaattgtggagggggtctccaacgcggagcatgcgcgcatcgcgcgtgggggcttggctcaagcattgctctttgtaggtcgagtataggtgaccaaatggaccgcacaaaggcatgccagcccaggcacgacttcaccacagttggcccaaacacggcacgtcggcgtgtggaccgtgcctgcaaggtccgtttggcatagcccaggcagaccagcccacctttttttttcaccgtagttttcctttttttttacccctgttattcctgtttttcccaaattttccatatgcttttccgatccccccagaaaaaaaatctcatgtgttttttctattttccctatttttcgtcatttttaacaactttttttttccatattattctttttctcccttcttttttcccttttctcccttctgcatttttaacaagatccattaaaaaaaagagtaaattttagaaaactataactttagtgacaaactattagtttgctgtaacattagcggtatattttagtttactacaacaatagcgtggaaaattatcaaaaaactgcaacttttacgttatatgctgctacagttgtcacctatatgtactgtagtagcatataatgtaaaagttatagttttatgataatttctcacgctattattgcaacaaacttaaacatgtcgctaatgttacagcaaactgatagttttgtcactaaagttgcagttttctaaaatttactcttaaaaaaaccatctcgaacctacttctcccatcctccccgaataccaaatataagaagctccgaccccttccacttctttaattttctttctcttggaaagcaaaggaaatatagggataatatttcatgaagcttcctataaggagatttccaatatactgttagaagctgcactgattttgaatttagaattaactatagtagattctcttcgccacttcaattgcctacccttttttcatgattgttatcagaccatgtaaaaaatctacttaggattattcttaaaaatcaactttaaaattcaaaagtagctttggcttttaaagaaaagcttagccgcgagttctacattaatgacattatatatttaaaacagttaatatggttcaaaccaagtaggaaaaaaaaacaatttatgagcataagagagaggtatgctcacccaacaccagaaaatgatcaaataacgaagagctacatgaacacgaacatatgtgtaaagactgacagatcgttgctccacgaaattacaagtttttttcatgtcaacagaatcagaggttcaagaaacatctattacagcatattgacagctacaatagagtggaacgaaccacaatgaataaacgaaagtgtaagaagggtctcctaagacattttttccaatgtcatgcacctacagagtaccgatatttactgcactgcaagttcagctcaggctgccaccactggctgatgccatgagcatatttgaagtccggtgaagggcttacgttgacaattaagtctgcagatggaagaaggtgcagtggttccgattcccatcctaatgccttgtaaaacagatctcctatggaattttgggttgcgagcttctcgataaatccagcaccgagatcctccatgttcttccgatgctggaagtagccgatgtactctgaacagatatggtctcctggattgacaaacagatatggcgtccatgatgacaaaatgtggaaagaatcttctgcaacagacctctggctgctcccctcgccttttcctttcattgcaatggctaatccagcagtaattacacttcttgcaatgcggaaaccatgcttcactctctcatcacttatcctctcgattggggcggcaacaaaaggtgggttgaagagatagctttccaaaagcacaccctttttaaccatgtttcttccagtaaggatggccatacctgcgcccagtgagtgcccagctagccagatgtttgagccagggaaaaccgaggcgacgttttggacagcttgcattgcaattgtaaatcttgaggtccgatggagaccattttggacaaggtggaggtcaagggcgatatcccttgagatggtttccttctcagttatagtgcctctgaaggcaataacaaatctcggtgcattatcagcagaagattctttacttgaaggaggattgaattcaaatattgcaccgaaaatagacaagtcagcatcatcgacaagcttgcggatcaactcaaaatggaagaattcccaccaaggaggtcccaaggcttcaacagattgacgacctagttgccggtccctctccaaaacatatacagcctgaactaagcatgcagccacagatctccgattatgctcacagttccttttgagagttcataaacgagggaaaaagttacttccaccaatttaatgcactacggaaactgttcatcacatctgtactcctagcaaaataatcatatatgtgcactctgtggcaatagctccaacaggcagctggttttgctgatcatcgatgaagatcaaggtgattactagtccctaaattcatgcttcattgtcaacactacatacataaatatgaagctcaatccacaatgaatgaaactccaaaaagattgtctgcacactttcatgcatcatattgtaagacatgccatttttttctttaactattgacataccaattatgactaatgccctcttcaaaaaaaatacaaatgatggctgtgacaagtttgttaacatgagaagcttttgtaataataaatgcctaaatagacctaatattatctatcatagaaataaaagataagaaccaaccaaaaccttaagacatttaacagaatttagttctgtgcatgcatgtgcataaaaattaaaaacgtagattaagtgcagcatctctacatagtacatacataataattcaagaatcacaaaattttccaggaaatgtcatgtaacactgtaatcacaacaggagcacgtaccaattaacaggattcagatatgtcggacctgagataccaaagatatctctgtccacagccatctggctatgcagagtcactcttcactttattggactttatagtgatgaaaaacataacactgaaacattaagaaaaaattagcacataaaaactgatactggtgtcaacaaatgaaagtattgaaatcctcaagaaaaagctacaaaggtggtcacattcaaatgccatctactttggaccgagagtgtggtagttaaacaataaataaactaaagagcaggcaaataagtccttagggtagttcgaagtatctatgttggtctgttcagcacaaggtgaaacaggtaaacactagcattcatatgattggttggcaactgaaagtaatttctcaacgcaggactctcccatgcaacgagttccattcgtgacaaacaaatcacaagaaaacactacatctgataatctgtcttataatcattaaccagtgtattcgtacaagcaaaaagcactgacattgagtcagtgactcagtgagacttacatcaacaaagaaaaaaggaatgaaactaaataaaaagtccagcaattgacagttctggcataaggtaactggtgttccaacatttcagtgcttagtgggcatgagaatgatcaaaggaagtgtaaaagataagttttttttgttcaccgagtgtaaaagaccaggttcaaagctggtcatcaggtgaagccgtgaagggatgaagccattctccaactaaaatgcaaatttggtttttttaaatattcacttttgtgaatcctgtgagagatgttgctaaaattaatacacatggtgacagctccttgctttaggcatttggcaccaaatctttctagataaggaatttggcaccatctctatcctgtaccaactttatatttctcacatacttcacaagcctccatttttaaaaagtgtaatgactaatgattcccataagctaacagacaggtgcttccaaaatatgcttacatcaaccaccctaggattgaaccttttagggctaacaaaaataatcttaaaaacagatgcacatacgatgttgacttgcacatagtagtttagcagcatcggcatgactggcaatgaaactagaacatccgggtagcgcgccaaggagcaccacaaatccatgccgtttgcatctcatgaaactaactagcacatctctgtattcaatttcagacagaatggacgccacccccattaccttacttgccgactatacaaaaaacgcccaattcctactcggaatttgaaattgagccacgaacacaatgcctacgatcgtcatattccataaaaaaaaaatccccagcaagggccttttttgcagaccattagtattccagaataataatactagtagaaagaaatcgcaacgcaaacaagggagaacaggtgccaatccaggagcaatatttgcgacgtcccggttcccccaaaacgcagaatatggctaactaaatcgggatccccatccagagaaaccggcaaccaagaggtccggcgaaaccacctcgagcggaaaccggggaagctcggagcggaggaggcgggcggggggcttaccctgacgacgaggaggaggagggcggcggcgaggcgggcgcactggcgcggcgacgcggaggaggcaaggcggggggcggtggatctgggcgtgggagaatggattttgcgagaggctcgggatgggagaggcggagagacggtgacccgagaacccgaccgagaaagtgaccgactctgtttttatctttttccttttttttctctttagatgtaaagtgactgacccgatcgagcagtaataatctgatcgtaagacatactagtatttaactatttaccacttttataaatggtaagtaaaaatttactcatatgttatagatacatattgattcacatacagtagtaaatctttcattatcgccttttaaaaaggatgtctagatggcatttgacagaaaaacacctcacaaatcatatgaattctggaccgtcggatcgctttaagattcgtgctgcagttctaaccctaactcctctacctcccctcgtcattctaggccgccgcccccacgcgtcgccaccccacatgccgcctcctggctcgcccgctggtcggaagggcccaacggcgccggcgagcc

SEQ ID NO: 61945 - DNA, 852 bp, Oryza sativa
actactataaggggtaggggtgtcttgagagtctggaatgacacgggttgttgagagtctggaatgacacgggttgtagttgtgtcggttgacccaccatacctaataagtagatccgccccttcacggtttgttttacatgggcgtttccgtttctcaaaggtggcacatagtgaagatgaatgttcttttttttcttcttttccattgccgaaccttgtcgagcacactgcaggagccgatgctatgaaaaaaaattgatttttttaataatagaataaaataacatcccggcctttgctcagaagagctacagccaattattacaatctagcactatgtaagagtgtaatccaaatgaaagctaacacaccaaccaaaattaaaaggaaaccaaactagacaaaataacattattcctgtctattggtaaatctccatctatgattggcaaacagttgcataaccatcgttttaagcttacgatatgcaacaattaggaactatcatcagaatggccaattctcggttagatcaatgtaattagcattaattaacaatatccatgaaaaaaatctgatagttatgaacaaagatcactctcatcaatacatcgttggtgcaggttgcaaaccgaacaaagattgaaacaaataagagaattaaacagaatagaacatacaccgtgttgatctcactggtggagaaaccatctttgatcggtcgacccaaatctacaatagtcccggttccatttaaaaccgggactaaaaacgatttttagtcccggtttataagaacaacaggactagatgatctttattcccggtttgtatgaccaaccgggactaa

SEQ ID NO: 61946 - DNA, 3158 bp, Oryza sativa
acttttgttaatttttgaaatagaaaattattttttaaaacttttaataaaaaaaatttaaaaattatgggctcaaatttctcttacccaacaaggaaccttaaggtgcttcgatgggctatataacccactaaagttatgggcccttttttttgcccacacttttttctcggcaaaacgtcgggcttaggccattgggcccatctcttctggccgtcaccacactagatcattctgtgacaaaattaatccaagtccctgttctttcgagcttatcacttaggcccatttgaattggaggaaaaacaaatgaattgaaatcctatcctatactaaaaacaaatgaattgaaaaggaaaaatgtaggaaacttttctattcctacgattctaaataaaaacgtagaaaatctagcatccactttaatctcttggaaaattccctttgagtctatctctcacatctgatttgtgcgtttatcctgcagtccaatcaaacgaccatttcttagttttccctgtgttttgcaatcctcagttttacacttgtattcttatcagaatcctgtgtttttcctattcatttgttttttcaatcttgccattcaaagggctctcggagttcatgtgcgtttttttttttgcaggtaagttaattaacagatagtctggtactcctatgtattttaataccattttatacatactatctataaaattaaataataaatatgtaaatttattacagataattgaactgttatacgagttgaaataaaaaaaagtacccattggataaaattgccaaaaatatgggcagtccggtaagtcactttagcaggattgggtccggtcgggtccggtctaacaaaaaaaatatataagatttatatattgatttattatagataagggagatagaggaaatgcactaaaattcccaaatcaatttgtaaaaatgttaaagttcctctagaatatgaagcaccttttcctatcatttgaaattcttttgaaccaatttcaccatccagaggctctcacagagaattttcttttaaaattgaactttcctacagatttcttcaaatctaatggagccttaaatagatggagagcaacaactcctccctaccctcatgcgtgtgtaatattaatgcattttcataacacagattaaaaaagatgatccataagcttgctaaatcatactggaaatataccatgcgtatcctggtataaacctcgctgctaatgcgtttctctcgtaaaaactttaagttgctttaaaatatcagtaaatcgatttgttgaatttgtaataattaaaactcaattaatcatatgctaatggttttctcgttctaagcacgtgaaaaatagataccacttgggtgaaatcatataactataaaagcaatagcagtgcagctatggcatttgaggagccaaagcaaccagctagactaagaaacaccctccacagtgcatgtggtatattttatccttcacagtacatgataatgggtctcacccgttctctctcttaacttttcatccctcctctctctctctttgcctttccccaccaaccactccccctcctccttcggctactccaccgccggcacccatctccccttccgtcgctctcctaccactcatgtcgacggatcgaagcggcaacaagctcggcactgcgtacgtgcgtggatggtgaggagcttggggcagatttggaatgtcggcggcttggcacgtccttctcgatgacagtgcctaggtggagaggtggccgagtggcgacgacgctgggcggagcggcgatggcattgggcgaagcgacgagggggcggccggatccagcccggggcagctccccttctccactatctccagcataactccccttctctgaccgccgcagcagctctccctcctctccgccgctccccctcccgcctgcgccgctcttcctttacctctccgctgatgctgctcaccccaccgcctgctaggtggctcgttggctgcatgcagatggtgacagcgggctaggcagctcatcgcaaggacaatgggctaggcggctcattggagggcaggggtgaagcctggatttatggttaggagggtgtgggcagggcgaacaagtcataagttatagtaagcaatgccgacgataaaacaagacatcatgtgttctgccataaaaaacttgaatttagctttttagctctatcattggatgtttgacagtttgagacttgagacaccatgctcgatagcgagacgcaatgggagtacggagagacgtgtgaagccgaagcaatgaaaacgaggagttgatttgcgttgtctctccgtctctttcttattaattaattttctatatcatatttattgataatggactaattaatatgctaatgcgctagttagtataatagggagggggtgggatgggggtgttagccccctccggccctgttggatgagggcgagcacaggaaggagcacgatgctactcgctccacagcgtagaagcagtgctgtctcccagcctcacgcgtcctctttttcacccaagaaccggtggtattctttggacacgagaactttattttggtgggtccggaagcaaacgtgccaagggtcaagggagaatgccactacaccgcaccgtgaatgccctaacgacacctccctcccatgcaaccgatgcttcttggcatacataatttagcaggatggtagttgaaatttattatatggaatatctcattggaagtaattgtttttctactggctagatcatctttagcatggaagataacacacaacctcacataaaaaaccgaaaactcgaaaaacgggaggcacacgcacgagtacaaagaggagttcgaaattgtgaccgtgtgtgttcacttcacagggcgcagtaatttttcttcgaccgcgactcgacgaacaaacggacgccacaggataattttcaaaaaaaaggaatatccccacccatttccaccatcgggccaccggtttgccggcggccgacgtggccggcctcgcagcggcacagccgcacccatggccgttatcccccaagcccccaccgccacacccccgcctacaaactcacctccacccccaccc

SEQ ID NO: 61947 - DNA, 2621 bp, Oryza sativa
tccacccccacccctcacccactcgccgcggcacaccctcccacccccacctccgcctccgcctccgcagccatgcagatgcaggcggccaccaccaccaccgccgcgcgccgcctcgcgccgaagccgcagccgcaggccaaccggtgccgcccctcgagcgtctccgtcgtcgcggcggggaggtcccggaggaggagcgcgcgctcctccctcagggcctccgcctccctcgaccaggaggtcaaggagcgcgcctcccccgccggtgagcgctaaacactctcatgactgcaaacctcgcttgcttgatcagcggaggggggtttgtgcgcttcggaggtagggctaggcttagcgctggatttttggtgccgccatggttgggttgctgattagtatcgtgaggtgaggtgaagtgctgtggttcgctttgagtggggttggttggggcactatgcccattgacgcgagttttgctacggcctcgctgatcaagtgcaatgagcacagaatgtgtatgctggtgcttggtagaggttgcccctccttttttttttttggtcctggaatgagttagcaatctgtaagtggtatatataattgggtgcaatctgattctcgctgtttagaattgggtggctgcagctgcataggatgacatagttgacatttcgagtatagcaattgtggcttcacaagctgagtagctccttagttgtaactgctaacaaatagatggagggttcaaggtctcaaacacttcatggaatgtattttgtgatttgctggctactcttgcatatttaatcgttgaagtttgttgaatgtgtttattgtgtgaaagctaccttgcctacattttagtttcacaaatacactatatcttccttccacattatatgtgcactggcttgacctagtgccatcagaacgactggtatttttcatgcatttatctatctatacatatcagcttcctgtcttttctgttatatgatgctaatctatgtaccatcttttcactgaattattcagctgggaagagtggtcaagcaactagaagagatgtgaggaatatagcaattgttgctcatgtcgatcatggaaagacaactctggtggattcaatgttaaggcaagccaaggtacattctagaagcttcttgttccattctgagattaatttcaaaattttaatgctaaggaaagctttactctgtagggaagaatatgtacttcatgaaaacaccttagaacgaacgacaaactatttgtgaaaattatttctgttcaaccacaaggttgtgctgaaaatcaatagtgcatttaccatttctgttgctgtttaaattatgcaggttttccgagacaatcaagttgtacaggaaagaataatggactcaaatgatctggagagggaaaggggaatcactatacttagcaaaaacacttcgataacttataagggtactaaaatcaacatcatcgatactcctggacattcagatttcggtggggaggtggaacgcgttctcaacatggtggaaggagttctcctagtggtactagctactgttgcggttaaatgttatataagaagattggcttacttcttatttgatgcttaaaacatattctattggcttcttttgcgcttcattgttcaataagtgttttgatgccatcacatcttgacatgccttatgtctatcaaaaattgtaacacactgcatatagggtactgattccatgttctgctgcatgctacacaagttcctatggaactgatttttcaaacagtgttctaatgtgaattgagaaaacgagctaaaatcattctattaacataatcctctatgcttcgtaggttgattctgtagagggacctatgccacagacaagatttgttctgaagaaagctctagaattcggacatgctgttgtagtggttgtaaacaagattgacagacctactgctcgtcctgagtttgtggtgaattcaacatttgagctatttatcgaattaaatgcaactgatgaacaggtaaatagttttgtccatacttttgttcattgatttgttctcttcctattccttatgttcttgttttgctgcaatatgtcagtgtgattttcaaacagtctatgcaagtggtattaaagggaaggctgggttatctccagaaaatttgggtgacgatcttggacccctttttgaggcaatccttagatgcataccagagccacgtattgagaaagacggtgcactgcaattgcttgtgagtaataaacttggggattatattgtcatgtacttaacttgtggctatgactttgcataatactttatatgcagccatcgtgattgttttcttggatgcatctgtaatttcggattttctctcaaaatggcaacttacacactgtatcactacatttttttcttctgtttgtttcttactgttattttcaactatggtaaagcttgaactttgggatgcttaactccatacagttgggagtaattactcccaagatgctgaaagccatgccatggatactaggttatgtaattatagttggaaatgactgaaatctgatagctaactagccaagat

SEQ ID NO: 61948 - DNA, 11829 bp, Oryza sativa
actactatagggcgaattcgagctcggtaccctattaaagggaaggctgggttatctccagaaaatttgggtgacgatcttggacccctttttgaggcaatccttagatgcataccagagccacgtattgagaaagacggtgcactgcaattgcttgtgagtaataaacttggggattatattgtcatgtacttaacttgtggctatgactttgcataatactttatatgcagccatcgtgattgttttcttggatgcatctgtaatttcggattttctctcaaaatggcaacttacacactgtatcactacatttttttcttctgtttgtttcttactgttattttcaactatggtaaagcttgaactttgggatgcttaactccatacagttgggagtaattactcccaagatgctgaaagccatgccatggatactaggttatgtaattatagttggaaatgactgaaatctgatagctaactagccaagatcagcaatcagtatcttgtgtacttggacagctaaggaaactcctacatgattaatattcaccgatcaatttgcaataactgccacattcgtaaatgaacatatgttcaaatttctaagattattttccatgcaaagttacatcaactagtgttgaagtctagacacttaccaggcacataatatgagtacgttagctattttgttcttctctacatcactttattgtttgttagaaagtttgatttgtcttcttgtgagcaaatttctgcggagctgcctttctgactttgacaaatctatttttctgataatagattatcagaacttctctttcattatttgtagtcctgtgtactaattccacaatgctgactgatgtataggtgtctaatactgaatatgatgaacataaaggacggatagcgattgggcgactgcatgcaggagaactgcagcgaggcatggaagtgaaggtacaaatttgttctttttgtgcatgtagtgcaaatgccaatattccaacaaagattaaaaagaacaacagggtagcatcaaagatatgtgcaacctttccaaaatttagatttaaatctctcatactctttgcatgagcaaccattgcagtcttggttaatggttcacttttgaagtttctttagatttgatctttttttcaaattacatctaggcacatctgtcaccttttttttgtttgcaagacaaagggaaaaaatatcttttcttatgacagcaatatagcttctactgatttcaagatattttgcaggtttgtacaccagatgatgcttgtagaattagcaaaataagtgagcttttcgtttatcagaacttcagccgagttccagttgataatgttagtgctggtgacatttgtgcagtatgtggaatcaatgatatcatggttggtgttttttaacaatttattcaagctttctggtttacatttatcttaagagcacgataattataaaatctgttattctttgaactctgcagattggggaaaccatagcagataaagtttctggaacacccttgcccaccatcaaaatagaggaaccgacagtcagaatgtctttttccatcaacacttcaccttttgtcggtaaagaggtatggataaactccattgtatctctactgtctagcagtctagcatggcctgcttgaaaaagagagttgaaaaatgcctaagctagatgttgatataatgctttgaattcaaatgataaaaaaaatcgatgtctaaattgcaactatgtggtcattccaagttgttagactaaatattattttattttgacaattgaaatgatctgccattgctggatgcttagaaagtatcaaatcatgattgtagttcacagaatgcagattttgctctattgtgctttaaagtggcatgaagtgaatgctgtcaaattggagtcaaattaaagtgccacaaagtgaatgctgtctcaaaaaaaagtgaatgctgtcaaattatattcaaatctcttttgtcaaattgaacttgtttaatctaaaatcgattgaatgtcttgccttcttgcaagttatttaaattaagattatccatagtggcacttttccaccacatttgctgtaatggtaccaatgccatgtttgtaaatataatgttgctagttttcttccttttctggaatgctgaaatatttgtccgttctcactggatttatcacaggggaaatatgtcacaagccgtaatctccgtgataggttatatcgtgagcttgaaaggaacttagctatgaaagtagaagacggggaaactgctgatacatttcttgttagtggcagaggcacactgcacctcactatattgatagaaaacatgtaagcatttattatcatattcagtgattccagaatgacatgtacttctggcattttcttgaaagaacctcaattgctaacaggcggagagaaggatttgagtttatgattggacctccaaaggtcattaacaagacagttgatggaaagctgcaagagccttatgaggtatgtttcttttaatgccagtattcacttgtatatttcaccaagtagcaaggtgcctgcatgttgcaattgcaacgagatcttgaaggacgggccgaatgttcccctccatgcttcagcgtagttcacgtttagttttttctgtttcggtttttcttggtgagcagttttcaggtgcatgatgcatccaccggtttattttagatggagttttttttttgttgcactagtggggatggtagggatcgtcgaacggacaaaactcccctttagaatagtagagatttctcaacaaatattgtctttggcactagtattgctattgattttactatcctacaactcctaatccctcagttttcatgtaaccaacttattcttgctactgtgttccagatagctgctgtggaagttccagaggaatatatgggttcagttgttgagcttttggggaaaaggcgtggacaaatggttgacatgcaacctagtgggttcgtaccacactctaattccttcatatgcttgcaagttatgttggaacttttttttggaggagagttatgttggaactttttaatactatcttcgcaaaaaagtataaatttcctattgaattaatcaagcaaccaacaaacaccatattgaagttagagtgtaaaagtttatgcatcgagtctgtctcattactctgagaactgcatgactttcctcaacattttatacaagagtgtactaagctgtcgtgtctcggagtaacttctgaccctcttatatcaattaaatgcaagaacaattgttgggagtggtttatgtattttcagatggtggttgagattgaatttttggatggattatttgtatggtttgaagcaaatatcttactctatgaagaaatcatgcagtaatggatgtaatgaatacaatatggctttgaaaattttctgttgcataatgcttattcctgagatagaggagttgttgccataacaagtgtcattttcaaatggcaggccagagggaacaacattactaaaatacaagattcctactagaggcctcattggactcaggaatgcagttttgacagcatctaggggcacagcaatactcaacacaatttttgacagctatggcccatgggctggagatcttagttcacgtgatcaaggctccttggtacacattactttcaagtttcaagcaacaagttttttttcttccgttttcatcaacatctaaattggataacatggtataggttgcatttgaggatggaagtactacatcgtatgcacttcttaatgctcaagaaagaggtatactatttgtgagtccaggacaggatgtttacaagggccaaatagttggtatccatcagcgaccaggtgatttagcaattaatgtgtgcaagaaaaaggctgcaacaaatgtccgctccaacaaggaaactacaggtaaaattttcatctgcaaccactattcgttactgcgattatattatttggtagaaatatctttttattgaagaaaattaggtactggttgttttctcttgtgaatagctgttcaactaaaccatagctagcttggtccaactcacataatccatgcctttcttgaaacctacagttgatatctccaaaaagttcctaggttggggttcctgataagtaaacccttgcatcttgaggctgggcaggtctggctggaggggctttagtgctttactgcctattgacctgattgatgcaaccaaaacatcataaacaggctctactttccctgagtgagttcgaagccatgtaagcaaaactgtaacccatgtatgcacaggctcgtggcagcgcaggggtggagccagccttgggccaaggcctgggccagccaagcctagcatgtttcggcccatactgggcttagcatggtgaaatttaatttgagcctattgaacttaaggcctaggctctgggccatagcccaggtgagccgatctggttccacctctgtggaatcatattcccgtgaatagagtccaacaaacactagtattagtgcattacattaccactgcgatcacagtcaccattttcttcatgccttctgacttgggctctcggaacagcctaaatattgacatgcttctcccttatcccattggataagctgccttcgttcacctttgaattcacagaaatccttctatgcattgcttcttgctagcaatcctcttgcacctgtgatctgcctgaccaaagcttaggaggcaacatgggaagcaagcagaggagccctgtgctctgtactccatgctgttaacctatatcttcctgggcctttccacatctgtgagcctgcctagctggctttccattgatttgttacataagtttcacatcaactgtcaaactcccaacttttgatagaaagacgattaatttccatccgttttggtatgctgcagtggttctcgatgaagcgttaagctacagtctggacgactgcatagagtttattcaagaagatgagctagtggaggttactcctgcaagcatccgcatgtgcaagaacccgaaagtttcgaagaaaaaccgataatgcagtggaggttactcaagcatcctgcaattttttggagctgctttgctttgcaagagcagactcagatataagattactcaattttgcaatgattataagttgccaaattattatctggattcctcattggacagagaagctttgggtagtattctaggctgcagatacatattctttcacagcgatatcagctgtgttacatgtttgtaggccacatagataccatatatacaagattcatgcaactatactccttgcaatgatctttacaaccaattaatggattacatatattactttactgaatgctcttgtgtacaatttgacattgtcaaactaataaagaattctctactcttctgattgcagagttctaacctatatacttacgagctcagctacaacagatcagagctcagttaaaacatggcgagagccagcggtttcagacgccgccgttcatcagtaatttaattacaacaactaaagcataaactaattcatggcagctgctgctttgattccttgtcagcaaccttgcccctgcttcggcaacaaacaatgttgatcttcatggattgcagcctcttccccctccagagctatggagattgatttgcgaccaaaccagccatgatattctgcatctcgacctcatcgaagccatcgaggaggccatccggcagcagctgctcctgaccaagaaactgctgagacgacaacgacgtcgtcgtctccgagggttcttgccacgatgtgagatctccatggaagtagtgctgctgctgctgttgctagtcgtagcaggcgaaagcgaattctgcttcttggttgctctgctgctgctgttcaggcatgatgtagcactggctttcctcgcagtacgcgtattcttggtcgccctgctgctgtgagatctcgccaaagccgtcgaggaggaggccatcaggcagcagctgttcctgaccaagaaactgctgtgatgacgaggacgacgacgtcacaaagggttcttgccacgatgtgagatctccatgtaagtattgctgctgctgctgctgctgctgctcgtcgtacaggcgaaagcgtattctgcttcttgattgctctgttgctgctgctgctgctgctcgtcgtagcagacgaaagcatattctgcttcttggttgctcagctcctgctgctccggcaagatgtagcactggctttgctcgctgtaagcgtattcttggtcgctcagctgctgctgctccggcaagatgtagcactggctttgttcgctgtaagcgtattcttggttgctcagctgctgctgctccggcacaatgtagcactggctttgctcgccgtaagcaaattcttggttgctctgcgtcatctgctccaacgccggcaagaactgttggtagttgctctgctcctccgccggcaagaactgatggctgctctgctcctccgccggcaagaactgatggctgctctgctcctccgccggcatgaagaactgttggttgctctgctcctctgccggcaagaataactgatggctgctctgctcctccgccggcacgaagaactgttggttgctctgctccgccgccgcctccgggaagtattcctggttgctcatctgctgctccgggacgaagcactgctgctggatttggtcggtgtaagcagcgtattcttgctcctcttgattgctctgctcggattccggaggaggtgctgcagcggcggcggcgggggggacggcgtcgtcgaggacgaggacgtagccgtcggggacgcgcttgcggttctggccgtggccggtgaaggcgatgtgggtggcccggtgggaggcggcgacggcggagccggcgggtggggagacgatgtactcgtgcatcacccacccggtgctgccgctccggcgatcgtcgcggtggaagttgaggctgaaattctcccacaggaacgcctcgccgccgggggccaccaccacctcacctttcccctccgacctctgcttcacccacttgccgccgccggcgacggagcgcacctgccgggccccatcgccggcacccatcggggcgacgaagtaggcctcgtcctcgtcgccgcggccgtggcggtcgaggaggatccacggcggcagcggcaggccccccaggtggtcgtcctccacgaagacgaggccgcggacggggagctcgccgtcgatcaggtacggcaggaggaagagctccacgagcatctggtcgctcggattgaacttgaaccccggcgagagaccctgcgacctcgccgccgccgccatggggctcctttcttgatcgctcgcagctcgctcgctcgctcgccctcgcgattagccctagctagggtttttgggagagaggcggtggccggtgggatttagtttgcgggcaggaaggatgtgtttgagaaggcgggggcccggtgtcggtgtctatataaacgcgctcgcgggctgcgggattgggtctccgagtccgattcggccttgctgtatgtttagggccgttactgggcagggagggattgggccaaatacacggggaacggcacatatgcgaaggtgttttcttacgacgagagaattcctaagactgctggaattatactccctccgctctataggacgtgcacgtattttaaaatttaatttttataatatttaatcaataattagtataatataaattttattttattttctgaaaataatatcattgatatttcaatttagttttatatggttataattttatatagaagttattttggagatcgtgctaagtttgaccgtgcctatattatggcatagagagagtaccactgaatatgtataaaggatatttttgtctattcttatctcgtgatttatagtctaaggctgtgtttagtttcttggccaaaatattttttgaagtatatagacacacatttaaagtattaaacgtagactaataacaaaacaaattatagattccgcttgtaaactatgagatgaatttattaagcctaattaatccgtcattaacaaatgtttactgtagcatcacattatcaaatcatggcgtaattatgctcgaaagattcgtctcgcaatttacatgcaaactgtgcaattggtttttttcgtccacatttaatgcttcatgtatgtgtcaaaacattcgatgcgatgtttttggcaaaaaaaaaaatctaaacacggcctaagacgaacgatcgatgtgcttattttcatgtaagcaactatattgccatttttgttaactgtgttgtaatatttgaggatgaaggaggttttgtatgaataggattgatgctttcactactactctccatcccataatataagggattttgactttttcttgtactgtttaaccactcgtcttattaaaaaattttgtgcaaatataaaaaacgaaaagttgtgcttaagtactttagataataaattaagtcacaaataaaataaataataattttaatttttttaaataagacgaatggttaaacagtacaaggaaaaaatcaaaatctattatattataggacggagggagtatatcgataccctttatcagtaccagttggacaaaacccaaccctgataagttttgctactctttgactcgcatgctcccaattagtaccgaaatatatggcatatccatgagacccacatcaatatcgattcattaaaacaattagggccgttttggattgaagccaaaacgtgaccttatcaaaattttagtaactttaatagtaaatatgctagtttggattgaagccaaacaattggtagtgtccacgctcaatttggctacattctaaaatcttcttcactctcatactaaattttggttttatattggtattaaaccaaacatagactagctaactttgccctaccaaaaaattggtagtgccaaaatttgcctagattttggtactactaattaattggtatggtagagaaccaaataggccctaaacaacactgataacatcagtgccggtacttctaaactctaagccgacgtgatttcagttttttaaaaaacgagaacagcccaagccttatccctcgatctcttcgctctctttctcttctattccccattctctgctctctcgctctctactattcgtccgacctctcactcttcgtttaggcggctgacgggcaatggccaacctcacaaacacctacgttgatatcgcgggctccggtggctagcctgtcaagtgttgcagatgcggctgacctcacaggtatcaatggccaggcttgcgggcaccacggcaatggctagcctcgcgggcaccgacggtagcggccttccccttggtggtgaggcctaggagcccactaaaggttgcctccccattgggttgccatatccggccacttggaggctaagggccaccgtatccgcatacctccggcctccctgccttgcatccctctatcgccaacacctcctcgacgtcccttccctctgcttggttgttgctcactacatgcgatggggttgaaggcacctccccccgggcttcgaggactacactactacaaaatgggtttacattgacacctaaaatggatttttgttggcggccggcggcatcgccagtaaccgaaggtcagtgcaaatacaaacttttcattggcgggtgcctatctgcatatgaaatccattctttaccggcaacatcttgatggctgccagtaaaaaagaaacttcactcacagagagattgagctgaccgcctgtgataaggattttcagggaaaagaattgcacaaaaaatatacaaattcatgcccccatctccaaaatctaccttagaaacccaaatccacattcttaaaaaaaaaaccccccctaaaatccacaatcccaaatcacagaagtcatcgttgtcgcaacgcctatcgtcgttgccgaggtccaaatccacctctcccaaccctgcaacagaggatgaggccgaggcgcatgcctcatccaccatcgctaactgcccctttgcggcaggctatcaagccccaggcacgcgtctcctcaaccgccgtcaccgcctagatcctgagcccatcgacggtggatccaccactcctgagattggtaatgacggatccgacactcctgagcttggtagcgatggatccgcctctcccaacctcattgaaggaagatttgcctcacccaagcttgttcgcaactctcgccacagtagctgttgccgtcccgacctcactgcagtaaccgtcattgtcaccgagccatcctccgctagatctagtggtggtcgttagccctctttgttgctaccgccgctggtggcctcctcccctccgaccagatctaggagagggatgggagtggggaagccgacaccgctgctcactctgctactgccactgctagcggccttgatcccctttagccagatctaggagaggaaagggacgcaactaagccggatcggcctcaaatctgtgtccacgacaaatttgtgcaaatccaactggtggagttgcagccaactcggagtgaatcaggagattatttacaagaaaagaaatacattgtttacaagtcgacgctgccaagaatagagaaatcttttacactctcaatgattgttctcgtgttctagcctaccagttacaaacagagaacgggtacacactgatctcatcgctccaggcctccagcaagcaaaagaacgtggtgagagctgttctttcagatgtatgacgcctctcatcatgtcaggtcacatcagagattaacaacaagtaaacatagattaactttcggctacttgattaaatactgccatcaacttggccagaatttggttttgtgctttgtcaaattcggagagcggcttgtccgacgagcctccatagccaccggccgccgcaaccttgattatatcctccacttctctcaacaaatgtccgaccacccgctctagctccgccgcgtcgggcggcaccggcagcggcggcgcgtcgccgtggccgtgctgagcagccaacggatcatccgcagccggcgctggggcggcggcgtgttcgccattgttgatgggcgcatcaattcggcataatcccttcgcatcagccatcaaatattcccgcatcttgtccaagaacacgctgtccactgccggaactggcccgctgtagtaccgggccggcggctgcgcagccggcgcggcgtcgtgctcgccgtcaccgttgttgttatagatcatcgcgccgccgtcgttgaggccagccggcgccggctcctgatcaagaaactgctgcggcggcgtcgcaaagggttgttccaataatggcgcgccaccagcggagctagccgatgccatggcggactcccctgctccgtcaacatatgcattttcaggtggctcaggcaccaaagtttccaagaacacgtcgtgcaccggcggctctgtagccggcgcggcggcggaggcgtgctcgccgttgtcggagacgacgagaccaccaccgaggccagtgaacatcacctcgtgatcctgaccaagaaactgctgcgaagtcgcgaggaaatctccatggaagagatgctgttgctgctgctggtatgcgtaatcctgttcttggttgatca

SEQ ID NO: 61949 - DNA, 2065 bp, Oryza sativa
gtgcatcacccacccggtgctgccgctccggcaccgctcgtcggcgtggaagttgaggctgaactcctcccaccggaacgtctcgccgccgaacaccaccaccggctcctcctcccctctcggccgctccgtcctctgctttatccacttgccgccgccgccgccggtgacggtgcggctcacctgctgctgccgccggccaccatggccgtcacctgcgggcaccggcccgatgaagtaggcctcgtcctcgccgccccggccgtggcggtggagcagcgcccacggcggcgcgctcgccgggtcgtcgaggaagacgacgccgtcgacgaggaggcgtcggtgctgcaagtagggcaggaggaagaagcagagaagctgctcgacggacggattgaacttgaaccccggggagagcccctgcgactccgccgccgtcgccattgacgcagttacaaatcgctcccgcctagctagctaggtttgttttttttttctttttctttagaaaaaaaatcatggagaagaaataaccgttatatcgggagaggttggacttttcatcccgattcgggctcgacccctcgtcgttccgactccgaaaccgtccatggcccgtacttttacatctcggtcgtctctcatctcgtcgcccagtgagagcagcccacgccacgataggtgtggatagcttttttcgtaatcctattttagccttatattgcgttcttattttttaatatacgatgccgttgattttttatatatctttggttatttatcttatttaaaaaattatgtgattattatttattttactgtgatttgatttatcatcgaaagttctttaagcacgatttaaatattttttatttgtacaaatatttttaaaaaggatgaatgggcaaacatttataaaaatacaacggcgtcatatatttaaaccggaggtaatataagtttaggttaaaatgaataaaaaaaaagcccactttatttttgaaataactcaattttgtagcctaaaaatttaggctctttaccacccctagcacacgatcaactgaatatgcacacgtgcgtgtagcctcgcgtgggttgagcataaaaccacaatatattatttggttgctcgtattcacatagttggactcatcttacttacttacatgtacacttcgccatgttcactaaaagattattgttttagctaatcaaagatatattaatcaagggattaaaagataaaaacattattaatcaagagattaaaagattgctatgctttcattaatatgcagagaaaataagttcagggagaaaacgaggaggagagaatatatatatatatatatatatatatatatatatatatatatatatatatatatatatatatatatatattgatggttagaacgagaaaaaaaaagttctacaaaaatagtatacgtgggacaattcttggataaaaatataatcttatattgtctacataccgcagaacggataaaccatcggtctcaagtcgaacgaccccctaatttgaccatcagcctcaagatatgtcgctcacagtgaatcggcaaccagacactggtggagaagtggtttttactcccggttcgtaacccccctttagtcccggtttttcaaccgggactacgaatccgggactaaagatcgctatctttagtcccgggtgaaataaccgggagtaaaaatcgatctctagtcccggttggtaacaccaaccgggactaaagatactttatctttagtcccggttggtaacaaccaaccgggactaaagagggaataacagcagtacagatggtcctcttttttcttttttattttctcccgaatcaagtgggatgcatatccccaaatcccaaatcaaagtaacatcccaaatccacatcacaaatctttaagttacttatacacataaatcaaatacatcacaaatcctaaaaaaaattacacaaatcaaattacatcacaagtctacaaaattcatcgcaaatacatcacaagttcacatcacacacaaaacaaatac

SEQ ID NO: 61950 - DNA, 5982 bp, Oryza sativa
  unsure (1)..(5982): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttaggttgtgttctgatgcaagatgggaaggtggtttcctatgcatcttgtcagttacgtccgcatgagaactaccctactcatgatcttgagttagctgcagtggttcatgcgttgaagatttggcgtcattatcttttcggtactcgtacagaggtgtacacggatcacaagagtttgaagtatatctttacccagccgaatctgaacatgagacaacggagatggttggaattgattaaggattatgacatgggaattcataatcaccacggaaaggctaatgttgtagcagatgctctcagcaggaaaggctattgcaatgctacggaaggacaacagttgccatgggaattatgcaaggaatttgaaagactgaatttgggaattgtcagtagaggttttgttgcaactttagaagcgaagcccactctcattgaccaggttagagaagctcaaatcaatgatcctgatattcaagagatcaagaagaatatgagaagaggaaaggctatcgggtatttggaagatgagcaaggaaccgtatggttgggtgagagaatctgtgtcccagagaacaaggagttgaaagatgcaattctgaaggaagctcacgacactttatactccatttaccctggtagtaccaagatgtaccaagatctcaaggaaaaattttggtgggcaagtatgaagtatgaagtgtgagatagcagagtatgtagctgtgtgtgatgtttgtcagcgagtcaaggcagaacatcagaaacccgcaggtttgttgcagcctttgaagataccagaatggaagtgggaggaaatcggtatggatttcatcactggtctacccagaacgtcatcgggccatgactctatttgggtgatagtcgacagacttaccaaagtggctcatttcatcccggtgaggacaacatatttcggaagccgtttggcagaattgtatatggcaaggattgtgtgtttgcatggcgttcctaagaaaatagtatccgatcgaggtagccagtttacttcaaagttttggaagaagcttcaggaagagatgggttccaagttgaacttcagtaccgcttatcatccgcagatagacggacaaaccgaaagggtaaatcagattttggaagacatgttaagagcttgtgctttagacttcggtggaagttgggataagaatctgccttacgcggaattctcgtacaacaacagttatcaagctagtcttcaaatggctccttatgaagcgttgtatggtcggaagtgccgcactccgcttttgtgggatcaaacgggagaacgtcaagttttcgggactgatattctgagggaagcagaagagaaggtaaagatcattcaagaaagattgcgtatagctcagtctcgtcataagagttatgccgacaatcgccgcagtgatttaagttttgaggaaggagatcatgtgtaccttcgtgtcacgcctctccgaggggttcatcgtttccacaccaaaggaaaattggcaccacgtttcgtgggaccttataagattgtcagtcaaagaggtgaggttgcttatcagttggagttacctcaatccttggcaggtgttcataatgtgatccatgtgtcaaagttgaaaaagtgttaaagggtacctactgaagaagctaatcttgaacagatagaagtccaagaggatctgacatatgttgagaaaccaatctgtatcctagaaacagatgagagaagaacaaggaatcgagttatccgtttctgtaaggtccaatggagtaatcactcagaggaagaatctacttgggaacgagaagatgaattaaagtcagctcatctgcatcttttcgccagttcttccgaatctcgaggacgagatcctgtttaagggggtaggtttgtcacaccctaaaaatcccaaatatataaattgttgtttaattggaattattagaaataattttaaaagcctagaagaaaagatctaattttaaataataaattccaaaataaaagtgggctagataaaattttattaaatactttacttgattctatagttcctagatttttctgggatttatttgagtcaaggaagtatttttaataaatggaattgcatttcatgaataatttaaattgaaaaagttttaaaagtcttctttttggctttgggccaaaagtcggcccaaaacctatctctctctctcccacctgtcaggcccgtcacctacctcgcgccgcccggcagcgccctagctgcccgagccgccgccgcctccttccaaattctgtcgcccctttccttctctggccaaatcgattgaggggaaatgatccccgggatcccctctatcttttctcttttggaatcgtcgtccaatttcgtttggaaatagccggattcgatctcgaatcggattcgtctctctctcccgaaccctaactttccatcgctgtcgccggtcgccatgggcctccgtcgccgccctctagcccctatttaaggacccccgggacctcctctctccgccgccaccatcgccttagcccgccgccgcctgtagcgctgcctccgctagaacccgtgcgccgcagtcgctgccgcttgtccagccgtgcgccgccgtcgctccggtcgtcaccgtcgctcgggaaggccgctgttgggatcgccaagtcgtcgccgtcctcgtcccgccctccgtttctgccgaggattgccggagcactgccgtcatcgttgacccgatcgtcgccgccgcttcatcctcgtcgccgtcgccgtccggttgccgtccaccgtcgtttgggtcaccggtgagttcgccgcgtcgccctctacgcgtagataccctccgtttacgccgccgcgccgtcattcaccggcgagcgtgcgaggccgagtcgccgccggtgatgacgtcaccgctgacgtcgtcgtcgttgtttccccgtagaccgcggtagatcaagttgtctcggccgtccgttttggataggatagatctcggccgttcgttccgtagaccgccgccgtgcacccggtccaccgtgagccgagcccgatgacgcaataattcatttttccttttcaaaaataattctatattgcgtcataattcaattaaaatctatataaatgatttaatccgatttaatctttaaaaattcataactaattcatcttagctcggatttagttggttcaagtctctaaatttttctaaaattgagatctacatgttaaaaatatccacatatactgttcatgcttttttatgtgttgttttggtgattttgctcttttctgtttagattccgacattcccggagagtccgatttcgcaggagaagaatttgaagagttccaaggccagcaaggcaggtcacacagatcccaaacaaccctttgagcatgttgatcccgtttaaagctattgtttctattcaactattgcatttattttcgaatgtcattgggtggagataacctattgctttgttatagcccttttgttattgattacctattctttgtcacttgggtaataatatgattagctagaacattatatggttttagctaaagtgaataggatgcttagccatgcttagagacactagctcatataaatgggatacttatgattcattattatttaatcatggtttaatgatagctcacgatggttaatctgattggttaattaattaatttgccaactaaaacctgataaaggtgggttgtgagcacatggttttgatggtcgtgctcatgacaattaaggaccggttcacgattttcggttgtgaaacatttaccgtgccaaccacaagccagcgtgggcaacggctttattttctgtacagtatggttcattgtagagcaacagactgtgaagtggcggaaataagcccacgggggtcgctggggagtccatgccttgtttacaagggggtgattatgatccgggaacggtgcactgctttgaattgtgttatatagagggtattgtcacaatctctattcgggtacttgttaagtatcgcgatgcatggttgacatgatgttgaggttgtgtcttgtgggtacagtggtacacctctggccagagtaaaactattcgaatagtcgtgcccgcggtgatgggcgggtttaacaatgtctttcgtgattagtattacacctctcactataataaatgatgctgtaattggtaataatttgtttagctcctggtttggaatggtatattcctggtttgctgatagaagccaggattggttgttcagaatggttgggcctatgcaacgggtatgttgtatagcgttgaattaatattgtttaattaatactttactgttttattaaattctgaaagatttattaaatgctatttatgcaaaatgagactatattatgccatcctttgctatcctttgcacttgcatatttgctgcatggcttgctgagtatgtcatatactcaccttgcaatcattcatcagaggaggagttctacagtgatgctgatggtgtggaggattaggtgtagccttggtcaagttgcctgtggagtggagccgtctgcgccgtttattttattttccgctgcttagatctttattgattgagaggaactatctacctctgtaatgacattttattcgcttattaattagagtaataattgtactctattatcaatttgttattgtgtgcctcggctgattcctggacgagggtttatacacatgtaagcgtttgaaattttggatagaaattccgggcgtgacaagtggggtgtaacatcccggtctagggcttaataggattaatagaatactcatatcaacaagttgcaacttcttttctggaagataatctccaaagaactccagggttaagcgtgcttggcctggagcaatttaggatgggtgaccgaccgggaaattcttcgcgggtgcacacgagtgaggacaaagtgtgcagaaaagacatgtgttggtctgtgagggcagtctatgacctatgaaagctatcaaatgtaagcgggcccggcctggggaaggcgggacgttacaaaatggtatcagagccgactctcgcggtttcacgggcgcaggcatggtgcgcatgtctggtgtagaccgggagtggttacacagcatggcacatgcgctggcactggacacatggacgtggccaagagaggacgttcctggcctagggttgatcgacgggggcgtcgatctctcttaaggggggtgagggtgtaacatcccggtctagggcttaataggattaatagaatactcatatcaacaagttgcaacttcttttccggaagccaatctccaaagaactccagggttaagcgtggacaaagtgtgcagaaaagacatgtgttggtctgtgagggcagtctatgacctatgaaagctatcagatgtaagcgggcccggcctggggaaggcgggacgttatagccccttcgccgctgccgaagaccgccggagcaccgtcgccgtcgtcaagccgaaggtcgccgccgcttcttcttcgtctccgttgctcttccgccgacgttttggtcaccggtgagttcgccgcgtcgccctctacatcctggtgtcctccgttcgtgccgaagcgccgttgttcgccggcgagtttgcgccgcccgagccgccgccggtggtgacgtcatcgacgtcatcggggccgtctgccgtgagcccacgtagacccgatcgatctcggccgtctgttttggatggatcgatctcggccgttcgtttccgtgaaccgtcgccgtgcgcccggtccaccgaaaaccctagccgctgacgcaataaa

SEQ ID NO: 61951 - DNA, 2945 bp, Oryza sativa
atatctacccgggccaccggctagcctccaatcctgtcgccggccagccaccattccaccgcctcccctccggccggatctggcggaggggagggcgaggccgccgccccgcgcccagccgctgccggccggcctcccatcccgccgccccgcgtcgggccaccaccggctggcctccatcccgccgccccgcgcccagccgccgccggccggcctcccatcccgccgccccgcgtcgggccgccaccggcctcccatcacgccgcccgccagaggggaggagaggaggggagggggccataggagaggggaggaggagatggggtgagagaagaaggaaggggatggacagagagcaggacttagcatgcgcacaagggggctcgaggctttttttcccggttgtttaacaaccgggactaaaaatagatctttactccggttggtgttaccaaccgggactaaagataatagaggggtctgacaccgcatcccatttattgaaccgggactaatactccctccgggctaaaaatacttgccgttttagacaaggctaaggtcaaactttagaatctttgattataaatcatttttaaaatatttctctttcaaatatgatgactacatgtatagattagtcttaaaaagtagtttaataaaatcatatatttgttaacacttttatacatattataattgaaaataatggtcaaggttgtttttgaagaccgtgcccttgtcaaaaacgataaaaacgacaagtattatcaacccggagggataatgatttttagtcccaccaaccgggactaaagatcaaaaaatactcattggcttttgaaccgggaaaaaaatgatttttagtcacggttttttgagcaatgggactaatgtggtttttgaccaaccacaaaaaatggtttctccaatagtggaaaaaaggaattgatgcggtaaaaaaatagtaaaaatttattgatcttgtttaacatgccaatagcatgttaggccttgtttagtttctaaaacaaaaaattttcaccaatcacatcgaatgtttgaacacattcatgaagtattaaatgtggataaaaaaataattacacagtttgcgtgtaaattgcgagacaaatctttaagcctaattgtgtcatgatttaataatgtggtgctacagtaaacatttgctaatgacggattaattaggcttaataaattcatctcacaattttctggcggaatatgtaatttgttttattattagactatgtttaatacttcaaacatgtgtccgtatatccgatgtgacatccaaaacaatttttttaactaaaccgggctactgtattcctagctactaatttactttagatgatgtggcacacgtatatcgctagcggccgacgatactaaacctgctcttagccgaaagtcctaaggggcgatcgatcggtcaccctccccacattgatcaccacctcctccacgtggtttccttttttgacatcaccttatttttctattttagtaaatttatacacctaaaatttgtacacctcaagtttacacatctaaagtttatacacctaaagtttggagacccaaagtttagaagtcaaaagtttataaatccgattcaaatttgaatgacttcaaatatttttatatatagtatttctatacgtctaaagtttatacacctatagattatagtttatagaccgaaagtttataagtcaaaagtttacatacccgattcaaatttgaatttaaatttaaatattttttatatatagtatttctatacatcaaaaggttatacacctaaagtttatagacctaatatttataagttaaaagtttacatacccgattcaaatttgaatttgaatttaaatattttttatatatagtatttctatacataattttttccaactttgtttttttatttttttaaaaaatttatggtgtagtaggaagagaagaaggggaggaggaagggggagagagcgtatattggggatggggatcgaatcacccattagccacacccgctcttagctggtcagatacgtacgtatttttgtatcagcccagttaacaaacaccggtggagaagtgatttttactcccgtggagaagtgatttttactcccggttcgtaaccctcttagtcccagttttctatctttagtctcgggtgaaataaccgggagtaaaaattaatttttagttccggttggtgttaccaactgagactaaagatagagcctttttagtcccggttggtactaaagaatgagccaaactagatctggttgctcctttattcttttcttttcttcatttcattatttttaatatattgatttcactccatcccgcccccaaaatcccaaatcaatcatccccgaattgtaaaatctcaaatcgattatcacctctaaatcctcaaatcctcaaatcgatcatctccaaatacatcacaaaatcttaaaaaaattacatcacaacttctacaaaattcatcacaaatacaatacataaatcaaatacatctcaatccaaatcacaaatcctaaaaaaaaaagaaaaaacctaaatcggcacctaagcccaccgccgcccatcgccgcgcccccacgaggccgcccggcctaccgcgaggcggcccggagcatcgcccgccgtcgcgtcgccgcgaggcctctagctgctgccacgccagccgcccggctctccgcgcccggccgccgcgcgccgccactgcaggtggggaggaagggggagggagaggaggagaggaagagaggagttgaaggagagggagaggaggagagaaagagataaggtgtgagccagcggaggagatagaacccagagggaggagtggcgatccgatccgcgcgcatgcctctccatgtatgttgatctttttt

SEQ ID NO: 61952 - DNA, 11584 bp, Oryza sativa
ggaaaaaaagagaataaaatttggaaatatactgttcattcattttatttttagaaatattcaggattcaaaaattttaaaaaaaaatataccatcgatttcgtacaaccttgcgcgaaagtgacgtggcgtgacgtcgcgagtgaacaacgcgaaaccgcgcggaccgttcggtctcgccgaaccaatctgcgataccggatttcaaaatgattaattagtgactaattatcatgattagcaattaattaattaattaattattaatctctaattagtattagttaaatagttaattacgtcattagtgactaaccaaagggagcattggtacggtatcgcactctttttcagcgataccgcttggtctcgctcgttcttcccgcgagagcgcgcggtctcgcgccagaccgtgctatggcgcgagagaccgggcggtctcgcattttcattgtgcgagactgtctttaacgtcacctcctcgtcattttcgcttaatggtggtgcgagatcgacggtatatttttgaaaaaaattacatatgtgcactatatttttaaatttaattcggaaaaaagatcgatataacataagctttactcccggttagtgttaccaaccaggactaaagataaaaaagtactcctgagcttttaagctgggattaaagatatttttagccctggtttttaatacaaccgggactactgtgaaatctggtcgaccgaccaaagatgggtttctccagtaatgaaaggttgacaacatggagacttggtgtcttgacactgcaaccatactgtacccaaaatcacacaagttaagattcaagaactatatatttgtgcagttacatagcatcggaacaaatttacaggtaatatatgtatggaattcataaaatataagtatagcaacagcacatgaaatctgatacatccctgaggactgagatgcatggggttcgacagccttcagtcattagtgtcagtgatatgctccagaagcaatcatagagatgattacattacatactatgtttacatatttatccgactttgttccttaaaatagataactcattattggttaataaatgtgtgattctttcatgagactctttatgttgtttgttactatttctaaaggatccctgatcaaatatcatatgtggaacaaatatgtttaaatgatcagcacatgtattaattgatgatcatgtcttatggatcatgatatagagataccaaattaataatgtggacacttgttggggaatatgttattggaaagacccaacatgagacactgtaagagccatatgtgttgtgtcatcagtgatctcatttagtgttggtgttgaatccttagacctgagattatcatggttcccaacatgtgtagtagattacttaaggactgctaaacgctactccgtaattaggtagttataaaagtagttttcgggtatgctgtgaaacatgtagtgggatatgaataatcaagatgggatttgcccctcctatagagagatatctatgggctcctcaatgttgtagattatggaagtgcatggccatgccaaaggtggttgaggagtcaatcacaagttatataatctatcacaggttcgattgaatgattgagctattagaggatggcacatatctaaccttgagcttaatcgatatcatgaggcaaaggggttcatacaagtatacactagagattcagccgatgtgatctttatgtatgcccggtgggtcaatacgttctgctagggaccgttgttgacacgtagaccgaaaaggagtttttgggttacagccgagtgtacatgaacctacagggtcacatgcttaatgagccagaataaggggattggatggagatccaatatgctcttaattcagatagggatccgaatagggtcctatggacctttggaggcccgttatgtatcctatatattcgtaaggggtgtgattggcggattgattgcatcacgtgagaaaccctagccgccactcccctccccgagcaaaaccctagccgcacgcgggtgcgagcacatctgcgcgtagcgttccgtccttgtacgtgtggatagcagtagaggtgccgctggtttgcggtgctgatcagcgtgggagtacagcaaggagaacgcacgtggaggagaaggtcgagccggtgcgatcgactacttcctacgcgtaggggtggaaacgagccaggccctggctcggctcgacttgcagtggctcgtgacaagctaggcttggcttggctcgactcagttaggaaaacaagctaaaacttgagctcggctcggctcgtttcctggctcgtgtagttattaaaaaaagcatgaacaaatcatcaacatgcaaaatttaaataagtttatatattaaattcttcaaactcttaatgataaatttcaagttgagaaataataacaccatgaaaagtaaaataatctttataaatgcataatggcctaggctcgtgagccaaaacaagcagctcgcgagctagctcggctcggctcatttcagtaacgagctgaaaaggtggcttgggcttggctcgttaggcttacaagccgagccaagccaaccaaactcgagccaagcccgagctgagctcacgagcccgagattttttttccacccctatcgacgcgtgctacttcgcgggagttccttcgatttcttagcgccttcttccgatgcgcagcgcgtcaagtggtaacgatctatgatctaatttttgtatggttaatggcttacgcgatagaaaattttcatttacgctatcgtagcctacgcgtatcccatcaatttggtgacagtttatcccaaagattaccagaatgtacatggaagcgtcagaagaacgttcacctcaaagatttgccagagcgtacaggtatcttgtttgagcctccatcgcgtccttgcaaccttgcctgacgaagacgaatggcttgaagtactatattgatttctgatgctaggggactagaagctccaattgtttgcacattcgaggtgttggtgttttgccaacctgatacctaccattccccatcagttcttgtcctataccaatcttctcttgaacacatgtcttccattttctcatctaattaacaggtacacacttagaggacaaagaaaaagagaagaatgcgacaactattttctagttatctttgcatatgttctatttatagctagatagctagtgttgaatttataagcacataatgatttaatttattctatataaatcataacattgcagatataatttagcatgaagaacgcatcattaaatctacatatgtaaactaagcagtaaaacatgaatagatctaatatgcgcaacatgttgataacgtaccgagggtaccggaagaccggttgctcagcaggaattactcgcggttgcggacgtcgacaacggcgcgcagtacgcgagcgaacaggaagacgagccattgtggtcgaacagggagcagtcgtgcgaagcgcttcccaaaaaccttattgctgccttctcccggtgcgggacgtcgaaggcagaggttccaaagacctgctctcccgatcaccatgcacgccgacgagcggaatggagtagactacgagtgacagtgcagtacataggaggagacaaacccttaattttaaggaattgaaaattagtttttttaagagtagagtgggtgaattgaaaattagtttttttaaagagtagagtgggtgaatctggccaattctagcttcaatgaaaatccttaaaattgaccattagaaccaaatccaatgaaaaatagttttcagtcaggtgtttgtgagaaaagaggggtgaggaattgaaggaaaaagtatgaattaccctcgaactattgcggtcgtccgaattaccctcccttaacccaaaaaccatcattcgttcaccccgaacttttaataccggacgaaataccccttctcgacccaatgcaaaagcggttttgtcctacgtgatgtacgcatggcaatccagtcagtattttattataaaaaagtgctggggtccacctgtcatacatcctctttcctctccctcttctcctctctctctctcatccacaagcagagacgacgggtatgggcggcggctggaggaggcacggcacgcggaggaggcggtgctggcgatggccgagatggagaagaccaagtgtcgcgcggccatggaggcggccgaggcggcgcaccggctggccgacctggaggcgtagcggcggcgcaacgccgagaggccgacgagaaggtccgcgccctggagcgtgtagtccgattgcctgcgcttgaacacaaggcagacggcggaggcgaaggctgcgagcgcgaggaggaaccaggagcagacgcagacgcaggagcagcgggcgtggcgggtgtagacgtgtagtgctggaagaggcgcgcgttctccggcggcgggatgcggaacaccttgtccttgggcatctgcaccacgtacgtgtctagctacgccggcggcagctgctggtactgccgcgcgtcggcgggcggctgcaaaatcactgatgatgcaagccatcgactgcaaattaaggccatgcatatatacaagtgtgcaagttagctctcgacaaaatcctttacccaacattccaaaacacgagctttgatcaagagaaaccaatctgctacatatgcagcacataaccacattcccaaagtccaaaacgcggcgccaaatcagatcagaaaattcagaagagggcagagacaaaaaaaaaaaagaacaaaaattccggcacgccgtcgcccatcgatcccgtggagccagcggttcaggatctcggcggagatcaccacggcgctgctgttcctccaccagaccaagccggagccgctcgtgcactgcgacctggacctcaagccggccaacatccttctcgaccgcaacatcctgctgcaggtgctgacgagtccgccgccgacggactcgtcagccacactcgtctactccggtgacgagtctgccgcccatccccatcatccccgcctctccgccgccacccacctgtccgcgccgaccggccccacccaccgtcggccgcaccgccatgcgcgccgtccgctgccttccccgcactgccgtgcgccatgccatgctgcgccgcctcggccgcctccatggccatgcggcacttggtcttctccatctcggccatcgccagcactgcctcctccgcgtgccgcgcctcctccagccgccgcccatcctcgtcgtccccgctatagatggccaaaaggcccgcccgacacggcccggcccaggcacggcccaccagccatcgggccagcacagcccgatcggcacttcgtgccgggccgtgccggctcatgggctgtgcctcccgcccaggcatggcccaccagccgtcgggccgtgccgggccggccgaaggcacgggtggcccatcgtgccttttttaaataagtctattttctatccctcctctttgggatgtgacatatatatatatatatatatatatatatatatatatagcgaaaacaagtctaatttcggtccctccactttgggctgtgacatatattagtgaaaataagtctattttccatccctcctctttgggctgacatatatgtaggtaaaataagtctatttaacgtccctattctttcgaccgtggcatataatatgtctatttttactccctattgtttatgtgtcgggcctggcctgcggcccatcgtgccatgccgggccggcccaatgtgtcggcggagaggcccaggcacggctcggtggtcgggccgggccggcacgggcccgacccttaacgggccgtgccgttcttgggccgggccaaaacgccgtgccgtgggccaggccatcagacctcggcccttttggccatctatagtccccgcttgtggacgagagagagaagagaagaggaagagggaagatgacatgtggaccccaccatttttttaataagaaaatgctgactggattgtcacgcgtacgccacgtaggacaaaaccactctggattggatcgagggggataatttgtccggtattgaaagttgagggtgaacgacgtctggttttcgggtttagggggtaattcgaacgaccgcgatagttcgagaaggtaatttgtaatttttccggaattgaaaaggctagtggttaccacttggcaaattctccatctttcttctgagttcctcttcttgatattcatcctgcagagtaaatggaagggtattctgtatatgtgtttatcattgcttcaactgaaaaacaagcccgggttgcctccttgttcatgctttatcttttttttcctgttttcaagtttgtttggattggactctaatttttaggaaaatatccactaaacttataaattgcaaatataatttctgtataaagtttatatatataaagtctagaaagattttaaaaagtttatatatactttttatattaaaaagtctagggtacacaaaagtctatatgtagaaaatttggatggaaatagttcatataaaaaagttttcgttaaaaaagagtaataaaaaaaggaaacaaaaaatttgagtggaagaaaaagaaaaaacgattcttatgaccatgatgaattactccctccggtttgataatacttgtcgttttacataagggtacggtcttttaaaaaacaacttttaccattattttttattatattatgtataaaagtgttaacaaatatatgattttattaaagtactttttaagactaatctattcatatagtcaccattttaaaagacaaatattttagaaatgatttataatcaaagattttaaagtttgacctcacatttatgtaaaacgacaagttataagtccggagagagtacgagagaataaggtacgtaaaagaggaaaaagaaatgaagacatacataagaatggagaaagaaaattgaaaacagcccatgcggtctccaaccttgaccagttcgcgataggctagcaaggcacagttgctgcgaattttttttatttttaattttttttattaaaagttttacaaaaataatttttcattttgaaaattgacagaagtggtcgcctaccgccctctgggagggcgatttttaaaaatcgccatcccagagggcggcgaaagtgacgtggcagacggccgttcgctctcgggcgacggccgtcaacgaaatttgcaggcggccccctttgccgccctccgctagcccgcccccggggcggcaggggggccgcctgcaaatgggcggcggggggcctggaattttgcaggcggcccccttgccgccctgggggagggcgattttatactgtgctttatattttttataaatatcaatagttatcaaatttttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcaaaatcaaacacaagtactattcaaattaccaaaatattggtagggcatgtttttggtagaaatccaaataggcccttagtcttacgcatacaaaaaatcaccatcataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttatgtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgttgtcgtagaactggctagtaggaccagtcctaccggcgtgagacgaagaggccccagtaccgaagatcccggctgcaaatcctgctggacaaggaccatcagtttcatacatgtatttaatagtattaataaaaagtaaagtaccgtgtgggcgagggatcgacgctccgtgagaggaagaggtggcgaacgcgcccgaagaggtggcgaacgcccctgcggagctcgcggaagcgccggtcgtgcctgcgaacacgctcgaaggcagacgaggtcctgcgatgaggaaacgtgcagttaaaacatggtgacatattcgtgcaaaagctgaaacaaaaatgaactaatctctgggctgaactgtaccgtgtgaaaccggtgctgtaggtcgcactgctccgaagctaggggcgctcgaaggcaaacgaggtcctgcgaggatggaacatcaagttacgacggggtgatgttttcgtacaaaaacataaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcatccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcacctgctagctgtccccgtcgagtcaacctgtgaagagaggtaaattatatggctcgatgaagtaagtatcataaaaatttagaaatgaacaatccgaactcacgagtggtcggcagggaggacggtcggctgcacgatgcccggaaacacctacctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagataacgtcgctcggctggagacggtcaaactcgaacacgaagtccgggtaacctcgtctcacctgtacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgtccaaccccgtagggtgcgctctccaccactggtcgacctatggcaaacctctcggctgcccaaagctgaagcaacatagggcagccagcgatgatcgctcccgcgtcagtcttcgtgcacgcctcaccgagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcatcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacaggaggaagggtgttggccggtcctaggtgtggaaggtgcatcacctgctcgaagcgcgcagtgatatcctccttccacccaacaacaccgtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccgcctcaacaagcctacaaagtggtagaaggcctgccgcacgcaacctgtgtagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaatgagctgtggttcctgtcaatcccacggttcaacagcgccggtgtgtcgtacgccatacagcatcaaatagattggtcagaaacatataaataattagtcaacataaataataaatgttcataagcgaattactaa

SEQ ID NO: 61953 - DNA, 6153 bp, Oryza sativa
accttccacgcactaaaacggagtaatgcttcttttgcaaaagacgcaccgtttatcaatttaaaaaacgtgcacaacacgagcgaagtgagttgaaaaaggtagggggagaaacccattagattaaggccattgaacggtcggatgcaagggagtgagtaccaccgctgccttgcaacacgcaagttggttatttagatgattcgtcttcaagaatccttgagataggaaggatacgctccgaagtttggagctcagatgaacaaagcgcattgcacaaatgatgtacgaaggatgcttcacagggctggtgtccatcatgcaaagcattcatcgagctgatagagtgatagttgagaatcggcgttctgggaaacaattctaaaagacagctctacacataccgaaacacaactagtacaacacaaagcaaaacaaaataacacaacagcatcaggcaatacataaacaggaaaagaaggatcgaaatccgggcaaacagttactctcatctcatcaagataacaataccctattggcatcagttctatcagaccccgaagattttatgcgatgcaagaaaagaagaaacgcaataccacgacatgactgagtgccaatatcatagcgtgatgtggtaccgtgaggagaagaaatgatcccatcagaactcatggaatcaattaaattttctaggtatatgacattctgaacaaatcgaggctctttgttcaaaatagaacattttcaaaaaggcaagctgaacgttaggtgatataaataactttcccaaagcatcttctctagcttacacaacagaaagcaatgagcatctatgtaaaaattataatcactcataaccgcatacaagcaaaatactgaaactgtccattggaacatcacctaacatttaccaatgtattgtcaccaaaatcaaaatagaatcatcaaccatgccattatccccatgatataactcaatcagattgtacaaatttaggcgcagacttgtcacaaagcattgttagccagaacaactgtagtctaaaaaaacataaacagccaaaccacaatcccacaatacttgatgcaaaacatccagacctaccactaaactgtctaagctcaacactgaagtaggataggacaattacactttttttaatctatctaagatttctacaaggatcatagtgcagccactgattgcaacaactaaaagaatgaaataagttacttatagacgtcctatttcataattttgcattcggattcaaatccaacaatgcaaacaaataagcagctagccaattgaaccttaatactttaagcataacataaacagctaacatacataacagtgcatagccaaccatgtaatccatccaaccaaagaaaccaagtgctaccaatcaccttgcacaccatgaaacaaacaaatcgatacctaaacactaatcaggcaacctatcgcaagttgcactaccattaccaaagaattgcctaagattacagttgctaaattttgatagccatgcgagttagtagacctaattaagttgcaaatcatgtccgcaaaacactgttgggcacatcgcaatgaatcaccgctggaaatggaggaacatggaaaacaaatcgcatctgaagcagtgtaattcccaaacaaaacttcaaccagatctatccttggcatgacttcataacacatgagcatcatcatgtcttaattttaaactcaatactaacaaccaagtcttcatggacacagataccaaaaaaagcagatatagattaacggatgatagcaagaacaagaaggcgcgcctagaagcggagcttggtgaagaaccacctgttcttgccggtcttgaacctctcctcgaggcgagccttggcggccttgcaggcggccaccttcttgtcgcgggtggcgagggcgtcgggtcccccggaggccacgtccttgaagtcgacgtcgagggtgtagcgggtgggcatgatgtgggtgaagttgacgagcttgaggaagcacttgaccctcgacttcttcgccgtcttcttcgccgagtccttgcggatcaccttcttcgggtacttggcgaggccggcgacgaggcagtggccgtaggggcggtcagggtgccctcctggaacacgcgcacgatcaccgccttccgccccgcgtaccgcccctgcagcaggatcaccgccttccccggcttcaggaacttcaccatcgcggcggctgtacggatctccttctccttcgccggtgtggttggtcgccgccgccgccgccgccgccgagctcacctctgctgctgctgcgccgccgccggatggtgttagggttcgcggagaggggagggttttatagtcgggatgcggcgaggctagggtttgaggtggggaacgaatggcggatttgcccctgggttgcggatcgttggatgtgaatcggacgggtgtttcctgggtaagttggtggtggggccgaggtggcagtgggagattgaagggcgagtggagggggtaaaatggggaaggttgagcgggtgcgctgagatgggctttgggcggagaaataggcccaataagacccatataggccgacctatcggtctggcccacttgtcggacggacggcctttcggcgcctgttagcaaagcagcagtggttatgtacagattatttgaaagagtactgctatatatacgactcaggtggtgattgaatcttctaaagatgaagttgaagattaagtgttttacgcaaaatgaggtggtaataatgtgtgtttaattgagttttaattactacaaacttgaaaaatggattaatctgatattttataacaactttcatatagaaagttttcgcacgaaacgcaccgtttagcagtttgaaatgcgtaccgcgaaaatccaaaacttcatctagtctttgtagaggaaacgaatgtggcctcaattgtacaactcatatatataactagatatatgcaacgatagattaatcgaaggagagcatgttcatatgcactgcaaccttttacagccgtcgatcaaattcagtcggatagttgggtcatatgcatagcaatttcctatttgaaattagcatggcatgtttagataagtactaggagtatttgttttctgaatggcagatgaatttaaattgctggagtcccaagatgatgagattgcgagaagggtaggggatgaaggcatgaagctgctcgatggttttttttttctttgggtggttgtgtgctaagctgaagttctgcttttcgatctgatctgggtggtgatctgctttggatcactctgggattgatgtctatgtttgtttttctctttgcagtagttgattagttggttgtaagatagttttcgtatatgcctgaagtctcccccaactatggttggatggcacctggtcaggtcgttttcgatgttgttttaaatcctctgaattttttgtagcttccgtttctggtaatagaaatggggagagcttggctctcctagttaaaaaaaaaaaaaaaaaaaacttctgaatgatgtccagtggtgttgggttgaactagtcagtgccaccgatttttggtttgaattttagtttgatgtcagaatcatgtttatgtactagttctccaaaaaatttggtaaggtaaaagtatttatcgagcgttcagtttactattaacaaactacgcgaagcaaactaggctgttattttgcttgcctgtccctttggatgtgctcaaatttgtgcctatatttgcagtgtttctgataggacttcccttcttttgttgaaataaaacacaagttcacaggagctggaaaagatcacaagtttgttatgtactcacatacatgtaaataccactgtaaaaggagtgacactgtaaaaaaaatattcgtttcagtacacatgcacaaacatatggttggttcgtcagctaattcagtgccagctccaagctttggaatctctgaactgttggtagcattttgagttcttgttcttccacctccttgactttgttgctccacttcgctttgctgttttcaacttgttgggttgtcaaacatccgttctaccggttttcctctgctttggcacttccttgatgttttcgcttgttggaaaagaggcgactcatcttctcttggttttttttttttttttttttttgcgggctatacatcttgggacaaaaaatcccacctcatatcattcgaattttaaaccattggatatgcttcaagatttatgcagatccttttaaccctagctcctctcctcctcctcccgattcagatcgcacaccaccaccactcctccgtcctcgcgcgatcctccgccgccaccgccccaccgcgccgccgcccgcctcgccggaaggggtcaacggcgccggcgagccccctcccccttcccccctctccccgttccctcctctcctcgaggtgcccccgtcccaccgtcttccctgtctccggcggctccccgccaccggatccaccacctcctaatctcatgctttgtttgcccctgccgccgacgccggcccactgccttcctccatccccgcggcttcggcggcgccgccgccgcctcgccgcctgccggagtccaccacccaccgccagtcctccgcccacggccatccctctaagccccaaggaaaccccccgcttccccctccctcaacccccctcctaccctcaccccaaccccaaaccctaacccgccggagttggggtgtcgccagcgccggagaagaagggagcccaccggagttggaggagagaagccgatgcatgaatcttggcatgaatccaatggtccaagatctgtaagatttcttccccaaatttcattcgaatgccatatagcaatccctttttttttcatctgccttagtggcacaaacaagaacatggaggatctttaatggcatgagactatgagagtgaactgtgaattttacagaagttttgatttgttactcgcctttcaagtttggcagagtagatcacacaggtttaaaaaaccaaggctaataaaccacgacacattcaagcaaaatctctgtcagaaaccgtgcaaaactgaaccttttatgtattacgaagttgacatgctcggatagcttcggtctccttcagacaaaggaacaaaaaaaaattacagcaattctctgcttcaaaacatgataaacccaatcacctcccatgttattactactaattattgtttaattttcctttcgctctatctcgaattcattcttcgattctaaagaaagaaatcggtgagaaaccaaacaaacaatacatgagccgagccgaggtgagcgattcagtgcctcccacgcttcttcgcgggcttgcagtcgtcgtcgtcatcttcgaagccggacacctcgtcgtcgtcgtcggagtcttcgtcgaggtcgtcgtcgaactccccgtcgcttcccatggcctcaaactcatcgtcctcgtcctcgtcctcgctctcgctcaccgccttcgccttccgccccgcggcggcgtaccctctccgcgcgtgcagcgccgcgggggtcgcgcccgcggggtggagcaggaagcgcgccacggcggcggatggcggcgccgccgctgccaggcggggagcggcgggcccaacggcgagatgcgccggtggtgggcgtggggcggccgcggcgaggcggcggagggcgagggaggcggcgcgctgcatggttgggggttggcggcggcggtggcggcggtgggggtgagtgggagggtggcggctagggttttggagcgggatttgcgcgagggctggggatttttaatggcggggaagtgggagggagcgcgggcgtggctggaagattccagagaccgcaagcggctcccgcgctctactctgatgatctgatctggtcgccgccgccaccggcgtgcgtgtgcctgctttttcatttttcttttcctattcgggctttgttgggccggtgaatgcttgttgggccattgaagatcaggaacaggttagattgggggaataagtccacattgactcccttcaaagtgacccgaatctaatccatgaccctaaacggcaaaaccgaatat

SEQ ID NO: 61954 - DNA, 2672 bp, Oryza sativa
tgttgacctagtctgtgaggttgacgtggcgcttagatggcacggaagttgacagccacgcagcgagctcgagcgatgactcgatgacgtcgtcgttgcaatgctgaatggcgtagcttgatggcggccctcgcccctaaccatcttgacaggctcgacatcagccatgtcatgagcctgccgcatatgtcgaatcttgttgttgcgatcggcgaaaaggccagagtgccggatcttattgtcgcggacagcgggaggcagcggagggagcagggagctcgttcccccggtgaggacgttgtgtcggtggaggtgaggactaggggtggaggaggtcgccggcgtggatccataaaggagatcggctccggtctccccccagcacccttaggccacgccggctcccagatcttggcccgctgaagccgtctaccgccgtccccccgctcgatctcgtcggcgctgtcgtcctctcccgcctccttgccggccatcgagctgcccgctgccgctccagaacccgccgttagctccaacccaccggcgctgccgcttcaactcccggcggccgccaccgctctagcccccgcccgccgccgctctagcccgtgctccccgcgaccggcgaaggggagagagagacaaagaaagagagaagggaggaagaggggaggaagaagaaagagataggatgacatgtggggcccacatgtcattgggccccataattttttgtgtgtgaatgacaaacgggtcccacatatatgtttttaattcaaagcccacctaagcaccacgtcaaccccacagactaggtcaacaccgccacgtcagcgaaatcgccctccaaaaccaccaagggagtcaaattgcagcggtttctatatttcgggggtcgagatatccggttttacggtttagggtcatcgatcagattcgggtcacttttaagggagtcaaagtggacttattcctagattggatcgtgaggcagcacgacaacaaacgggtgattttagcatggaaaaagtacaccaaaggtccctcaactttttatcgagttacaaaatcgtcccccaaccgcaaaaccagatttaggacatccctcaacttacaaatccgttaactttaggtcctccggtggttttgaccataattttgtctgacgtggcagctgagtcagcgtgagaccaacgtgatccccacatgtcagggtgtccacatcgtcaccctatttctttcccctcttctctcttactcttctcgtctaggactctgggtagggcgactgacggatggggaggagaccggcggggtggggcggggcgaggcgggagaggtggtccggccacaattgctatctcgcgccagttgcttatgtcgcgcgcacgtggcaagccaactgcacatgcatgcatgcaccacggtctccagtcgtgcagatgcattacacacatgcatgcatgcatctatacgatctttctttttttttatgctttcatcttaattaatttaggatgtagtgaaagttatcaaaatttctattataagataattttaataaaaatattttttataatgcaaatttaaaaactcgacatgaaagtttttaaatcggagttgaaagttttcaaatctcgagttgaaagttttcaaatccaacttgaaagttttcaaatctcgagttgaaagttttcaaatctgagtcgaaagttgtcaaatctcgagttgaaagtttttaaatctgaattgaaagttttcaaaatttatcttgcaaatttaaatttcgacttgaaatttttcaaagtttaagttgaaagatttcaaaatttgactttaaagtttaaatcttaagttgaaattttcaaatctaacctgaaagttctcaatctattagaaaaaagaaaaagtttttaggtactaattatgattagcactaatcactaatcacgtcatcattagtgctaatcacatctttgtgacgggggcagcgtacgcacgagttccgttcgcggcgcgtatgcgcgcgttaggactcccttggtccggcagccggcgacgacggtgcttgtgttggcaactttttttgacaagcggtgatcctagagtcgccaaccacctcgatctagcaaagagctaaacctagatgggttttgataactaaactagctagcggagccgatttctagataactacccgtctcgtgggcaaaacggaaggttttcaggacaaacctacaaagagatgtcgcactctcgcagcggcggcggacggtttacggcgcaaaccgacaaagatggaaaaactaagagaaaactaaaagcaatatgaaaaacgattcgattgattgattgtagattggttttttacaatgaaccggccatgtcccttatataggggttggtcttgccctctacaggccctcctccacgtccaactcggagtagaaaccaaaggaaacccgaaacatgctttcccgagcaagaaaacctcgagacccgatgaaacacagttagactcggacctgccggtcagaccggccacacaccgccggtctgactggccctcaaccggtggtctgaccgcccaacacacgcggtcagaccggcccactcgaaggaaaccggtagacttccaaattttggcaatctttcctattttaatcctaggt

SEQ ID NO: 61955 - DNA, 1206 bp, Oryza sativa
  unsure (1)..(1206): unsure at all n locations
gccgttgtcttcctcccgtgccctgcctcccgcaactccagctccagctcccgacgacgacggcgcttggtcctggcgagccgccgccgtcgcgctgtccctgcgtcttgtcgctccagctcccagcggtggcggcgcttgcaagtctccggcagcagctgctccgaccacgcccggtcctcggccagccacgcaaccgccacattcgagcccgccctcannnnnnnnnnnnnnnnnnnnnnnnntttgccaccggtggggagaccggaggcacacggtggcgaagacgggctgaggctgggggagactggaggccgccatcaccgtcgtgtcccgttgtcacgccctgaagtttcccccttttttcttgctttaaaaattggttaaataaatcgtccgaaaaaattgttttaattaacctagagctaaatccctaattaataaatgcattcaataattggaaagggcattatgggatttttttttcttgggttccacatgtcacaattgattaacaggatttttagtggaattttcatagccctataaataattttaaccaattaaaattcattaaccgcgatattttaaatcccaggaattcatttccctttttcctctttctccttttccttctttttctttcttgggccgtcggcccggtccatcttgcccggccacgctcaccctccttctttttgggccggcccgtgcccctcccttcctccctagggttgccgacaggtggggcccacctgtcggtcgtcctaacctccagccgcccgcgcctaggccagcaaccgccgccgcctgctccagccgcccacgtcgcccgcttcctccaccccactccgcgcctccccacgtcgccgcccacctcctacacctctcccgtacgcgtgcaagctcgcatagaggcgcgattcatttttgaatcccctctctctctcttcctccccactcccccacatcgccggcgaaatagggaggtttcccggccacgtccgccccctcccgcacctataaatcgctcccccgagccccctcaacctttttccgctctcgccacgctcgcccgtgcactccgccgctcttcccacgccacacccgagcttcgccgtcaccgcccatctccggccgcgcgccaccgccttttagagccgccgtagcgctcaccgagtccgcccgcaccttggccaccacttg

SEQ ID NO: 61956 - DNA, 2746 bp, Oryza sativa
tttctcccacaccagagctgaagatcttcctagttggagctgtcttgttagggttggtttcgtcgctgccgtcaaggttgcctgtggagtggagtcgcccgttgcagaagtcaagcttccaagtttagctcgttttatcttttccgctgcatttgtaatcttttatatttttgtaagacgtggatctgtatgtcaacaattatcgtttgtataccctggctggtcctggacagggatttaatgcacattcagcttagaaattcttgtttgtgaatttctgggcatgacacctgtgctccccccttctcccacgtagccggcgccctccccttctcccgcctcgccccggcgacctcctccccgcccgccggccggctgccaagagaggagaaaagtgaaaagtgagagagggagagagaaagaaagaggggaaagagaggggcgctgatgtggacaccctaacatgtggggcccttgtgggtcccacgctgactcagctgccacgtcagacaaaaccggggtcaaaaccaccgaaggacctaaagtgaatggttttgtaagttgagggatgttctatatctggttttgcggttgggggacgattttgtaactcgatgacaagttgaggtaccttcgatgtaccttttccttttagcatggagaggcacttttgtcctgcccaattgtattaggagggaataagtccactttgactacctcaaaatataggtctaatttggttcgtacccctgatctgcaatgctggatattttgacctcccaattattaaaacaggtgtagtttgactcccttaatggttttgagagtgggttttcgctgatgtggcacgttcatcaggaaggaggaggtgtgaacgaggatgatagtggcaatgagatgggaggctgacgaaaccgtcgatgcaccattgccgactgctgtcacactcctcgtcaccatcgtgccgccgacgactgccatcactggctctccctgatagctcagcggtgtggggaaagtggaggagaggagaaagaaaggaggcatgtgggccccattgataacttagtaggttggaccaagtcaacgtgctacatgagcgaaaccgccctcaagagcagccgagagaagcaaattacaccaattttaatagtttggtggtaaagataaccgatatatgaattagaatgttggacctctattcaagggagtcaaagtggacttattcctattgggagttaatgaaatataaaagttactagggctggtttacccctaaaaagggtagaggtattctttgacagggttgaccaaatatttatgtagtgaacgtccattgatatttatcaaaatagtaaatgcctcaatggaaggttttggtttagggcatgcttagtagggctccaactcctaaatttaactctaagagtcggatctgaagtgaagctgtggagcagcctaaaacaaattccacctatttagtttattttgtgagagcactttaacccgctccgctcccttttttggtggaactgaaaccgtttgattgggctccagaactggagttggaactctgccaaacaagcccttaacaagtagcatgtaccagaaatgccaacggattgttattgacggtcgttatagaccaattccaaccgtcaatatatccaaaaataaaggagaactagcaatgcttcatgcatatttgtttaagaataatctatttccatttatacttggcaaaatattgtttgcaggagaacttcacataatcggaggaagaataaaagaaaataacatcaaagacacacctccgaccaatcagtcgcaagtacaagtattgaagggcccataggtcaggtgaaaccgccataaaatgggtcataaccgccataaggacccaccagtcagcctcctggacaaaggataggccaggaggtggggcccagggttcggttgaaccaagccgaaccgccatcaggccctttctgacaattccatgatagcttctcaaagacggttgcggggcatttctgacaattccacaactgtcatatgaaccctataaaaggagctcaccttctccactccaacacacaccaagaagaagcaatcaagagctctctctagtttatttactttgttctagtgctagtggagtagaattagaacagtctcttagtttttgaagtcttccggagatttcggataaggctttagtagctcttctctctcttgtaagacttaattcattaataaattattcttcttgtcatagtttcggtcctttacttcatttatataattattcgagtaccggctttagcttatacttgtctcgtaataattatgtagctagcttactggagatatgcaatggtattggtttaatgttcatttatatattgctctatgtgatctgcaaagatgtagagtagtatttaataatgtaagcgcaatgcttagattatcagatatcattaaatagggttatatgccacgggtctatatacaggtaggccgctgatggtgacagctcagtacgagtattcctccacatgcgtatataatataagagaatttcctggtgtgggtactcctccgtattcattaccggttggatggccacgacgggttatcgtaaggaactcgacaattaggggtggtttctcgatataccaagagggcatagttagggatattggctgcataattgttaaatagcaagtgtagactaaaatgacta

SEQ ID NO: 61957 - DNA, 14842 bp, Oryza sativa
cattaccggccggatggccacgacgggttatcgtaaggaactcgacaattaggggtggtttctcgatataccaggagggcatagttagggatattggctgcataattgtaaaatagcaagtgtagactaaaatgactatactagagttcagaaattatttttttcttattttttctccacttagtttagattattattttaataaaagtattctggttagtttcttttgtgtgtcaacctaccatattcttgaatcaattaacccatgaattagactttgatctatataagtgatataaattatcagcatagtactctcttatcatatcatcccttgtgattaaataaatacgatatataccttggaatatttccggtgaaatgttacagcggtatatccgtatgcctgcagattatatctgtaaccgtaaagaataccgagtaatgtttcaagagtcattgctgggaattactatattcctagtaatgactttaagaaatatcaacacacgccggagtgctgccatcgccgccaccgccgccgccgctgctacttctccacggcgatgtgcgtcatctactggtgacggtgaggatgacgacatgagagaggaggacaaaaatagtgatgggagtgacatagtttcaattttaaaatttttcagtgacatccaaccaataacgcgaactataatgatatttttttcatataccatataccatattcagagtaccgtggatcaaattagagtactgtatacgattgtagctgtctgaacggctatgcatgcactgaagtgtggctttccaacggttgaatatcccacctgtcatcccccccaacttatacatattcttacactgaaaataggccatttccaaagtttggtcgagtcagcaagatccatggcatagctggagtaggtatccaaggctgcacggtggcacatgcaccatgccccgacaaagtgggccctcactaaactggcacgcatacatggcccagtccagcagtagaccacagaagatccaacacgaagcagtcaggcccggaaaacaacaactcacggagcacatgaccactgggccccatccatccccttacattgttgcatgcccaacgctaaagaaacagatcaacacagcaccgattcattgtgtcaatgcctcaatggtacatgttaacaactgcacacatacatggacatatgtgcaagaaaagattgtgcaaaccttttgaaattttcagaatatttatagagatatatcatgaaagaaagaacaataaccaatcaatgaattaataatgcatatgcttccaagatgaacaaaactggcgataatatacagatgccatacatacatgtcctcacactgcatataattaatttaagtacagacaaaaattataggcttacacgtctaaccataaagaggggaagaaatggtagagaaaaataatgaacaacaataatggaatatctgcatcatcatgcatatgtgtaagagcaaagaatggtggtggtgactggtgacatggcacaacgacgacatcgatcatccctctctagctagggcttgaggcgtccatcaataatggcggcgatgaaccctagctagctatagctagttaggcctttggtgcctcctcctcctcggccttcgccggcgccgcctcagcggccgccggcgtcgctgcggcctcgactgggggctcggcctcggcggcggcaggtgcgctctcaccggcggctgcagctggctcgtcggcgggggcggcggcctcttcttctttcttctcctcggcttcttccttcttctcctcgccggcggcgtcggtggcggcggcggcggcggcggcttcctccttcttctcctcttcggcggcggcggccgtagcctccttgggcttgatctcctcctcgtcggcggggagcaacgtggagaccttctcgaaggtggcgaacaccgggccggagagcagcgccgggccgaccttggcgatcccctcgctcagttgcttcgctccggggaactctgatcaatccaccatgaaaatttcacgtagctaattaatgatcagcgaaattatattaaaaaagaatttgatacatgtgtttgttgattatatattaccgattttggcgagatcgtcgacgaacttggtgacggcggcggagttcttcttgatcccggacaccttggccctgtccttgatcagaacctgccaaccatggacacatcaaatgtttcagtgacctatacttaattagctgtaaacttggcagatagtatgagctaagctaagctagctggctggcagtcttttactgatcactactcatatgtgtagggtacatgcatatgcatgacgcatcactgctcatcactgagccagcgagggcgactagacgtacagaacgcatgcagcatgatgcagccaagcatcgatacatcaggatcatcacttcattagttgcatgattagatgggcctaagtctcaattaccgcaaactaatacgtgcagttggcagcactgatcgagttaattaactactgaattagtaggacggatgatacggttggcgtgtgattagtttctgaattatatttaccttgagcggcgcaggagcagcctcgtagatctcgacgaccttgggctggaggtcagccttcttctcctcgaactcgccgttgatcccctcctgcaccaccaccaccacaatcatcagcatctcatcgcaatcaaccagatcgatcgaccagacgaatcaaacgacggcggcggcggcggcggcgtaccttagattcatcaaacgacttgatgagttcggcggcggcagccttcttggcgttgccgcccttggcgaagacgaccttaatcttcggcagaaccttggtcttccagtaatccatggccggctagatcgatcgatctaccactgatcggcggcggcggcggcggtggcgaggctaagcaacgatgtggttggaggtagaggagatgatggaacgtgaagtggacgctgctgtggctgtgcggcctgtggtttttgcagaatttgatgggcgccgctggggtggctgcagttatagaaatggagggggggaggggcagcagaagaggtcaggaattgcgggaatgccactggccgctaataattgggcggaattccagccagggccagggccggaggccagcagagcttctgcaggatggtgaaccgcccgatgatgattagaatgtgtgttggcctacatgaccaatttgccctccggtctacgtactgattatgtgcaatgtttattagactcccttctatcgtaaacgtgtccagattcatatgatgctaagtttagtctggaatgggtttataagctggtatgactacaagatttaagattgcagaaaccgcaggagatgatcaaaatgtgaacaaaaccgataatggtacaaagcactagtactacgtacttatggtaggtaatatatttggttttaactgttatcattacaactctacataatcaaacaattaagtctataacattattatagtgcttttactaatctttagcacggagatccaatctccgttatgtgctaattgtagatttaatgatgaaaatatggtactagcatagtactgatgtcacaaaagttatagtacatgatgaatttgctttcaattgttaccattacgggctgttcagattgtagctaaaataaacatcactaaattttagtattggcaagatgataggatttcttatgtattattaaatttggcaacaaactaaatgtacaattttttttacacctttacttaaaaaaatgatatagttaaaaatagcatcaatctgaactgcccctacatctctaaataataatcaaataactatcacaatgcttttactaatcttcagcacggagatcccatctctgttctgctaatcaggcaagtcaccagtggcaaatggcgtaaatatcccagacctacgggggcagagcgcgtggcacagttggcaggcacagctggcaatgcgctgccagttcagttgccggtcgggtctggcctcgcgcccgcctcggtgtcccaagattgatgcgtgatacgtgctgcccatccccacgcgctgacaggtgggccccacaaacgagcgcggtccccacctcacggccaccgatgccgtgcggcgctggagcgtggcgagggggaggaggcaacggtcgtgttggtggactggcgggggaggggtgggtggggcccggcgctgggacggaggagaccgccgaccacgtggcctcgctggctacgctgccgcttgccaccgtggctgccgttgctcctctcccccgaaatctcgtttcaatccgcggctccgtttccggcgccgccttggtcagattcagagtgaccgggtgacgcgtgcgttcgatcgtttttttaagcatatatactccctccatatttttttaaaaaaaaaatcgtttaaaataatatttgagtcaaatcttaagaatataaattataaataactcttaagttgttgagtttgaaaatataaaaattatatgaatagatttgtcttgaaaaatactttcataaaagtatacttccttcgtcctaaaatataaacatttttagctaaaaattgttatattttgggacggaggtagtacatatatcacttttcaataaatatttttatagaaataaaaagtcaaagttgtgttttgtagatcgagtcgctgtccaaaacgacttcaattcctttataagtacggaggaagtacattttttctctttaaaaaaacatggtaatactatcttacttttattagcgcatctgaaacaatgaatcagtatattttaatattaacgaaatcatcatgaacatctcactattggcatatgctactttttaaactgataaacgatatgccttatgaaaaccatatgcatagaagttttctaaaaattaaataaatctaatttatgagagatcactgagccaaattcagggaaccgtagttcgatttcaatcgagcagtcgcgtgtctcagcgcagagctgtgcgtcctcgatcgatcggctgctggctgccaccgttcatggtcatgtgagtaacctgactcaactttctgacagttttttcttttcttaagactctctgacggtaggaatggccgatggaatgattgttctaggtctaatgttagtacctgccttttcccttgggtcatgtagaagtaaaatcagttctgttagcagtaaaaaaaaattgttcatttgccttgtgttgttcttactgcaaagtccttgttagtctgtccacatttgataaaacaattgatttttttaagtcaatattgttcgacatcgaacaacaaaataaaaatatttaaattgatggtgcactgtattaaccttttggtctttaaagaacctaacagtgcgctagctttccttcttttcttttcgatcggatcagtgtacaaaattagctaggcatacaaacgggctaactcataaacctatttatatgttaaataaatggtaatccgcaggtttccacattgtgacctggcgtatcgcatcaagtggatcgacccttaaaaccattaatagatcaaattagtaggtaaccgtgagttaatccgcaggttgcctactaattttatctataagagcagatacaatagcaggctattagccagctgtaaacatattttaatgagataaaagatgagagagaagagcagcgggctacagatctgtagccagctgcagcacggactccaagacgcaatgtgtgtataacaggtgggaccatatattagtagtatagtaagcaactattgtatgaattggctattagattggctataaatgaattggagctagtagtggggtttactattaaatttgctctaagtaggtttacgagttgaccacttatatcccttacttagcaataggaaaagagcatatatataaacacaacaaacatgatcgagttcggtggcatgcaatgcaaggatgcagcctgggtgcatatgcatatggctggcggttactaataattagcaatgatgagtttggttacattaataatccaggattagggcgtcattagcatcatcaattggcccttccagcccctgttctgctactattagggcacccacaatggttatctatagactctctataagagatccatgtcaacatatttttctacttggaagagattaaatgaagagagagagcaaaactatctactaacttgaagatagtctatagagaaaaatgaggcaatggattagagagctatagatacccatgtagacataccattgaagtggtttactattaatctagtctattgctgagatatacatgttttatagatagcgccttactttaccattgcgggttgctcttagcagtagtattaacatgggtgtttcgcatgggttgatcagttcggttgggcggctgtggctggttggtggccaatgattttggtctcgtacagacaacggttggcatctccaacctttcgattccgtgtatatgtgcgttggattattggattccgcgccagctgttcttgaccgtggatgcgtgatgaaatggaagtcgagtacgtagtggagtatacgttgcatttggggctttggaaaccctagttggcttggctccatcgatcgatggttagctcggcggttacttgcctgggtggggggatattctgtactcctaccatgcatgtttccatctacaaaattcgaaatgaaccttcttgcgcctgtctgacacgctcacacgcaaaggtttttgcctgtttcaaacggagaagaaaatggaaagtgaggccctatttagttcgcgtgacaaaaaattttagcgtgttatattggatacggatacatatttaaagtattaaacgtagtctaataataaataaattacagattccgcctgtaaactacgagacgaatttattaaacctaattaatctgtcattagcagatgtttattgtagcaccacagtgtcaacatgacgtaattaggcttaaaagatttgtcacgcaatttacacgtaatctgtgtaattatttttttgtctattacataaatgtgtccaaacatttgatgtgacagggtgaaaaatttttgtttgggaactaaacagggcctgagttgcatactagatccggtttagtttatgctgtcatttttaatcacactaaaatgtcaaattttggtaattttggtggttttattttgttcgaacccttattaaagttttgcagagtttctaagggcgaaaccctcttaaattactaaattttggtacgatagtattgggtttttcatattttgtttgttgcaataccattggctgtaaaaatgttttgcaggttgaaaatgatagtaaattgaaaacacccttacagtacttaaaaaatcattttccatagcatcgcccttttagttttactagcaggtttaatgagcacacggttttaaaaaatacttgatggggatttcggtaaccaaccgccaacccaaaaatacttgatggggatttcggtaaccaaccgccaacccaaattaattttcgttggttgtcaattaagagatctacttgcaaaaatagagttctttttgcaagcggagctcttaagtgacaagcaaggacatagatccggatttggcatacccgcctcccctccctctcccgcatctagccagcgacagtgacagtggaggggatggatccgtcggcaacggcggcggtggtgctcggaactgctagatccgtcgccccggtggtgaaggagaagggcaggtgacggtggaggaggtggatccggcggcggctaccatgacgacagctaggccttgagaaggttccggcagcacctccaatcccctcccctctcccagatcaagcagagggacaggtggtggctcagggcctgggtggtggatctggaggctcaaggtggtggggttgccacaggcggtggagctcggtcgctggaggcaggcagcaaattcggcgatggcttggggcatgggtagcgcatccgatggcggagcttgagcatgggcagcagatttgggaaattcattttgtactcgaaaatcttttttccttgatggtcagtgtcaatgggggatacccgtagaccggatatagagggtattggggtacgctggtacaaggatctacgtaatacgacatcaagcaggcaaaaaacaaagattatactggttcaggccccttgataggtaatagccctaatccagttgatatgggattatatgatggaaaccacagattacaaagggaatagtggaactcgacgataccgacgagatcgtagtcgagttgattcgactagatcacccggcgacttggctcctgtaagctccggcttcgtaggctgtggtggatatgttggcggtaagattcgatgccttaggtcctccggggggtcccttttataccgcaggtcaactggtcttcaagtaagactcggagacatcggacccaatatgatacaatgacgacccagttctatccgagtaggactccttacatctgtgaactccataatgaatttccttaacttatgccgaaaacgtccgtatacgtgcaagtataccatatcgatatgtgacatatatcgaagggtagagggtataccttacccgtaaccctgacagtcagcttaacctaaccgtttgtgaagatggttgattttcattggtctttagtcattggtggcaacgtcggccactatagaaaacgcaaattggccgccaggaaaaaaaatccattctgtactagtgttcacctttttaccaatatatcttccaaaccaatcacaatcctccaccatttaatttttctgtctagctctatttctcaaccgatcacaacatccctccatacttaattttacctattctcttaataatcatatctatctctaaaacttattatattctggaacagaggtacattatttccgggggcatacagtacaacgacgctgcttactcacgcgttagattactgtagcagacgtattttccctattgctacagtgatcattttatgctgtaatgcagaggatctaggacgttgttcagtcgttctcatcacacttgttttataggtctataaaaatggtatagattaattatatgtgtgtttttgaatgattaactatatatatgtaaattattatagtattaatgtttcagttaggataatgaggaaaacgtttaaaaagagttaactgtccccaggacagaaaaaatggagcaaatgtaatcaaattatgttgtattttttctattgcgtttggacgaaaccaaaagcccagctcatcattaaaaagatgaaaagccccagttgtatcagctgggctgaagcttcctgattgctgctgtttaggcatgactatatttccccatcttgggccagatcaactggacttaagaccattcagggcactaacttttcaaacgcattttttttataattttttttagagaagggtattttctacccggcctccatatccaaccggatatatacggccattgagatagggaacttagccccgcaaacaacccaatttgaaattcgctccataggagatttgaactcaggacctttgggtactactcagatcactgtaacttttcaaacgcataaggaagaatctctaagaattttgtttttgtcaattgccattgaacagtaagttctatgttttgccatcatctaactaaggttttatgaaaaatgccagtgtataagccttttcttttcttcttttgtcatctacgtcagtctctcgttaattaatcttatgcaaatagaggggtgaaacagtcggaattggtagcatttctttggaaacaacgctcgatcaatcggtaattgaccatgattatcatttaaactactcagatgtagaaagaagttagaaagaataaaatttatatataacgaaaagggtaataacagtgccttttatacggaaacggtgcttggactatccggaatttccatgaccatttaatagtccatgttacacctagaaaacataaagcacttcttggactgagatacacttgttgggggtaaaatggccattttgcaactgtgttaatagagcgctattgacagaagactaactacaatggcaaaatgaggtaagaaaatactttatgctatggtattttatagaaccacatttgccgatagccaaccaattgcttattagttgcaaaacatagaattatcaaagaattaagatgttggcttttgcatgtcttggtgatctgaatcttaaactgatgtatagaatatcaacatgaaggtgaaaaaaacaaaaaattgacttcaatcctaacagagctatgctttgttaaaattagccatgctaaattttctaaaatttagcattgacaagaaaattagtaaagtcaatttaggccactaaccaaactaacccagaagttttttcaactcgatagtaatcttggtcacttggttcatttgaaaagagtgaagcgaaaggattttcgggcaatatcttcctcgcctagtactgttgtggataagatcatggaagagttgtggagttgacacgaagctatgttgatcaggatggcggtgtaaatttttttttttagtgttcacttctagcgttgggagggggtttactgtgttttctcgatttttttcttcaatagccttgcttgttactttgttaccttttattccttgcatctcaataaagttttggctggcttttgccggtccagtggaaaaaaaaatcaaccacaatgctaacattttgggacactaaatagccttctttgaagggtctattatgcggttgaccgctctgcccactccccccctctcccttgtggcccacgtgtaaactaggaaaaatacccacacatttatttgtatttacattggcccaaaaatattatacatcaaagctctatataaaaagtttatacatacaaaatagaaacattaggtatataaactttatacttaaaaaaattgacaaaaaaactttataataaaatatttggtatataaactttattcgttgatactttgaacatgtaaactttatgcatacaattttatacatataaaattttattttaaatatgatattattatatgtttgttggtcatcataaaagtaaataaataaattataatatctactattataaaaattgaagatgtttttaccgatactttggtacgtcatccatgtataagtcggttgttagttcgttcgcttttggaaatacatatccgtatttgagtcagtttttaagttcgtttgctgttagaaatacatatacgtatttgaatcggtttttaagttcgttcgcttttggaaatacagaaggagtcgtataagaaaactcgcatggtaactttagacgaacggactcctaattgcagctcattattttctaaaaatatatatccaagtgaatttccataaatttcatcttaactaaaccatataacaataataagattaaaatggattttacccgttgcaatacacgggcttttttctggtaattcaaaagtaaaaaacaaatcaaatagggtcggccttactagtttcaaaggtccaacctataaaaatcacacaaaataggacagcgtggggaaagtttgaagaaaaaaatggagaccttgcggaaactcgaaaaagaaattaggataaggtggtgtttggatccagggacttaactttagtctctgtatttagacactaatttagagtattaaatatagactccttccaaaactaattacataaatgaaagctaatttgtgagacaaattttttaagcctaattaatccataattagagaatgtttactgtagcatcatatatgtaaatcatggattaattaggctcaatagattcgtctcgcgaattagtccaagattatggatgggttttattaacactctaagtttaatatttataattcgtgtccaaacaattttaattccatctaaacagggtcttaagcagtggttgtcaaaaactgaaattccgatctgatcacaatccgatcccacacatgatctctcgctaaatatccttttcgtcctttggagtgcatgatttcattggaattttacagtgttataatttctgcaggaatcggcaaaaaaatctcagtttaagaaagaggacaatctacataattaagcacagcatgccttaactttggcatatttcacatgaaagatccgagcaaatatatgaaatacaaaaatccaacgaaaaaacaattaacgcgataataatcgatcttttctcctagaagtactcgaattcaacgtaggacggatcatcccgtggcgagctggccttcccaccggcggcgctcttcttcggcgttccgccgccctgcgtcgcgcgcgcgagcggcgagcggcagtccacggcggcggcggcgacgtccgcctccgggatgtagggtggcatggcgctcctgaccagcgcccagttgacgccgtcgaagaacgggtgctgcttgacctcggtggcgccgcggcggtaggcgagcctggactggggctccttgacgagcaggccgcggatgaggtccctggcggcggcgctggccgccggcgcgtccgggaaccggagcggctggccgacgacgttgaacagcgtggcgcggttgccggagcccttgaacggcgtcgtcccgtgcagcagctcgtacaggaacacgccgaacgtccaccagtcgacggcgctgccgtgcccctcgccgcggatgatctccggcgccaggtactcgtgcgtgcccacgaacgacatcgacctcgcccccgtcggctccgcggtgaactccagcgacgtcgccggcggcggcctgttcttgccgttgccgtcgccggtcgctgacgtcacctcctggtcattccccttctgcttcttcttcttcttgccgctccttctcgggagaatccgcgggagcacgcagccgtgcaccagtccggcgccggcaccgacacggcccgacggcgagcggaccagcgccgggctgacggagcagcggagcgagaggtcgaagtcggagagcatgatgtggccttcctccctgacgagcacgttctccggcttgaggtcgcggtacaccacccccagcatgtgcaggtactccagcgccagcaacacctccgacgcgtagaacctaagaagatcgccatgatttcagaatttcacctcctcttcttctccaactccggcgatcgatcgaacaagaaatttttacctggcggcgtgctcggagaagcacttgttgggctgcttctggcggagggaatggaggttgccgccggagcagaactccatgaggaggcagtagaacttgtcggtctcgaagtgggagtagagggtggggaggaaggggtggtcgaggaggccgaggatctcgcgctccgtctgcgcgcgggcgagcttgttgcggctcaccagcgagctcttgtccatcaccttcatggcgaacagcgcgccgctccctccgccgcggagctcgacgaggtacacgctgccgatgtcgccgtacccgagccgccgcagaaggcggaagtgtcccaggctgagcggcgactcgcgcgcgctcgccgcccggatcgcctcccacctcccgtccccggcgccgcccgtgtgccgccgcaccagcgccggagcagcgccgccatcgtcgtcgtcttcgacggcggccgccgccgccgtcctggacggacgggcggcggcggcggccatgtcgacgacgacggcgtcggcgtagatcgggttgatgctcttcctgaagcccgacggcttgtccggcgactgatccttcgccggtacgaccatcctcgggcttggcagcgtcatcgggtacacgccggcggcgtcgaagctccccgcctcctccatatatataccgccggccgccgctgctcgatctctccgatcagtttcgctccatgccgtcgacggggtgttcgtcgtacgtgttgctggagttttaaggccggagacaatgcagccggccggcagcaagttcgatcgggaggggatattgtatggatcgccatggctgggcgcgtcgtcgtggccgccactacaagaatgggtcgacgtggagggggcgaactggcggagttgaggcggcgcgacacgattgatcggttggttggtggtggatgtcatgtccgtcatcaaacgcgcgcggccgggtggccggcaggtcgttggtgacgacgaccagattgacaagtatgaggggctcaccaattggcctgcttggaagcccaccaattggcccagaaaaaccgggaatttttttatttttaattttttttattaaaagatttacaaaaataattttgtatttcaaaaattgacagaagtagtcgtccgctgccctctgggaggcaaatcgccctcccagagggcggcaaatgtgacgtggcagacgtccgttcactctcgggcgacgaccgtcaatgaaatttgcaggcggcccccttgccgccctccgctagggcgattttacactgtgcggggggccgcctgcaaatgggcggcgaggggggcatggaaatttgcaggcggccccctttccgccctgggggagggcgattttacattgtgcggggggccgcctgcaaatgggcggcgaggggccctagaattttgcaggcggccccctttccgccccgggggagggcgattt

SEQ ID NO: 61958 - DNA, 2046 bp, Oryza sativa
aaatcaaattctcaaataaagggatgcacagtgtaaaatcgccctcccccagggcggaaggggggccgcctgcaaatgggcggcgagggggcctggaattttgcaggcggccccctttccgccctgggggagggcgattttacactgtgcaaccctttatttgagaaatagatatttttataattatcaatagttatccaatcttttatattgaaaactcaatacaagattaaaatctcaaagattggtaaaatccaattttattattttttagtcttacgcatacaaaaatacaccatcataattaaacattgtaatgataagataggtaagaagtgccatcgatacacgatacaaatttgtcggtcccgacgaatctagcctgtggtaacctatcagccccttctaggttggtcaatatgcattgcattctcgtggtccttcaatcgttgatactctacttgtgtttctgactctgctatcttttggccatgatatgatggagtgacattgtcgatccaccgagtaaatccacacatccttggattgccatgaaaaaatagtaatgttattcagtttgggtagaaattttgtgcaaatcatagcagattttggaaacggttagacatacaacgaaattgttgtctacattggggcagacaaaatatctccttccaaatgtctgttctgcaaatgtggtagccacttggcagcgatctctgcacccacactttggacgctcggaccagctaggtaaccctaatggattgttcctccagtctaagcttgcaattttcacccgacgttcgtactccatccaagcatgaatgaactgtgtggtcggttcaggttacgttatcggcccgccactggaagtaactctgactgtgtcaatccattgtacgaattgacatttccttacatcctcctatgtacatccattgtggggatagttaagttaatgatagtacagaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacactcacgctacgtggggagtcctaggggatttacctgccattctaaagcctcagcagcaattcggcgttcatgctcatccttccgccttaggtagtccgatcttgtttcactacatgggtatgcacgtgttccgtcgttttgtgggttctccatgtctacccactcgatgaagttgcacattggacgatatgtctgcgtaagatgttacgattgtgtacgaagaagttagtttttatccatttgaacttcgaatagatgaatcatacctgatcaaagttcgtgcattggaagaatctcttgccccgagtttgtatcatgagggaagacttgagtatgcatccatctccacaatcgcacaaaggacggtcacaccatggtagaaaccaaccagcgaaaggatcgcttcgccagttgagacgctcaagtaatggcgcttccattctcgttaggtgtgtgctagttggaaagaagatatgaagaggttgccttcagcttgttttcagtgcaatatttgtgcacttaatgatatacattattcattagatgtgacaagacgagcacgcgcgggcgtgattcactttatgtcagcaggcagcaccgaaagttgatagtgactactcgagctggcgcttttcatgtgtgctgtggtggactgtgcagctagtggatctgacactaccgtgaagcgccgaaagtgtgttttcgtgagcataagttgttctagcaccatatgaatgaaaacaactatataggcgagagaaacacaagtagtactgcagtagtaaaagcaaaagtagtactgctttacatatttgtaagccaaaagaaagggtcacataagcactgaaggtgtagaacactactgacgaggcctcttacccctgtccctcctaccctgtgccctaacgtgcccctaggagtacgtgagtcgg

SEQ ID NO: 61959 - DNA, 1345 bp, Oryza sativa
aatgcaaggcaagggtgatagtgcaactcgataagggagaatggagttcacagcagtttgccatgagccctatcatccgttatgcccaagccctttgcttgcaagattcatagtagaccacaaacaaatgtcaactggagagaagtcatttttaagagttttgcaacaaaatagggtacctcctaagaaaattatgaagattttcaggaaactaagagtttgtttcggagacataccatttgaaaataaagatgagcacaacatagcacagacagaacatagaaaagcaaactcagatgttgaaagcgcattgaagcacttcacagaattgcagattcaaaacccagaatttctgtacgtaatgcaaaaagatgaggacaacacagttacaagcatcttctggactgatgcaagattgaggatcgagtatgatattttcggagatctcattatgtttgatgctgcctatagcactgatatgtataacatgccttttgtgcctattattggaataaatagccacgcgacacccttcctgttaggatgtgctttgttaaaagatgagaaagtagaaaccttcgaatggatgttgcgtacatttttgcaagtgatgggaggaaaaatgccaagagcggtcataacaaaccaggacacatcaatggagaaggcatttgcagaactcatgccgcatgtaaggcttaggttttgcaagcggcatgttatgagcaaagctcaggaaaagcttggagacttcatgacagcaagaggtaacataaatacagatctacataacttagtaggcaactcgctggtagaaacagaatttgaagaaggatgggttgagcttattgagagatacaatgcaagtgaaaaccaacacctgcaactcatgtggcaaacaagaaaaagttgggcacctgtctattttagagaagatctctacccatttattgactcagttggttccaacgagggaataaactcattatttaaaggtaatatgcttccaaaggacacaatagataagttcattgggcaatttaaggagatacaagagaatatagcaaaagttcatgaagaagatagatttcagtcaggagctgaccttaaatacatctcaatgcaaccaatagaacaacatgcagcacatatttacacaagggaaatatttctgaaagtacaggaagaactactacattctactgcattcaacgtgcaggagatacaaatagggacagtgtacagacttgaaaaggtcttcaactatgagaacccagagttcgatagaaattatttttgaagtgcttgctgaacctggcatcaatgcattcaagtgccaatgtgc

SEQ ID NO: 61960 - DNA, 10009 bp, Oryza sativa
agaacttacttattatatttaagtgtgtttccggaagattacaaaatcgaaaaagatcgtttgatatggatgtgggtagctgaaggctttatccagtgtgggaaacaagggaggagcctatttgaactcggagagagttacttcaatgaccttgtaaatataatatgatccaacccatatatgatatgtatactgacatggtatctgagtgtcgcgtacacgatatggtcctcgatcttatctgctcattgtcaagtgaggaaaacttgttactatattaaatggtagggatcaaggatctctgtcatacacgattcggaggttgtccctccaaaatggcaatgaagatcatgctatgacttcagcaactcggagcttgcagcaagcaaggacagctcttgtctttccatctgccactgatctagtacctgtccttaggagcttctgagttttacgtgtactggatttacaaggttgtgatctttcacaaggttacagccttaagtatgttgggaatttatttcacttgaggtatctaggactacgtgacacagatattcgggaggccccagaagaaataggaaacatacagtttctacaaactttggacctgagggcaaaccctatttgtgacttgccactgaatattgtgaagctcagacatttgacgtccctatgcttcgacgggtttgcgagggtgccagatgggattggaagcctaacaaggcttgaacatctagcatatgtgttgatcgattgtgctactgtgggcattctagaagagctgggcaacctaacggagctgagggtgctgtgcatcatcttctgggacggatggaacgacaaactggtgggtctcctacacaagttgcagaagatccagcgtctctccatcgacgtctgcatgaacaatgttcgaaagaacatgggtggtttggacgcctgggtcgcccctcggcatctcgtcgcactggatacagagaagatctgctggttctcgtcgctgccggcgtggatgacgaatccgtcgcatgtcccaaacctccgctcgctatccatcgccgtgagggagatccggcaggccgacgttgagaccctcgggaggctgcctgctctccgcgatctgcagctgcaggtggaccacgaggagctcggaatccgcggggtggtgttggtgattggatcagctggctcgttcgcgtgcctggtgtgctgtgggttgtggggattcgttgggccggcggtgttccggcgaggagcaatgccgaggctcagaacgcttcgctcccggttctccgtgcgggaggcgatcgccgtcgccggtgccggcgacgatggtctcgacttgggactggggagcttgccatcgctccaggaggtcaatgtctcgttggattgtgaaggcgccagcgaggaggaggtgaacgaattgaaggctgcgctgaggcgtgccaccaagatccacccgaatcatccaagcattagcattgacggaggtacatgtgatgcttgctaagcttgctcctaattgattcttgtcgatcttttgccctttcttattctgacgttaattaattgatatttcagatggccaagtttcagatgacgagcgcgaatagatggtagagtatagtactagcatcgatctaattatgcagatcgccaaatgctgttgctatccatctaaatcggccaagatcgcaatatacaattgtcctctcctcgatcgccggagaccgctgtcgtcaaccgcctcactgagtagccaatatgcagtgccgcggtgtttcaggaagtgcatgcatcagtgcatggcaatcactcctacaaatctcttgtgcatttaacctgctggacgattgatacggaagccattatattgtttatgataattttattcctctctaatcaatggttcgtattgttccacatctcaattctataacatacctcgttaacgtaataaaatttctcataaagaaatagtgcggtcacaccgcaaatggtactgtcgcgcgtcgctgcagtatatttaaatagaggttagcatgcagctacgcctcctgttcctcgtctcaacattcaccaccagttattaaaattttgtttcttgccccccaccggcaagcacaaatctcatccgaaatttttggttctttttcttttttgaatttagtcaaagtttatttaaattcattaaaaaaatttcaaattttcaaataatttcggccaagaaatttctaaaattttggttctttcaagaccaacaccccccacaaccacccctccccccggcgccaaaaacctaatttcgagattgcaaaccctgttcaccaatcaccacactaacagaaaaagaagaagaagatacatacctcatatcaatatatcatacatggcacatcggctgtgcgctcggcatggtggcggtgttccatgcggcgccgcaccgcgtggaggccaaacacgtcgaccacagcgtgctcccgagcgtgcccaaggcttggtgccccaagccgctcatggtggtggcccccgccaacgccgggacctacccggtcgccatcttcctccacggctgcaacatggtgaacagctggtacgagcagtggcggaagcaggattaaaataaagataggacggagaatctatggatacaagcggacggacaagcagatttttttagcccgtttatctcacttctagttcattttttattctaaattttgcactaccatgtaagaaatgaactagtaaacaggtttttatacgggtaacgggactacccacttgtatctctagcggagatggtcgtttcataagaatagctaaacacactaaatatcatatttatactataatcacatagaaatatagtgtaaccaataaattaagggaaacaaaaacattttaaaataaattaataatctgtgtcatatatgattcattatacaacaaaagataatagttgacgtgttaagccctgtttggttccatgggctaatgtttagccctcaaggatccaaacaggtgggctaattttgagctaatgtgaattagcccccctcaaaacattagcccctccaaggggtgctaatggggctaattttgtgtggggaccatcaaaaagcagctctctctctccttctctctcctctctttctactctctctccaccttttagccttgaattagcctatcgatccaaacataccaccctaggctaatgttgagcctaccaattcatgactaaacatgagctcccaacattagctctgggctaatcttccaaacagggccttaatttgcaaatattagacaactcataaagccaagtggttcaccgttcagacttgatggaagtaatcaattgattagtgattagggctgtcaaccaggcagccagaacagtaggactacatcctgcatgagccaccgagccaggaggaatggagtgagcggcgttgcggcgccgcgacgggaccgtttcggctagtgcgcgggagcgcgcctactccctatagggctagcacctaccggcatgctggcgtcgctgcgtcggcgcttggtcgactcggtgtctcggtgaaggctgaagggggaagccgcgaaggcgaattgatggtgtggcgccgatccaggtcgaaagaaatgaggcgtcgctcgcgtgcggcttatgcgatcggcggttagactggtcactagcgcttcggctgctcattttgggcccaatgttgatagagccaaggagggtggggggtggggcggtgcgggccgtagctgggtcggccgtccaaccctgcccaatgggtggatccgcccctaggtacgagggcctcctgtcgcatgtcgcctcccacggcttcatcgccgtcatgccgtagctctacggcatcgcgctcgacttgaacgatgccaccaggaaggttgcatgctgggccgccgacgagcggcagggcctcgcctacgtcctcggcagcgtcctcaacctccccggcgtcaagcccgacctctccaggctggccctcgtcgcttgaccttcaagccatggtccctccacccggggatgccggtgacggtggggcggagcccaatgggccaggggggtgctcaagaacccggcccaaaattctaaatagcttattacccctatattctccaccatatagacagtccccagtccaaaccagggaacccccctccccccaaagatccaaaactctggcccaaaactataactctaccaggcccaactgagaggaggatacgagaattcgctcgtgtttcccatagatcgatagcgcgcggcagaggtagggctgggcggcgacgggaatcaaggcgccagggcggcaccgtttcgagttcgacgtttcctcttccaaaaatcaaaaatcgctattgtttctcacctctcgttctatggatgtgacgccgtcttcccgttctgcccagcccactgcggcacagcactgcgccaatccggccgtgccggcgtgcccgagccagacaccggcggccagctgcctagcctgagccctgcccggttggtggctgccctgccctgccagcctgcccttacagccttggcgccttgctgttgccgaccagcccaagcagtgagtgaagcagaagcagcccaactccaagtctccaacgccggccggccggtaagtcttgcgtggttgcaccctgccgctcccttcttttaattttgcaagtctaccaatgattaggttattgtttgttgtttgcagtcaacggaggggattaccggagtagaacggttgcaagtgattgtgcttctatgaaaaatcacagccgttaaccaacacttaagctctgttcgggagtgagggttgaaccctcactctctggaacacaaaacgaagcagcgtttagcacgtgattaattaagttttagctaattttttttaaaaatggattaatatgattttttaaatgaactttcatatataaacttttttgaaaaaaacacaccgtttagcagtttgaaaagcatgcgcgcgaaagatgaggaggaggtgttgggaactacccctaacgaacgcagccttagagtacgtgagcgctttctctcaactttcatatttaatttgttgtatcaatataaagcttgaaaatttttatttgatctctaaaaggtttctatggagaaatttcttaaaagaaaagtaatggattgtaccaacaatgtgaagagttcatcccttcgactagatgatgccaagagacgatcgaatatcatccaggcttaagaaaagaaattgatgattatcatcccaaccaaagagacaaggtaaaaagaaagtacttagagaatgggtcttgccaacctcgtgatcttgtacttcccatatcagttatttccaacaaagatggaaaattcaatccggcatggttttatggtacgcattttttaaattttttccatgcactttcttgttgtatattgccttcaattagacagatgatgcttatatgtactgggtacgtaactatttagtataatatcgttctagaactatgcatgtcagtattttacataaagaaagttagagcaaggtcaatagtgtcgcccgctaatggctgcaaaaatgaccacatcagcatagacattgctaagagctaatgtatacaataagcaggtttacatggactattatccaattttttaatctttagctagcttcctcatccaattttttaatcttgttgctgtcgtttcgtctcgccattcctacatcacaccagctcgcgtggaccccacaattgcatgccccagtcaaagctagcctagtgttgctgcacttgcgttgggatgtgtgtgtagccggtgataatttaatccccgactcatgctctctcgtgtccagctcattgacaaatccgatgtggcagttttatcgtcggctaaactagcttattgaacttgctcttaggaaccccctcatatttctctagctccgcccctgacggtgatggtcatcgcattactataaaatattaaataggtatcggcacatatgtgttgaaagtattaccaccgacatctataccccttttccatctctacggtctaaaaacacaaaaaaatcggcaccggcctaggcccgaggcacgtcggcggcccgccatgcgcgccggcgggcgtgaaccattgcgagttctacgacgagtgcgcgccgccgcgataccactttgtgctgcgggacaacggccacctggacatgctggacgacggcgtgccgtacgccatcaacaactgcatgtgcatgaggaacctcggggacaccaaggaggtggccaggaggaccatcggtggcctcatggtggccttcctcagggacgcgctggaggaccaacacgacgacctcaagctcgtgctcaaagttggcgttaacccgggcctcgagctcacggttaataagccgggtgcttacgatatgcatgaaatcacgctcgcccggattaattaattatcgctcattaattaccgttagtaattaatcactttcgcgtgtaatcccataaatcctaaatgtatttataaagcacatcctcgttaagtatagttaataatgtttgttctctattctcttatggtatcacatcacattaattatttttagtctccagatggttcatcacacatcatcttaattatttttagtctctggatggttcatcaggagtgataattgactatctatctattatatactaaaagtccattaaacttcctacaaacgctctcaaaccgccacgtggcatcatacaaacgctccaaagccaaacttcctacaaacgctctcaaaccgccacgtggcatcctacaaacgctcctaagctgtcacatggcattctaataaataataatagaaattcttagaaattctaagaaaaaaaacaaaacatctggccattggccatctgttttcatttaaatcggtggacccattatttcaaaccggcagatttatctaaaatatctttccacatccacctccctctcctcccacacgtaactctttccctttgtacgtagtgacgtaccgtgcaaaaaaaggttataaatgtacgtgcagcccatatatatctcctccttctctctacaccctattttatagctagaaatttaacacaaacatggtaagttaaatggtcataatttaatttagaattaaacttataacttaagatcaataaaatccaaaatattctaaaaaaataaaagctaaacatcgaaccattgatttacgcatgtacgggtgaattattatttttaaccattatattagattagatcatatcagattaaagtaattaatccatctcctaatctcatccttatttgcaagagggaaaaataaatatataacaattgattttcgcatgtacaagtgaattattattttgaaccattagattagattagatcaaatcatattaaaataattaatccctctctcctaatctaatgtgtatttgtaagagagaaaaataaatatatgctattcatctggagaaaatatatgtatgtatatatgcacgtacaggagagggaaaaaaaacatgcatatatacgtacataagaaaaactattgaccatgttttcctaatccttaaattagaggtcagtctaccctctgttgtggctcctttctctccagtttatttgctagggtattctatgttaactatattttaataaaaaagagaccgtatatttcttctgacataaaacgaacgctaaaacagtcagatttcatagtacaattaaaaggagatcactatggttacgaccaaacaaaatgcaacataatttattaatatgatgatgtaaacttaaacaaaattaacttggttaaaaatacaaaacaatatttaaattttgaaaaaaacgaatgattaaaattacactccagtataatataaaatacaccctaattactgtgtagtactctataattataaattataaatgtaaatgcacattgagattttgctaattattacccctctctttctgcactttgacagtcgcgtggatgcctagcatctaacgtttctactggtcatgtactggtagtagtagaggttggagtagtagcaatagctcagttagagcaggtacaatagcatgctataagccagctgcaaatatattttaaggagataaatcaggagagagaagagcagcaggctacagatttatagccagctgtagtacggactccaagacacagtgtgtctatgacaggtgtgactaggtattaatagtgtagtatgtaactattgtatgaatgagctattagattggcgatagatgaattaaagctagtagttggctatactattaaacttgctcttaagaacgcagttagtgtcactttttacatctctccacattctaccacatcgctaaatgctatagcacgaatctcaacattaaaattaaatttcactttaaggcacctttctattactgatattttgctttgtaccaacctttaaccaatacttttactttgcataacatatttttaccactgtgattctttggaccaacctcaacgcttctatccatctacatcatacatcaaaaatatggtattacatataactgtgacagttaattgatcattagaagccaacataaccgagatcattaatacgtaccctgtccaaaataaaaatattggtttaagggtagtctaaaataagactttcgtaataaaatatggcccaaagtgaaattcatgacatatatatagcaattctgattaaaaagttatcacatggaacaatattctaaccctttttatgtctttcttatctaaataatcttaacaattactccattctttttaagaacgtactgatagtggatattatattcatttacaacccacttttttctatagaaaattgataaatatgttaactatcttttgaataaaaaaatattaaatgaaaccacattctatcaatcttcatgttattataaattgtcttaacaatcagcacaaataaacatgataacatatattgttccattatatattaccccacgaacatgcatagatgaattagatcaataatgaaaaaaaaatatcaaaactcatattcatatgttcatgaacaattacttctcaagatcaactctacatattttcagaagagataattatatatgataaaatttagtggaccaattaacgccataaacaagtgtcactctatttcataaatggactcaaaactaaaaaaaaattcacttccatcttatctatgtgtcatcccttgaagggcgctaagcatggataacgtagtatactctgcttctgtagaaatggcgggggcatgcatatgactgagtaaaggtgaccctggtgagaggctactattcgcaataaagttcaactagcctacttatcgatgcaattctttagctgataatgaattaagcgttaaaattatgctccacactgattttgaggagcacggctatgttgataaaggacacatgtttcaaggcataagagaagaaagccttggtggctactgtcggcttcacccattagaggggcatttatatctaatgttaaatgttttatcccatgaattggtaggagcaatacttcaaaatatttatacatatatttaaacacaagtgaggcatgaacaattaggtatgaagtacagatgatctttttgttgtattaatgacatattaagtttggtttcttggatggatgtaatcccatctattaaaaaggcacacaacttataatacaacgataataaatagtggtgacaggcgagtatacatatatctgggacatagttatttctgtttgaaaatgaaagatactattgtcatttagtatatcaaaatttgtggtctagatatttattttcatataattataaggtgatctacggtccttataattaatcaatatggcgagatgggatttcttta

SEQ ID NO: 61961 - DNA, 1627 bp, Oryza sativa
  unsure (1)..(1627): unsure at all n locations
nnnnnnnnnnnnnnnnnnnnnnnnnnnnnnnnnnnnnnnnnnnnnnnnnnnnnnnnnnnnnnnnnnncgttaaaattatgctccacactgattttgaggagcacggctatgttgataaaggacacatgtttcaaggcataagagaagaaagccttggtggctactgtcggcttcacccattagaggggcatttatatctaatgttaaatgttttatcccatgaattggtaggagcaatacttcaaaatatttatacatatatttaaacacaagtgaggcatgaacaattaggtatgaagtacagatgatctttttgttgtattaatgacatattaagtttgttttcttggatggatgtaatcccatctattaaaaaggcacacaacttataatacaacgataataaatagtggtgacaggcgagtatacatatatctgggacatagttatttctgtttgaaaatgaaagatactattgtcatttagtatatcaaaatttgtggtctagatatttattttcatataattataaggtgatctacggtccttataattaatcaatatggcgagatgggatttctttagcattatttttataaataataaataagcggttcttataattaatatagtgaaatacaactttttttaacaatcttttatatataagttgcccgcgcatctgtgcgggcttccttcctagtttgggaaacaatcatagctagattgttggatgacactttggggaaagaaaaataaaaaagcaaaggcaacctagaaggattaatattttttttacacatcagcacctctatatactaattaaggatgaacttctgcaaaaacgattaactcacatgtaaaactacaacccaagccaaagtttgtactactgtacatattgagttttctgagattttctcaataggaacaaagaaatatgaaattaatatggaattgagccttaaaaaatagcaaaacttcatgagaatttcaagaaatttgggagatctcactcaaatatttgttgtcaatgacccatgtaaattacaattagcacgctcattgttataaaatttccttacgttcataaagtgttgcagaagcttaaatggtcattctgtattaatcaccactgttgcacatgagcaaaatttaaaagacgactatcctagagagagagagagagagtaccaattacaaaaatgaagtaatgtgtaatttgattggattactaccctgaccctgttatggcttgatcattcatcgcccaatcagtggatcggtatatgcacttgctctaagcttgctggaaacaacaaaaagaaaagagcacttatattacaaaaatgaatgtggagtaaatcaaacggaaagggaacctaatgttgttcatgaacacgcagaagccttcgtatcttgtgctcttcccataggtggagaccaaatgttggctaaatcagccggctgttgtcgcataggaaagcggcttcgacttgtgagaggcttatgcaagtgagggaatcaaattggctcagtgactcagtgtagacggtgcaggaaaacgggcagtgttgcacacttatataggaggaattgagagttataaagagaatcaatgagattt

SEQ ID NO: 61962 - DNA, 15612 bp, Oryza sativa
tgcccaatggtttggacgaagactggggagtgattccatgaaaaggttgatcggttggtgtcaactcgcttcgaggaatccccattgcgtccaaggtgctggcgaagagaaagttgatggaactgccgccatcgatgaggactcgcgctaccttgatattccgaatagtgggttcgaccacgatcggatatcgtcctgggataacagcagccttggggtggtcctcatctgagaactcgatcttctgttcagaccacttcatcttgggtgtaaccccttgccatgtcgaacaaacctcgcgctccacttttttgtattctcgctttgaagagtacgctgtggaacctccgaagatgtgcgagacatgaagatcgaaatctgggtacgccgagtccgagtcctgagtggttgcctctgcggccttctcgactacacgtgctcgtttgcccttctccaaagctagttgcttttctagcgactttttgaagatgaggcactcctccggagaatgtctgtctgacttgtgtatggggcatcatattctcttcgtatcactgccttgtgggtctgggtgtttgggagggtgctcgtattcagacgcgaggacttccgcttgagctttccttttcctactcttgccgcttttcttcttgcttggctcaggtgcgtccttggctggcttcttctctccccccgcctttggcttgtcgttcttgcgtctcagtgcgtcgtccacatgagcgcatcaatcgacgacctcgaacaaccttcgagtagttgtgattcgccttgttgccaactcctgggtagtgtagcgatctctgacaccggttttgaaagcgcgaatcacaaaggcgtcggtaatatcagggatcgtatttctgcactcattaaagagccgaacgtagtccctcaaagatttccccggattctgtgttaacgcgtgtaaatcgtcttcgatcgcatggcgcttgtaagttccttggaagttagcgacgaattgctgccacaaatttgcccatgaagaaatcgagtagggcgggaggtgcatcagccacgaacgcgcaaaacctttcaacgccattggcaaatagtttgctaacgcgttgtcgtctgctccagcagcgtatagtaccgtggagtagacctggaggaattcttttgggtcagtactcccatcgtacttctctattgcctcgggtcagaatttctcgggccaccggacatcacatagagaacggttgaaagctctacacccggcgctaggggcggtgggttgtcggcgatcgtgtgtcctccgtggatgtctatcggatgacgaggatgaagatgatgacgatgatgacgatggttcactcggctccggtgtgcgattccgagggcgacgttcaggttctcgagaattctatcgtcgtccaccattgttgtcctggcaccgatccccattataatcaccgtcatgttgacgtcctcgaccagcatcgtccggtgtccactgttcgcgatcgtcgcggtcgtggtggatgtgacgattatggtggtgttggtcttcgttcgagcggcctcctcgctcttcgttcttatgacgacgtgaagagacacaatgttgggaacgattctcgttatctcgcgcgcgttgtgcttctcggcggccattcagatggtcgcggagatcgccggtgccgcgaggtggaggggtagctcgtctaggcgacgtccgttgctccggtggttcgccgtcggcaccgccaaccgtcagatgttctggttgtgctctggtagcgacctcctcgaacgcgttactgagattggctactgattcccgtagtcgttctgtccatcatgggagatcatcgttaagtacggggtcatagggagcttctctcagtattgcgttgacggtgccgaggtgttgggccggcgtgaccgcttggttctccgcatctgcgttagcgtgcgcagacgtgctagtcccaccgatggtaaacacgtcgcgtcgtttactggaagatgacgagccatagtcttcgagcaagtgtaggactgatggctcgtggggatcgatgtcgattactccaacgaatcgatccgaggtcaacgtcgctccttgttccttgtctgcatccttaagagagattcctgactgctggaccttaggaagcgatgttttcatggcgcggagaaagaccttgcagcttgagaagtcatgattcttcgtcttgtgaataggacaatagacatcacgagttggagaagtacgctggattccacgctccttgcaagcatgaatttcagcttgtacgttgagaaaaacccagcaagcttgcaagttgtgcttcctggatttgtggataggacaccagggctttgttacctcgggagttgtccttgtcggctcacagttcttgtcggaaggacaaggtttggccgcactaggaaccttctcgggctcgtatgacgtcgatgttctgttctccgctacggcgggaggatccttcgacacgggatcgtccggggttatagccacggcgttctcgtttccggtcattgatggaccagccgagattggtaccgtggtgtaaaccgggaagacaattttgccgacttgagtccacaccagcattgttgaagtagggactccttggatggggccggtgttgacgccgttgtcgacgaagcttgatgtcatagtagtacaaccttgagcaccaagttcccctacctggcgcgccactgtcgacggcgggtacccgtagaccggatatagagggtattggggtacgctggtacgagcatctacgtagtacgacatcaaggaaacaagagacaacgattatactggttcaggccccttaataggtaatagccctaatccagttgatatgggattatatggagagaaccacaaattataaagggaataatggaactcgatgataccgacgagatcgtagtcgagttgattcgactagatcacccgacgacttggctcctgtaggctccggcttcgtaggctgtggtcgttgtgttggctatgagattcgatgccttaggtcttcccgggggtccctattatatcgcaggtcatgtggtctccaagtaggactcggagacatcgtaccctgcacgatatagtgacgacccagtcctatacgggtaggaacctttccattggtggacttcgtgatggatttccttagtgtatacagagaacgtccgtacacgcgcagatgtaccatattgtcgtatagcgtacatccaagggtagagggtataccttatccgtaactctgacaaatatatgtaaattacttttagactctattaaatttacttttatatgtctaagaagtaatttagtcaactctaaaagtaacttttatatatatatgtatatatatatatatatatatatatatatatatatatatatatatatgagataagagtaacttacatatataataaaagtaatttataaatataaatattttttcatcgtaatataatcacgtaagattttgttgtgaagatttaattgtaacgaacacaatggtgtaatcggattgtagatcggataagtaatttgagagaaaactttatttgaagaggaaagggacgtacatgtatattaaaaaaaatgcatgcatgtagtaccatgtagtagctggacttctccacgtttctccgtatttagacgtcactagttaaggcaaaatcaagaggcctctccaaatagattttacgaaagagaaagtgtaacaccctaaatattcagttaaagatcagtaaaatttccaacttttgcatcattctaggatcttgttgcttgagttatgtggaacttcaccttaaaacggaactataaataattaaataccaaaacctaccgaggaatgtaaatgaactaatttacaaatatcaaataaagcacagagaaatcaaacaccaatttttttctatataatccaattatgatgtaataaaagtccgggaatcaaataccaatttaattcgctaatcacaaggtcatacgttatacacaaacacaagcaatatattgacgaattataaaaggggagataattcaaatacaacaaatatagttcaattataatttaagaattcgatttcactctagtccaagcaaagggctaaaggaagatcaataaaaaaaatcaaattatttatacaactataatcagactacacattaacaaatccatattaaaccctaaatataagtctgattcccatacttgggcttaaaccatcacacgttaaaaggaactccaaatgggcctcaaggctcagctacttgagctcggcttgttgcaaactcgttttctgctgggctctcgactggaaatcgagccgaatgaaatccctcttcttcctacttgtaacgcttgcgagcttcaccgagccgagctcgaccaagctgggctaagttcgtgttgcggcttggcacatcccagccgtccgatcgagccacccctcccttacaaaaccccacccaggccactaggtttcgcctcttctacctcttctcccacctgcgccgccgccactcactcccaaaccctaaccccggaggagagggaggagcagccatggccgtgggcaagaacaagaggatctccaagggcaggaagggcagcaagaagaagacgtaagctgcttgcgcgcgggcggtgtgggcgccacacctctcgtcctctctgagctgcttgttcttgcttggggtttttgggggattctgatttgggacttcttctctttttctctctccgtgtgggtgcagcgtcgatcccttttccaagaaggattggtacgacatcaaggcgccgaccgtgttctccgtccgcaacatcggcaagaccctcgtctccaggacccaggggaccaaggttcgttcgttcgttccccattcgcgcccgtcaacctcaatccgcgatctgatccatgctttcattttgtatcactgtctgtgagtacatgtgcggaatctatctgtttggatctgcgtggctgcgtcattctatatctgagtaggctaagggattaatgttggcgttgatgtagttattgtgattgtgatgtcttgatgcatttttatgttttggctagaagtttgtttcgttaatgcaaatgtgggagttctggcaagatttcttctgtgctgtacttgttctactctcctagatttttatggctgatacatggaatgtttcatttcatttgatgaacactaatcatatatataagttcttgaggtgattgattcttgctgagatgtacttggagtaacctttttgctgcctttaatgtttgctgcctttaatgcgtcatacatcaaatgcttgatttcagtaacactatcatgtgttctcactaattagatattttagtctgatgtttaaatacccaagatatttctttgtgtaatcttcctaaggttatctgaattttttacagcactatgtctgttgctgattattattcatgaaattattttctagattgcatctgagggtctcaagcatcgtgtctttgaagtctccttggcggatcttcagaatgacgaggatcaggcttacaggaaggttagacttcgtgctgaggatgttcaggggaggaatgtcctcacgaatttctgggtaagaatgagcattgattgttcattaatccttttgtgttgtatctgtgatcccttttgtcctatgtagtctaaaccaatacatattttctctagggcatgagttttaccacggacaaacttaggtccttggtcaagaaatggcaaacattgattgaagcccatgtggatgttaagaccacagataactacatgctccgcctgttttgcattggtttcaccaagcgccgcccaaatcaggtgaagcgtacctgttacgctcaggctagccagatccggcaggtaaaagttttgtcatacttttttgcatgttctgtactaggtaagttcttgttttttgagatgaggtatgttcttgttgtttactttatttttgtccactgtttgaagatccgccggaagatggttgagatcatggccaaccaggcatcaacatgtgacttgaaagaactggtttcaaaattcatccctgaagtcattggaaaggagatcgagaagtcaacttcaagtatattccctctccaaaatgtgttcatccgcaaggtgaagatcttgaaggcaccgaagtttgatcttgggaagttgatggaggtgaggaaccttattctcatgcctagctagatgcctttagtgctcctggttattcttctgagaaatgtattagcatggttattggctttggaatcttattagaaaatctatctagtatatttgctatgtgttggaatcaactatgtttactaactcccctgctataacctggctgccctaaaatacttagttcaggattttgctttgacttgaatactaacttttagtgtaagatgttgcaataccgagttttaacaatatattttagggtttatgacattatgcatttagataatttttcctgataaaaaattcctaggcaattttgtgctcttaggcagccaatattagctcaaatcttatattagggcttgccttctgtaaatagtgctgtactgtagtgttgatttggaagcaagacttactcaagtattaggggggctaaatgacctggccggagttcttttttttactgtcacagaatgtagcaagtaaatttaaacatgatatggcgtccaagtacaaaacatgtttgttaacagcctcaaataacgttgaaggcagccaacacaaattggcctcagtatgctgcctcttgatgtcctcagtagtgccagatgttttttttccactcctagttcctgtgtgtacgtaactttactagccaaacacctgtgcttttctgtggattaaatctaattaatagtgaggtttttgggacaatttcattcctgtagatgttgttacagatgaaatatgataaaatcatggatagtttggatagttggtacaaaacatgatggagtaggtgggaaataaaaataatactgtacttggtggcaccattgcccttgtttaaaaggagtatagattctgagaaaatgtggtctttattggttttacaggtacacggtgactacaaggaagatgtcggtatgaagctggacaggcctgctgagactgacgaggcggtggcaggggaggttgcagcagctgagtagagatggtgttgctagttgctttaccttttaggagatttgggctgttactaaattatggatgatcaaaacttaatgtcagttccgatacccttttttgtctgccgagttggtttctctgattaaaaccatggaaaattgtgagactgatttcatggccagctcattttgaatgcagttgaatgattagtactatatgatagtataatactactggttagatcattgctatgcatttgatcatgatctgctcagcttgcgcattggcaatggtatacacctggtgaattacattctggaatgcggtggtttggaccatttttttgggcccgttggaaagctgggattcggatgggctgaaattaagatggtgcaataatctcggtaccgcgagatggactggcctgttgagttactgttcaagccaaccgtgagggtgacggcgtggatagctttcggtcgctcgttcgtgcattgctttctccacctgttcttgcggagtccctcatctttctcctccgaacactaaagcaaccgttggtcacggaggcgaatcgagatctgcatcggctcctgcttgtcctgagcggcgtgcaagcggtagaccatgcgctcgacgtcgatggctcattgggcaggagggttgccaggcacatacactccatcaaaaaaaaaaaaaaaactcaacctataacagaatgtgacccctcctagaataatgaacaatccccttctaggttaaatttttttagacggagggagtaggggagaagcacttagatcgaatattagcgcattggaggtggagaaaaaacgagaggcacagtcgcagcaagcatcggcgcggcgtcgattccaccgacagtgcatcagcctctccagcgcgcgtctgctgctctggtgagttctcgtgccgaatagggccggagattcacgtcccatccggcatccaaggaggcgccattgccaaaattggtggagagggggacttgaactcatagctatattaagccatcttgtggatccggccatggcatccaaaggcgtgaaacggaagcttcatctctagcactccaccaccgagcccttgatatcctctccacagttgccatttacttcggcaaaacggcgagaggtggctttagatctgaaatcctctcagggttcatccaagtctctgcaatccgacgccagctacactgccacagctgaagacgacatccaggccgtagcgcgagcactcatcatcatcgctgcaaagttccatgaagctatcttgcagctggtccgccgcctcactccggccagagttgcatcttcactcgattgggacttgctcgactcgtagcaccaagggcagtagtaatgcaaactacccatttgaagaacctaaaactgccacatagactaaagatactgtgtccaaattttggttccccacagtgcaaatggcctcatgggtgacttcgatttttcgttttagctcctaccacttttgattttagccctcatatttttctcaatttagaaagaagtacaaattttacaatgaacaccttacagtggaggaaataatacaaatctcaaccccacccaggcacccaccaccactgcacaatcctctccattttctccacccaccaaccttggcgagtttaccagcgatgccgctgcctccgtcctctcctcacctcggcgacgaactctgccgctggcggcctctccccactccccccacctcggcgacaaactccgccaccgcgggcctctctcctatccctatcggggcctctccactcccggacgccgctcaagcccactcgcacggggacgcggcggtggttgaggaagccgaggcggtggtggacccaccggcgaatcgacgacgacgaggtcggtggagccaagcagagggatgacgtataggggaataatcgggaaaattgagagtagtagcacgcgacatgggagaggggaccactcacagtttctttttgggcctgaggaaaccggatccttggtaggagatgcaaacctttgcaaagatacgggtcccaccaggccaccacctttttttttatccacgtcagagtttggcctagatggaaaacgataactcgccacgtaggtgcactgtaaaggccctaagaaaggtaaagcacaagttctagcttttattttcaacctacttgcttgcttgacttgggttgttagatggctggcggtcacacccattggacgtaggcggagctgaaagcattcctggatagctgcatggaagaaattgagggctgcatcatcacctccagctgccccaaagctcaaggatacatgaatctgcagaacaagatgtacgagaagggtcatgaacaagcagtagctgaagaacttatgggaccactgtcgccaccgtttccaaacatggacctagctggaatgaatggccaccgatctggggcaagatccctacactggctccatccaagtaaactctgaatggtgggagcagatggaagggttatgtatagtttaactttgcaatttttccattttgcgcatgccatgcaatttttcctaaagttcatgacactagagattacatgtagcaaatttgaaaacatagatgcttcacacaccaccatcagtggatcaatagagccatatagagtaggagctttaacaaacataggcctccagatgaatgacattacagaccagatgtagcatagttcaaaacataggcctctacatgcatgattcatacataggtctatagatgtatgatttactgtcatacatatatttggaatgttaatcctaaagtatttcgaatgacagattacttgttccatgcctagcgatatgtcaaactatatttatgattaattatgccatgttatcagcaatatgttcatatgttcattgtcatgcgtgtagtcttactgaatttaaaacaacctagtatgatatgttcatgccatgtgtacaccatatttgataattaaatttcaatatctttagaatacttctatatataccaagataattatgagctcaaagtatagattacaaaatttgacatttgtatctgaaaattacattgaaacttgtagcagaatttcatgcatatataggtttatagatatactctagatgccagtgtatcaaaactttatacataggtgtatagatgtatgattaactatcatacatatatttggaatgttgatcccaaagtacatgacattacagaccacttgttctatgcctagatatgtcaaactacatttatgattaattatgccatgttattaacaatatattatgttcatgccatgtgtacaccatatttgtcacaagtgtagtccttaatttaaaacagcctaatatgatctgttcatgccatgtgtacaccacatttgataattaaatatgtgtgttcttttaaatgcttgtgtatataccaagataattttgagctgaatgtatacatcacaaacctagacatttgtttctgaaaaacacaatgaaacttgtaagtgtgtagttcactcaaaaaaacacagaaaaatatgaacttttcatgccatgtgtagttcacaactgatattacatctgcagattgtgtgcaatgtttttgtacatagaatgataagtatgagctcaatgtatggattacaaaaaatgatatttttttctgcaaattaaattgaatgttgaatgttttctgatctgtctagggtactgaattaaagtttacatgttctgatctctctactatgatcttttcatgccatgtgtagatgacaagagcacatttaatttgaacatgtctgcaatgtttctgtatttatcatgataacaatgagcagcatgcataggttgcaaaataatccaaggcgatcagccatgacatgttgtaattaaaatctgacctgttagtgccatgtgttgaggattactgataattgaacttgcacatgtttgaattattctgtattaagcaagagatttaggagctgaagttattgtttgcaaagttggcatgtgttacatatctaaaacaatatttccagcaacaacgtgatcaaaccacataactgaattgtgtgttgtatttgcagcaaaactttaatttatcttagatgtaatgacaacaataaataaaacttatcttttaagtaccaacttgctgcatctacaatttatgaacgcatatttgtgcacttattttaactactcagttgtattgtggtagaaggtgatatgcttccgttttttttttcttaacttcaacacatggttgctgccatgtgtacactaactgcactacatgtattttcacttgctactgttatatactttgttataacaaatgtgtgcctatgtgtatttgattccagattctactgttttgaacatgcttacatgtttacatgtgctgccatttctatatcctgccatctgtacatgcatacaagtggttattttctgattaaaccaactatgtgctgtaatttgtgtagcttagaagaggagcgcgtgtattcagaaatgcaccgctcagattcaacgctgagcatcatgttgtttacagaggaagaactgtgctgctaaaccgctccggtgtgcctaggtccaagccggcacagtcacaggtgtcctaggaggctaagatcctcgatgttgaggacctcatgcagatggcactacttatgcatctccagagccttcttcaatgaggaggcgcggtaaaggaaaaaaggatcgtaacccctgtcagtgtctctagtggcagcggcaagcatatttgcggtgactccactggagatgctctgaataggttggctgacctaagggtgcagtccaatgagagcaaagaaagaagggaggaacagaggcaagccaaaagtgctagagcttgcatggagctactgaaggctgatggcatcaccaagaaggttcctctgtaccacatggcactgaagctgtttcgtgatgggtatttgcatgagttcttcattgatgattgcatcacaccaaaggaaggtgtgtacttcatccactcgcactaccaggtagaaactatgtttgctccaccaccaacatgctcaggtggtgctaatggatttggaggctggtttgatggtggaggtggatttgggcctagaggttatgatggtacggttggagcagatggtgcagcaatgttaaaatgttttaacatttcttaaggcagtgattatcgtactggtgccatgcgatctttgtcatgcatctctaattttccttgtgatgtccgttaaataacttgttcgatttctttcgagaaacgtgattgttctaggccttattaatttgagtgtttagtttaacaatttcggcaccattaatttgagctatcagttgcactgattgaataaattatgttgagacgaattttacttgacatgtgctaatattttaagtatttcgtacctcatttgttctttgtccgtattccatctttttctgaaattttctgtactgtcttataattttttcatcgtgactaagtttatagttgaacgataataaagttaaaacctattagcaccattcatacttgtaccttaaccatgtttattttgtcatataatgctatgggaacttgagcacttcgtctgaaagaacaaatgcttcaaaggatggatacttcagtgaagaggaagattgcattcttgatatgttggttgctagtttggaggcaaaattgcgtggtaaggccgcaaggcgggtcccgcaacaattcgagatggaatgaatgatggaaacaatgtccaatgcagctcagtgccaagctatatttcgaatgagggctgatcagattcatgctttgtttgggctactcactaatcggtataaccttcacggaacaattgagatataccctatggaagcacttggaatattcctatacaacatggcaggtggctattctaatcggtcgacaaataataggatggtccattcacgatctactgtgtcaaagtatttccatagagtgcttaatgttgtctatgcaattacaattgacataaataagcatgtagatcctaactttgctagagtggataaccgtgtcatgcaagatgaggccttccagccatttgctagtgcggcaggttcagtggatgggacacattcctgttattgtggcatttgatgattccattcaacacggaatcgtcaccatgtcaaatctaggaatgttcttgttgttattggatgggacaatcgtgtcatatttatagatgcgggataaccaggatctatgcacgactaaagggtgctcatagaagtagtacgaggctatccctacatatttccaaggtttccatggggttcgcaacacttttatttttttaatgaaacaagttaatgccatataggggtattaactgaatattttatttgtgcaagcaaatatctccttgtgggctcgggttatgccagttggtatggattcctacctccatacccgcatgttcgataccacttggatgattttgagggttcagaagcaacactaccgcatggaaaggaagagacttttaactacattcactcctttttgtgtaacacaatggaaagagctttggagttatcaagagttagtggagaattcttagagaaataccttactttcctgggcagaacgatcagacaaatatcacacactgtacgtttgctctccacaacttcaagcttgacagttcagacccgcatttcatgacacaaaacctgttatacaatgggtaccccaacatcccagaggctccacccctatgtgtttggtatgacgcacctaacagcgaggaagtgatgaatacaatccgtaaagccattgcagatgaagtgtataatggataggtggcaatgagtctgcaccttcaaaaataagtaacatatccatgagtgtcatggatatgtatcctatatgtatttgtgtgttgctacaagactctattctcgtctatgtataattatttgtgtgcacgtactaatgattaatcattttgtcttccctttaatcatctcaaatcaatttgtcttccctatgtgtttaactagaagatactccgcacgttgctgtggaaattagttgcattagaagaatgtttgcctaggcaacaaagcttgtagtaagttgattctatggaggaaaactctcatacaaagtaatacttgcgttagggcaaccatatcacatacaaagagccatgctgggtcatggtacatatgattgagcatagaaccataagcattaaactttatagttgagaagaaaaaaaaagctacatcatatcaaacatggataaatacgacaacagaaaagagtgaatccctggaaggaaacatataacttgtaagactaaggctagaaagaacatggtgaaatgtttaggcgtaggcgtctatctcaagaggacttgtatttacatgcctagcaatatgagatagagagaatccattatatgtcactgactttgtcatacgtctacgattaatttgccactgactttatcacgttctacaatatgctatcaacttttgcttaacttctacgatttaccatcgttgtccggttagtctccgttagtactgcacaaatttatcaaaatgaccaaaatacccctaggataaaaaccttcaaaatctggataagaattctgaaatgttagattttaagttttttttaccaaattttggatgttttgcaatcttgtgttcataatatgatattttgataattttatctaaattttagaagtttttgtcgtaggggtattttggtcatttggacaaaattgtacagtgctaacggaggctaactagacggtgatggtaaatcgtagaagttaaacaaaagttgatgacatattgtagaacgtgacaaagtcagtggtaaattgtagacatgtgacaaagtcagtggcatataatggattctctcgatgagataaaccatcttaaaaaaatctgataaaaaaagcacatgatcgaacaaagttcggaagatgtacatgtttctaccttcatagattagcatataagatatctccatgcctccatgctaggaatcttgcgctgcatgcatcacttgctccattgcaggtactagctctttagttccatgcatggctatactattttaccaagtgaagccatgaacacgattagacgaaaataacattagcactgccgtttaaggactgaggccaagaaatattttacccccaattttttttccatttatgcagcccataaccgatgtcacgtgctccctctttttggtgctattatgctctaccgcactctgtt
